United States Patent 8,067,671 (METHODS FOR GENETIC CONTROL OF PLANT PEST INFESTATION AND COMPOSITIONS THEREOF) - sequence listing, part 40

SEQ ID NO: 78590 - DNA, 1953 bp, Heterodera glycines
  Genomic contig location: Contig_ID=SeqID_14536; Location=1786..3738; Strand=-
  SCN-specific regions: Sequence locations=1-288,311-668,775-794,816 -1202,1255-1311,1333-1543,1565-1611,1633-1804,1826-1831,1870 -1883,1921-1953
atgattggcaaagtgccggatgaaaggcgaatcgctgccagcacatttttgaatttagacaaaacggaagggtaattaatgtacagccgtaaattagggctgctgtccccgactcttggggagaaaaattggagatgaaattcccggtcaaattttgtggtgccgggtcgttactcaaaaaccatcaaaatggattagcctaaaatgcaacaaattttatattcttgatttaacttgatagccttaaagttttttattatcctgcaaaattccaaaaaaaaatcgttaaattccaatttcttttcataaagccgagaaaaacgcgaacaaaaaatcttattgttgaaacaaaaaaccatcaaattgaaatttgttgacagaaaattattaataacttcgtacaaaatgaatcaaattttaaaactttgatgtcattcgatagttttaatgttttctatttttctgcaaaaattcaaaaaaccatgtttttttttggacatttttagtcataactttcttgaatcataacaaagcgtttgaaaattttgcaggttaatagaaaacattttcaatttttcgggagcccatttaaagacactctcatcgaattggggtgcaatcacgacatttgtaatttccccgcatcggctcggggaccaacccgagcgtaaaaataaaaaataaaattaatttaatgatttcaaaatttaatagtttccacacattttataagttaaaaattaagaaattaaatttcaaaaaaattatttaaaagtttgtcatcactattcattgcaaaaacaagtgaaaaatggcaaaaattgtgccaaatgaaagtgtttgaagaagaaatcggcactctcaaaaaagaattgggcaatggcattaataaattggcaatgcaaaaaaaggaggacaaaacgacgacaagcaaaacgaacgaaaacaaagacattttatctaaaaaaataatggcaaaaattaaggaatcaccaaaaaaagttacaacaaaaattaaagaaaaacgaaaagaagacaaaatggagcagaacattgaattaatggacaaaatgaatgttattgagggacaaatgggcgaattttgtgcaaaatttgccgaatttgaacaaatttgcgatgttaatttggaccaaacattgcccagattttgcagaaatgatcaaaagtctgcaaaaaaagccaaaaaaaagtaaataaattttattactttttaaataaaacaaatttaaatttcatgtaacgaaatgaatagtttatatgaaaaaaatgaaattttcaagtgtttttgtgtcttaatttttgctttaaaatttgttgaaattgtatttaagcccacaaaattatttttgaaaggattggctaagcaaattgaagcagtgaaaaatgatttggtgccagaattggaagtgctgatcaatgagaagaaattagaaaatgccggagtcaaatcgaccaaattgttatttgaattggccgattttcagctgaaaattgaaacgaaattgcgaaaatatgaagaaattgggcgagaaatctcccaaaatttggtccatctaaaacatggcagggccaaaaagaaagctttgacagatgcaatccaacagaatgccaatagcgcaaaaaagcacatggaaaacattggcaaaatgctcaaaaaaatcaaaaattccaacagcaaaaaaatgggagattcagcatcaaattaggaaaccaatttttagagtagggatatgatttttggggaccaaaaaccgaaatagataacaaacatatcagggatgttgatcatttcatgtttcgcgtttcgtattttaacagagtaaaagttttttgaaaaaattaatttatcccacgggcctaaaacccaaaatttaaaaaattgacataaaattgcaaactttgctcactttatagacaaaatttgttaataaa

SEQ ID NO: 78591 - DNA, 644 bp, Heterodera glycines
  Genomic contig location: Contig_ID=SeqID_14537; Location=723..1366; Strand=-
  SCN-specific regions: Sequence locations=1-582,604-644
atggaaagaacagcaggaggactatcccttgcatttgattgtcaggtaaaagcgtctctttttgttgtttttcctaagcaatgcctttttagtcggatgatgtttgtatacggcgattccgacgagcctttgaacatttgccaggaatttatgctcgatttgctttgcaaacaactgaaaatgctcctcgacaaggcccataaactttcgattgaacgacagttacaatttatttgattttctcattatgttttaccaaaaattcaactcttttagcagcccttctgtcggctttcctgagtttatgttcgcattcaggttttgccatttttggtatttcggtaaattcattttttataagaaaggcgccatccgttgctgatccgaaaactgattggatacatgcgggtattaattatttttgcttttgtttcttagttttttcgtttagctggttgaccttatgccagcgatgtttcgtgaagaagaacaaaaaattgatgattcagaagacattctgccgttgtcaagttcatcgtctctcaacatccaaaattcattggacgacttaatgaaattgaaaaagtagcaaaattaaaaatatttgggaaaatggcatagattaatatgctgacaaaaataaa

SEQ ID NO: 78592 - DNA, 1042 bp, Heterodera glycines
  Genomic contig location: Contig_ID=SeqID_14538; Location=558..1599; Strand=+
  SCN-specific regions: Sequence locations=1-160,190-444,466-574,596 -1042
  Gene Ontology: Mol. function=transaldolase activity; Cellular component=cytoplasm; Biological process=carbohydrate metabolism
atgggcagactttcctttgacaaagaaggctcaatagccaaagcattgagtctgatcaaactttacgaagaggagggcattgagaaggagcgcattctgatcaaactcagctcaacttgggagggcattgaggcagcgaagttggtgccattggaaattgaaatttttagtttaataattaaaatttaacatttccaagggttctcgaatcccaacacggcattcattgcaacatgactttgctgttcaacttttaccaagccgtcgcttgtgctcaagctaaagtcacgcttatttcgccttttgttggtctgtttgtacataattatgttgttttgataaatggcaaatttaggtcgtattttggattggttcgttaagaattccgacaaaaaagagttcgaccgaattactgaccccggtgtgcaaagtgtgaagcgcattttcaattattacaagaaattcggacacaaaacgcaagtgatggccgcctcatttcggaacacggaggaaataaaaggactggtcggatgcgatcttatgacgataaggtaaaagtggtgaagacgaccctaaaagttttaaaatttttatatttctattttgcctttcacggaattaggcattttcggttttagtgcattttaggagtctaaccatttaaagctttttaatacagtcaattttttttcttctaaatgaaatgctgggtttttatctatctctaattatttattacattcattctttttgcaaaaaacgaatttgattgaaaacaggtctaattaatttatcgtttgtcattgttttcttaagccccgctttgttgggtgaattagccaaagattctgaggcggttggaccgatgatgaccgtggaaaatgcaaagaaatgcgaattggagcagattgaggtggacgagaaaatattccgctggcagatgaacgaagacgcaatggcggacgaaaagctcgcggatggaattcgccgctttgccgtcgatgctattaaactcgaagagttgattcgatcgaacctttga

SEQ ID NO: 78593 - DNA, 1091 bp, Heterodera glycines
  Genomic contig location: Contig_ID=SeqID_14542; Location=259..1349; Strand=-
  SCN-specific regions: Sequence locations=1-90,113-758,828-1091
atggagcgggacaagcgcaagtacatgagcagccgcttctccatcaccgagcagggcgaattttcggtgagcccttttggggtcacgcagaaaaatttaaaattgaattaacattctttttatagagaaaattgttcataccttttttaggtgaacggtcagcggaatgggggggggggagaggcttcttaatcggaggaggggggagtttttgaaaaaaaatttaattcgtttaaatcaacaaattttctcagcggtgcctataagcaccgctgggccattttctttcttttttttaaagaaaagtgctccacaaaaaatgggttgaaaagcaaaaaaaaagcgaaaaaactcgtcgactacatggcaggaaaccttcgattttgaattttcaaaaatttccatttttcaaatttttcgagcaaaatgataggacgatgagtgagggtagtgcgacaaaatttaattaatagacaacattatgccattctgtgccaattttttgttttttcagtggcatttgcccaaaggccgctttgaccaccacggcaccgcggaggacatgctgcgctgtgtgcagctgaacctgcgacggcttgtcgaccgcatcccggacgcattgatgcaccgcggatgggtgttggacggtgaaaagggcaacttcctgcgacggttggctgctgttcggaccattgactcgttgaggtgtgccgattttttgaattttttgtttttctatgttttcaattggcacttacattttttaaaaaaagtaaaaaaaaaacaaaaaaaatcacaaaaatatataatattttctatatttaaatgagcattttgtagggatctgttgatgctctacgaggcagccatccgtcggcccgttttcctgccaatttggtggcaatcgttgtccgcaacacgctttgtaaatacattatttttaaacaaaaaaattggaacttagagtaaaaatagaaacatttttataatcaaattacatacaaaatttctaattctaagatttgaaaactttaagttgcggtaccaaaaaattgcgaaatgtacaaaatttcgctgacggcgtcattaaa

SEQ ID NO: 78594 - DNA, 169 bp, Heterodera glycines
  Genomic contig location: Contig_ID=SeqID_21; Location=523..691; Strand=+
  SCN-specific regions: Sequence locations=1-169
atgaaaaacggaccgaacgcaacattcactccattcaaatctgggcactcttttgtcgtgatcataaattcggtgcctaaagggaagggtaatacaataattttttttaattaacgaaatttttgaaattttgcaggccaataaagacacataaggttattgattggta

SEQ ID NO: 78595 - DNA, 2004 bp, Heterodera glycines
  Genomic contig location: Contig_ID=SeqID_21; Location=1418..3421; Strand=-
  SCN-specific regions: Sequence locations=1-279,301-334,374-411,433 -902,961-1023,1045-1123,1191-1200,1222-1504,1527-1810,1834-1954,1991 -2004
  Gene Ontology: Mol. function=peptidyl-prolyl cis-trans isomerase activity; Cellular component=histone deacetylase complex; Biological process=protein metabolism
atgtcaccacagtacactaaatggatggaatttaatgcatcgttggctcatccatcagacccagtcgtatttctggtaattttttcttttttcctttctctcttattttttattattatgtttaaggacattgaaagtgactcggcttcttgcggtaattttttgtttaattaatttcgaaaaaatgagtcgtggccagttcggcgcttaaaataaaatactaaatttttttggaaaaaagtataaaatttcaggacgtataattattgacctcatggttgctgctgtgccacagacgacggaaaatttcaaacaattgtgtgcaggagcattgtaatattttattaaaattttataaattaaatattatattcgaaattttcatgctattagaataaattacaaacctaccaagttttggaaactttctctcggagtttttacggtcacttctcgttcgctgttttacagattagaaaccggacaaaacctgggccccgcatgggttttgccggaactcccggttccggtttctttggccataccccgggaaccccggaaaaacggaagtccaagtccattttccaagttactttttcgttccttaccattttaaaattcctatctcgaatactggcaaaatgatcttaaattttctcagttttatggcattttggaatcgatagtttaaagtttcggtattcctatccaatcgtataattgactttttttgcattaaaaattatggtttttgtttttttgttgaaaaatggttttttaaaacttgaaattcttataaaaactcaattctgttttaggacattgcccgtcaatggcgcacaaattgaatacggataccgaggaaccaattttgaccggattgtaaaagtaaggcctcgtagattttaatttataaataaatgtttagaaaaatatattttaatatttatttaaatatttggttataaaccgaccctgactttttgatgaaattctaattttacatgtcaatttatgtttttctttatatttttttaaattattcttttttgccgtgaatgccaaaaattaaaattattttctccgacgtcgccgtccataatttcaatttttgcctttttcgatatttttttttgaaataataaatttttgattgaaaaaattattataataaaattaatttttataaacaaaaatcaagttttattcactaatgaatttcattcttttaggacaaatacataaagggcggaaaaattgaagaggtaaataaaacgaaaaaacaatttctttatggtaaaaatagtttcgataacaagaccctcttgtttaggatttttctcatagtgattgatcattgatcactgggcttttttttgctcttcggatttttttgccgatttaatttacttaaattttcggcgtcatagaaaacgggaaatttaaattggggtcggcggtgccattaggcgccacaaaggaaaacctagataatttttgtccgaatttattaagaaaacagtaaaattcaaaaaaaattacccaatttttcgggaaaaaaaattcgaatgattgattgtcgagaactttaaaatggttcatttaatgcaaaatatttttttttggtggtttttgattaatgccttgcgcgtaaaatggagcgtttattagtgatcaatgccttaaagccctataaaagcgttacagataacattttaagacaaattttttttgtcaaaattggaacaatctcacaattattattatatctattttttcaggttcttggctgcaaatcgctgtacggagattattttgcagatgaaaatttttcggtggcacacgatgcaccgggaattgtttcaatggtaatgaaatggaagtagaacgcctcgtaaatttccgaaaggattcgattattttacaacatgacaagtttttaaatcaccggttgatttttattttttaaaagaaaacaaaaaaaattttaccgctactaataaa

SEQ ID NO: 78596 - DNA, 614 bp, Heterodera glycines
  Genomic contig location: Contig_ID=SeqID_21; Location=6426..7039; Strand=-
  SCN-specific regions: Sequence locations=1-5,27-61,87-369,391-475,498- 539,580-591,613-614
atgaccagctcaatgacaactcaaaatgcaaaagttaaattaaggacaccaattcttttcgaatatttttattattattttgtgattcacactttaaatccaagccttgataataattttttcaggaaaagtcattcgaggcttcgaggtcttggagaagatttgccaagtgaaatttttgcgttaaaatttttcttgcgaaaaaacaaagagggttctgtcaatttgtttttcttaacacgtgtaggctgatcattagggaatccacttgaagaattttcttagcttcaacaaaaacatttatatattttaagatgtaccagcacgtttcaagactttctacaaaattgcttaaatacatatttcgcctatttttgtatatatttctaattttgaagaaactccctaacaaaaaatttgattggtttcatatgaattttcaaacaaattcttttttttaatttcagagaaatagtccaaaaaaggaaatttgaaattctcggccgaaaatcgatttttcttaattgtttcagtttcagtatatatttatttttaaatttcataattttcttatataaagtggaatcccatttgatcctttcctaaagaataaa

SEQ ID NO: 78597 - DNA, 169 bp, Heterodera glycines; identical to SEQ ID NO: 78594
  Genomic contig location: Contig_ID=SeqID_21; Location=7615..7783; Strand=+
  SCN-specific regions: Sequence locations=1-169

SEQ ID NO: 78598 - DNA, 224 bp, Heterodera glycines
  Genomic contig location: Contig_ID=SeqID_21; Location=8529..8752; Strand=-
  SCN-specific regions: Sequence locations=1-30,54-174,211-224
gtttcttggctgcaaatcgctgtacggagattattttgcagatgaaaatttttcggtggcacacgatgcaccgggaattgtttcaatggtaatgaaatggaagtagaacgcctcgtaaatttccgaaaggattcgattattttacaacatgacaagtttttaaatcaccggttgatttttattttttaaaagaaaacaaaaaaaattttaccgctactaataaa

SEQ ID NO: 78599 - DNA, 399 bp, Heterodera glycines
  Genomic contig location: Contig_ID=SeqID_22; Location=337..735; Strand=-
  SCN-specific regions: Sequence locations=1-279,301-334,374-399
atgtcaccacagtacactaaatggatggaatttaatgcatcgttggctcatccatcagacccagtcgtatttctggtaattttttcttttttcctttctctcttattttttattattatgtttaaggacattgaaagtgactcggtttcttgcggtaattttttgtttaattaatttcgaaaaaatgagtcgtggccagttcggcgcttaaaataaaatactaaatttttttggaaaaaagtataaaatttcaggacgtataattattgacctcatggttgctgctgtgccacagacgacggaaaatttcaaacaattgtgtgcaggagcattgtaatattttattaaaattttataaattaaatattatattcgaaattttcatgctattagaataaa

SEQ ID NO: 78600 - DNA, 804 bp, Heterodera glycines
  Genomic contig location: Contig_ID=SeqID_224; Location=1057..1860; Strand=+
  SCN-specific regions: Sequence locations=1-36,64-75,141-143,165 -437,461-519,564-646,717-804
atgaccatcaaagggacgggctgcgtcaactcgatgaattttgtcttttttctcttcatcttcatgactcaggtgatttttaaattttttaaaataaaatcttaaaaaattttcaaatgaaatttcaaatttttaatattggtttaatttcaggttttcattttttgggcaatcttgctgaacgtgccgtctcgcctgcgacgcattggagggctgcgtccgcgtcgtcgtccgccggtattcgatgatgtagacacccgtccgcttcgtccgcttcatcttctggttcgtgaggtgagccccccccccccctcatcctatcatccgattacacaatcattttcccttcagcgttcgtcggaccatcgattgtccgccgagaatgacggcaacgagcgccgcactggaggggtcagtgaatggaggagaaaaatgggattttttttaaaatttattttttgttgcaggactcaactggtacccgcaaccgtttgtctacgatccaggaggtgaaatgactttattattaatttacaaaatttatttttttttgtttttttaaagaaaaacgagaacgcctttgccagcggctgagatgtccatgaaaaagaatggaaaaaacggagggaataactttatataatcctttttgatggtgatggtgatgattttatcttatatatttttagtaatttatcatttaaaatatttaaatacatgggcaagctgaatggaggattttattttagagttatgtgcttaattaatttttacatagaagctggatttaaattatcagttaaa

SEQ ID NO: 78601 - DNA, 638 bp, Heterodera glycines
  Genomic contig location: Contig_ID=SeqID_225; Location=248..885; Strand=+
  SCN-specific regions: Sequence locations=1-91,114-206,228-406,455 -519,541-638
atgtcgactctaccaccgagacatcagagccattccgaagcttctgatttcttttcgccaattgcagcagctacaatggcgatggacgtggaacaaaagaaacccaacccaaagccgagacaacagcaaacagacgcctcaaatttctttggacctatttcagcggcaacaatgggaatgggtgcagaacagctaaagccaacgataaaacaacaacaaaatcaacagcaaaacggagttgcttctgagtttgcttcggccatttccgctgcaacaatgggtatgggcaacgaacaacgccaacatcagcctccgccccaaaaagagaaggaacagacggaccaagaaattttggatgagtttcttgagagcgtttcggctgcaacaaccctattggatgttccgcagaagaagccgaagaagaaaggaaagaaggaggtagaagatgaagaagccgcagcaatcgcatcgatcacccgtaaacaataaactatttaagtacttgtgatgcaattgattttttaaaaatatccagaatgtttggaaatcaattttatacagataaagagctaaaattaaaaatgccatttggtatgctcatttctgggccatcggggagtgggaaaagcactttttta

SEQ ID NO: 78602 - DNA, 563 bp, Heterodera glycines
  Genomic contig location: Contig_ID=SeqID_226; Location=42..604; Strand=+
  SCN-specific regions: Sequence locations=1-16,39-131,165-329,380 -444,466-563
atggcgatggacgtggaacaaaagaaacccaacccaaagccgagacaacagcaaacagacgcctcaaatttctttggacctatttcagcggcaacaatgggaatgggcgcagaacagctaaagccaacgataaaacaacaacaaaatcaacagcaaaagggagttgcttccgagtttgcttcggccaattccgctgcaacaatgggtatgggcaacgaacaacgccaacatcagcctccgacccaaaaagagaaggaacagacggaacaagaaattttggatgagtttcttgagagcgtttcggctgcaacaaccctattggatgttccggagaagaagccgaagaagaaaggaaagaaggaggtagaagatgaagaagccgcagcaatcgcatcgatcacccgtaaacaataaactatttaagtacttgtgatgcaattgattttttaaaaatatccagaatgtttggaaatcaattttatacagataaagagctaaaattaaaaatgccatttggtatgctcatttctgggccatcggggagtgggaaaagcactttttta

SEQ ID NO: 78603 - DNA, 2981 bp, Heterodera glycines
  Genomic contig location: Contig_ID=SeqID_226; Location=1545..4525; Strand=+
  SCN-specific regions: Sequence locations=1-95,117-337,361-486,510 -786,809-933,955-991,1037-1102,1124-1742,1764-1967,1989-2608,2630 -2719,2741-2981
atggcatcaaaatttgttcttgtgcctgatgaaatttatcgcggtctaacaaacagtgattcggaaaacatcaacttggattttgttcagcgtgctttggaaagaacaaaaagaaagggcgaaaatgtgacagcaaaaaatgtccattataaccaagaattgtcgcgttacctacacctgagagatgaagatcaaaataagccatcaaaagtagaaattaccaaaggtctaaatgcactgatcaaaagaggaaacgaaagtgatgaagaagaacaagtttttaatttggagtcagatagatcacaacagccagcttcacaaattagcagaccgcgtcgacatcatcatcatcataataatgacgatgaggaaatgccattgcagccagcttttccagcgcttcaagctgaaaataggggacaaaagcggaaagcaaatgatttttattcctcatgggaggagggcgcaaagagacaactgcgtcacgaagatgaaacggttccttcttcctctaaaattggtaatagacaaagaagaagacaaccgccactctcattgagaagagaacaacgacaaattcccgctgagattcagcaggaagaacccttccaaccagccccagaaccgtctattcccatccacccacaaattaacagaaaacgcaaagcccataatgctctaaatgatgttcgagaaataaaaaagagacttataggcttggaagaacttagacctccctctctccagcaagaagcatcccttcgctttcaacagaaaagaacaaacaaaccccgagtaaaccaaccccagcattcgagttcatcggccttggtaacaagaagaaatcctcagaggaatttactggccgaggcggcctttgctccattaccagataatgacgatggcgatgattttgaactctcacaaccaccagccaccgcagctcaggcccagcctctcccacctagaccttcattaccaagtaaaactaaaaagaggaaaagcaacaaagcggaagaagacacagaaagaaaaagaatcaaaattagctctcgaaaaagggacttgctggcagaagcagccgctgctccattacccgttaatgatgatggtgacgatgactttgagctctcacaacaaccgggaacctcggctcaggcccacccacctggacctccgttgcctagcaaaaccaaaaagcggaaaagcaacaaagatgaagaagataccgaaggaaaaagaaccagaattggttcccgaaagagattgtcgtcaccaactgtgaccaaaaatgagccaaaaagacaaaagagctctggaaacgaaggactatcagaagaacagcgtcgtcagtttgcggacgatcaacgccttttcaccatcccgaattcccaacttaccaatgagcaaaagagaagacggctccagttcgtatttaaccgaaacccggtaaagtatggtgtacgcggagacaccattttaaataatgcaggaaatccaataacggatagcagtgtgacacaagcacttgaatatattattgaacgcagagctggaagagttcctcagtttagacagccaccgggaacaaaaattattcaaaatcgaattaatcgagaccttattctacgaacatggacggccccaccggtaccaccgaggggagccaaacggaaattaccacagacagaccaagacgcggaattaaaccaaaaatcacaaaaaataagaggattggggcaggcgagaggcagagcacaggaaggattgatgcttccgtttccaacgaggggagtcaagcggaaaacaacggtcccaccagaagcagcaatggaaataccctcaaagacacaacgtctgagaccacagaaatggaaaaaccattaaaaattcaaaaactattagaccgtctatacaatgacccaaattcgcctgctgcattcgctggcgtaaaccgtttgtggttggaagccaaaaaggaacttgggtataaaatttctaaaaaggatgtgaaacactacttggagggacatcgcacatacacgttaatgcgtccaagacgtattaactttcctcgttctcggacaactgctgctggctttatgacagactgtcaggtggatttggcagactttcaagcactttctcgacataacagtggaaaccggtacttgatggtactaattgatgttctttctaagcaaatttttgtaacaccacttcgtacaaagaaggcagatgacatgattgaaggatttaagcaacttttttcacaaatgccaatgaaaccctaccgaattttttcagacaaagggactgagtttaaaaatcagcagctgaaaaagcttttcgacgaagaagaagtcgaaaaatatgagagtaatcactctgagaaaaaggcagcattagccgaacgtgccattcgacaaattaagaatcgagtctaccgctatttcgcccaactcaaaactcttaattggtttgatgtaatctacaaaattgttaatggaattaacaagtcaccgagtcgggtacatggcatgcgaccaattgatgtgaattttaaaaattctcaaaaagtttgggaaaaaatgtttggtgaagaacaacacagatcactttttggaaagcacagaaaaagaccaaaatttgttcccgaccagaatgtaagaatgagcatagcaaagggtcaattcgagaaaggatacatacctaactatggcgatgaaattctggaaatcgatgccgtcaaacgtcacatgaaaccaatgcgttataagttacgtgatgcaaaaggagaaaagtttaaaggattcttttatcctgaagaattaactcccgtacgtaaggaaactgatacgacttatagaattgaacgcgtttttcggaaacggaagcggactgacggaacgatggaagttttagtgaaatttatcggttatcctgaaagagaatggattcacgagacccaacttgtataa

SEQ ID NO: 78604 - DNA, 588 bp, Heterodera glycines
  Genomic contig location: Contig_ID=SeqID_227; Location=3791..4378; Strand=+
  SCN-specific regions: Sequence locations=1-8,30-588
atgtcaaattctactccttcttctcctccatcaaaacgttcgcggcgttttttcattgatgaattacttcgtgaaccatacaatgaactttcaaatccacgaaagtctccaaaagactacgtaaaaaagctcgactcggaaattgagcgtgtcccaaaatttcaatggttaaaaaacaaatcaaccttcatcattgaggatgtaccagcagaccccgaagggcttctaattggaatttttcaacattgcatggacgaagcaatgagcgaaagcgttttgggaggcattaaaccaactcatcttggttgcattgtctccagtcaacttcttacatccgacatttggataccaatccgtcagatcactcccgataccatcaataccattctcaaccgattcaatgacgttgcacagagcaaaaagcaggacggtgtaacgctttgggggcagccgtttaatgtcactgtgataactgttaaccggaagggtttgccagagaagcggcaactgaaaggaggagctccgagaaaattagcaccagtgaatcaccaaatccacgagcaatgtcttatcaaggtttttaagtaa

SEQ ID NO: 78605 - DNA, 1782 bp, Heterodera glycines
  Genomic contig location: Contig_ID=SeqID_228; Location=1143..2924; Strand=+
  SCN-specific regions: Sequence locations=1-20,44-236,288-1363,1395 -1782
atggatttcataacggagcgagtgccaaatgttgaaattttttggcaatgcgaaattgaggcgatgttggtcagagacaagcagatgaagaccaagttcagcgaatatacaggagatggaggaccaatagatatccgttcctgcttcatgggaggacggacgggagccttgaaactttaccatgaggcagcaaaacacgagcaaatcagttactatgacttcacaagtctctacccatatataaagtaattcaataataaataattaattaattaaaaagaaaattagttatgtaaccgattacccaattggccatccaactctccatgttccttgtgaggatgttgattggcggcgccctgaggataatccctacccgttggcaattctcaaagttttcgtcatcccacctcgccgaattgatgtccccgttttacctgtcaaagtcgatgatcgtctatgctttcctctgtgcatgaaatgttgcaaaaaattcccaaatggtgctgttaaagcggcatacagctgcacgcataacgaccgtgaacgagggtggattagcacgtgtacttcgctggaagtaagttgcttttttcgacagttctaataaataatttagctcaacgcagcattagaagaggggtaccgagtaacagagcttttgcgtgtacttgagtacagtaaaagcgacaatgaattattccgcccgtacatgagcgaatttgttgtccaaaagctgcacgcttcgggatttgatcagaacatccgtgggaatcttgaagccgaggagcaatttattgcagaatgttgtgaacaattcggaatgaaaattgatcgcaacaaaatgataccaaataagggaaagagagcccttgccaaattggcagtcaataatttgtgtatgttttttttaaatttttttcatctccttaatttagggggtcgtttttccctacgcaactatggactctcccaaacgctcattactgacgacccgtcggagttaggcaactacttggacaacaagaaaatcgatgtcacagggcttgacatgttgaccccggaccgaattttgatcagctaccaacagaaaaaagattgggttaaggaacacccttgctcgaatgttgtcgtctcactttttaccacttctgcagctcggcttcatttgttaaaagcaatgcaaaaggtcgttcgaacacccggctgtgtccttttatatacaggtaagaataaaatttctatccaaaatatttgcaattttagataccgattctttaatatatgctcacccaattggcaaaaaccctcttagtacagggccccatttgggtcagttcactgatgaattccccgacgttagtttaaaaatattaatttttctcttaaaaatatctttagcatgacatattggaatttgtgagcggcggctcaaagcaatatggattgaagctcaggcggaaagggactgaaaaaattgagcacatgctgaagctcagagggattacactcaattatgatgtcaccgaaaaccaagggcttcgatttgatacgttcaaagaaaaagttttacaatttgctcgtaccggaaatgttgagccaatcaaagcagtttacccaaatttcctccgtcctacagtaaacgctggcagcgttatctccgccccccttcaaaagatatacaaaccatatgttagtaaaggaattgtttgttctcgtgactttcgtgtgatcgattttggatatgttgcacagtaaaattgtattttaattaccgaacaa

SEQ ID NO: 78606 - DNA, 620 bp, Heterodera glycines
  Genomic contig location: Contig_ID=SeqID_228; Location=3031..3650; Strand=-
  SCN-specific regions: Sequence locations=1-620
atgcttcttactgagaaaatcgcccaaattttgaattgtcgtgtgtctgagctccgcgatcggcttaatcatccttcagattttaaacatgtcgttaaagcattgaagggatgtcacgtacaaacaacatacaaggatcggaacggtttcacaaagagctttctgtttggtggcataacaccgcaaggagcatcaacaactatggcctacgggcgattgggaagacccttcaatgtgaatgtgacagcgcatttttacgttcgccaccgcattaaacttcgacacccattcctgcactgtgtaatcgagagatttcccgagggtcaggaggatcgcttctacccgcttgagctatgcaaaattaatgctggacagattgaaccgggttggctgggacgtatttttactgaaaccggaagtgacaacaataacaacattaacacagacgaaaatgcaagcactgagacatcactaatatcaagcggacgccaagaatgtagccaaagcgacggttattctttatggtaggtaggtagttcaaatgtataaaacttatctactaatattcataaaattgtatcttctattcattaatttttcattttcccagccaaaattga

SEQ ID NO: 78607 - DNA, 494 bp, Heterodera glycines
  Genomic contig location: Contig_ID=SeqID_228; Location=3911..4404; Strand=+
  SCN-specific regions: Sequence locations=1-21,43-68,98-125,147 -270,293-406,442-494
atgccgactcctcctcatgacaacaaaatttacaaaaaatctgaatatttaaaaggtatttttgtctcattatttattaataatattcaaaaaattagtcgatgatgctgatgaagtggatacggacccctctcctgaagaagttgagaaatggacgcccgagcaagtgattgaatgggaccagcgtagttatgaaaaaatgcctgccgaggaagagatttggcaagaattcctcgacaaaggagaagcgaatgtcggtgatatttatccatttttatgtttaaattaaaactttaggttctgcgtgagttctttggcggagagggggctcttaaagttgagaaaagtcttcgcgaatatgccaagaagaaagaacagcgagatgaaattctgatgcgaaagcggaaagaatatgaagaaaaaatggaaaacaacaaaggcgaaaattaaacactcctttgtactgttattgttattgattcaaatttggatta

SEQ ID NO: 78608 - DNA, 1392 bp, Heterodera glycines
  Genomic contig location: Contig_ID=SeqID_228; Location=5447..6838; Strand=+
  SCN-specific regions: Sequence locations=1-195,232-446,478-660,682 -793,815-986,1008-1369
atgagcgattcgaccaacgatgccattcgtgaattacaacgagcactgcgtgaacaacagagaacaatttttgttttgcgcagtcaaatggttgatcaccgggcggtcattctacaaactgtcgcacgcacggaagccctggagggatacgcggctaacgtaaatttgaattcaaaatttcactagaatttaccctttttaattaataattaaaataattttctaaaaattgtttcagagccgaggagggagatttcgttcccgttattcacctatggtggcgcttgaaatgaccaccataggacggcggcttgaagagagacaacaacgtcgccatgcgcaagcccatgcatcgaccaattcatcatcaccagggcgcggtgagcccggcacatcctctggcgatggtgccaatggtgattttttgaattttcatacttttcttgaaatattgaatttaaaaaatatatattttaaggacaaggctcaaacgagccgagtgttggagctatagcagtcaactcgggtttgactgaaacttgtaattataaaaaaaaacccaaaaaaataaattatcatattttttcagtcccaccaaccccactcagctctcgtggacaaaacagtgctccattgcgtcagagtgcgtttaaaacaaattaagtgagagaaatctgtttaatttaattttcagataccgctggtgctggtcccagcacgggaattgcagatgggggcgctgaaagcggcggtaagaacatttttctttctttaagtcatcataatggaaatatattttaggtcagtggttcgggcccacgattgaaaaccacatgaaccgatcacgacttcgacttgtgcgcgaggaaatggcacaccgaacgatgcagcaacaggtggaacatcagcatcagcaattgcttgaacgggcggaaagagtgcgacaggccaatgttgaacaacagatggaggaagcagacgttctacaagaacagctgcagcagcaggacgaagaaaacgacgagaaccgcgacccagaaatggagcagcgacgactagttcaggtcgctcgacaggcagaatacgagcgacttgtccgcttgcaattgcgggaagctcgccgttttcacaacggagtcgcttcttcggttgtggtccctcctcccttgttttgggaggaggaatgcgtcatttgcaccaacgcccgtgcaaatttttataatcgtcagtgcgggcatgtttgcctttgcgcggagtgcgcagtcactgcggtaatccaaaaactcactgtctgtatgatgtgccgtgccccagttaacggcatatacccatatgttcgttaactgggacacgaaaataagtgttagcataattttaaaaatttggaaaaaa

SEQ ID NO: 78609 - DNA, 1624 bp, Heterodera glycines
  Genomic contig location: Contig_ID=SeqID_2227; Location=334..1957; Strand=-
  SCN-specific regions: Sequence locations=1-153,175-243,265-579,618 -851,887-983,1005-1060,1085-1159,1194-1296,1321-1373,1428-1574
atgtctattttggactttttgtactctatgcctaggcgcctattttgtgcctatttcgctatttttggtacatattttgatgattttcggaaaaatccttaacaaaaaaacgaaaaatatatccctaagattatgacccaaaaaaattaagacttttggtaaatttttaagtaatttttacttgcctatttttgtgcctatttaatgcatattttgcgtatttcgttgctcaagacaaccaaattaacattctttttattttaaggattattagaggccttaaatggattaagaaatattaaagttgacaattatttgattgaacttgaaaaggtgtcggaagaatatcaaaaacaatggaaacgctttgaaaacaaaaatttaaacgagaaagaacagaaggaaattgtgaagagaatgggagaagaaaatgcaaaactgtgggaattaatgaaagaaattggattgggtaaaatcctcaagctgtgtgggatttaggaatttctaaaaaaaaagtttacgttttctgttttccgtggcgccacttttgggcattttcaaataaaacgacatttggggattttaatgaaaaaataaaaaatattataaaaaattaagtactcagcctcaaactcgacaaaattatctgcttttgccatacttaattctattttgtgaaaaataacaatattttttaaatcaactctgtttccgggcaaccgtgaagagttagttagcagactttttttttgcgtttaatttatgtacagtaaacttttttgctaatttatttaaaacgccttttccaagggccaacgggatgtatcctaaatatattatggttacaatggaaaataaaaattatgctttatatatattttttaatctattagattgggcgtcaatgtgtgaggctggcaaggagttcttttcacagattttgaagaaatccaaatgtgccctcaatgacggatccatgcgaggaggcgaagctgaaagtgaagaagaagccgggcaagctgatcagccgatcagcagcccaaagtgattagaatcggcaccactgatcagagagcacttctaagggttgcatatgttttcgtgacaatttcaattattttgctgatttgtggagaacaccttttttagaaatgagttgattttaaaaattctcttttttatttgtaaagatagacgaataattttagctatttttagcaactttccaagatgagaatttagtataaaaaagtgaaaaaaattacaaaaatatctttactaaaaggcgttttcgagtatattaatttattttaattttatccaattttcgttaaaatccttacaacatttgccgatttttggttaaatttttagtaaatgttatttaaaaatttgtgaatttcttgaaaaaatatattatattcatagtactaacgtgggctggtaatttaagtcatgaaaatttccaaaagtcgacttaaaacaaaaaaaaaatcaccaaaaagtcatgaaaagtcataaaataccaaaaaatcacgacaaaaatgcaaaaaatcatgaaaattaggcaaaagtaaaaataataatcaatttttaaacaatttatagaatagtatttaataaa

SEQ ID NO: 78610 - DNA, 760 bp, Heterodera glycines
  Genomic contig location: Contig_ID=SeqID_2227; Location=2126..2885; Strand=-
  SCN-specific regions: Sequence locations=1-182,221-568,606-760
atgttggcacttcagcaagcacgggtcgtgccaacaccccgccagtggtcactttggactgccaaattcaattttaaatataactctaaacgggcgccggatttttccgatagaggacttttcgacagcaaaggacatttcgacagaaatattataaattttaggaggggacttttcgacagtaaaaagtaattaaatttcaaaaaggggggtgtaaaatcgtaaaattttatccaaaaagcaacaaaattaagccaaatcattattgagataaataatttttaaatcaaaaattctaaccaagaaaataaataaataaattttgaagatgaatttttgagaaaatttttgattcttcttatgggtgtatttttgaaattttaaaggccgtttcttaagggttattctttggaaatttttttaggtaaaaaacgtaaaaaccgtatccttccttagtaataatgatttagcaatacatattagtatgttaatttaaacggaatttagtgctatgctgtcgaaaagtccgggagccctataaaatagtttttcaatctaaaaaatgtgcaatttttcattaattattttattttttcatattttaagaaaattcagtaaaattcttttttgtgaagacacggttcattgtggaccagggcgaacttcagatgagctccgcaatggaggcgattaaagcttaaaaattcaaaggcaacgcctcagcttgatgtgaggcttaatgaagtcgcgggtaaataaa

SEQ ID NO: 78611 - DNA, 267 bp, Heterodera glycines
  Genomic contig location: Contig_ID=SeqID_2227; Location=3000..3266; Strand=-
  SCN-specific regions: Sequence locations=1-27,51-267
atgcatcattttcaattttggtcgaatctatttcccattttggtcttgatcacatcgattgtcgttctatcagcgaatgaagtggtcgaagatggcacaacggaagagcaagacatggccaaggcattggcattgagcaaaacgtactattggcgaaatatggtgttgaaatgggactgcaaaaaagagaaaatgataagtcctgaacaaattggatataaacaatcccatgaaaaatgttggagatttgcgaacattggaaaatga

SEQ ID NO: 78612 - DNA, 755 bp, Heterodera glycines
  Genomic contig location: Contig_ID=SeqID_2229; Location=1438..2192; Strand=+
  SCN-specific regions: Sequence locations=1-59,99-311,346-755
atgaaagcggcagccgtgccaaaggcggcagcggcggaaaatgctcagaagggaccgctgagtgcggaagtggtggcggaggaaaacaacttggacaccgaggcggtcgacgacgacttgggggtggaagcatcggacattgacgaattggcagaggacgaactgctcgaggacgacgccatggacagtaaggcggatgcatttttggacatgggagaggaggcggagatggacagctaaatggacaactaaggccaattggagtgacaaatggaataatacgggacaaatgacacaaatatcattttaattatagaattatagagaagataaaaatatattaaatcatcatttctgtgcttctaacttcgaaaaaacattgaaatttctagaaaaacacacctttaaattattagacaaaaatatttacactttatccttgaattcaagatgtccttgaaaaagagcattcgaaaaaaacattcaaaatttttgaatttataatttgattcatagacacacacaaaaagcgttaaaatttgactaattttggacaactctgttaagaaattgcttaaaatttcaaaattttccttggtggcacctatcgcaaggctatgtcctggtttgagggtagtggaaaatgttgttccgattcttaaacatattcataattttgaaattttatgggcataatgtcattattatttagtaattttaaagtttgaaagcaaaatttggtcattattgaacaa

SEQ ID NO: 78613 - DNA, 2060 bp, Heterodera glycines
  Genomic contig location: Contig_ID=SeqID_2230; Location=577..2636; Strand=+
  SCN-specific regions: Sequence locations=1-23,45-109,137-392,414 -416,438-604,636-888,925-1416,1456-1534,1557-1668,1690-1811,1833 -1850,1872-2028,2051-2060
atgaaaaacgcacgaaagttagtgaattgtaaaagtaaagcacaaaagaatgtttctgctcagattctctgtataaaagtgagagctttgaaaaaagaacttttttttcaaccaaaaatttaaaatttaaaagattttccattttcgaattctttgaataaaacagcaaattaattctcttttgaaatggatgattttgccgacaacaacaaattttgcgactatttgaacatcaccaccacaacaaaaagtgatgttgataatctgacgggaaaatttgctgcttttgaggcacagaaaaatttgtctgtttttgaatggcttttcagttcaatgactcatcaattaattgtcgctaattgcgcgtatcagttcaaagtggcgcaagttgcggtaaaaatgattttaaagatggcaaaattaaatttttaaaatttggcaatttaattaagtccaattggtacctcgacaatgttctcgtgttatatgacaagttgaattgcgtttcgccgcttctcgcttggattgtcttcccaaatattttcactccgatttccattctattaaatttgtctctaatttgggtcacatgtacaaaaatgtgaattttattatcataattaaatttaatttttgcttcaaggactaatcacaaagtgtgcaattggctgatcgcctttgattcgctgtgccaactttttgtggtcgctccgttcggcgtcaatgcgattggcgtcattttccaatacagtagcattgattaccgtttctgcctggccacccttatggcagccaccgtagcatcatacgcctctatcatggcaatgtatctgatctcagttgaacgcctgttgatcataatgtacccaatcaagtgagttcctcataaaatgtcaaatttaaatttattttccattttttcgaatgaattggaataaaaaatctacggttctttggtgttcaacagtttcggtggttttttgctcattttttggcattctgatgaatttgaaagtattcgatgtgtggacaattatcaacgtgccatatgagcggtatcctttgatctagggttgctccccgacccctcggggggcaaaatctcgggggccggggaccatcggggggcacatgtcgcgggtcggggaggaactaaattgtcgggggtcggcgaccccgatcgggtagtgatcaacaaatttttttaacgaaaaaaccaatttttattttaaatgctcgtaaattttcttttttttcactgtcaaccgaaatttttggtaaggagtctgggtggaggaggggggggggggcgtcagctccgatttttgaaggtatctcaacatcggatttgacgatgacccttttttttttttgcttttcaaaattggtttttgcggcgtgttttttccaaaagacttttggggagaaacaaaggggtccgtccggcggtgccggtaggtgccgccgggaaaaattttgaaaatttgaggcaatttgttaacagattatgtctaaaaaagtaccaaattttgaataattttttaagaaaaattaatacttttggtggccggaggtgcagatagtcgccgccggaaagtttttcagaatttttaatgaattttattaagaaatttttcaaaaattttcaatctttcacccttcctggttgaattaatttttaaatttttacaacgctcggggtccccggccacccgactaagtgtcggggggtcggggggggggggcaaaatgtcgggggtcggggagcaacccaactttgatcaatgtcaaattaatatcgcaataattattaatgactgaactacatttaccgcaaatttagttgcgtttactgtaacagtggactttatgctgacgtgctgaatacagttccatcttatgtaatccttttgatgtgcaccttaaattatgcggcaattttttgcctgattttatggcgtcatcaaacaaacaaaggatcaactcaaacaacgcaacaatcggctgcaaaatgttgccaattatccgattttaattttattttttatttccacatttaa

SEQ ID NO: 78614 - DNA, 305 bp, Heterodera glycines
  Genomic contig location: Contig_ID=SeqID_2231; Location=195..499; Strand=+
  SCN-specific regions: Sequence locations=1-105,127-168,190-231,253-305
atgactccaattctaacattgcatcaaattcacgcgtttcacactaaaacgcgagaaagaaacccccaaaaaggcgagaatgcgaaaaagcaagacgaaactgattttccgtctccacctagaaaaacaacaaaagtgagttcatttgaaaaatttttgagctcttttagttgatgaatttcatcaaaatttccagtaaccatgaaaaaaagagattatataccccaacgaagaaagtgacagaggtaaataaccgcacagaattaggggggtgggggctgagttagaggtcagtaaaattcata

SEQ ID NO: 78615 - DNA, 1629 bp, Heterodera glycines
  Genomic contig location: Contig_ID=SeqID_14544; Location=191..1819; Strand=-
  SCN-specific regions: Sequence locations=1-432,455-854,880-900,923 -923,1001-1112,1219-1243,1301-1452,1474-1629
ctgaggaaccgcccaccggcaacagttcaactgccaccaccgacccggtggcgatgatgttggcacggcggtgcgcgccgagtccaatgcgtacaccgccaacctccacttcttccggtgccgcagccaccgccataacaatagggacaccacagtgccctggtacaacaataacaacagctgaagaaggtttgtgacacggcacaatgccattgacagacaaatggggacattatgactgtaaaaactcaaaaataggctaaaattttttagaaaatggcaatttttcgccagtatttcaaagtaaaaagcgtaaaaaaccattcgttacaaatatccgcctattttaattgtggagccccgacatttgcgcctatgtccaaagtcggactcaaagttgaattttttttaagccctgatagcctaattagcattaaaattaagaaagcacagtcttttggttcattatgatcattaattctgttgtttgaaaattttattattttttcaagaattctttgaagatcaaataatcgtatacaattactttcaatcgcttattttaaagctgtttaggcgatcagggattgaaaaacttaatcttgaacccgattttggacaaaaacgcaaatgttggaccgcaaatgtcgggacacgttaattgttaagaaattggcccaaatttgagtgaaaatattaatctggataatttcaaaaatataaatgcccggttttcaatgccaaaaacgcaactctaccggcacatctatgccaatcgcttacaattagcaagaaactgggtttcatgggacgggggtggggacgagctaccctcggaaaatttagttttttcggatattttcaaaataaagatttttggggattaaaaaaatcctattgatttgtttgcagaaaatgatgatcaacaacagcagcaggcaacgacaacaagcagtgcatcctcaacaccatcagcagcacaacaacaacaacagcaacagacatcgttgaacaaaaagcatccggagatggacaacgcaaaacggcgactgttgctggacccgttcatccaccagagtttgtacacgccgaaacgaagcgtaagtgtggccaaagggaagaagggggagggaatagagagataaatgaaacacaaggaaaaagaatgggtgaggtggatagagtgacgagcgagagatatagagaaaagaaagagagcgtcctggaaaggccaataaagtaaagagagagatagggagacaaagacagagagagagagaaaggaagagagagagagagaatagaatgcaagaaggggtcgaagagatagagcgaggttgatccaggcctgctttagatgaaaaagcgaaaaatttttgaaaaaatagcttttggccgaaatctgtgaaaatgtcagtttttcctagcgctgctcgtcagtggtgcctaatttagaggaaaaattttcggtttcagattttcggtacccaagcgggcgcctactcccaggtggccgactccaacgaactgttgctggccgaacagagtgccaccgttgctgttgaagggctggtccgcacttcgtttgtggaatggtgtgccaaaacatggacaggtgtgcgcttttga

SEQ ID NO: 78616 - DNA, 924 bp, Heterodera glycines
  Genomic contig location: Contig_ID=SeqID_14547; Location=611..1534; Strand=-
  SCN-specific regions: Sequence locations=1-510,532-886,908-924
atggcggaggaaaccagcaaaaccagtgaaaacatcgctgaggacaacggcatcaaagcgctcgactctttgtttgccgccgtcgcccacgcctcaaaatgtttggcattcgctgccggcacgcccaacttctgcttggccacccccgccttcctggctgtcatggtacgacctttttcagtcaatttcatacttttaagggaggatggtcagtaataaaatggtgttttcgtaatttacaaacacttccgctccctcccccttttttgggttggcaaataaaatgccatcatttcgctgtggatttaggcgctaggatttctataaattgtaacctttgacacgtgcgcatcagaaattaaccccacaaactgcggtcaaatttatccttgcaaaaaatgttggcaaattcggcggttgcggccgaactttttttttgtcggttgagtaagccgaaaaatggaccaccttttttgttttggcctctgttcaaaccgaaagtaacgcaccaatttaaaaaatcaaataaatcttcggaatgaatttccccattttccccaaaaactctgtttttctatttttaggtttggtgctgtttcctcatgccggtaatggtcaaatggggagagggcatcatttgaattgagtcgaaatgcgttttgtttcagcctgtcgctgtgcttttccgaagctatcgccgcgacggcaacgcgttcactgtgcaggcggcgtacaacgtcattctgtggtgagggggcgggtgaggaggtcaactgcatctgagcaaagccataagttatatgaatttggtatctatcaaaagctatggtctttttgaaaaaaaacaattttctttctaacaataagcaatcgcaacccacaaaagggaaaattttaaatttattggatttgactaaaaataaa

SEQ ID NO: 78617 - DNA, 1755 bp, Heterodera glycines
  Genomic contig location: Contig_ID=SeqID_14550; Location=62..1816; Strand=+
  SCN-specific regions: Sequence locations=1-97,120-203,226-302,343 -507,529-1336,1368-1548,1584-1628,1650-1661,1704-1714,1738-1755
atgttagtggataaaggttaaaaaataaagaaaaatcaggagaatttatttgttttatttgggttttcgaattaaataggaaaaaaattttccagaaattctggaaattttcaatttttcagaaaaaattcaacactcgattctgaaaaggagttttcataaattaaaaaactaaaaaaccgcaatttttagcattaaaagagatattttattttatatttttatctcctagaaattttttcgaaaaataaaaaattccatttatccccccggggggataaatggagacgggggattattgttcaacctcctcagaaaggggggaataaatggagatcagattctttcgtccatggaaaattaggctgaatctttgttatttagccagcaaattattgtgtatcttgtgatttttttttcatttccggttagcttcttcctaaatgcctatgtttgttcaagcgtttcatggatttcttcgatgatttaatccctctaccttcagtggaacaaatttctaaattaattgacgacgcatctcattacaccaacgaaatgctttattcaatttttgccggttggattggcgcaaatgctgctgttaaggtgtttgaatgatgaagatgaaaacgattaccaacttattttttaaatattcgacaatgcctcattcattttttcatatatttagtcaaaaagtcgcgtggccatcgatcgttcgacaattggcccctttcaatgtgggcctggtctttgcactcgaatggccggcatttcgggcggaattgctgtcgcaatgaatgcgtacggcgcacactttggtgaattcaaaattaaaaaaaaacgctaaaaagaactttttgcgttttcagagagatggattaattctaatttgtgtttttttagttctcgccaatgccgacattaatgatgaacgaaaaagagccatgacttatgcgatcaaccatcacttcatcaactgcattggaatggcgttggccggcgtcggtgcccattatccgacgctgacctcgaggtctttacaaaaatctcattaacgatttttaagccgatcatttctattactaggtcgtatcataaaaaagggcccttatccaaaatgacttccattaagaccatattatctcttaaaaaaaaataatccgcagccaagcggattcgaaccccagaccctcgtctcatgacccctaagggccagtaattaaatttcaaaaaatcatataaaactttaaatttgtcttcttcataaatttaatagttcattcgaaagctctttttgagctctacaatatctgtgtatgagttttaacgcccgatttattttattaaaatttttgaaaaaaaatcaagtacttgatgaaaaacatagataaagtcaatgattttgcaaatctgagctcacattcgtaatcagcacattttttcaccctagaaaaaaccaataaaatttttgaattcatttttcgtcgggaccgccatttctaagggattaccggtctcctttggtttgtatcccccttttgggtcaaattttttcaaaaattttaaattattattttattgtcgcaattgctttttagattaatggaaaagcttaaagattttactcttgatgatttattcaaagttttggctctacaagacaaagaattcgaagaatggctcagagaacttaagcttctctacacaccactcgtttttgtgactgtggcaacgaaatgagctacaaatgaa

SEQ ID NO: 78618 - DNA, 2033 bp, Heterodera glycines
  Genomic contig location: Contig_ID=SeqID_14551; Location=904..2936; Strand=+
  SCN-specific regions: Sequence locations=1-370,399-459,491-563,585 -758,780-1140,1164-1997,2022-2033
  Gene Ontology: Mol. function=protein binding; Cellular component =nucleus; Biological process=regulation of transcription from Pol II promoter
gctttcagctgatttttgccggtgaatataccaaagcgatgaacaaagactggcacggtgaccacttctgttgttggcaatgcgacagccaactgacaggccaacggtacattctgcgagacgaccacccgtactgtatcaaatgctacgaagagatattcgccaatgtgtgcgacgagtgccaaaaacacattggcatcgattccaaagtgaatctgctcacactttgtttagggggtccagcggttggtctttcctttcgtgtgacacccccacccccgagagtttttattatttattacagtcatcaaaaaatgagaaaagtcacgatgacattattttgctcttttgcagaaaaatccttttatgggttttaggcaaaaagggaattttaaaaaggagaggcccgacaaacgcctgcgtgtaaatattaacaattttacaaaccccacactatactttaaaaaaattgtttttttttttaatttttcgaaagatacggagaccggtaaccccaaaacacagccgccgaaaaaaaagttttctttaaaaattctatgagaaaaaaatttttcaagaaattttcggcgatttttttttgaaaattttttcttatagaattttcaaagaaaaatttttctaagatttttttcttgaaaaattctgtttgaaatttttttttaatttattcccggctgtgtttcggcggctgtgttttgtcctgttccatacggagacggacgttccctaaccacattttaaatagattattttctcaaatatttagaggagcggaggggggggggagggatatgtacctcatttgccaactcaaaaatgcagttatttgtaaaaaccaaagttttaacattctaaggatctgtcctacaaagacaaacattggcacgaagactgtttcctctgctcaatgtgcaaagtttcacttgtggacaaaccatttggcagcaaaaatgagcggatcttttgctcaaattgttatgaccaagcatttgccacgcgatgcgacggatgcggggaaatattcaaagcaggtgacaactgatgaaatggccggaagatattcccaatgttttgataaaactgacaatgagaaagaagccccttttccacagggatgaagaaaatggagtacaaagggaagcaatggcacgacaaatgcttctgttgtgcccactgcaaaacgcccattggcacacggagtttcatccccaaaaacgaggaggtgtactgtgccccctgttatgaggagaaatttgccactcgctgttgcaaatgtaaaaaggtgcctttttgtgtggcctttgggcggggggaaggggaaaggcacttgtgaaacatcaattaattatataaaatccaccaaattaatgtctcgttacaaatcgttactttatcttgccaacaattccttgtctctctctccaagaattaacccgtaaaatgaatgaatgaccaatgattgcgtggcgttccaatggctgtgcctttaaggtgataagcaccggcggagtcacttacaaaaatgagccgtggcatcgtgagtgcttttgctgtaccaattgcaacacctccttggccggccagcggtttacttccaaagaggagaagccgtactgtgcggattgctacggcgaattgttcgccaagcgatgttccgcctgtgtaaagcccatcaccggtaaatgaatgggatgattcgccttagttgacaattttctgttctctccaggaattggtggagcaaaattcatctcatttgaagaccgacattggcataatgactggtgaatttagaatttttttggttttaaaatcggtcagcttatggtgtttgaagaaatcattgcttttagcttcgtatgcagccaatgcaccgccagtttggtgggcaaaggattcatcacagatggggcggacattctttgtgcggaatgtgcaaaagcaaggcttatggcggcgagcagctgaatatccatctccggagacacttttattttgccccacccccatca

SEQ ID NO: 78619 - DNA, 895 bp, Heterodera glycines
  Genomic contig location: Contig_ID=SeqID_14553; Location=205..1099; Strand=+
  SCN-specific regions: Sequence locations=1-296,381-436,463-895
atgtttttgcatttttcagtgaatgctgctgaagcaaatgaactgcttgaagatgacgatgatagggctgcaacttcatcttctgcgccatcactaccaaaggcaacagcaacaacaacatcattagtgaagccatatacaacatcggacccatttggcagccgcagaccaccaatttcatcaaccataaagtcattgttggcaaaatttgagccgtcagcagcaaagccaaccgacccatcattcgccagtgccaaaccaaatggacttggaacgaaggtaaatttttttgagagatatttttaatatgaaattcaaaaaatgaaaatgtttttcaaaattttatgataaatttctaagtttgtttttttattttttttcgggttatacgccctgttccctgcttcttttttcggcatccaaaatgaaggaaatcagggaaacttttttcaaattttctccccaaagttcactgttttttctcaatgccatcattgttgaaggcttccataaaaccggacccatcattcgtcggtgatgcttccgccgtgccattctcatcctcggccgtatcaccgacaattagcggtgccaccaccaccggcacggattcctccgccacggccgttggtgttgaacaacaaccagtgcatgctgacgatggtgatggacggcttggtgatgaagaggttgatgaagttgcagaggaggtccggcttgagttggagcaggacgcgctggtggtgttcacggacatttgttgctgggacttgcacatgcgcttcttcctggacaaggagggcaaattcaccagccgcaagtgctgcaaccgatcggagtgagtttgagttgttgtttattgtacatttggttttttattggtaacgaaaaaata

SEQ ID NO: 78620 - DNA, 994 bp, Heterodera glycines
  Genomic contig location: Contig_ID=SeqID_14553; Location=1854..2847; Strand=+
  SCN-specific regions: Sequence locations=1-51,75-303,370-603,630 -717,783-994
atggcgattggacgtgggggcgacgctggcagccattcgggaattggtgcggaacaacaacaacagcagcaggtgttacattgttgcttggcagtttaatgagggctgttgagcccgaaaatttggaaaaaaataatgaaaatttcaacaacaaaaaaactgatggaaaacgccgcgggcgacgaaacgacttgggtgggaggggtgaaatgggggtgcactacgtttcccactcccccttccggttcagttccctgtatcaattccctccctctctcatagcgtccctccccccccccctcgaaaaatttttaaaaaatttcaaatttgtattttctttttaaaccctaaatttttataaaaatttttcaagcacttttgaataaaaaatttttagagacttagtaattcattataaaagttagataatcaaagaaaaaaaaattattgcggcaaacaatattgggagggggaatgaactgcttcagtgaaatggacccatttcaatattaaaaaaattagtcctttcgatggcggccaatttttccgcttttatctcccaacaatttcagcgagttcaacgcggcgatgaacaggttgaacaagttgtgcagcaacaaaaaacgcctgttgttgttgtcgattcgcgcgtgtcgccggtgcagcggaaaccaagccgtacggtgtttaatgagtccaacgaaattgtggacaatgagcagcagcagccatacccgtggcaacaacgacggcaaaacgccaacagcagcagcagttgcagcgacgtgcgcgactcggtctcattgtcagccggtgacaacgaggccgacgacgattttggcgaggatgacgttgatcacacggtcgaggtgtgcggggcgatgttatggatgggaccgagcggatattattggcattttatgttgtgtgccaatcattgggttcggaatggcacctcgaccgttggacaactttaatttttatatgaaaatta

SEQ ID NO: 78621 - DNA, 2742 bp, Heterodera glycines
  Genomic contig location: Contig_ID=SeqID_14554; Location=51..2792; Strand=+
  SCN-specific regions: Sequence locations=1-39,165-288,322-518,576 -595,617-1422,1444-2263,2285-2494,2612-2742
  Gene Ontology: Cellular component=small nuclear ribonucleoprotein complex; Biological process=35S primary transcript processing
attactgccgaaattgaccaaaatgatggaccacttgttgaagagaagaaaaataaaaaaaacgatgaaaaggaagaaaaaagaagagaaacaaaggatgaggaagtaagtgagaagagcagcgacagagaggaggaagaacaggaagaggggggcggagaggacgaactcttttcagaggatgaacgaattgacgaagttggggaagatcaagacgtcgcagagggagggacaaaggcgacactcaaagggacgggaaatgacaacggcactctaatgcgagaccaaagtgatgatgatgaggaggaggaagagggcgaaattgtggaggaaggggcggaggatgccaatgagtggtgagtgataaatagaatagtacaaaatggacgattatattgaaacaccagtcataggtccattagaataacaaaaaatgaaattaagcaacggtaaaatcgcaaaacgccgagtggatgaagagcacgatgacgaagaaattgatggcgcgagtgacgaacaggaagaggatgaaatggaagacaatgttgatgaaaaggaggagggagaagagagcgggtttctatttcttttatacatgcaaatttaaataataaaaggcattttccatttgcagttacgaggaagacattgaggacccaaaagtggtgcagcaaaaacgcgggaaattgccaaagtcagccgtggacgacaaattcttcaatttggctgaaatgaatgcatttttggactccgaagacaaaaaagaggaggataaaatgcgacagcgaagtgtcagaaatttgggacaaatcgaaaacgctgaagaggttggtgatagtggtttaatgaatttgttgatttgccctgcatggattaattcatatctctgcagttgttcaaatttccagcgtctttaatccaagtatttagttggagcaactaatcagtgcacatgagcagtccaacttgcagccgcgtgagtgggcgctgtcaggtgaagcaaaggcggaagaacggccgaaggacgcgctgttggagcagtatgtggacgcggactaccgaatggccgcaccaccgacaattgacgcagaaaagatggcacagcttgagggaatcatcaccaaacggatcaaagacggggtaaaaagggacattttagcagagtaatttcttgcccaaaatcaaaaaattgtttcagtttttttttctttcaaaaatacgtctctttcaaaagtgaatgcgtcttttttaccttttcagttgtttgacgacgtcgttcgcaaagtgcgcgtcaacgaatcgcttcagcccgcagcgccctatcgaaacgctactgttaatggcacaacggagcaaaaagtgcgcaagtcattggcggaggtgtacggcgacaaattatctgctgggctaaacgacgaacacgaacttggaggagaggggaaaaaggcaaacgtttaaattttcaaaaacgctttgatgaatgaaaaatttgaaaaaattgcacacgttaattaatcatattaaaagttatcatttctttaggaagaggaacagtccaaattggacccggcggttgaagagatcaaaagcgacttggacactctttttctgaagttggacgcgctcagtcattttcaatttcgaccccagccaatccaagaggaagtgaaaattgtcaataacatgccgagcttgcacttggaggtccctttttcattttttaaagagcaactttatgggcctgagaagggtagcgaaatcgggagtaccttttcaacaagcagcatttgatccttccgattagtgtttatctgaagaaattgggtatacttttcccggcatgaaccaataactcttcagcttacaattagtgcaagtcatttaaaatcctattaaaggaagttggaccccaagcagcggttggaccagaggtgaatttgttggcaccggaggaagtgaagcgacgcgtgaaaagtgcgccgaaagggacagatgaacgaacggagacggaccgaaagcggcagagacggcagaagaagaagaagcaacggtgagtgaatttggaggaacgtttgtgcaaggaaagtcattcggaacgtgtccagacatttgcacttgtctaaaatcgggttcaaatctgagtttttcaattcctaatgtgcaaatgtctggggtgaaaaagcccgaggcgcaaatgtggggtaaccattcggaaaagccttcaaacgcaatagaataagaaatgtttaaaaacttaaaagtgaaagtttccaaatcatttttgccttttcttacaaggcaaccgcaatacaatacagccgttccttaatgctttttttagcattttggcctccatcggcgcaatgaatggtgaagggaccgacggcggagaaacggcggaacgggtgaaaacgaagaaaaaagttcgacgggtgaaaatggattttgctgagcaaattaacaaattggtacaaaatgaaggcgaacaacagttgaagaaaaagaagaagcgaaaaatagtggaggaaaacggcgaggaaaagaagtcgaaaaagatgaagaagaagaagagcaaagttggaggagaaaaggaatgaaagagagagaaggacggacaaaggaaagaccagcggatttgcccattgtctcgttgtttcttgttgatcttattttttgagtttattcttaatttttgtttgacctgttcattgatctgatgtttatttttacaattttataaaa

SEQ ID NO: 78622 - DNA, 1265 bp, Heterodera glycines
  misc_feature (14)..(15): n is a, c, g, or t
  Genomic contig location: Contig_ID=SeqID_14556; Location=63..1327; Strand=+
  SCN-specific regions: Sequence locations=1-15,37-560,582-1051,1073 -1118,1140-1265
atggatgcagtcanncagcagcagcagcagctgcccgaactgttgaagcacgtgccggtgttggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggaacagtttgacgacgacacctgtggaccagcgacagcacaacaacaacaacaacaaatgccgccggatggattgaacccgcggcggctgcgcttcttctgcgacggcgagccgggcaccggacgtggcgcaatggcccaatttgtggactttttgctccacaccggccccaaagggacgcgcaccgtgatgttggcgcacaacggggtaagagcagcgagggggtgggggtggcaaccgattagtagtgaaaaaataacattttttcagggtcgttatgacgttcacctgttgctggaggagttgcagcggcggggcgagcggccgaagaaggcggtccagcacgggctgcgcgtctacatgctggagctgcgcgggactcaccagcgccagctgatctgcaaagactcgctgaacttcttccacgcagcgctcgccaccctgccacgcacctttgggctgcacggggtgctggacaagccgttttcccataccatcacattcgggagcagaatctggatgttgaactgccggccggcactctaccaccaccagcggcctacgacccggaccggatgcgtgccgcgcagcgtgacgacttcatggcctggtacgagcgcgagctgcaccggcccggacggcaaccgtttgtgctccgccgtgagctgttgcgctactgctggaacggttagttgttgttgttgtcgctgtcggggagtgctgaagtggtggaaaaaaatgccgagcatacagatgtccgtatcctgcgtgccgcctgccttcgcttccgggagttggtgggcgagtgtgcggacggcatggagcccttcctggccgccacgaccattgccagcctgtccatggcggtgttccgccaacaccatctgcgcccgcacacaatggtccacacgccggagggcggcttcctgcgcgggcgtcgcgcgtcggccgagtcgcgccgcttcttcgccctgctcgccgccatgcgtcctgacttgggcccgttgcgcaccgcccgctggtcagtcggagagatggtgatggacaacagcagctag

SEQ ID NO: 78623 - DNA, 504 bp, Heterodera glycines
  Genomic contig location: Contig_ID=SeqID_14557; Location=1254..1757; Strand=-
  SCN-specific regions: Sequence locations=1-54,80-504
atggcaaccgatattaaaactattttacttcgactgtcttcaattgaaacgttattatcaaacaacaacaacaacactttggcaacgcaaatggcagaacaattcaacgccattgctgaacgcctcaacgaaattgagcgcaaaatcaacagcaacaataacgacaattccagtgcggaggaaaaagaacgcaaacgaagcctcgttttgattggcctgccggaggctgtggctgaaaagccgtcagaacgcgccaaagaggacgcggaaacagttgcggaagtgttggacgctttggatgtggaggtttgcccgcagatggtgtatagaatggggcggcggattgatgagaagcgaaatgggcaaagttgtcttgccagcgacgacgttccaacgttttgcattggcacaatgggggcgcaaccggacggaactgaagcagcatgttggttggcagcgacttctcgtcaggccctctctgacgaaagaagaattggcggctga

SEQ ID NO: 78624 - DNA, 1536 bp, Heterodera glycines
  Genomic contig location: Contig_ID=SeqID_14557; Location=2834..4369; Strand=+
  SCN-specific regions: Sequence locations=1-12,47-349,378-1131,1154 -1296,1318-1536
atgaatcgacggtaaggaaatttttgaaaaattaaaatttttgtctacccaatttttttccttgtttcagttggatttgtggcgacgtttggatggacattctgccatcttttgaccgtccccaactcggactcaaaatggcactgatttccgaccgtttcgactttttagtggacaaacattttgatggaaaaacggaattgacaatttggagaagaatcaaaattgtaaaggacgaaggaccaaaagcgaaactgtctgtggcgatcgatggcaaatttgtgggatttccatttcctgaccatccgttgcccaacaaaatccgttttaagaaccttcagatttagtaaatcaaaaaatatacagaaaaccaatcttcattttttcactttatcagctacattgaccattctgtgctcgcatttctccgttccaacaagcaaatttgggacagaagtggcaccaaattggaagtgtttgtgccgttatatatgaccgacgtcaagctcatttgggatgtttttacccgcgaaatttggccactttttgcgagaaacattcggcatttgagctttcataatgccgatgctttggacaattggcgtcgtcgcacttcgccaacatttctcactgatcttgatgaattggtttctatcgattctgttggtctgttccccgatggaattgctgacgacgggccaaatgcaactgctggccaagctttggccaaatggcttcacacgccgagcaaaaatggccaaccaaagcgattgcatcgcaataatttgttgggtccactgaatctcgaatggctcaacaacttcaaagaggtgtgtctagccatattttctataaattgttttttccaattttttgtttagacatttcgccgtgccaccacttctgtcagttacaatattcaattttatcttcgtgtggaaccaatgccaactgctggccaaaaataatggccataactagggcgggaaccgcccaactcgccgcggggccaactcgccgcggccaactcgccgcggccaactcgccacgccttgttttttggctatctcgccgccagatttttcgttaaaaaaatgcattaaaagcaaaaattctttaacagttaattgtattcaatgtgttatatttcagcaaagtttctctccaatttaatatgcttcaaattgaaagttaacgcaggaaggaaaaattgcagaacgatatattcctctgtattttccacaaatttaaagagcaatcatgtcggtcattggtcccgaatttttttttttctgggaattctttaacaagtttctttgggtattttgaggcgctgagcactagagaccggcgcgggacgggatcccgcgcgggattttgcgggatccccttcgcgcttcccccttgttttttttcttcgccgttcactcaacccgcgccatcccgtccctgaggaagtgtagtgtaccagacctctgcaggggcatccgcaccatgacaattgccagatttcgactgaggactccattacattta

SEQ ID NO: 78625 - DNA, 785 bp, Heterodera glycines
  misc_feature (88)..(88): n is a, c, g, or t
  Genomic contig location: Contig_ID=SeqID_2233; Location=32..816; Strand=+
  SCN-specific regions: Sequence locations=1-25,48-112,134-398,421 -729,778-785
atggatgaattgaacatttttgctgaaaattatgacaaaaaattaatgattgacaagcaacaatcattaaaggaactgttggcaattntaatgaaaatctacgcggactatagcaatgccagcaaaagagaaataagcaaaaatgccattcggttgacacattctgggaatgtaactttacgatttggacaaattttatatgaaacgatagagaatttggaaaatttgccggaagaccgcgtgaagtacgatgaaaatgaacaattgctaaccattccattattatttgtcaatcatttgcttgagcgactcaatgaattcattgaaaggtttgtaaattagcctatggcgttttttgccacatttggtcaacattttctgctggcggttaaaaatggtttaattaattataatataaatgggaaacatagaatttttaattactttttttaagaaacttgaaagaaaatagtaaaatcagtgatgactttgatttcgtgctaacacttcaaacagttgccgaagagagcacggaattagaggcggagaaacggcaaaagccaatttcggctggagttaatgtgaacttgttccaattgcttttctcattagcaattcgtttgtgcttactaattgacgaaaaagaaaaattggcagaaaaatatttgccaaaattcgtattcgcattgaaaatgtgcacaacaaacactgggtaaaaaggcgtgtttcattttttattcattaagaatttaatctaatatataatatatatttatacaaggaaa

SEQ ID NO: 78626 - DNA, 1268 bp, Heterodera glycines
  Genomic contig location: Contig_ID=SeqID_2233; Location=991..2258; Strand=+
  SCN-specific regions: Sequence locations=1-29,67-134,188-258,287 -348,399-644,666-868,890-1050,1091-1206,1238-1268
atggataaagctgaaagtaaatttgaaagtatttaataaatagttcattaatattattttttaatagacaaagagattgtgaaaaaattgagtgaattaatggaattgatcaaactgaaaagggtagagaaaggtaataatcttaaatttaataaaaaattttaaataatattgtttttttttaatagtgaaaggactcaaagaaaaatttgttgaattattggaaaaagatgaaggtaattttgaataaaagtcaacaattttttaaagtattatttttataatagtggaaaagctcatggaaaagctgctggaattgaaaaaattgcaagtggaaaaagccatgggtaattttaaattattattattatttaattaattaattttataaattatttctctaatagtcgaagagctcttaaaagaattgaagaatgtttataaagtataaaaatgtgaagagaaaggaaaacatcaaggccggaagaaaagcagaaaaaaggaacaaaaacaaaaaagaattttctcccattatccaacatttcttttttcactttatctaaaacgatgtaaaaaattttgcgcatttatttttgaaccaaattcttcgtattgttattaggctggacacaaattcgacaaattcattatgtccatgattttcatgcgtatacaaatttatttcagttctttatccatcaaaaaaaacttcggttcccaaaaactttcatttcgcctactaagccaaaaaggtaagctcgaacttgagcccgtaggaaatcaagattttcgtgagagaatatatgaaaaactccgctctttttgtagatagacctgaatgtttgaaagacaaatttaaaatagggagaaaaattttcacaatttttcctcacatgaaaagccgggatttccggcggagatgggagtgagtaaatcttcccagaatttctagtgctcttgcatgcccataactggctacttattattacattttttagcgatgcgatttagagccttaatttttgcccttttaatacgcctaatcctgattttagaaattttcctttaaaattttaagtaatttttgtgtgtatgcttactgatttacccttatttgttaggcagaaaaatgttaaatgattttttgctagaaaaacatgaaatttcttaaattttttaaaaatcatacaaatattttttgagtaaaaagtctcagtttttacaaaattattcaaaacataattaaaacgctcaaatgttaaataaga

SEQ ID NO: 78627 - DNA, 1367 bp, Heterodera glycines
  Genomic contig location: Contig_ID=SeqID_2234; Location=25..1391; Strand=+
  SCN-specific regions: Sequence locations=1-19,73-241,286-334,356 -765,787-947,989-1015,1039-1069,1097-1135,1162-1367
atgatcagtttgacggaggtttaaaatctaaaaaatataaatataataataaaaaatttttgtatttttttagctttctctcactgatcaatcaaatcaagaaagacttaaaaatgcccatgtgaaaccaaatgaaatagacgaaaagggaacgaaaaatcataaaggaaaaaaaaaaggtatgatatttttggcacttttaaaattcaattaacgaaagaaaagagtcggcaccagtttgaaaattataaaaaatagaaaattaaattaaatttaaaaaatttagcggtaaaaatatattccaaggaagaaaaactacaattgcttaagaaattccaaaaaagaaagaaggaattcaaaatggatgaccaaataaatgcatttaatagaatggaagtagcaattgctcaggaattaggtgttagcataagaatgataaatgaatggaaacgagagttcggcttaacaagtaaaatttaattggttttcaaaaataaaatatcctacttttaatttaggaaaatacattaattattcaaaagaacagaaattagaattggtaaaggaatttcaaaaaaaaagaaaatgaattcattacaactgacaaaattaatacagttcgtagaatagaagaagcagttgcaagggaattgggcatcggtaggacgaccttaaaaaaatggaaaaaacaactcgggctaacaggtgattagaatcattttaattgttattctattaaacgatttatgttttagcgaaaaaaagttattcaaaagaagaaaaattcgaagtgattttgcaatttcataaaagaaatattgaatttaaaaaggatgaaattttaaattcatacaataaaattgtccaagcaattgcaagagaattaggcgtaagccgaaaaaatatatacaaatggaaaaaggaacttgggctatcaagtaagaatcattttaatattctatcattatttataaataaattttttaaagacgaacaatggttggagctaatccgaggaagaatgaatgaatttgaaaaagatgaaaatccgaatgaatttaacaatgccgaagatggaattgaagaggaaatggataattgtcatgtcaaaaaaggtgattttaaatgctacaaaagaaataataaaatattttaagagagcaaaatttattcaattaaagaaaaacttgagttgctagagcaattccaaaaagagaaaaatgcatccaaaaagaatgacgaattaaatacattgcgtaaaatagatgctgcaattgcaaagaaattaggcatctctcgaactgcgatttacagatggaagaagaaatttggactctccgggttatcaagtgattagaaagaattta

SEQ ID NO: 78628 - DNA, 1076 bp, Heterodera glycines
  Genomic contig location: Contig_ID=SeqID_2235; Location=242..1317; Strand=+
  SCN-specific regions: Sequence locations=1-52,75-127,163-168,190 -438,460-801,824-1076
tcgaaaaaatagaagaagtaattgcaagggaattgggaatctgtcgacggacaataagaagatggaaaaaagaattcggcttaacaagtaaatttcaatttaacattaatttgtggtagaattgatgatttttatttgttttaaattaatttttaaatattacttagatttatgtaatttagggaggacgattagttattcagcggacgaaaaactcaaattgcttgagcaattccaaaaaatccgaaatgcattacaaaaaaatggaattacgaatatatgtgctaaaatcgaaaataaaattgcaaagaaaataggcgttgatcgaaaaaagataaagcgatgggaaaaatggcttttcatagcaagtaattttttgtccatttaggcctatgaataaggttatacaagaatgaggaacaaagttatccttaaattgggaattagaataaatgaaaaacatacaatgaattagtgctgctcgagagtctattcttgagtctcatcgagaaaagtctcggcttttgtggtctaagtctcgcgtctcggggtcaagtccgcggtctcggaaagtttcagactctagtgtcactactagagaggcggaacaggaccagaccctggcatgaatttacaggatctgaaagcatccgcatcctaaaaattttaaaacccaatcctataatatgatcccaaaattcgtaatttgccgatgtcgaaacactactattgttaatacatgttttggaattacatgttttggaaatctagaaaataattaagaaactaattttgtaatgaaatactcattttcagctttccaacatcagaatggacaaaaaaacaaagcagattcgcttaacgcagaatttaatgatcaaaacggtcaatcatcatttatcaaaagacaaaaacacgtcaactttgaagaaaattcaccgccaaattcgtcaccgatttcgcaatcaatttcttctgattcgccattgaataatgaacttcacgaaaaattggtcagtctaaggactaattgtttctttttggactccagatttcgcatagattttgatttttag

SEQ ID NO: 78629 - DNA, 3217 bp, Heterodera glycines
  misc_feature (3205)..(3205): n is a, c, g, or t
  Genomic contig location: Contig_ID=SeqID_2236; Location=1231..4447; Strand=+
  SCN-specific regions: Sequence locations=1-501,523-649,681-802,835 -916,940-1199,1221-1277,1311-1478,1511-2451,2496-3217
  Gene Ontology: Mol. function=transcription factor activity; Cellular component=nucleus
tctgaacggtcaatcatcatttatcaaaagacaaaaacacgtcaactttgaagaaaattcaccgccaaattcgtcaccgatttcgcaatcaatttcttctgattcgccattgaataatgaacttcaggagaaattgtccagtctaaagactaattgtttctttttggactccagattatttcgcatagattttgatttttagaatgtttctgcggaattgcatcaaagcaattttattggcggaagatatccaaaacgacactgcaatcaaagagtaaaagataaaagtgttcaagaagaaaggcagaacagcagccaaccagtagtctattgtatcaaattgacgaatatattagtgctaatgagttagagcatgacgacacaatacacgcaatgaaaattagtggtgggatattttgcatttttattaattaatttttgcgctagttaaaaagtggagcactttgaattttcttaaaaccaagaaagggtaataagcccttttgctttgcaattttataaattcgtttgcgaattttatttgtggaattcgagttgggattagtaattagtgaaaaactgatgtcaaattcgtgctcaactactccgaagcacagctaaaataaattccacaatttaatacgaccaaataattttgctttttaaataaaattcaaaaaactccactttcaaaataatttcgatttttattattatagaatttacaatgaaatacgttagggaatctggcttgcttcatccacttttgttcagcgagccacctgaaaagttgggaatgaggtttataaagtaattttttttaaaataaattttgcattttaagaatgccaaatccacaagagtttagcattttggatgttcttggtaatttattcgttgttctgtatgaaatcagaaacttttaattacatttcagagcttgttggtggcgaaagacgaattgaagttttcgatgtacacactcaggaggggaaaaatatgcgactgaaagaatttgtcaaatatttcaggtgaataatatttatggttgggatactgtatgtgataaatggacgaaaaacaccatttttattgcttaattctttattaaatactattttgttaaattgtaaatataaataccaaccctaaataatataatttgttgatcagtggaatggaattatccaatcatcagattttttgttttagacaaagtccgtcaatgcgtaaaaatttgttgaattcgctctcactcgaaatctctgacaccaaattgtcagaacaggtttttaaaatgatttttatttatacattttggttcatttaggtgatagcgccgggttttgtaagaagaattgattggattgacaatgtgtggccaaaagaacttttggcacgtcagaaaaacctactaaaaaagagtcgttgggcacgaagcaacgatttttccacttacccaaaagtgcaaaagtttgtaaaatttaaaatatatttttatgattttttactttaagatattgcctgatgagcgttgctaattgctttacagactttcatattggtgagttatgaaaaactttttgttctacaaattttgctaaatttgtcgaacaaattcactcttccgatgggacttggatccacggccttttcccattgcgggaaatgctttaacaaactaagctatgggcgtttcctttagattttctcccaagtcctttatcccatttccccatacccgcttccttctggcaccaaactcaccacatcattttccggaaaattcctcttaaaattcatttattttaagattttggcggatcatcagtctggtaccatgttctgaagggtgaaaaagttggtgacggatgagaaaaatttaaataaaccttttatttgataatctcagaaaaagatgtagaatttgtataaattaaattttcataattcaataatgctacagcaaattttagattttttggctaattgaaccgactgaggaaaacctgaaactttatgaagaatggtttctgggcgggaatggagattcaaaattccttggcaaattgaccaaatgttcacgtgttcgactccgtcagggagaaacgcttattataccatcgggtgaattaaaacaaacatctttggtgaaaattgcataaacatttttcgtctggcttgttcacaaaaactgccaaattggctattcctaaaaattggcatttgctaaaactgccaaatagctgttttggcattttttgggaaacaatgaagcaccatgtttcttacggacgagtctgtgaataacattgatcgccgttaaggatggattcacagtgtttacacaccggtggatgcactcgtttttggtggcaactttctgcacagttacgcaattccgacacaaattcggatttcaacattggaagataacatcaaagtgaaatgatttattaaattaatatatattaattaataatatataataaatactctgtttggtacaaaaatttatatgatatttggtccctgaccaaattatcaaaaattttgtaaaaattttcaaaaatccacaaaatacccaattttggtgcaaatctatttaaaaatttggccaaatctcaatttttcaccgtcctactgtagtactaccgcacagctgggcctctcattccccgaaacttttttgaaaaaccgcaaaagcggtgtgcagtgaaaaacacatcctaggacgaccatcagtgatgctggtcgtatcataaaattttattatttattgcagcgcggcaaaaaatatcgcttccctcatttcaaacaaatattttggtgtttcattgcacaaattgtgcgcaaatgcacacatcgtctgtaccagaaaaagctgtcagaagaagcccacaatgttgaaggcctaaatttggtgcaggtcattgatgaaaggatggtcagtagcctttatttgtggttactggacatttgcgccccggatatttacacccgagcatatgcgctccagacattgcgccccgaacctttgagcataattatcattttaagcttaaattttaaactttgttcaaaaggatgacgaaatggcaaacaatggcccacggctgaatttggatggagaagaaatttgttacaacgaatttttgggaaatgcaattgatgtgagggaattttatagcaattaaagtccaanattaaactttaa

SEQ ID NO: 78630 - DNA, 304 bp, Heterodera glycines
  Genomic contig location: Contig_ID=SeqID_2237; Location=341..644; Strand=+
  SCN-specific regions: Sequence locations=1-148,170-304
atggcaaacaatggcccccggctgaatttggatggagaagaaatttgttacaacgaatttttgggaaatgcaattgatgtgagggaattttatagcaattaaagtccaaattaaactttaagaaaaatcagtatcaaaattcggaaacaaaaaatatatttataaaattcggttttagggttcatatacatttaatccgattcaatcagtctacgacaataaagacaaggcgaaattcactcctacaaaaaactacaatattggtacgcacaaaaatattaatagattatcatttataaattaa

SEQ ID NO: 78631 - DNA, 3792 bp, Heterodera glycines
  Genomic contig location: Contig_ID=SeqID_14558; Location=155..3946; Strand=-
  SCN-specific regions: Sequence locations=1-46,68-639,661-672,697 -1359,1381-1604,1627-2724,2747-3394,3423-3455,3480-3792
atgctggcaggaggcctgtccctaagcctcctgtgcttcatcttcaccatgtgttccatggtgggatacgccatggcaggactgagaatccttttttggattttctcagtcttgttcgcgcgcttattcaagccgcgaaaagagacatgggtgttgagtgaagaggaggaaaacctcctctatcctcaccgacgaatacgccggcccaggccagcaacaagaaactgggccagtggccgagttagccaaatgacaatgcttgtcatggcatctcttccgtttgtacacgggggaattgagacagtggccataatggccaaatcagagagctgtctcaacaacggcacaacgaaaatgtgccaagtcaagggaagcgtaacccttgcgcttctcccggtaggacaaccgaatgtcctgtcaatgaagaccgatgatggtctcattttgggaacccttcaagtgatcttgaaggggctctctctcgaatgccaagcatacaccaaggcttggaaacgatcatacgagatcgcttccgtggccagcaaaagatgtccgtcggctggctcatgtgtcggtgacttttgcacaaaagtcccaccctccacagccatccgagagctgagggagaccgaaacgttccccgggaacagtttctgcatcgacagcacggctttttggggaaaccaatgtctcctagcagccagttcatgtctcttctacaagtggtttgccaaaccacgctcatcggccattaacgaagtcatcggatgcaactcttgggagtttggcatccatattcaacttcgcctcgactctaccactggaagaagtgcgacagtcgaaactgtgcttcttccaggccgtgtgctcaaatggcacaacatcagcatttcaacaataggagtgagccaagcaccggctcccctactgaacgctgacttcctgattgaagggcgaagtgtcgccattgtccgtgagaaaatcacggactctttccattgtacagacttgaaagccgcccaagctttcaattgtactctgggaattgacgcatgcacgggctgtcttcccgatcacacagacgggacagtctcgtgccattgtcgcgtcgccaatctcgagggtctaatggaagaccctcagcggagacttccgctctcattccgccattacgaactgcggaatcacggaaggcgaatattcgccataaccggatatagtccggtccaaatgaacattcaaatggacagccttcaaatgtccttggaaatgcaccagagtttgtgcacaatcacaccaaagcacatctctggctgctacaaatgtgcgacgggagctcagctctcctactcgtgccacactgacattggccaaacattggccgacattcaatgcgaagatggttcgcatttcacgagcaaatgtggcccgaacataacggaccacactgtcgtgctcccattccagcatgccgaaataagcacgacatgccaagtcatgtgcttggctgggagaaccaagttctccttggtgggacaactccattacatcccactccgacaacagtcagaattcggagcccgagtctccgaaagcctcgaagaggccagcaactcaggctgggctgacttcagtttcgactggaagtccacttttcaagctctgtttggccttaaaacaggcctaattttcttcattgtcttgatgatcggcattgtgatcatcattttcgttgtacacttctctcctgtgtacaagttatggagaacatttgcttggttgctcatgaaccaagctccgcgacccaacaacgccacaactttttccgtggctgccattctctttttggcggccggaggatccttcggatgggaacctcgaaaaggggattctttccccgtttcatgcggggaattaagaatccccgaccccgaattttcattcagggaagcggaggtgaatacagtacccctccatcaaaaaatcgattaccgtaatcgatcgccaaaaactgatataaaagaaggaaatttgatgacaatttcattccttcgccatcatcaagctccaaacaacacccagcgcctcagcaaaaccatgccgattccgttccgagaacggccaccttttttctcggcaccaacaatcagccgacccacaaacgaagtggtcattaatgaccgcctcgtcatcgacatcatcggccaatacgaagccgagaacggacagagagcaaacaatgctcctcaacccggggctgacaatgctcctccgccctgggccgaagaccaaagaggcccctggtggttcgaccaggattgggggccccagctcccaatggtccctgaaaacagtggccaaaatcgccaaatggacgatcagcgagatgattggggagcccatgctcctccccaacgggaaccatcgccccgtgaacacaccgagcgcctgaactcatgggttgagcgacaccacggccaacaatggtatgagacggctagcattcgccgtgacgcggaggaacacctccgccgagaactgcgcaccggtgccacgctttttgcggcacacctcggtccattcgcgaatgtctatttcgacgggttttcgcgttttggaccggctaacacgcgaatgtttccgggacggactgtccaggaacatttccgacggcgcgggttccaggtggacccgaatttgccatgcctccaagagtatggaggcttcagcaatagccaacaaggaatccatgtcgattacttcccaatcgacatggtcaatgtccgattccaaatcggagctgatcagagggaggctgagccccctcgtcttccccgaataagagcatatttggcattggaagaggctcccaatgaccaagaggggccaaacaggggacccccgtctcgacggttcttcgaggccattggcctccgaagaggcaatccgaatgttggcgaaatggcggaaaacaatggccgccaagcgcctctccaacgcggagagcgagccatggactatggccgccccaattcaccggacggcagctttgagaatcgcccacgaagggcggtccccaaccgtccaatgcgccgttggcagaacggccttttcattgtggccgtggctttgtgcctctgcaatttggcggagggaaaggaattcccttcgacaaggacttgccatcagccgcttgaagcggcgaacatggcacgtgaaaaccaatggggattttcacgaatgctgttcccatggccactttcccacgatcagaaagcaaatctgatcgaagagctccgccccttcaatggtagcaaaacctatttaagggcatggatttgccatgtcccaccatcacttgccttttccaaaatgccgaagcccatcaaaatggcttcctcttcttcttcttcttcttcttcctgttcatcatacggcagcgacacatcggaagagccgcccccgccgccaccaccgcgcaaaaaggcggtggaattgttcaacatcgccgcagcaacaccggaacgggacgcaaaaagcggacggaacttttccgtccgcgatttcatcgacgcggaagcgaaggaggagtcgtcgtcaaaacgcatgccgacatgttcggcgtgccaactctctggccatcgccgcggggcaaaggcctgccccctttatgttcctcctcaaaaggagcgaacggcggcagcgagccgccccggcacatcaaacacacgccgcgactcccccgaggaaggggagatcaccgccgataaggcgggccgcgatcgcccaccg

SEQ ID NO: 78632 - DNA, 1507 bp, Heterodera glycines
  misc_feature (1418)..(1418): n is a, c, g, or t
  Genomic contig location: Contig_ID=SeqID_14559; Location=200..1706; Strand=-
  SCN-specific regions: Sequence locations=1-354,376-459,489-557,589 -1193,1239-1309,1333-1507
atgaaggagcatccgctgtggcgcatggcgcacattgcaattttgtgccaacgcgtggacattttcacggacgacgggctggcctacctggaacggtttgactactccgtcaccgacttggtccaagtggcttgctccccggaaggcctcttcccgctgatgttggccgtccagaccaaccaggactccattgtccgctttttgctcaagcatggggctgatctgaccgcgcgtgaccccgttgggaacaatgcggtgcgtcgaacaaaaaaaaatttttttttgcaatataaaaggctgtttgtttaggggcacaacactgccctctgtccaatgccgtttctcctccatgaattcttttaaaaattgattttttagttttcgtaatctcttcgaaatttttttagtaaaaaatcttaaaaatttacgctttttttgaataacttgaagtaaacaaacaaaaaaaaatttttttcaatttaaattttgtacatgtttaaaaagtaaaactggaggtcttccggtgccgccgataggcaacacttggaaattggaacttttaatatttttatatagaaattttaaaatgttttcgatatttatttttttgtaaaatcgaatttttgatttactttttaaatttggtaacattggtgggaatggcagcacatcctcaaaatttttttggtttttcaaacaaatttcccatattttccattttcagcttcactatgctgccctggtttccacccaaatgttggagacactgcttgaacaagaggcgggcaaggcgttgatcaactcgcggaacaatgcgggcgaaacgccgtcaatggtcgcactgcgggcggtcaatccgttgtgcatgaaaacgttgttcaaccacgggggcgaccttttgaacaaatcgacggacaaaaacccgctcatcgaactcatccagtccagcaagggcaacacgccggagtatgtgctttttggggatttgtttatgctggattcagtgacggtcgcaggatttttcgggattttttttaaaatagaaattggaaattttagaccgttgggagttgggtatatactccatgaaaattttgcatcaatttatttgttattttttgaattgttctgttagtttatgagtttaaaaaattttttttgaagcctcaaaaaagcttcaaaatagccatttgttaatttaattatttatttttccaaaaattatataaaaaattaatgacgtggagaggacttgaacccctgcactttgttcctttactgtcgtcttacaaaagccacttcgccatacatgcaaaatttgaaaacagaattccaagaccaaaatattagcaatccgaaaacacatcacatccccgatataggtagggggtatctagaaaaaattttcgggggggggngggggggacccgactcgagactttttttttttttttgctcttcaactgaaaacctttaaaccttctttttttgatatttaaccaataaa

SEQ ID NO: 78633 - DNA, 677 bp, Heterodera glycines
  Genomic contig location: Contig_ID=SeqID_14560; Location=215..891; Strand=+
  SCN-specific regions: Sequence locations=1-78,100-345,379-677
atgtcgactttaaatcttcattttgcttactttcttctcattgttgtgtttttgcttgtggactattcattggcaacgagaaagaaaaataagaacaaaggtgaggcaattatgctaattataatattattatccattgcattcatttataatttccattcaaagttcgctcactatttaatttaaatgggaccggacctgaaaaaatttgtaaatgggaatttcgcgtttttctttttcggcaaagcaaacgcttggcattccaccgaggccgatggacaaataagcggagccgacaaacaattgggctacacaattcgggattctcccaattcagtaataccgttttttaaaaaataaattttgattaatttaaatgttttgcaggaggcgtcacattcactaaaagtgtacacgagaagaggaaaacaattaagcaaatcaaacgacgcagaaaggacgacgcccactgtcggagaacaacaaatgccattgtcagccgacgcagcggaagaaaacggcacaaattcacagggaacggcgcaggaagagaaactgcaaaaaattgtcgacaaattggagacgaatcagaaagaaatgcagaggaacattgaggaaatgttgaaggaacatttgacaaaaatggaggcgaaagttgacgaggtgaaaaatgaaaa

SEQ ID NO: 78634 - DNA, 1014 bp, Heterodera glycines
  Genomic contig location: Contig_ID=SeqID_14562; Location=51..1064; Strand=-
  SCN-specific regions: Sequence locations=1-155,197-259,283-433,455 -875,898-924,946-1014
atggaaaatgaggaggaacgcccgtctcagaaggaacccatcgaagcatatttcgcgaagtttaagcagttcatggcccatttgcaagacaatccgacaaaaggccaaagtgacaaattgttggccattttgagagaaatcgaagggcgaaaagaaacagtgaaatttgccaaggaaatggcagagatggatgaaattagagaacatattgacgaattggagcagggatttagggagaaaaacgcagaattggcgaataagaaaaccaccgagagagaaaaagattcttctttgaaagcgaacattgccgagggggcggataaaattggcgaaggagtgaaaagtgtggtggaatatcaggtggaaaatcatcaaaaattatgaaaagcaccacaaattactaaaacatcaccaattaagcttggcacctacgtgaaaaaggaatttatttatttgacaaaagcaaaacgaaattcgttgccgccattgaaaataattacggacttttttggggctttggagttggcaatagcctatctaaatcatgtgtgggatatcacaaagggtcagtaaatcgttggcaattagcttgaaaatggcaatgcttggtcgatggtaattcattgtgtgattcatttagtctgcctattgttgcttttcttcgttttcccctcattagcgccttaattaccctgccaattcactctcttaattactcggcccattttctgtatcatttgcctcccattatctgcttcagatttggtcgctttttcctcgttgcgccgttattttataagagtcgacatgaaacttgtgtttctaaacccagcgctttccatcatcagaaaagaagcggcaaaaaaattgcatttttctgggcaattgtcaaacattgcagggccaattcaacaaatttttacggaaaaagtgttgaagcatgaccaaatggcgaatttgcatgaaattatgcaaatggcattgctggaaggcaaacccatctcagaggaacag

SEQ ID NO: 78635 - DNA, 460 bp, Heterodera glycines
  misc_feature (446)..(446): n is a, c, g, or t
  Genomic contig location: Contig_ID=SeqID_14563; Location=2258..2717; Strand=+
  SCN-specific regions: Sequence locations=1-98,129-133,188-190,247 -301,334-346
atggcgtgctttcaacgtggtatggtcgtaagcgaaaggacagcaattaaagtaatttaaataggcatatttaaaaaagcctatttttttgccttttcacaagagaatttattaaaaaaggcaaaattcgccttaaattaataaggtgaaagtttgaaaatgtttattaaaaaatttcaggatgaaatacaattaaaataattaaaaagaaaaaaaataaatttatttttctaaataaataaaaaacattgtcagaggcagtgcctgccgaaaaaatagacaaaattttttcaaaaaagccaaaaaaaattgaaaatttaaataaatttaaaagtgaaaaaagtaaaaagcttccaacaccttcgattccaggacgtctccgttccaagtactaagaaggccccacgttgcttaacttgccagatcggacgggatggcgtgctttncacgtggtatggtc

SEQ ID NO: 78636 - DNA, 1488 bp, Heterodera glycines
  Genomic contig location: Contig_ID=SeqID_14565; Location=184..1671; Strand=+
  SCN-specific regions: Sequence locations=1-361,383-1032,1055 -1316,1338-1488
atggcgttgtgggcggagtgcactcggaggaggggaggaaaagcagacacacgacatttatgtgccggtaaattcattggcatttacatcaatgccactgacaaatggctgagtgttcacaatcagaagggcaaccaagactggacaaactcattacgtttcaatttgactgtgtccgtctccccaaacggcgcactcgtgcaacagtcgttcccgctgcccataatcaacagaaaacaacgcagtcacttcttcgaaatcgcatttgacaagaaatgcggtgaggacaatgaatgccattccgagttggcactacaagcagccattctcgacataacgtgagcataccggggatggaaatgcagaaaaacattgggacaaactcaggaggcgcgaagacggcatttacattgccaaggtgacggagcgcgactcgctggtgattcgttttttggtggagaatcgtaaggagcgcgcatttctggccaaattatttgtggaatataacggagtgaggggaagtacatttcgatggaaaatgagttgtcaaaattaaggacgaattggacgaacctcacctcacgcaaagggactaccaaaaagagactccaaagttggacatcgaacggaggaacgaaggattggtggttgttggactcggaaacccaatggaagcgggaagaaaggtccgatcagacggagacgtttgttgccaagtcgtttctctttcagcttagctttgacttggcgtttaaactcgtccgtggaagttccgaacgaatcagcgcctcactgaactttcgcgcactgatcaattcgtccagtgttgaggaggaaacggcgaacaatgaatggagtgccgaagtccaactgatcaaagaagccgacctccagctgggctagtgccttcctttcttggagcccttttatcaattccttccgctttcagaaggcgcttctcggccgtccatcgtccgcttcagtaaaggcaaccgattggtcactgacgaagtggacatcggtcctcaagtggtgcacgtgtacacaataaccaaccacggccctttctacgcacgaaatgtgagcctgaagatcaactggccgttacagctgatgagcggggaccctttgtccccgcgtcaaattgcctccggcagttgggcactttacacacttgaagagccattgatacgtcataatggccaaatccgacggtgtgcagcaccaccacaattacatggacaaaagtccatcaatccgttgggcgtgtacaacgacgaaaccctcaaattggattatcaaatgacgagtcgacggcaaagaccgaaaagggcccccaatcagcggacagttggaacaaacgccgaaggcgggacattctctgccacggcaccgctgacatcgattttcgacaacggacgcattcgacggaaggaaatcgaggaaagttcaggcgccaaagttcgtattgccgacattgtgagttga

SEQ ID NO: 78637 - DNA, 96 bp, Heterodera glycines
  Genomic contig location: Contig_ID=SeqID_14566; Location=773..868; Strand=+
  SCN-specific regions: Sequence locations=1-96
agcccgatggactcgttatcaccagtgtttaaaataattatttacttatggaaaagccattaatcctatattttcaaattgaacatgtaaattagt

SEQ ID NO: 78638 - DNA, 2541 bp, Heterodera glycines
  misc_feature (2044)..(2044): n is a, c, g, or t
  Genomic contig location: Contig_ID=SeqID_14567; Location=81..2621; Strand=+
  SCN-specific regions: Sequence locations=1-27,49-81,155-473,495 -579,670-716,738-756,786-795,865-866,927-949,971-993,1016-1017,1053 -1068,1093-1199,1234-1291,1313-1589,1664-1666,1723-1765,1824 -2232,2280-2371,2393-2405,2427-2541
  Gene Ontology: Mol. function=structural constituent of cytoskeleton; Cellular component=cytoskeleton; Biological process=reproduction
atggtcggcatgggacagaaggactcgtacgtgggagacgaggcgcagtccaaacgtggtattctgacgctgaagtacccgattgaacacggcatcgtcaccaactgggacgacatggagaagatctggcaccacaccttctacaacgagctgtaagtgtgctgtgagaatttgttggtgccttttttgtgattctccacgacggtgaaatttaaagtttagtggttggggtgggtcaaaaaaattcgggaatagtccgaaaccgtggcttgtgtcatgtttgatcacgaatttatttcgccttgtttcggacttcgggcgcaaatccgaacaacaaaaaccgttacctgtcgagacgttcccgtgatttttcataaaatattaaaaaatgcaacccaaaaatatggcaaaatttcgctcccgtccttttgcaggcgtgtcgcgcccgaggagcatccggtgttgctcacagaggctccgctgaacccgaaggctaacagagagaaggtcagccagtcgccatcggtcgaccaatggtcaaaccgcacggcccgtccccctgttcagatgacccaaattatgttcgagacgttcaacacgccggccatgtacgtggccattcaggccgtgctgtcgctgtacgcctctggccgtaccaccggtatcgtgttggactccggcgacggtatggcagccaaatcattggcataatgccattgctaatatccctgtacaggtgtcacccacaccgtgccaatctacgagggttacgcgctgccccatgctattctccgcctggacttggccggccgtgacctcactgactacctgatgaagatcctcactgagcgtggttactccttcacgaccaccgccgagcgtgagattgtccgtgacatcaaggagaagctgtgctacgtggccctcgacttcgagcaggtcggactttggccaatgccgtgccaaaattatcagtccgtccgccttcaggaaatggccaccgccgcttcgtcctcatcgctggagaagagctatgagctgcccgacggccaagtgatcactgttggaaacgagcgcttccgttgccctgaggcgttgttccaggtacgtatttggctggatcggccgaaatgtagccggcctataatgtcgtcgcaaaaaaattcaaggccttgagcacttttccggaagcagttttttggcaggaagagcaaaaacaaaaatttttttccgtattccccatcaaaaaaaattttctttctatgggcctggccctgaagtggggaacaggagggcaggggacacactgcttccagcataagtagagactggactgaatatgcaaaacgcggtgcattactttctgttctctatgtaattgtcacccccccccccccgagatttaaaaaaaaattttttcttgaaatccgttgaactttgaacaaaagtatttttgggctgggggcgagtcgtttctcagtgctctgtggaaatcgttgccaccatggcaacacactgattgtatgaatacacaactcctttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgccggagcgcaaatattcggtgtggatcggcggctccatcctcgcctcgctctccactttccagcagatgtacgtttgggttggccgtttttgttgtcgggtttggctgagcaatcaaactgcttctccccccccccccctccgcattcaattccacgcacctccgcatttgcatttttttttgcacggtaatctcttggatagtcttgtcgccattttttgggtttgtgtaacatcagactgtcttggctcttcttagaaaactcacggaaagtgccgcagggaacttttntaaacgatttaattttgtcccaacttacgagtgtatcaattttggtttacaattaaactcattttccctttttaagtgattcattttttggatggctgtagccttttaaaattggcttattattactttttccaaaactgttttatgcaattaatcattgcgcgttttctcaggtggatcagcaaatccgagtacgacgagtcgggcccgtccattgtgcaccgcaagtgcttctgattgagcggcggcccgcagggagccgaaagaaggaggaaaatgttgccgataaaatttgatttctttttttttttgctgtttgtcatggcgtatttaatttaaaatgataatatatagaggcggatttaattttatgaattgcttgtggataattaggaaaatcttattccttggcgggtgaggagtttgacagtgatttgatttttttaaatttgaggcaggcgggtaatacctctgcatgtccctcctattttctgaaa

SEQ ID NO: 78639 - DNA, 329 bp, Heterodera glycines
  Genomic contig location: Contig_ID=SeqID_14569; Location=1..329; Strand=+
  SCN-specific regions: Sequence locations=1-329
ataatttacacgatggggaccaataaaagtggacgcatcgtttttggtagttgccaaagcgttaaaagcagtggtggacatttttggccactatttgttggcccttaattaagacaattagccaaattttccgaaggtgaccatttctgcgggccatgaaaacatcgacaccgtggaatgtgccagaaggtggtcactaatcacttccgctcagttccccacctctacaaattaggggcatccgaatgggctttggcggtgccattctcactgaagcaacagccgaaacggcgatggcacttttacttacggtttcacgccgccttgtc

SEQ ID NO: 78640 - DNA, 1578 bp, Heterodera glycines
  misc_feature (1543)..(1543): n is a, c, g, or t
  Genomic contig location: Contig_ID=SeqID_14571; Location=1..1578; Strand=-
  SCN-specific regions: Sequence locations=1-472,502-1578
  Gene Ontology: Mol. function=transcription factor activity; Cellular component=nucleus; Biological process=transcription from Pol II promoter
caggagccacgcgtaagttgcctgtttttttaattttttgttaaatttctgtaccgtttcccattcaggaggtcccaccggaccgcgtggaaagggaattttggcgcaatgtgatcgacattgacaagggtgttcaagtgaagtacggggcggacctctgagttttttttttgtcttggaattccccaacttatgaaaaaaaaaaaattaattttccgaatttctcccaacaattcaggactctagggaatttgtgccttaaaactctaaccaacaatttatttggatgaattggcattttttcaaggagagagtgaattttgggaaattttgacaattcgattgaaaaaactactaaaattcttgacaaatttctgaccctaatcccaatattcaaaccctctcccccggcttttccattcaaaacttttttggattttttttttgaaatcctctttttttacaaatttttctaaatggattatgtgtatgtatttgcattattgcccgacaaatgcgattttccggggacgggaaagaccaagaatttcctgacgggaaattgttgccatgccaaacattggtgtaatgccgtatatattttacacatgtgctcacgcctcccccaatttgttgcgcagcatttcgagcaaagtcggcagcggttttccgcgccgtgaggacgcgtcggtgcgcggtgttgcggcggacgcgcaggaccgccaacagtacgccaaccatccgtggaatttgcacaatttgccgaaggtgcgcgagagtgtgctgtgccacatgaccaccgacatctccggcatgatcatcccatgggtgtacattggcatgctgttctccaccttttgttggcacgtcgaggaccactggtctgtgtctgctgtttggtggctttgtggccaaaaaattgtggcatttttgggatttagaatccgaatatgccctcgaattccttattgttttacggcaaaataatttgtctacgccgaattgaaacagttcaaaatgctccaaaaattttagatacagcgaatttctaactgtcccaaaaaattatagaattttcgggattccgaatccgggtacgccccctgattctaattataagactgtgtttttgggcatgggcatagttaacccgcatttctacgccgaattgaagcaattgaaaatgctcgagattttctggattttttttttcatacctttgccaacaatttttattgccaaaaattctatgtctgtttggtggaatttaattatccgccttctacattttatgctgtattccatcaactacaaccattggggggagcgcaaaatttggtacggagtgccgggcgaagaggccgaactgttcgccaaagttgttaaaggtgtgccggaattttccatggcattttaatgataattttcttcccctacagaatcggcacccgaattgtttatggagaataaggatttgctccatcaaatgatcactcacatgtatgattgattgttcatttttgattccatttttgcattattnattttttgacagaaatccgcaatttctgatcgacc

SEQ ID NO: 78641 - DNA, 170 bp, Heterodera glycines
  Genomic contig location: Contig_ID=SeqID_14572; Location=523..692; Strand=+
  SCN-specific regions: Sequence locations=1-170
acatcgcaccgccgttccgcgcccgggacgaggccgaattgttgctgctgcccttcttccactgtttcggtttcactcagctgaacatggctttgctgaacgggtccaccggcgttgtgctcagcaaattcgagcagaattccttttgccgagtggtggagcagtacagg

SEQ ID NO: 78642 - DNA, 748 bp, Heterodera glycines
  Genomic contig location: Contig_ID=SeqID_14573; Location=1089..1836; Strand=+
  SCN-specific regions: Sequence locations=1-490,513-586,607-748
atgcgcttcaaatgcaaaggcggccttttgctgctcacttttctcgtgggctttgccggcggcgatttggcccacaacccaatttataagccaggtaaaaaacgaaatgaacagcgaagagacaaacatttgctttttattcgcttccatttttgtttccgatttattttttcagataaaaatgacgcggttgtttttcatggacaaatttgggaggaaaacgaagtgaaagagtaccaaatggaggcggaagtgttggacgagcaacagccgataaaagaacctaaaataatttgggcgacggataaattgggcgacagacactttcggatgacttttaaattcgccggagggacgggcaaaaggcaaattgacaagctaaagttggaactgttcacaaggtaaagccaagggaaggcaaaagagtgccatggaaatttactgtttcagcagaacagtgacatcgttcagagaaaagaatggccgagttgaaaaggtgaaaaagaaaaagggagacactgaaaaatgagagtacggtaggagaagggacagacaaaccaaaggggtacggtggaggaggggaacggagagagagagagagagagatgggggaacaacggaaggatacggtaggaagatgagaaggggaccggcgggcgaccgaaatgggccaattccgtcacggccaattcagccccgtgtctatcatcattggggaggggggctaaaattgtaaaaaatcgaataa

SEQ ID NO: 78643 - DNA, 534 bp, Heterodera glycines
  Genomic contig location: Contig_ID=SeqID_14573; Location=1..534; Strand=+
  SCN-specific regions: Sequence locations=1-534
cgggtgagtgatcagtatctggctggttgtgggtgatcagaccgtaattcgttggtgtgctgatcataggtgacatcgtgttggtggacaagtacggcttcatcactgtggtggaccgactaaaagagctgatcaaagtgaacggattgcaagtgagcaaccactaatcagctgatcacctcacttttgcttctgcttatggtcgctccttctgagttggaggatttgcttctctcccaccccaaattgcaagactgtgccgtcattggcgtgccggacaaagtctccggcgaattgccacgggcatttgtcgtgccaaagaatggggcgaaagtgaacgaattggaaattcagcaatttgtcaaaggttgcggaattacaagctgatcaaaaagacgaacattagccaattcagaaagaatggcgtattataagcagctgaaaggcggtgttgaatttgtggcggaagtgccgaaaagcccagcggggaaaattctaaggagaattttgagagaaaaaatgacaaaaggaaac

SEQ ID NO: 78644 - DNA, 1845 bp, Heterodera glycines
  Genomic contig location: Contig_ID=SeqID_2238; Location=91..1935; Strand=-
  SCN-specific regions: Sequence locations=1-44,76-214,236-258,294 -708,730-1559,1582-1845
atgtaccgggacccaattgggaagcgaaatgccaagaaaaacaatgccgccgtctcctcctcctcttcagcaccaattgagcggaagagaaaaagagttgtcgctgctgctgctcccgccattcccactactggtttgtgtgacggccaattttcatttaaattttacaccaattttttttttttgatggactaagcgcttttgcctgtgttgcctcctcctcctctgttcccacttcgtcgccgttgggcacagttcccaccaccaccaccaccactgccgcttcaccaccaaatgctgagtgagtgagtttggtttggaaaacgatggacccactaggcacagaggcaaagttttctggattaggaatcgggaattggccccgatagtcgagaccaagacttccaaaaaattgctaaaatgcaaaaacataaaaattaatgggaaattggcagttttcgtctcggctgcatccccaaaatagaaagttctttgtaacaaaattctatgaacaaatttttttcgaaaacttttgtggtcacttactaagatttttcaaaaaatcgctgaaacttctcgaaattttttctcttagaagataaaaaagtttctaattgtaagatttttttcttgaaaaaaaattcccggacgaaacgatgcgatgggcgggaactgatactggggagggggggggggggtgaacgtagtgcatcctcctccatcacactctcatttttttcgtccattcccccaacaaattatgcacctaacaataaacataaactcctcaccgcaggggttgttcgtttttttcaaaaaaaaattcaaaaatattcgaaaattcagtgtcctctataaataatttttatcttttatgaaatgtttcccctacacttctttgtttcctccattccagcttggcttcttccgtctctgaacttcgccgaatcggtggcattggcattagcagtgcgactggtgcaatgcaaccaacaccacccgcattgtccagctcggcattctttccggatggcagcgggacagtgccgacaaccacaacaacgacggcggcgccgacggccccgacactgcctgccggggtgagtgatgccgaaacgggtcgtcacacatccaccgattttaggatgccgaaatggctgccacaatttatgatgtaaataaattttttccttatttgaccgaccaaatccaataaaaaaaaaagttggtatcatttttcttttaagaaattcattttttgccgtcaaaggcatttttaaaatttaattgggagaataatcaattgaactaacccaatatcgctggtatttcggtttcaatttttccaatcattttggcatcggtaccaaaaaacagtaaatttacacaatcgccaaaaaattttgcccttaaactctaatattttttttgattggactgactcttaacatattcagttgctccatttcgcactttctccgtccgttcgtccgtcttcaactcttcagcaacagtccctcgccaccaccgccggtccttccgtcgatgtaaaatacgagttttaaatattttttttaatttcattttccctaatttttagacaccggccgccgcaattgcgctgctgccctgtgcccttccgtccccctctgagtcgccctccgtgctgcagcggctcgtggacggataccgcaattttcagtcgtcccaggtgaattcgaaaaaaatctgggtaatttctgataatgagttggttttttgaaaatgattattttcacaagtgtagtgtgattaaacttttttataatttttgagaaaatttaaagattttctttttctaataaa

SEQ ID NO: 78645 - DNA, 401 bp, Heterodera glycines
  misc_feature (389)..(389): n is a, c, g, or t
  Genomic contig location: Contig_ID=SeqID_2238; Location=4112..4512; Strand=+
  SCN-specific regions: Sequence locations=1-401
atgggcataaaatatggacataaatgccaaaatatggacaaatatggaaatatggatataaatcgcaaaatatggaaaaatatggaaaatatgagtatagaaatacggtaggggtcaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcaaagttttttatttctatctttttttatagttcgaaattttctgtaatttttagtaggactaatagagcatgtgaagagctttcgaatgatatncagattgtttga

SEQ ID NO: 78646 - DNA, 1870 bp, Heterodera glycines
  Genomic contig location: Contig_ID=SeqID_2239; Location=2057..3926; Strand=+
  SCN-specific regions: Sequence locations=1-19,41-1066,1088-1189,1218 -1355,1377-1568,1590-1870
atgttttgtggttctgttagtaaaggagtgttctgttttggtaatttttcgtttggttaccaaaataggaaaaggtgatcttttcctatttgaaaaattataaggtcttttgggttgaggtgagtagtatttttgataattttaaaggctgttatgatatcaagatattttctcctggtttcaagcttggaaagttttagaaattttagcctttcgctgtatgagatgtaggggagacagcattttctgaaaacattttttgtaaagtttttctgaaatttttccaggcggtttatttcttttttggtttgaggattccaaatttcggttgcgtattctaaaaggggtcgaatataacttttataaactgtaatccaagtcttggttgacttggttttaattttttttaaagaattctgcttttgagataagctttttggagaattattgaaacatgttcgttgaatttgagtttgttgtcgattaaaatacctagatcacgaataatttttgattcaggaaaagttgaatttttaattgtgtacggtatttttttgttatttttacctagatatgagacggaagatttttttactgaaaaatttaagccacatgtttcaattaaagactgaaattagagctgtttctaaaactttacgttgggattcatttgaatagcaatgataaatttttgtatcatctgcaaaaagtttaattgagatttcttttggaatttcttcaggcaaaagctaaagggattttaaaaatgcaaaaaaaaaagaatgaaatttgcccgggctagtctaaatgctaaaggggctgactgcaccgaaaattgacaaatttgacaatttgtaggagagagcgagagagagagaataagaaaagagagtgaaggaagccaaaaataaccaaaaaaagtcctggtagcaaacgaataaggtagactaatttataaaaatatttgaacgattgagaagcaaaaaaaagagagagagaaaaaagaagtgagacagaaaaaaatagaacaattttttttttgaggagagcaaaaaggcctgggctgataaccaatcaaaggggcactattttagctaattaaaaaaagagggaccaataaaaaatgaaaattaggccctatcattttgcttacagtatgagttacagtttttacaagttccaaagttcattttatctctttgttttctctcgtttttcacgccataagaatattcacgtaatcacgtgccgccgcattttttcattgggcaagatcattcactttacacatttttgcggcgcctgagaattgttaattgctcttgtcaggcggagtttaaatgaagatggagcagataagcccattcctggaaggcgttcgcatccattcgattacccgctgtcattcattaattttttttctctctcaatcaatgcataatgggattaccaaataatttttttttagcaaaataaaacaaaatcttattataactgaacgacttcgaatgtctacatcagggggctcgtcaaatgagttcccctttggtacatcccaagccttcgggcaggaaacaaagatgtttttgagtggaaaggaggatgagtcctcgatttcggctattgataggaaactttggcaaggaaagaccacgataaaaatctctgatttagaaaaagctcaaaatgatatggggaaattagaagatggagtgaacagagcttttcgctacatgaatcgttctttgaaccaaaaagtcaacaatgcctatacaactcaacaaattcaaacactatgtcggccgagaaatctcacaatggccttattcgaccgttttggcttacaattagcattagcctaataagagaa

SEQ ID NO: 78647 - DNA, 1101 bp, Heterodera glycines
  Genomic contig location: Contig_ID=SeqID_2239; Location=4294..5394; Strand=+
  SCN-specific regions: Sequence locations=1-63,85-187,209-418,441 -443,466-562,584-1054,1077-1101
atggtcggaaatggaaatgaattagtggaaacagaggatgacgaaaattctgttaatttcatgaacttgtttgagaatttggaactgacggattctgaaaaattgcctagtctaatggaaattgagaaaatatttacggacaccacaccaacgccagctgatctgccaccaattgaaagctcagttatggggtttgtgttcatctcacaccccatactgtgggcactggtacaaccggacattttgggcgaacaaaatgagctattggaccggaaaaatttaagcttagaatcagatcaatttgtcttccaaagtacaccaagttatgtgacgacaattacattggaccctaacaataactggccacatttcacacaaatttcgttgaattggaacaaacaatctctattaggaactcggctcaaaacaattgatttgaagcaaatgacttatcctccaaaactgggaccatcagtgagtcaaattgtcccttcgagctgctgtggaataattagggaagtgatccaaaataaaatcacctcagaaattatggccattgatgtctttttgtatggggaagaaagtaatcagcgtttcttcccccaccaaatcgattcaagtgttaatttgatggaattagaaggcacccgggtccaaactacgggatttcgagccaagacttcagaaaatgaatggaccaacttcgggtgatggaattcgcgattggtgggctgagcagatctatgtcgggaccagggacgtatccaggatttgggcttggggggggggtaccgatccgaaaagtcaattcttaggggtgtatttttgaaaattcttcgcccgattcttaggggtgtatttttgaaaaactttcgtttttttttttgctcataccagcgacgctgggaaaataggcagacagtcagacagtgcattatttccttcttttcttccgcatagccacgagagaaaggaagaaatagtgcactgtctgactgtctgtctacgtggggctgcggcgggtggaagggtagacagtaaacagccgtgtgctcgctgtgcagcagcattgtgtgtgggaaaagggaagaagtgagaaaa

SEQ ID NO: 78648 - DNA, 429 bp, Heterodera glycines
  Genomic contig location: Contig_ID=SeqID_2240; Location=1408..1836; Strand=+
  SCN-specific regions: Sequence locations=1-429
atgcaaaaacctactccttctaaccgccccaattcctctgtctccaaaacccttgcctgcgggcttgaaaaaattgtgaatttgagtggaaatgagccactctcggtgccggtgctggcggatcggagtgatccgctgggactcaagtcggtccaacccgacacggtgccaatggaaagtgccgagggcaccaaggaagtggaaataatggaagtggatgaaatgagtggagaaaaagggaaaaagggtgaaatgggtaaagaaaaggtgaaaagtggtggaatggaagaggaagaagaaagtgagggcagtgaaagtgaactgctaggagaaggtggatttgacaatttgcaattgaaccccagcctgagggcgggaaataaagcagttgaaaaggaagataaggggaaaccctatctggtcgcccaa

SEQ ID NO: 78649 - DNA, 482 bp, Heterodera glycines
  Genomic contig location: Contig_ID=SeqID_14575; Location=72..553; Strand=+
  SCN-specific regions: Sequence locations=1-94,116-423,466-482
atgtcaccgatatggccaaatttgtcgtcaaaaatggcacaagcattaataaagttagaaaattgaatttgttcattttctattaaaattaatgctctttaataacttaattattattttttactttccacattacgattaaactgattttttttttttttttactacgcatactctatcattccaacaaatcttattaagaactgaaccaaactcgaaaattttgcataaatttgatgccgaaaatgagagtattctgcagatttttcgaaagtaaaatttaagcaattttttcagaaatttctaaaagaaattttccaggcttttgggttttttgcattttttaaaatattaattgggacggtatgcttagcaaaaaaaaaactcggttttattaatctatttgaatgtaaaaagcattgcttaatttattaaacaatatatataattataatgaaaaaaaatgatttctaatggcctaa

SEQ ID NO: 78650 - DNA, 1235 bp, Heterodera glycines
  Genomic contig location: Contig_ID=SeqID_14577; Location=205..1439; Strand=+
  SCN-specific regions: Sequence locations=1-317,397-663,686-912,935 -1019,1042-1235
atgcgatttttgctaattatccctgctcaattatttcaggtacgcttcatttctgagctgaaaaagttgcaggagccgtcgctgatgaacagtgtgttagagaattttaccggtaattgtccaactacagtaatcacacagtgttttttaaggtcatgaaatgtttgcgaaattgagcgaattttctgtttacaaaaaagttcttgctgaaaatcaaatctttgttttacctctctttgaaatttacttaatatgacattgtttttatttttatttcaactaaaggtttttcaattttctgttgttctaaatttctcatttttaattaatattttctatattttataaatatttaatttaaattgttttaaaaaaatttttaattaaaaaaaaattcagttcttcaaattgtcactgataaacaaagcaacgacacattgatggtcatcgcgttcatgttcggaatacgagaggagtaagcttgtttaaaagtttgatttcaaaaaaatttacagtatcgttttagtcaactcaattacagtttccttacggtgtcactaaaacatgggtgggggaacgtattccagcttttttagcgcaagaatttcatgattttttctccagaaatttttttattgtaaaatatgtaaaattctcgggtctcaaaaattttaaaaattagaaatatttgcactttttaattaagtgctaacattcgcgacgacggtgaaggagacgatgaaatattcaccaacatttatcggataacagaatagggcttctcactgatcaccacattcactgaccagatcagactggacaaccaaaacaggagaaggaggagcaattgggctgctgttggtcagtaaattttttcgcctgtggtaataattgtgtcgagactgacgagattcgtcctccaaaaaacaactgactaaacaattaactactctgcttgctcatcgagattgtcgaacccaacacaaaattgggacacattgtcaaaatttacatgatattttttctttcgtgcctgtgtttttacattgaagaagaccggatagggtagatcagtagcagcatccttattttgggatttgcgactttaaagtcatttgcccaacatttggcggcacagattttgatccgccattttcggtttaattcgccgtttccatccaatttcaaatgtttccattaagccacccatatacatagaaacgatgttggcatta

SEQ ID NO: 78651 - DNA, 486 bp, Heterodera glycines
  Genomic contig location: Contig_ID=SeqID_14577; Location=2475..2960; Strand=-
  SCN-specific regions: Sequence locations=1-221,243-277,299-431,453-486
atgccgacatttgcctcgcgagaggctcttcaaccaaccaagacaactcgaaattgcgatcaccggggacttgcagttgtgcacatgttatggtatgaaaataattggtattgtaactttaccggagggtcgtggaaccggggccacccgccgccggtggtgtgggtcaatcagttccttccttccgtctgttctgattgtaagccaaattttttggtccataaaatttggcattattatattggtgaattgttctttttaataactttttttttagttttcatttttaatggctctaattgagagctttaaatttgtgaaaattggccaatttggaaaaaagtttgacccgaaaaaattggctcacaatcagacggaaacgacccgctttgccacctgtctggcttaaaaattgtcaatccattactgtaccaaattaattgaattaaaaaactcactaatggaaacaaccctcactaaaataaa

SEQ ID NO: 78652 - DNA, 250 bp, Heterodera glycines
  Genomic contig location: Contig_ID=SeqID_14578; Location=1243..1492; Strand=+
  SCN-specific regions: Sequence locations=1-50,72-109,159-250
atggtatgtacttattcaaatttcttcattaggttttatttccaagaatatttaattcattcatttcttttccttaataactcaaaactaaggcttttttgttttgtggtataaattaaattaaatcgaatattaaattaaaattttttaaatattttctcagttttattcaactttttttcttgttcatgtgaaaatattgagatataaattgtgtgattaattttctttaatattttatccgtcaaaa

SEQ ID NO: 78653 - DNA, 1511 bp, Heterodera glycines
  misc_feature (1501)..(1501): n is a, c, g, or t
  Genomic contig location: Contig_ID=SeqID_14580; Location=1455..2965; Strand=+
  SCN-specific regions: Sequence locations=1-36,63-166,206-366,390 -520,556-672,699-765,787-821,844-886,923-926,948-977,1007-1043,1065 -1097,1119-1208,1230-1264,1286-1511
atgaaatcaaattacattaaaggattttatacatggattataattttatataaattaataaagccttcattttttgctgacgtaagttgcttttgccacttttgcaaatgtcacatgatgttccatgcaaaattggcagttctttctttttacaaatatcattttgaaaataaaattattatttttattatttttctttaaaaatgattcaaaatgcttttattttttcttttatttgctttttcaacaaaatattttttgccgaaaatgtcaaaccggccatcaatctgatcaaatattcggctatcatttctccgccgggtttttataaaattgcaatttgggacagatttgaaaagaaaaaagcacaacaatgcaaaaatctttttgaagaagttgaacaagaagtaagaaattaaaagcatttttataaatattcaattttggctaactttgccctgaaactttgagagtgatttttcattatgccaatattctgccaattcgggaatagtaattcataaattaaatattaaatattttaaatgaaaaattctttcagtaattttcaaagtttcaatttcaaaaaacgattattttcaaaatattttctttttttcatgggccaattgtccgaattttgaaattttgtgctttttctcccaatttaattgtctaaatttttacttttaatagttcaatggtaaatttcatgctgttcgtcgcttcaagtattatgatggcattgaattagaatattttgctgaatgttttgaaaactttttcattgctcagaccaatgaagacggtgaatttgatgtgaatttaaggggtaacattggagaaacaatctttttccaaatatttccactctataataataaggtaattaattagaaaatattaaatgtaattaaaatatgacattgatactaatattcaaaacatatttatagctaaacgaagtgaaatttgcatattttgttaatttctttaaattaaattttcattaattccttcttcaggctccaatccgttccgattctttcccctccacttttctccaaagcatacacagaaaacccgattggaggttatgtgtgcattttgagcaacatttttattttctaattcataaggaaaaaaagactaaaatcggcacaatgttggacaattggcagagaagtgccaatgccaacccatcggatgaagaagcctttttcctcaaggcatgtttacaggaaatagcgtcaagaattgttgacacattcaccaagggcatcaagctgaccaataatgaaatcagcatccagcgcaaatattggagtgcatttcaacagatgaaagggcatggaattttggccggaaaattggcacaaattgatggaatgccaaagttaatgaaagatttatgcagatttacggttgctgattatgaggcgaactccgccgatggattcgaatttaatgacaaattatttgccttggctttcttttgtgncgaattataa

SEQ ID NO: 78654 - DNA, 861 bp, Heterodera glycines
  Genomic contig location: Contig_ID=SeqID_14582; Location=289..1149; Strand=-
  SCN-specific regions: Sequence locations=1-282,304-477,499-861
atgataaatattgcacaattgactaatgctgatgatgttacgcttttggtataaaatgcttttcaaaaggttttcactaaaacattggtattttagaagggtcgctacagagttcggctgattgattcggaattggtcccgctttgttatgaacattacattgcgtggcaaagtgatcgtcattgatttgccggaggctgaagtttgttggatgtgttaccctacacattgctttcatttttatgagacttcccaatgattggtggtggtcattcagggggacccccaccccgggaaacaaaattttcattggactcacaaaactcaaataggcacataaaatgcaataacaacaacagcaatcatggaaatacttttgccttcatgaattttgggaaaaatgtgaccgagagttggaaatgtggccggggtgggagtaccgggacgcaaagacaccgttttaccgaccgagttttttagccccctccccctctccaaatcccgtttaaattccaccgtgatcacgcttcaattgaatttgtataattttcccatcttagggatatgaagcgacggctgccaaagcgtacgaacgctttcgtgccatggcaatgacagccaaagtggaggacgacgaattgtgcgatgaaaacaaggagaatttgccgtccgattgcacgctcgttggtgacccgctcaaagtgacatttttgtccatcgaaaagttggacgcggtggctgcagcgaacaaatcacgcttcgattctggccatgaactcattgaagttggcggcacttcggccattgacttccacttgatcccaccgtcagaagcacacggccttatcaatgagtaataaa

SEQ ID NO: 78655 - DNA, 1328 bp, Heterodera glycines
  Genomic contig location: Contig_ID=SeqID_14585; Location=405..1732; Strand=-
  SCN-specific regions: Sequence locations=1-32,55-299,335-1328
atggagccaagaagtcgcagtgttcgtccttatcttattcaatccaatgaagtcgacaaattcttgagaaagcaacgtcttccttcgccatatcgtcgacctcttgcatatactcttgagaaatttccaaaaaacgactctgatgataataaaaatcccaggacgaatacacatttttcaccaccattatcgacgaggattaatggatctaatggcaccgcaaactctgttaattgttactcggactcaaattctgtccagccttcgttgtctaacaaatttttggagaacagagtgggaaaatatttttgttataaaatttaaaattaatttagagaagaacatctgggagatctccatcagtgccaccaagaaattattcctcgtcatattctggaaaaattgatgggtacgacaccaaatcgacttatggacaacggttaaaaggtcgatccattactattaaaatatcattcaaaagataaccattccatttttgtttttttctagaaggtttttttgattaccagcaacagaacggaggccgagttattccggtacagattaatgctgacgaggcgagaaagaacaagacatcggccttaaaaatattacgttctttctttaagaagcatcttggcttctctaatcccacacataaaagggattattccgtcgagccgattgacagcaaacgcttttcctcaacgctaaatgttcgttttgttaagtgcagtttctgctgtgaaatttgcgttgcgtttgaagtgccttttattgcctttaggttaatggtggactcccttcctcgtcttcatcgtcagatccttatgagcgtcgtcgttctaattcaatcatttcgtccgctttcccacggcgtcagtcgttcagttaccgaaatggagggacaactgattatgcaccaataccagccacaaataacatgccgtcttctcaatttaatcacgacaggcgcaaaaacggggtgacaagtactgattgcgagtcggatgaaccaccacagttcgctgaactgatgcaacgtttctcggatatttcgacttccgacatacgtccaaggcttccgtctgcatcaatgtatcaatttcctaccaagattggctcaacgtcgacgaaattttccacgtcgacgcttcctccaacgccttcgcctttttctcgaccaatgcataattcgttaaagcccttacaaccacggccaacgacgagtgatgcacagcattcattcagagaaaaatccgctgctaatgatggggagttaatgctgaaacaacattctcggagttcacaagttccttgtcttaaag

SEQ ID NO: 78656 - DNA, 131 bp, Heterodera glycines
  Genomic contig location: Contig_ID=SeqID_14585; Location=2301..2431; Strand=+
  SCN-specific regions: Sequence locations=1-30,60-131
ggtcccggttttgaccagttttgaccgggaccgggaaattcccggcttttttcccggttttcccagccaaaaagtcccggttttcctcccaaaaagtcccggtcccggtcttgcccaaatttcccggtccc

SEQ ID NO: 78657 - DNA, 427 bp, Heterodera glycines
  Genomic contig location: Contig_ID=SeqID_14586; Location=1710..2136; Strand=-
  SCN-specific regions: Sequence locations=1-427
atgacgtaagaaacatcatattggtattagataatgaatcgatttaattacatttgtaatttaaatagaaaaaaagattatttgaaaaaatggtttaaattatttacctatttgaaaaaatggtcaaattaaaaagcgcgtaaaactttatataaaaataaaaacaattttcagtattttcttaacgatttttgcaggatcacaaccggtgcgaattggtccgagggccgggaggggtggcagggatgtaaagtgtggtgttctccttataagggaaatctagggcttgagtgtgcgttagaattgatcgaatcgaaaaacaaatggtattctgcacatctacagactctgctctttaaaatgatataggatagattagggtccgggttcgggaagtagtcgaaaaagggatatcaggcttattaaa

SEQ ID NO: 78658 - DNA, 2407 bp, Heterodera glycines
  Genomic contig location: Contig_ID=SeqID_14586; Location=551..2957; Strand=+
  SCN-specific regions: Sequence locations=1-110,133-190,213-282,304 -441,479-705,733-841,863-956,978-1150,1172-1482,1504-1584,1659 -1946,1970-1979,2010-2037,2060-2091,2113-2218,2250-2262,2295-2407
ttgtacctctttgatcactgttgtacctcttttaatcacagttgtacctcttctgatctctgttgtacctcttctaatcacttttgtacctcttttaatcacagttgtacctcttcatcacatttgtacctcttcaatctctgttgcacctcttctaatcactgttgtacctcttttatcacttttgtacctcttcatcacatttgtacctcttctattcactgttgcacctcttctaatcacttttctatcactttttcactgttgtacctcttctattcactgttgtacctcttcaaatcactgttgtgtctttcccttccgtggttgcacttgtacctcttctcatctctgttgtacctcttctcatctctgttgtacctcttctaatcacttttgtatctgttctaaaatttaaaaaacggcgcgaagcggccgttcgaggccgcaaattggcctaaaaaggccacaaaaagggtgcgaatcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgaggccgcgaagcagcctaaaaatcaccgaatttaaaaaacgggtgcgtagcgcccgtctgaggccgcgaagcggcctaaaaatcgctgataattttttaaaaattccaaatcttttcacaacccgatagctaatctaggagcgaagctcaagaagcgcgaagcgctttatcccagctaaatagccgacggttcacgcacccgctagtttttcccttatagagtgaaccaggggcccagtgaaagcgccggggccgctttcaacaccggggccagcatacatataaagcattcctaatggtggtgattttcccgaattcgcaaaaaaaaattcacttagattctaagcctgtacgaaaatgccaagcaccgatcttgagtccggcattatagatcttgccaatttgcacgtaggtgatctctacacatataaacaatatttcctagcgtgttagttttcaaaaattcgctcaaaaacctccctgaatccctgcatagcccactgagccggattcagaaaaacagggcagaaaacatgcacatttttaataagcctgatatccctttttcgactacttcccgaacccggaccctaatctatcctatatcattttaaagagcagagtctgtagatgtgcagaataccatttgtttttcgattcgatcaattctaacgcacactcaagccctagatttcccttataaggagaacaccacactttacatccctgccacccctcccggccctcggaccaattcgcaccggttgtgatcctgcaaaaatcgttaagaaaatactgaaaattgtttttatttttatataaagttttacgcgctttttaatttgaccattttttcaaataggtaaataatttaaaccattttttcaaataatctttttttctatttaaattacaaatgtaattaaatcgattcattatctaataccaatatgatgtttcttacgtcatattatattaataaaaaatttgtatgaataatataatttatgaaaaatgaaaaatgattattttagtattatacaaaacgcgaattataggattacaatttttcttgataatttgcattaaatcattttcataaatttatttcccattaattttttttatagaaaaatgaaaacgaaaattttctatatttttttgtcattgcttttgctattctctctgatacaacgaaatgagtcgacaaacccaaagcatttgaaatttgttggaagaaatgggaaatcagtcgaaaatgggcatgaacagaaagaacaaagtcaaaaaattggtaattaattatgggtaattagcgggtggaaggaattcaaattttattaaaaacccacaagaaaaatgaataaatttaataaaaaaaatttataaaaagttaaaacattgttcctatatttgtgttcaaaaaagaaaagattattttattattcaccggagttcactcaaagtttaataatcgttttaaattttaaattatgcaaaaaagaaaatttaaaaaccaattattttaatgccttttcagaggatccatcaaattctgatgacgccatcgttgatgctaatgagcaagttgaggcgaataatgaagaaatgaaaaagaacagaaaaggaaaggtagcgaaatttgtttaaaatatttacattttaaattttaatttaggcaattattgaaatgataatgtcgcctaaattttcgaaaattgttggaagaaaaggaaaacctatcgaaccaccacaaacaaaagatgttgatgaacaaagagttaaaaagg

SEQ ID NO: 78659 - DNA, 1942 bp, Heterodera glycines
  Genomic contig location: Contig_ID=SeqID_14587; Location=400..2341; Strand=+
  SCN-specific regions: Sequence locations=1-127,182-233,264-295,361 -710,734-771,808-1028,1064-1431,1455-1659,1725-1910
  Gene Ontology: Mol. function=catalytic activity; Cellular component =brush border; Biological process=protein modification
atgatcagattatgcttggcccaatgtggcctgattaccattgtggctttcctgatttcttggaccctttgccgaacaccacagattggtgggtggacgaatttgtgcgtttccacaatgaagtaagttttttaattaactaattaaatgttttttaattttacatttttatcattttattccaacattatttaacattcattaaattttctgaaaaataaattaaggtacaatttgatggaatttggattgatatgaacgaaccgtaaggaaatcaaattaaaatgaagaattcaaaaataaatttgttttaattgaaaaaagtacataaatttattacatagaaattttttaaattttgcatatttttcaagctccgtctttggcacaaatgagaaacatccatggtactttgacacgcaacctgcatttgccggcaagccaccaattgcgccgctgatgtgccaagagccgaacaacaaattggactacccaccgtatcgcacatggaatgcatacaaatgggactcgaagaatacggtaagtagagaatttgcctgacttgaaccaaaatatgatccacctttgggttgcctcaaaaattttggtcctttgatggagatttttcttgattttttttgagtctaactcaattaatttgtttttcttatctcatagcaaaaatttagtttggacactcaaaagatggcaatattttattttattttttaatctcgttagtgagctctaatggtgtaatttagaaaatgcaaaattttatttcattattaattttatttatttatacaatttgcttttatgaattttttaaggatttttaatttaacttggcatattttgtattcaccctaaaataatgtcaataagttttagattagaagctttttttaaaaaaactcaatgttgttaataaattttttagaagagaacgctgaacgaaaaaacattatgcatgattggaaaaagtgggcgccgcaactggacaatgtacgatacggtaaatgatcaaattaataattaatattttaatttttaattatttcttaattggtccagcattctctctacggctggtcagaaatggtcgccacacaaaaagcgttgcgcgtctcaactggcaaacgcggctcactcacttctcgttcaacatttccagtatgcactggaaaataattaaacacattaatataggatatattttgcagatatgtctttttgctaatttcctatttgtaaaacgcacgaaaaacaatttttttaaatttcaaatgctagcttttttgttcttgcattttgaaattttggtcactaatgcccggtctggattttctgaaagtttcttaatataacgtataaaatgaaaatacccctaaaaattttgcaaaaaatactctcttaaaagtgaccttgaaaaaaatatatatttttttaaacacacccgttaaaaactggaaatttttcacaaaaattcacctcctaaattttttctctcaatttagaattttatgaaattgatttaatttcttccgtagttttttttatcatcattgccattttcagaaaatatttgaattaacaaacagcaaatattttaatttctaagttcaaagctagcgcaaattttaacaaagatttttgaaaatatattacaaatttctatattataaatatgcttttaaattaacaataaagataaattaattcctcaattttcagtcatctggccattacggtggccattggcttggtgacaaccaatcccgatggcctgatctccggctgtcaataatcggggtcatggagttcaacatgtttggcatcccacaagttggcgccgatgtttgcgggttcatcggagactcaaatgaagtgagaaaaataggataaagcttatgttatatatattttttaatgattttaa

SEQ ID NO: 78660 - DNA, 921 bp, Heterodera glycines
  Genomic contig location: Contig_ID=SeqID_14589; Location=221..1141; Strand=+
  SCN-specific regions: Sequence locations=1-12,36-124,146-236,258-921
atggaagcggaagacgacgacagcgatgacaacgatgcagaaaacaactacatgcttggctatgatgaggagggagagaaaccacgctccgtcaccacatatgccttcgcccacgcaggtaaacaaattttaacaaaaataaaaggaaaatttatcgatttttaagggtcacgttacgatcacgtgctgatctacggcgagatgctgcgcatgggtgtgcgtcccgaactcgtgcgccatgggaatcagctgctggagatgaaggcccgcaagaggggagccatcacaacgacaatcttccgggacaggtaaactgtgttaaaataatataaaataatcgattatttttcagttacaaactgattcccatcaagctggcttcctttgtgaagacgttcggcttggaaatagagggagtggacaacaagaaatacttcccgcacaagttcaacaaagtaaaaaaatcaataaataaaaccaaaaacaatcaataattaaggctgcaaattatggtgttgtgctggacactcttccgccgcttgaggactactaccccggcggacacttccctgaggagcgaaagaagctgaagcagtggtacgaggagaaccgcaacacgccgtttgacctgcgcgaagtcatcgcggactactgtaaagcaggtaaaaatcggtaaaatcttgaaaaatatgcaaattttcttcagatgtccaaattctcgcccatggaatggtcaaaatgcggcagttgttcgccgctgcaactagccaggagctgaccgactccatcaccatcccgtccgcctgcatgaagttcttcgtggtcttgtcgcacgtcggcaaagagagggtggccatcatcccccaccttggctacgagaagcgtgggaagcagagtgctatcgcccgaaaatacctctag

SEQ ID NO: 78661 - DNA, 881 bp, Heterodera glycines
  Genomic contig location: Contig_ID=SeqID_14590; Location=288..1168; Strand=+
  SCN-specific regions: Sequence locations=1-197,225-737,759-847,869-881
atgaattttaaattttccttcgcaggattctcaacgaccatcccgcacatcgagctcgaggcggcgctgcgatccggctacagagttacccatgtctaccgtgcgtacgtctggccgctgtattgtgaatggagtaacggcctcttccactcctacctcaacaaattcctgcgcatcaaatttgagggtaagtagtaaattgatcaatcaatcaaccaatcaataatatttagccagcggtttccctgctgactgtgccgctgatgagattgacgaggaggatagggagcgcagaaaggagcaatacatcaacaacccctggaagggctgtacggtgcggctcgacgccaacaacatcaagccaaatcccggcatgcggtacctttcgaagctgtgcctcaactcgctgtggggccgctttgccttgcgcaatcggattacgaagacggaaatcatcgattgccacgccgaccttgcgaagcttctgaacgacgtcaaaaccgacatcagcagcatcgaccaactgacggagaaattctggatggtgtgctacaaggcgaaagatgagcacgtggtggagcacgacaccagcaacgtcgccattgccctatggactacggcagcggcccatgtgcacttgctcaactcactgcaattggtctacaggcaggaaaatctagttcagcgctacgacacgcgcattttatacatggtaagagtgtgacaataaaatattcataataaaatattcttttttcaggacaccgacagtatcttccatgacttcaagactgcactgggggacccgctgaagggaggcaaccaacttggggagctcgcggacgagtaccccagccataccatcgtcgagtttatctgtg

SEQ ID NO: 78662 - DNA, 49 bp, Heterodera glycines
  Genomic contig location: Contig_ID=SeqID_14591; Location=346..394; Strand=-
  SCN-specific regions: Sequence locations=1-49
atggcactggcattttctgctttgtatgcttcaattactaaaaaagaag

SEQ ID NO: 78663 - DNA, 1484 bp, Heterodera glycines
  Genomic contig location: Contig_ID=SeqID_14592; Location=2193..3676; Strand=+
  SCN-specific regions: Sequence locations=1-62,84-472,495-1044,1066 -1336,1358-1484
atgccaactgttcgcgaaatacttgagagtctgcaaaagcgagtaaaaaagcctcgcattgctacaaatgaagacagcgtactgaatgttgagaggacagacgcagaacaacaaattgaaggcacttcaaccaggaacaatttgggcgtcgcttcgagtgatgacgaagaaaattgtgagcccgttcaattcaaacgtgaagaaacaatccggggagctctttgtctttggtatcaaggtgttaatagtttttttttgatttttatttctttattttcaggctttcgatttatcaaaaacagaaaagatggtagctggttcaggtgcgaacagcgcaattgtccagcgacagccaaattggacgacaacgatttgatgacaggcattttgggcgcaaaaggacatcaccatggttgcgcaccatcgcgttatgatgcagagacgaaacgaaatcagatgaagcgcctgatcaaggaggagccaaaaacgaaaccatgtcaaatccgcgctcaaattcggactgacatcgacgatgaagtcttcgaattgctcggcaccaatgaagcgctcgaccaaatggcgaacaggtagacaaaattcagagaaaataatgatgcaatatttagaacaaagaacaaattcgttaggtggtgtcaactgtgccgacccactgaacatacaaattccgcctggtcttttgataaagaatgatgagtctgtcctcatttatgacagccgtgaagtgaggactggacaatctgatggttgacaacgaagcaccgattcaataggacatccgttcactaaacattcaagcgcttctgacaacgtaccgaggagttacattcaaaaatgggacgaatggctgacactgccggtgtgctactcggaactgagccgtgacgccattttgcacttcaccgtttgggaggtgggcaacacaattgagccggtgagtgaaatgtcttatatttaaaacattcttccgtccgctattttcccaaaaaataactgcatcggacaatgagacaatcttttattctgattctttcgattcataccatctttatagaactagttttttagactttactccagcataaatggcataaatttatgaagacaacaaatttaaaattcatataaacacacaaattctgtgtcgagtaacatatgaatacgaaaaaacctcatttatggatacgtctcggattgcgaatgatttgcattttcaggtgctggtcgcccaatgtgccaagcctttgttctctaaacatgccattttccgcaacggtctcatcgatttgactttggactttgttgccaatgcggcgacaacggacaaacagcagagacggcccgccgtacaactccaagcagcacacagcaaaagtccgtcgaagggaatggcgacggaaaacgcccggccggcggaacagtcggtagaagccgacgacagcacgccgctgcatcagcacaactaa

SEQ ID NO: 78664 - DNA, 624 bp, Heterodera glycines
  Genomic contig location: Contig_ID=SeqID_2241; Location=393..1016; Strand=+
  SCN-specific regions: Sequence locations=1-82,124-339,361-374,396 -400,428-624
atgccaaaagaggaagcttcagcggcaccgttcagaaatgctttccaaccgttgctgatgggaaaagttcggatgtgccaagaaggggccaaagaagaagaggaggaagaagaggagaatgggcacgaagtgccaacatcggaaggtaaatttgaaattgtacaggaaaggaagagggcgaaaaggtggatttgattacatataaggggaagggagggggataacgggggaggggggacgaaagaggaaaaggaagtaggaagtctttgaaaagggaaatggctaatgaaaattcaaaaatcaatttcagaatcctctcaatcggaggacgatgggattttggccaaagatggggaacagaaagtggagatgaaagaagaggaagaggagcaagattttggagagagtgagctgaagatggagcaggaacataagcagacgaaggcggagggaaagagagagggcgacgagagagacaaagggaacacaacgccaagagagggtgcgtttgaacaaccataccagtggaagctcgtaattaaaacgaaagtccccccagggcatactgtactatcaaaaagggaaggaaacggcgatgggggcatcagaaaagcaaaggaatga

SEQ ID NO: 78665 - DNA, 3327 bp, Heterodera glycines
  Genomic contig location: Contig_ID=SeqID_2242; Location=1669..4995; Strand=+
  SCN-specific regions: Sequence locations=1-44,70-80,102-222,249 -278,300-425,488-1029,1051-1159,1182-1203,1300-1317,1653-2249,2300 -2309,2331-2450,2473-2612,2636-2819,2842-2896,2935-3117,3154 -3163,3193-3230,3252-3327
  Gene Ontology: Mol. function=calcium, potassium:sodium antiporter activity; Cellular component=outer membrane; Biological process =calcium ion transport
atggcgcccgggggcaaaacgtatgctcgacttaaaaatgtgagtaaatgaataaatttttgatttgtatttttcgtaagtaaatgactaaattttgttatgtcgttaacatgtttaggcatcaaagcccatcggctcgtcaagttcatcgtcagaggatgaacttcccagcaggaaaaaaaggccactaccaaccatgaaagcaccaatggtcagtttaagtgtttaaaatttttgaaattttttcaagtccttttccgccagtgaaaaggatggattttaatgagaaaaatttgtaccaaatgaaaaaaattttttttcttaatactttagaacgttgcgaatcgaaccggcctgggcaccgacactgcactggtccaacagccagcaccaaaaaaattgcccattacacgcaaaagcgtgggtttaaaaaattaattaattttatcaaaataataaatatccgtttttttttttaaaataatttcccgttaattttgtaggccaagggaaataccgccgcaccatcctcctcctccgtttccgtccgcaatccaacgcgccgcgctccttcaacccgtaaagctgttgcacaacaaccgcaacatcacaaattggaaaagcgaaaagcggtaaatttgcgctgaaattttttatgtgatttttcattaaaataaaaatgacaataattgtattaattttggattttttttttttgaatcaggcaacaccgcaactggacgacaattgcccgggggaccaccggcacccatcacagaccctgttggagcagcagaacaatgcgttgtaccggctcctcttcgatggcagcaacgagaactacttcacccatttggagcgagcccgtcacctcgtccacacatgcgccgtgtgtgagaagaagtacgagttcgtgttggtgcggttcccggacacaggagtcgagactccatggcatcctgtgttaccaacgcatcgcaacattcgtgatggttggacgttgctagacctagcaatgttggtaagcgaaatttgtttcaatttttgaaattggtcatcggaaaaaaaaaaatatttgaggagcccgacacaatttacgcttttgacgcagcatggcaacaatgtgttgcacctgatgatgcgattggagggaatgaaaatgatgatggtggcgatgatgagaacggcagaggaaacaacagcggaggaagaaacaagaagaagggcggaggaggtggacagaaagacggaggagggagcaaagacggagcaaatggaggaggaagagaagaggaggagcaaaacgacaacaatggaaagaggggagaaagagagagagaagaggaaagaagagaagaggaggaggaggaggagcaaaacggaaacaatgaagagaggggagaaaaaaagagaagggaagaagggagaggaaaagaaggaggagaacaagacagaagagaagatgaggaggacgaaggaagaggcgaagaagaaacaagagagagaggagacgaagaggaaacggaagaagcaagagaaaaattgaagagaggtgaagaaaaaggaggaggagagaaaggaggaggaaaagccaaagaaggacgaagcgaaggaggaggaaaagccaaagaaggacgaggaggaggagtaggcgagaagaaacagccgccgcccgggtcaaaaatggtgggacatttgttattttgtgaaatacgaaaacgcaaatgtgtattggccatcggaggtcaatcctttatgagtattggctaccgaagggccgggtccgtgggagtgttggtcgccggagggccgagtccttgggagtattggctactggagggccgagctcttcggagtattggctgccagtgggccgagctcttgggggttttggctaccggaggaccgaactcttagggatgctggctgttggtgggccgagctcatagaggctttgactgtcgaagggccgaactcttggggattttcacagattctaaggcgtaattttatctggccaatcaaaaatttcaatgttaaaatttagacccactcacagtggcgcagagtgatgcgcattaacaaaaagaaaggagtgaaggatggacgagccaacgcacatccgacaacaattttcaatgttttataattttttcgacaaattttcaatgttttatatattttttttttgtttaccaacaataacaacatttcttatctcccattcaaatctttagggatagtggatcaaaataacaaaagaaaagaaggaaagggggtttgggaggggggtccaaaacagatccacgctcattcattcattattcacatttattaaaaaaatggaaccaacaaatacaacttggatcattgagcaaaattgttcttgcaacaatgatttgcttcagtgcgtccggcccctgtactacaaatcacccgtattgtgtgtgcccattgaatttggcaccaattttgtgcaccatttgacccaattttcaaaacccccgtccctcaatgtcccacttgttgttatgatcttactgattctgctccaggtataaaccccctacaaattatttatgtttgtatgtgcaattaatattttacagttgtgtcaaatcatcctcactttgttctatggttatcgccgtcgtcgccgtcgaccacgtgtccgttttcctaccaatgtaagacccttcacaaattttggcaaaaatttttttcaatttttaaaggacactccgctctcgccattgcgccgctttcctccaccaccgccgccctcaattgcaattcgggcaacaacacagaaagtgtgtttaattttgtttctgtttgaacaatttgtattagcatttaacattttcaacaggatcagcaccacacggatgagcgcaaaaatgaacagttcaaaaagagggaggaaccgaagggggcggaggacggacggcgcaatttgcacaactcatcggtggttaaaaataaaaccattgttatatttctaataaaattaaagaagcccaggacgtttccgttcaacaacaaagcagtgatggatgggttgccaaacaacaagcgcaacaaggacaagccgttatacggtatttgtttttgttgaaaattaaaaaatatcacaatattattattattattcagctttggcaagcatcccggaggaggaggagacaaaaaagaatggacgtgaaaagacggcgctcgtgaaggatgacaaatatggggacaattattttgaggattgctattaccagtccacttgggtctaggcaataatttttcatatgcatttttttttttttgctaaattca

SEQ ID NO: 78666 - DNA, 497 bp, Heterodera glycines
  Genomic contig location: Contig_ID=SeqID_2242; Location=5028..5524; Strand=-
  SCN-specific regions: Sequence locations=1-64,86-497
atgtccccatgccgtcgttttaaatctcgcccccagaaaaaaaattccgaatataaatggcttcatattgtgaagcgtcaaaaacatcgccagcagcggcaccaacaaaaccatttcaatgaaatgtgcgtggcatttcagagtatggaaatgtcggaatcggcaagacccctgcctggtggaccaataaatggaccaaagtccttcggtagaacaatttttgatatgcattttcagttcttactgtaatttttaataattttaggatgtgcatttctgaaagaagaaatcgacaaacagatgacgaatctgattttcacaatcacaaaaatcgaagagcgctcaaacggactacccgacccgcaagcggcgcacctttatggaatagtcaaggagcagctcgaaagaactgttcgtcaaattgagaaggactgcttgtgaatcggtattgatgatgggaattattttggtggtgatgggattattttttaaataaa

SEQ ID NO: 78667 - DNA, 384 bp, Heterodera glycines
  Genomic contig location: Contig_ID=SeqID_2242; Location=5655..6038; Strand=-
  SCN-specific regions: Sequence locations=1-384
atggcagaacaatttgtacaacccgaaactgcggaggagcaacaagtgaaagctaagaagccacacgttgatgagcgatttctttggaaaatcacgcggggccaatttgtgcttgcgattcggctgtgctcaggttaatcaaatttttgacgaccaaattaattgacagctttcagaggactggaacaatttatttcacaacaaagacaaggcacgccggctggaagacgggcgagtggcgattggactcgagatgtgtgaagaatgtgccagaatcaattgctgtgtcagtgacatgattgctgatcaaaagaaaaagccaaaaaccaccaaataattcatcaaatttttcgcattatttggataattttgactaccaataaa

SEQ ID NO: 78668 - DNA, 495 bp, Heterodera glycines
  misc_feature (446)..(446): n is a, c, g, or t
  Genomic contig location: Contig_ID=SeqID_2242; Location=6180..6674; Strand=+
  SCN-specific regions: Sequence locations=1-301,323-495
atggtccttgtcatcgaattttgtgcccaaattctcggctgttccccgaaatcactccgcgacaagctcaatcatcctgaggaccgagtgaaggcactgaaggagctggtcggaaaaaaggttcggacgacataccaggaccggaatggaatgcagaaaacattttttgtcgacggaatatcggaccatggagcggctttgaccccagcatacggcagacttcgacaaccatacaacattaacattgctgcccatttctacgctcggcaccgtatcaagctgcatctcccatacgtgccatgtgttgtggagaaatattctggatgtggcgaagacagatactacccaatggagctactcgaaattgtggacgaggactacaccatcaaagagcgatggcttggcaactgtttaccgaaatcgaggacgacttcattcctctcaancgctgtggtcgagttgacgaagacgaagaaattgacgctggtcgtttga

SEQ ID NO: 78669 - DNA, 1744 bp, Heterodera glycines
  Genomic contig location: Contig_ID=SeqID_2244; Location=182..1925; Strand=-
  SCN-specific regions: Sequence locations=1-326,348-1133,1156 -1157,1179-1744
atgctgatgccgaacggaaagactgctggggaggtgcgagagcgggatgagaagcggctggaattcatcgaaagccaagtttctcgtgtggacgtgtactgggagtgccaaattgaaagaatgctgcaccgtgacccgtatatgcgcgaaagttttggtgattatgtggatgacgggccactgaacattcgcgaggcgttcatgggtggaagaacaggaccactgaagctgtaccacaaggcgggagagggcgagaaaatctcatactatgacttcacgtccctctacccgtacgtaatgtgagttttgtttcgatcattatttacaattcataattattttaattttcagtttctccaccacttacccaattgaacacccaaaagtgctcatcttgaatgaggatgtggaatggacaactgcacgggacaacccatacaaattgtctctgctcaaggtgtgggtgattccgccacgaaagtgtgatgtgccagtgctgcccgtcaaagtcaacaaacggctctgttttccgttgtgcatgcagtgttgtctagactacccgaagggaggcgttgattttgactaccattgtgaacacgacgaccaacaacgcggatgggtgacaacatgcacatcaattgaattggacgcagcactagaagagggctaccgcgtgaccaaagtgttccgggtgctgaagtacaggcatggcgacgacaaacttttccgcccatacatcgccgagttcatgtcgcagaaaattgaagcctccggatttgacgccagcatcaagggaaatacggagttggagcagcagttcatcacagaatgtgcggagaaattcggaatttcaatcgacaaggacaacatgaaagtcaacaagggcaagcggtcgttggcaaagctgtgtctcaacaacctgtgggggcgcttctctctgcgcaacttcggtctcgcccagacgttgatcaccgacgacccttcagtgttgactgaatacgtggaaaacagctcaatcgacatcatttccattgatgagctggacgaaaaacatcaattgatcagctacgtccagaaaaaggagtgggtggaggagcacgagtgctccaacattggtgagattttaaagaaattttgtttaatttttgggatttttcagtcatctcactctggacaacatcaaaggcccgccttctgctgttgaaagcgatgcagaaggtgatgagaacgcctggatgccgcctcctctacacggacaccgactcgctgattttcgtccacccgatcggcatgaacccgttggagacaggaccacacttgggacaattcaccgatgaataccccaagcatgaaattgtggagtattgtagtggcggagcgaagcaggttaatttaccgtttatttagtgcataataatttactttatcatttcagtatggactcaaactccggcgtaatgggcaggacgaatttgtgctgaagctgaggggcatcacactgaactacgacgtgatgcagaaccaatccctatgctacgacacattcaaagaagaagtgttgcgatatgcccaaaccggagagtatgagccaataaatgtgatgtaccccaactttttgagacccgacattaggggtggcggacacgtcacttcaggccccctccaaaaatgttatcgcccatatgtaggcaaagggatagtgggctctaattataatgtgcttaattttggacacactttgtaa

SEQ ID NO: 78670 - DNA, 414 bp, Heterodera glycines
  Genomic contig location: Contig_ID=SeqID_14593; Location=1112..1525; Strand=+
  SCN-specific regions: Sequence locations=1-101,123-223,245-414
atgccttttgtcatgggtccatctgagtccggtgcaaagtccaaaatcagtcagtttaatatggccactccggtcgatcagaatgttatccggctaaacgatttaaatgcatttgaaactttgaaatcaaataatttgcacttttatgtcacgatgaataaagccaagggaatggacatattccacggccaaagtcaactcggcaatgtaaaatctgtaatgtttggcgttaaacattcaaagaagtgaatttagtctgaattgcctggcgagactttcggggaaaatgcccatgttaatctgaaaatgatctgtgtgtagagagggcagtttgggtggaccaaccagaagttgcatcatatcgcctccggggacgtattccatgatgaaataacttatgtaagcaaatgggga

SEQ ID NO: 78671 - DNA, 1197 bp, Heterodera glycines
  Genomic contig location: Contig_ID=SeqID_14594; Location=292..1488; Strand=-
  SCN-specific regions: Sequence locations=1-492,514-944,966-1080,1102 -1197
atgggttagtaggcttgcaaatataatctaaccaatcttaagtaaataacgtacaaaattttgatcgagggaatcacccgttttgagttttgatgggtcgatctcacagcactttctctcagcaaaaatctgaaatacaatcagcaatcccattgacgagtaatccaaacggaccaagtcaatgagtggcttcagcgaattgaataaataactttgaccaacaaatttcatcatttcgtacatgactttggaagccaaagattggctgcgaaacagagtattcacatcgctaaatgaaaattgaatgctttaaattaattaggcttggcgtggattacttgcaacttttgacataatccatgcaaattgcacgaaagaattgacgaatttggttggaatggacaaatattttcatcaatggcttagcgaggttttccaggtcgaccttaatcataattatcaaaaacaaagacacaggctaaggcacacaggtaaacattggatgagtgagattaaagagcatgcgtgaggatcaacgttcagagagcggacgagattcaaatagaggggccggtagttgacaaaggggtgcacttcgtccatgtcgtacctgtcgattggattgaatattctttccttgaccgtatcttcccattcccaaatttaaatgcttcgagttttaggatccgttgtttatttttagcctaccaaagtttgagacggacttccccactgtcctgctgattgtttgacgtggacagtgagcttgaggagaagggcaccaaatgcctttgatttggttgctgcttgttttttttattgtataaaagacaatcattgttgttgagctcatttacgccaaatggagaaaacaatggcgcagcggaaggcgtagtcagcggttttaatcgagcgttagccacagttgtgtgtgaaacagtagcgaaggaggaggccgaagaagccgaggccgagccaggcggacagtgccgatggaaagcgggcgatgaattggatgggacaacagaaacgcgacgatggtgggaaaaaccacttgggcaaggttgtttctgcagcgtttgtgcttgtttttgtggaaaaggagacgttggagttgagttcaactctgacgttgtgagttgtttagaaattgatgaacaaaaagcagtattattggtaacaaaagtaggaaattga

SEQ ID NO: 78672 - DNA, 1151 bp, Heterodera glycines
  misc_feature (479)..(479): n is a, c, g, or t
  Genomic contig location: Contig_ID=SeqID_14595; Location=849..1999; Strand=+
  SCN-specific regions: Sequence locations=1-23,47-230,256-395,420 -777,811-882,904-918,956-1021,1044-1151
atgtcccaaccatacgctaaaaggggtgggatcaaaaggtgggtgacgcctaatttaaggggtccggcgtcctaggtttatatgagacaggggtttggggttcgaatccgcttggctgcggattattttttacgatacattaggaaaacccgtggacaaaaacattgattttgcaaatcttagctcatattcgtgatcagcgcattttttaccccgaattaattgtaaagaattttttttaataataaaaattttggaaaaaatcaagtacttgatgaaaagtcatagacaaaatcaatgattttgccaaatctgagttcaattcgtaatcagcacccttttttacctcaggaaagataagacttcgttatcacacgtataatacgaaatttattaagaaatatttttcttttaggattatactgatccagaaacaacaacgccgtcagctgatggttaagaaccggtccatcctgacntcacaagttcagcagcaaatgtgcgctgaaattgacttggaacgggagttacacgtcgtttacacaaatttggcgactcacatggacacactttgtgatcacaattggtgctgtcgcttcgaatgcgcacggtgcgacggtgggaagtgaactcggaatgagtgcacggattcgaggacggatcgctggaattcgatgggaggaagcggccttattaattattgtttttttattgtaccgattcggcatcagaaatattttgattcaggaaatcagaacagaacttctatctcgttcttttttgtaaatgctcttttatctgtccctccttcgtttgtcctctcaaatacattatgataacctctctaccttcacaaccattcaaacaattttgtcacttggatttcatttaaactgtaatctttgtttgttattatttatatttgttgtaaaaatgattgattgattgacttaatgaaaaaaaactccttttttcagttaagaaaaagaggtgtcacatgttgtgatgttaattaggtgattttaatatcaaatatagttatagtttctgttgtttttttgtattgaaattggaacttaatgttagcagtttaaagggtcacatgctcgatgccgacgttgactcccaagtcaattaagatttacaacaca

SEQ ID NO: 78673 - DNA, 1119 bp, Heterodera glycines
  Genomic contig location: Contig_ID=SeqID_14596; Location=28..1146; Strand=-
  SCN-specific regions: Sequence locations=1-507,529-1119
atgcgcatcattcgtaacttctttttcattactaaagcaatccgcaaatggctcgccatcaactacaacgacggtgtgattcccgagccgcccgtccgttgcatccgtcccactcgcttgacgcgtcgttcgactccgatggactcgcgcttagacagccaattgagtggaggcctcaaacactcgccaattgaccaccgatacagttgccttgcaattaccaatgtcatttctcctcgttcttcagggtccgttaagaattacgacctcgcaactgcactaaaagagcgacacaatcggagtggtggcattggcattgaacatcgctattacgccgaccattcgtccgacttcctcgcgcattcgtcgtcgctcagtcttcgttttctgctgaatggcctcgcacgcagtttcactggatgtctggccgaccctgacgaggaaatgaacacgcagcagggggaaagtgacgcctcccaggaaaatgtgtcatttacagcatttcttatacaaatagccttttacttgtaattatatttgttacttctccaatctgccgccctgggatggtttcagaatttcgccttggatagggtatggtccggcgatgactttgaaggccaaaaatttttgcgctcaattttcaaacagaaaagaaaggaggccggcggagccgaacaatttgatacgatctgttaggaaaataatcaaatttcccttaaattgagaccatgacatttttaggtgtatgggggcgcataacattgggtgcttttgcatggataatcttaacacggactttctatttaaattggctgcaagttttcagactggtgagaaaaaagctggtgcggacttcaaaacctcggcggaatttctgaccgatgcttcggaaaaccgtcgcagaaatgaaatggtaaacaatggaattcatttgcaaggctaaagtttcattttgcaggtcgtggagtctgttctggagaacgatgccgtacagaaactgaatgccaattcgtcattgagaaagtgccgttaccgatgccgattttcgacgacgccgccactgccttttccacgcgtagagtgacactgaccatgccattgacacttttcaattga

SEQ ID NO: 78674 - DNA, 1808 bp, Heterodera glycines
  Genomic contig location: Contig_ID=SeqID_14596; Location=3041..4848; Strand=+
  SCN-specific regions: Sequence locations=1-83,119-383,405-1763,1789 -1808
atggggcaaaagccggtgatttgccattggtgtgagaccttcgattttgtgcgttatggtaagaaatgcgaacgaacctccgaaatcatttcaatgttaatttttctcaaggtgattatgcaatggggcgtttttcaagacagtaagcaaaattgaagaagcaaattaaaattgaattcatcacttttaagttggtggtacccttgccaaacagtgtcaaatgatgaatttccacaaaagaacaaccctttgttgggttctgtcgggtatttgtgtgtcaaatggtgggttttttatgaaccaatgaataaattgtaagttaaattttgaaacttttcaggttaccgtataaagggaaaatactttacaatcttttgtcacataatcggtatgtttgtggaatttgttgtgtaatggtctcttcctcttccttggcaatagaattgttgtaatgactgatcatgattacttttttgtgagcgaggcacaaacatcggacattttcaggggtttcctttgcttacggcaattattattatcattttttttttgttttttagagtggcgagaagcgcaaaatttcatggtacggaacaacccactgaacagaccactcaaaagtgatcaaattcccgagaaagggattagcaatgggcagcggatggtcaagcacctccaggtaatcctaatcaagcaaaaattaacaaaggattcgcaatcccggcctcgttctaccaacgattagcgtcccagtggcatggaaattgtcaaaacgatcggataatttctcacaatcagacaaatctgaccactttcaaggggactatgttaaaactgatttttttcctcgttacctttcccttttataatctttcactatgaaaatgaggcgcatcccttgttaataatgcaatatcattcttaaaaacaccaattatgttggtttacacttaattgtttagcgtaatcactattcaaaagcggagctgaaaactcaaagtgaccgtctgttggtgcccgacttttgcaattgtccgaatggttctgaccgatgtgggccgtccaccaattgcatcaatcgatcgcttctgcaagaatgtccgaagggttgcggagaagacttcaaccttggctgtgccaacagacgcataagcgagggaaacaattgcatcaaaatcgagataaagttcttcccgggcaaaggttacggggcaattgctaaggagaaagtgccatctgtgagttttttttcatcgaattcggcatttttatttcttatgaagcgaatagttctacattctcactgttcgtccttattcagggtggctttgtcggtgaatatgtcggggaagtgattagcaatgaggagggaaggcgccgagttgagaaaattgccgagttacaatcgcacgaggctcaatattacgtgatggagttggacgaacgacggtccatcgatgcgcaattttacggcaacgatatgcggtccatttcccaaattctgtgctttttacatttaatttctttcagttatgtgaaccattcctgcagccccaactgtgtgatccagcaaatccaaagcgattttgacttgcatttggttttggtcgccaacaaagagatttccatcggggaggaactgtcctttgattacaatatgcaggcgaacggacgttccgtgccgaattgccattgcggggcgccgaaatgcacgggagtactttcggcagaaaaaaatggcaaacagagaataagtgagtgggtttattttttaaaattggcatttatgtagcaaagagccctagcaa

SEQ ID NO: 78675 - DNA, 1033 bp, Heterodera glycines
  misc_feature (64)..(64): n is a, c, g, or t
  Genomic contig location: Contig_ID=SeqID_14597; Location=2267..3299; Strand=+
  SCN-specific regions: Sequence locations=1-92,115-791,820-825,884 -914,936-1001,1030-1033
atgcgaaatttgcgtgttccaattttacttatgctattgagcacagtgattattttcatattanaatttttattgcatgaaaatatgccgacaaaaataacaattaaccctgttgcgggaaattttatgcaacgaaggattttgttttttgatagtgacgtagactccccaaagttgctgcttggaatgaacacccaagtaaaaatatgaatatttgagtcgaatcataacacatatttcttggcacaaaaaattataaaattaagccattgccaacaaaaagtcactttggcatatttaatgaggagacagtatttgtagaaatgatgacaagcaataattaaaaagaaactttaataaattcaattagtcgataatcatatttattgagttccaatcaattaaaaacaaggattaatgagtattcaatcaattaaaaagaaactttaataaattcttagtcgataataatatttattgagttccaatcaattaaaaacaaggattaatgagtattcaatcaattaaaaagaaactttaataaattcttagtcgataataatatttattgagttccaatcaattaaaaacaaagtttaatgagttttcatattcctttggcagtcattttgattcaattttgcaaactatttaacaattaagccattgccaacaaaaagccactttggtacatttaatgaagactgggacagaatttgtggaagtgatggccagcagcaatgtgtgagaaagtttgatggcaaattccagcgcaatgttgtgtgtttttgttataaaaaataattaaaaaataattatgcattgttaaattataacttaaattaaattaattaaatatattttaattcaattttagtttattccgtcgcttaaattggccggctgtttaattgcaaaaaattcaaatgttttcttggaggcgttgttttgctacttaacaaacatgaacaaaattaacacgacaaatatcgattacgaacttttcaatttgtttgtttttaactatttataa

SEQ ID NO: 78676 - DNA, 746 bp, Heterodera glycines
  Genomic contig location: Contig_ID=SeqID_14598; Location=90..835; Strand=+
  SCN-specific regions: Sequence locations=1-16,65-69,91-255,277 -385,407-449,471-473,499-552,574-633,655-700,722-746
atgcctaatttacttgtttatatattttttaataattttaaaattttatttaatttgtttttaactccgtttatttatatttttaaaattgatttagcaggtaaatctggcaaaagtttccgcgattccccagactttgcgtctatgtccaaaatcgggttcaaactcaagttttttcaatcactgatagcctaatcagcattatataaatgatagaaagtgattgtgtctaataatttgctagttattttaattttaaaagtcatcaattattcaaacagctgatcagggcgagaaaaatccgactttggacataggcgcaagtgcccgaggcgcaaatctctgggcactgttgctgcaaatgtgggaggcaaaaaaatggggcgccatttgcaagtctttgatttgtgacccaacggccgcctaaagcgccgtagggcactttcaccatttttaaaaataatatttttcgtatctgagttaaattttattattattgcagagcaccattgtatagatctgatgccactggtggacgacaatattgcaatggctgtgggccaaatttgacatgttttgtcatgacggaatatgaaaaaatgttaaaccattcgtcgtccaatctttcatttgcggccacggcggaggactcgcatttttttccacaaaattggtatgtaatttggctaaggtgtcacgcaggaaaggccctggattttgatagaagacttataacaaatattcaa

SEQ ID NO: 78677 - DNA, 776 bp, Heterodera glycines
  Genomic contig location: Contig_ID=SeqID_14599; Location=1827..2602; Strand=+
  SCN-specific regions: Sequence locations=1-343,366-482,504-561,583-776
atgcaaacgatgcgacaacgaactgacggacgacgcgcgagagatcggcggagcactttactgcttgagatgccacgatttggtagaaaaaagcatttaaaggaataccttggaggagttaattccatgtgcttttacagatgggaattccaatttgtggtgcttgtcaccggcccatcgaggaaagagtggtgaccgcgctgggaaagcaatggcacgttgaggtcagtttcagaatgcctctttctgtgcaacgtcttttagcactttgtctgtgccgtgtgcgaaaagcctttcctcggccacaaacactacgaaaggaaagggttggcctattgcgagcaacacttccatttggtcaccagcaacgcactgaaacttaacacttttctgtttagttgtacggccatctctgcttcaaatgtggcaatccttgtgggggagaagttttccaagcgcttggcaagacttggtgtgtcaaatgtttttcgtgctctctctgcgacaaaaaaatggaccaaaagtgagcattttctttcctcttaatcttaatgtgtcggaaaccaaattcttgatttatttcatgaattattctcaggacgaaattctacgagtttgacatgaagccaacgtgcaaaaaatgttatgatcggttccctactgaactaaagaaacggatcagcgacaatttgaaggagagggaagcagaaacactgcgacggagatcagcaagtcccgcacaaccacagaaatcaaaatcacccggactgaaatga

SEQ ID NO: 78678 - DNA, 144 bp, Heterodera glycines
  Genomic contig location: Contig_ID=SeqID_14600; Location=412..555; Strand=+
  SCN-specific regions: Sequence locations=1-144
atggcggacgaagctgaggttgatgaagaacttatcgatgttctcagagaaacagacctcgtcaagtttcaaccaatgatggtttttgacaaacaacttaccaggattgaacactttcgggatgttactgacttcgagcttatg

SEQ ID NO: 78679 - DNA, 579 bp, Heterodera glycines
  Genomic contig location: Contig_ID=SeqID_14601; Location=74..652; Strand=-
  SCN-specific regions: Sequence locations=1-426,481-579
atggaggccaattgtgtaagggaggaagtgggaatggcatttgaatgggaaggaattgaagatgaagaatttggcggaagggatgccaattgtgtaagggaggaagtgggaatggcatttgaatgggaaggaattgaagatgaagaatttggcggaagggatgccaattgtgtaagggaggaagtgggaatggcatttgaatgggaaggaattgaagatgaagaatttggcggaagggatgccaattgtgtaagggaggaagtgggaatgaaatttaaaggaggaggaattgaagatgaagaatttggcagaagagaagaagaaggcaggtgttgggtgtttatcaaatttgaagatgaaccggaaaacggttgaaatgccgaagcatcctcatcgtcaatataatagccctttttcgaattgtccataaatatttttctataaattttaacaaacaaataatttttaattatttatttacatttttcgtgctcgacatatgtccacgtgtccgtctttgaatgctctcgtgtaaactacacttagcaaatgtccaagtgtaaacccggactgaataaa

SEQ ID NO: 78680 - DNA, 1502 bp, Heterodera glycines
  Genomic contig location: Contig_ID=SeqID_14601; Location=83..1584; Strand=+
  SCN-specific regions: Sequence locations=1-90,145-1371,1393-1394,1416- 1502
  Gene Ontology: Mol. function=signal transducer activity; Cellular component=secretory vesicle; Biological process=invasive growth
tccgggtttacacttggacatttgctaagtgtagtttacacgagagcattcaaagacggacacgtggacatatgtcgagcacgaaaaatgtaaataaataattaaaaattatttgtttgttaaaatttatagaaaaatatttatggacaattcgaaaaagggctattatattgacgatgaggatgcttcggcatttcaaccgttttccggttcatcttcaaatttgataaacacccaacacctgccttcttcttctcttctgccaaattcttcatcttcaattcctcctcctttaaatttcattcccacttcctcccttacacaattggcatcccttccgccaaattcttcatcttcaattccttcccattcaaatgccattcccacttcctcccttacacaattggcatcccttccgccaaattcttcatcttcaattccttcccattcaaatgccattcccacttcctcccttacacaattggcatcccttccgccaaattcttcatcttcaattccttcccattcaaatgccattcccacttcctcccttacacaattggcctccattccgccaaattcgtcaccttcaattcatccacagttaaatcccaatgccggtccctccattacacaattggcctccattccgccaaattcgtcaccttcaattcctccacagttaaatcccaatcccggtccctccattgcacaattttcttccattccgccaaattcgtcaccttcatttcctccacatttaaatcctattcccacttcatctcctacacaactgtcttccgttctgccaaattcatccactcaagccgcattacttccgtccgattttatggagcctacgagtatctttatcattgactatcaactttataaaaagtatcgcttccttttagcggaaaacccactattttctgacatatcggacgcttccgcttacttacaaatcgacgagcgcgattatgggaatgaacaatcggcatctgcacaagttttacgttcaatcttagacgtatgtttgttctattacactttcaaaaacaattttttctgattaagacgaaaaattccaacttaatttgattctcacattaaacatttgagaatcatgaagtttcatgaaaataaaaaaatatgggaattttatacatactttagtttttatttaactttaattcattttcattgctagttaaatttattctgcaaattatcttcataaaacaattatttagctccgtccaacatcatccacggcgtcatcgcaaacaagttcgacaacaagccggaattttcgggaccatatgaggaaactgtacacagaactgggcgaaacaaatcgagatgaacgggatcgcgcaatgaaagctttagagttcaaaaataaacaaatcgaaactaggtcggaggatggacaaagaagaagatcaaaaggatcaacctccgaagatgataagaaaaaaagcgtattttgcaatatctga

SEQ ID NO: 78681 - DNA, 402 bp, Heterodera glycines
  Genomic contig location: Contig_ID=SeqID_14601; Location=2181..2582; Strand=-
  SCN-specific regions: Sequence locations=1-370,399-402
atggcgcaaaacgctgctcaaaacgacgaccaagtcgtttttgctctgaccgaagaagaaatggtggagtgggatgaacgcgagaggagatggcaggaagaagtgcgtctcaggtgtgaagaacggaggagggaagcggaagaaagacggcaagagcggggcgactggcacagtgacatgctgaggcggcaacatgtttgggagcaacaaaaagaggaacgagaaagagacagagagcgatgggagcaaagaatggaggacgaaggaagaaagtgtgaagagagaagcgcagcaatccgaaagaaagagaaagaagaaaaagacaagaatgatgttaccgatcattactctttcaaatgggaagaatggagggaaaaggaaaaattattttttggaaaataa

SEQ ID NO: 78682 - DNA, 645 bp, Heterodera glycines
  Genomic contig location: Contig_ID=SeqID_14602; Location=354..998; Strand=-
  SCN-specific regions: Sequence locations=1-68,101-110,132-366,388 -399,421-450,473-645
atggaagggtgttctgtaattgagtcattatgtcatgaggacttaaaatttggatttacaaaatataaaaccaaattttattttaaaaatcctttcctaattaatgcggaggaaaattttaaactaatactcgcatcaataatcgaagaaatttataaaaatgaacagggaaaattcaaaagcattctgaagctttcctttggttttgaatcattttattgccctcttagatgccctagcgaaaacacagccgaggctttgttccaacatgtcatattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatagttaaacgatcaaataatctcgaaatttttgcaaatatgttttttaaacgggtgaaaaatttctacatagcggcatttagtgcacctggaatcgaaaatttatattttacattcttagaaatgcttgaaaaaattcaaaaattaccagggcttattatgcatgaatatataaaccaagccttagctatgcaaaaattagaaattggcctcaaagaaataaa

SEQ ID NO: 78683 - DNA, 456 bp, Heterodera glycines
  Genomic contig location: Contig_ID=SeqID_14602; Location=1030..1485; Strand=-
  SCN-specific regions: Sequence locations=1-95,117-397,419-456
atgaattctgaaaaatcagaaaaagctaataccattttggtggaagctgcaaaaaaagagacagagagagcatggagggatgcagcggcgttagcagaagaagttggcgattttgccaagtcttctcgcgaaacacttaatcaggcaataaaatctagagaaaaagctccttatgctaacggtgttcgggaattatatcttaaaatgtccgattcaatttgggaaattttcaaaatcgaggaccaaattaatttggagtctgtaaaggctgaatctgcatggcgcgagttcgagagatgcaaaacttttgaccaggcaacaaaattcgaggaacaagcgcaaaattcgttaatggaagcccggagattacatttcgagtcccgaagggttcagagccaaatgttaaattatgaaaataggctcaaaacaattgtttgggagcacgttggtatataa

SEQ ID NO: 78684 - DNA, 567 bp, Heterodera glycines
  Genomic contig location: Contig_ID=SeqID_14605; Location=389..955; Strand=+
  SCN-specific regions: Sequence locations=1-208,230-567
atggttttttactttttccgacttgtggagagtgtgcacgtaagtctaaccaggaatttgttagggtagaatgtttcaagaagtacagacactcagcagaaggacggggtttagttgggttttcacttctattgtactccgaaaagcgttagaactcggctacaaaataacgaaattttatcgagcatacaattatgagaattttgacacaaatcttttcaaaaattatgtaagaatgtttttgaaaattaaaatcgaatcgtcgggctggccggataatacgactactgaaaagcaaaaaacgagttttttgagtatgcacaagcgtaaatatgatatagagcttgatcctaataatataaataaaaatccaggattacgtttaatagcaaaattggtgagaatcaaattcatttaaatatgtatgtaaaatcttagggcctaaactccttatggggtaaattttcaatgagaaactccctttgtcagaccaaagtgattaatagttcgactgagtggtataatcttttgcttgatgattctatagaactttctagcccaataata

SEQ ID NO: 78685 - DNA, 954 bp, Heterodera glycines
  Genomic contig location: Contig_ID=SeqID_14605; Location=2546..3499; Strand=+
  SCN-specific regions: Sequence locations=1-371,393-615,638-954
atgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaattttgagactctgaaagtccaattcgagaccctaaccgaaagagttgatatgttggaacaagacagtgatgggacgaattcaggtgggactgttagcattactaatttgaatagagcgtcgcgtgcgccgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacgagaaaaagtcacaagactcaaattggctctgagggacactcctcgggcactgtttaaggaattattgccagcacaaacggacactcttgactcagcattgagtgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtaaagagaaaatttgcgaggaatttttggatagattgaagcctaacattagttttctgatccgtctggtgggtttgtcacgagcaaaagacttggacctg

SEQ ID NO: 78686 - DNA, 396 bp, Heterodera glycines
  Genomic contig location: Contig_ID=SeqID_14606; Location=912..1307; Strand=+
  SCN-specific regions: Sequence locations=1-81,105-169,192-205,236 -251,273-363,395-396
atgtccaaatttgcgcccaccgccagcggaggagtcgcgggaggagcgcaacaacagttcatgacggcaccgcagtgccgatgcaaagacttggacgaatgttcaaaggaaattgagaaattggtggccaaatgcaaaacggagtcagtatttgtggccaattagcacgaattaattttaaaatgccaaaaaatctttgctatcgattttttaattttttaaattgattattttaggccaaaatgcgaggcgcatttgaagaaaattggaaactctcaaaaaattcgtcaatgccttgcggacgagcaaaaggacatggaaaagttggaacaatgcgtggagaaagcggtcggaccaattgggtaaaaatattttaaaaattatattaaaataaga

SEQ ID NO: 78687 - DNA, 515 bp, Heterodera glycines
  Genomic contig location: Contig_ID=SeqID_14607; Location=360..874; Strand=+
  SCN-specific regions: Sequence locations=1-242,264-272,295-463,486-515
atgcctcctaatgagcggcaggaaaaggcatttggcgattgtgagcaaaaactgggtctgacagcacaaaagcgactaaaaaagtaagtggtttttttgtcattttacatagagaatgacaaaatcaaattttctcatttcttttactttttgttggtaaaaaatcatggtattgtaaattaaataagaacgctatttaaaaatggaaagtatttcgctttaacttttggcttttatgaagttaaaaataatagaaaagataatgctataacatttttaaaattttttttttaactgacaaaatcactgggaaccacaaaaacctttctaaattaataatttcaggtcctgcgaatgtctgaaggcgtccggaataaaaattgtgtgcccaaaataagaaagaacgaagaaatgaaaaaaagccagccagactgatgagagattataattggaaatatttattgtcgtgaatcatttaaaatattatattgctattgtaaataacgggaaattga

SEQ ID NO: 78688 - DNA, 448 bp, Heterodera glycines
  Genomic contig location: Contig_ID=SeqID_2246; Location=172..619; Strand=+
  SCN-specific regions: Sequence locations=1-105,198-448
atggccactgtgcattttgcttgtaatcaacaatcgttttgtactcctctgataaaacgttttgatgataaaatccagaagcgcgcttttttaattggcattgacttaaaaaatataagaaattatttgatattaaaacaaatataagaaattatttggtaataaacaaacataaaaaaaatatttgatatttttaagacaaaccgaacaagaacacggtttcggttagtaattctgcatataggaagttgaaatgattccggtatgcgaaaacgaataacaccgataagtcgcgaccagacatttagcgatatgatgttatcaaaaaaataatcaatatttgagcccaaatcatcagagcttggggtgatcgtcttggcgccgacaatagagtcgtaatcacacatttcgagattctaggcgaaaaaaatacaaaaaaaagcaaaca

SEQ ID NO: 78689 - DNA, 459 bp, Heterodera glycines
  Genomic contig location: Contig_ID=SeqID_2246; Location=4066..4524; Strand=-
  SCN-specific regions: Sequence locations=1-459
atgtcgttccaaaatacgccaaaagaagttcggcgtgcgagaaacacccgccactttttcaaggcaacccctgacaagggaaagtgtctcgaaaagattgagagccatgtcaacgagcgagccaagtttggtataagggagcacgtaactagtttttatttcaaatgcccaccaaatgaagatgcggaaaataattttagaataattatcgataaactaatacacgaggcaaaggaaaaagaacctgcacaaggatggaagacggaaagaatttcgctgaatttatattgtgctgctttgtctgatcctgttatgataccagtgagaccactacaacaagtaacttcggatgttgtgctaaacgaatttatgcatcgtcagcaatcatttggcgacgtaaaccttatggacgaaagaatttctgtgatcgtgaccacttttgcatatcctctcaagtga

SEQ ID NO: 78690 - DNA, 1220 bp, Heterodera glycines
  Genomic contig location: Contig_ID=SeqID_2247; Location=84..1303; Strand=-
  SCN-specific regions: Sequence locations=1-651,673-771,793-1111,1149 -1179,1202-1220
atgaagatcttctttgaaagtgtgccggacaagggaccaatcaatccgagggatgcttacgcaggaggacgaccaatgcctttttgcttgtatgcaaaggctacggaagcagttgagatttcgatgttcgatataatcagtttgtacccctatgtgaattatggtaaaaaaccgcttgctttttttaatgttgcccttcacttaagacactccatatcccgttggtgtcccaaaaattgtagtgagcagggattttaatgtgaattggacagtgcccgacgatattccttatgatggactgctaaaggtgaaggtcgtccccccgaaggaactgctgtaccccctcctccccgtgcacatcgacaacatgctcctctttcccaattgtggcatttgtgcgagaaaggccaagaatgagtttgttacgacgaaggatgtgaaaaaatgtaaccatcggccagagcagagggcatttttggggacgttcacttcgattgaactgcggaaggcattggagttgggatataggatcgttggcttatatcgggcatatcactttgaacaatttgacaatcaattgttcaaaggatatgtgcggatgttcttgaaaataaaggtggaggcgtcagggtggcccggggaagtgaagagtgaggaggaaaaaagtgcattcaccgatatgtacaaggcgaaatacgacatctgccttgatcatgacaagattgtgtttaatcctggtcttcgaatgatagcgaaattggtgcgaaatgtttattaataacaataacaattaaaattaaggggttgaatagcttgtgggggaagttttcgatgcgcaacacgctttctacgaatgagatttttaacagcatggaacggtgggtcgcattgtcacaagacaatacgcttgatgtttcgacgccaatacaaatatgtgaaggagtagagcgtgttgtatatcgtaaaaaggaggagttcataaaggagcataaggtgtcgaatatagttttatctttgtggactacgagcgctgcaaggataaagttgtacgagtatatggagcaggtctacagggaggagggatgtaaaccactgtattgtgatacaggtgttttattataaaaaatttccataaaattttatatttagattctctggcctttgctcatcggaagggtcggtgtccattgaaggaggggaaatttttggggtaaaataaa

SEQ ID NO: 78691 - DNA, 1127 bp, Heterodera glycines
  Genomic contig location: Contig_ID=SeqID_2248; Location=54..1180; Strand=-
  SCN-specific regions: Sequence locations=1-297,319-394,416-862,886 -1127
atgtctcgcttttgccctctcgttgaaaccaaagaattgggacgtctttccgttatgaagggaaaattttgtgagtttgagatccctttaacttcagcacaagatttacaaatcttttacttgaattttaggccttttttatgccctcgaattatctcgtaattaccaactgatcgataatggaatctctaggaaggctttccgttattttatggaaacagagaaaaaacaaagtgaaatgactttcaaactgatggaaaaggcggggataaatgcggaggaaaaaacttttggtctccaacatcttgaaatgatccaaatcttttgggacaaggaattccctgacatgtttcgcattgtggcctttgatatggtaaaaaaactacatactttgaaaaaatttttattttccagagaacgggaatcaaaccaattttcaagggagagggaattcgtaaaaacgaagtatgcgtgataaaagaaggagaccactgggatgggatcaaatcagtgacgcagttcttttgtgttagaaattattgtgtcagctgtgaagtgacttgcgaaaggccggagagacatcgattggagtgcaaggagcgctgtaagaagtgctgtcggatggggttcggctttccatgtgcggacgtatgtgaggagattcattgtgagggatgtaaccgaaatttctacaacaccgactgttttgaatcgcataagaagacagcttgtagggagtacaaaaaatgtgaaaaatgtgatgagacttaccaaacaagatcgaagcacacgtgtggggagaaattctgccgaatttgtaaaatctatcatccgaagcggggctgtttcatccagaagttaaaaattcgttcaacgaggaaatacagaattgttgcatatgatcttgagacgacattgtataacggagtccatgcaccgaatctcgtttgcgcggcgttgacatgcagtgagtgcgttggagagaaaaggaaatgtgagatttgtgaggaaccgagtatgctgacttggtcggcagcagatgtggaggaccctattggcggatttatcgattggattatgggcttcaaacaatttgaaacggttgcttttgctcattatgctggacg

SEQ ID NO: 78692 - DNA, 1789 bp, Heterodera glycines
  misc_feature (1593)..(1593): n is a, c, g, or t
  Genomic contig location: Contig_ID=SeqID_2248; Location=3619..5407; Strand=+
  SCN-specific regions: Sequence locations=1-31,53-163,185-286,308 -315,337-349,386-452,475-1106,1151-1568,1593-1789
  Gene Ontology: Mol. function=protein binding
atggcggaggggggagggggttagcattgaaaatttggggccagatttgtggacttatactactaccgtatcggatttttggccataatcggaatcggcgatttaatcggaatcggattttgtctggctcggcacatccctgctgtgtatgtgtaaataaaaagttattgttgttgttttttacgtcaaccaattctttcacgcattccctttcgatctatgtaaatttgtaaatcgaagtcgaccgcaaaacagtaaatttagttagttttaccatttttgatagttttttgggaaaaacaaaattattacctcatttatttattattataatttccatattcaacaatttttattgccattttttcttagaaatttcaatgtcgagcaatttgctgggtcggtttaagctgatgttgagcacgggcgatggggcggacgttcactttttggttgggaaggaaaaggaggtgagttgaacacaaaaaatttaaaaaagagaaaaaagctccagtggtagcgcgcaacaattatttagatggtctaaaagtcgcaattatacataaatctactcttaagtcgataatttaagcactaagaacgggaaaaagaacgaatggcgttgttcaaatgctaatttataccgctggacacacataaagcgcgcgtcgctttttaaaaatttggaggtgtggccgcatggtcgaaaagtaccaaaaaatgatactttctgacagactgaaatgagtgaggcctctgaaatttatcttttgggtttaaaacttcaatgataaattcatttctattccgagttttttatttagcttttgaaagcacacaaatgcgtgatgatgttcgcttctgctgtgtttgggtcgatgttccgttttgatgacaaaaacgcaaagataaaaagttaaaaaaatcgaaatattttttaaaaatgtttttttttcatcattttttagcctctgccgactgtcctcacgtaattgaagtgaccgatgttgaagcagaagcattcaaagtgatgttgagcttcatttatgcggaagatttgagcgaattgaacggacaaaatgccatggcagtgctttacgcaggtgaaaaatttaaaaaataaataaataattatatttaaacatttttagccaataaatataacgtttctctgatggtcaaagccttgttggatgttccgattaatgaattgccaaatgttttccttgcttttgtcgaagctcgtcttctcaacgaacatgtcagaatctggctaataatgaagcttttccctatttttaacaataaattttaggtaccataggttttcagaccccctccaatttttttttcttatttcactttttattgattcattttaaggatttctctcgtcgctgcttggattacattgaccaaaatgccgaaactttattcgaatcagaagaatttttgcaaattggtcaaaatttgttgtgcaaaattttcggacgtgaccaattgaaaatcgacgacgaactcaccatttggaaagctgtactaattaattaattattcgattaaaatgctaatttttattaaaaaattattttntcaggcactccgttgggctgacgaacgctgtgctcaaatgctcattgattgttccgctaaaaatcgtcgagatgtccttggcccaacactattcaaaatacgtttcccactgatcacaaaaagagaattttcaaaaattattggtaaatttttttggtttaaatttttccataattttgtagggaaatttaaatta

SEQ ID NO: 78693 - DNA, 279 bp, Heterodera glycines
  Genomic contig location: Contig_ID=SeqID_14610; Location=28..306; Strand=-
  SCN-specific regions: Sequence locations=1-169,200-279
atgaagtatgtgtgtgctctttcagaaaatatcaaattcattaatttttctcaaatatattttctaaaaatcctttttttagagaaaaattgccaaaaaaagaaagaaagttaagtaatttgtttacaactcatttgtcagttcactttttgtctcacccatcatttacattaaatctttttattttttaaatttttaagcgcttaatgtgatacttaatactaatacattaatattacttttttaatttaattactgtagggatatagatttaataaa

SEQ ID NO: 78694 - DNA, 277 bp, Heterodera glycines
  Genomic contig location: Contig_ID=SeqID_14610; Location=967..1243; Strand=-
  SCN-specific regions: Sequence locations=1-277
ctacgaacattattactcatcagtttgccacggaagcggatggtggtgaacaatttggacaacgccaacagacaaatgcatttgttcaaagcggttttacggcatttttcatgccgacatttctgttttcaatttccaggtgcgattggacgcactcaatccgtcagtgaagcagccattgaaaatgccgaggcggagaatcagcaattgactttgtcacgaatgcaaagtgtcaacggcagtttcgaaaaaattggcgatgaaccgaacgaattcg

SEQ ID NO: 78695 - DNA, 1467 bp, Heterodera glycines
  Genomic contig location: Contig_ID=SeqID_14612; Location=391..1857; Strand=-
  SCN-specific regions: Sequence locations=1-581,603-718,752-781,983 -1189,1211-1259,1288-1291,1313-1346,1380-1467
atgattagaagaggtacaaatttgatgaagaggtacaaatgtgattttaagaggtacaaaagtgataaaagaggtacaaaagtgattagaagaggtacaaaagtgattagaagaggtacaacagagattagaagaggtacaattttgatgaagaggtacaaaagtgataaaagaggtgtaacagtgattagaagaggtacaacagagattagaagaggtacaacagagattagaagaggtacaacagagattagaagaggtacaaatttgatgaagagttacaaatgtgatttaaagaggtacaaaagtgatttaaagaggtacaaaagtgataacagaggtacaaaagtgatgagaagaggtacaaaagtgattagaagaggtacaaaagtgattagaagaggtacaatggtgattagaagaggtacaaaagtgattataagaggtacaacagtgattagaagaggtacaatggtgattagaagaggtacaaaagtgattataagaggtacaacagtgattagaagaggtacaatggtgattagaagaggtacaaaagtgattataagaggtacaacagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgccccccccccccccctcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaatcctggtcacccccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaa

SEQ ID NO: 78696 - DNA, 2543 bp, Heterodera glycines
  Genomic contig location: Contig_ID=SeqID_14613; Location=1615..4157; Strand=+
  SCN-specific regions: Sequence locations=1-338,362-472,499-509,547 -997,1026-1401,1423-1582,1606-1733,1755-1788,1810-1863,1896-2072,2096- 2135,2159-2241,2269-2543
atggatcccaaattcgcccccacaaattcaatgccaatttttccagtgaatttgccgactccgctgggcccaatttgctgctgctgctccacgccggtgcgctcccctcacaggcatggctttatcctttggctcctaacaaattttctacacttttcatggcatggcttaatttttgtcgcctgacgggggatgatgtccaatttttctgacaaacttttttgggaatttggtcaataaatccgcttctgtttgcaaaattcgactctgattgataagtggtcgtttttgaaaatttattaaatcaaaggaacagaaatcttttctcattgaaagtcgcgaaaaatttttcccggggattaattaacgaccctttggtcgaattcaggcctgatattcggaattggttgaaatggtggtcagcgactcacaatctgaagacccccgggaacatttttctcgacttgtcaccaacttaaaaattttttggaaatttgtaacactaatggaaaattaaaaaacaaaaaaaatatttctaaaaatttaggaagcaaaactgttgcgcaaacgacgcgatttggcatgccaaagtgccgaaagtgttcctgccgctggcgacgacgagccgagcgtttccgaatggattttctgcgatttgtgccggaaatggtttcactgtgtgtgagtgaagcaattgtttttttttcttaaaatcaacaaattttcaaccatttttggaaactcactgtttaattgaccacttagtcacaatagttttcgcggatttaatgtcagtggcaacacaaaaatttaaaaaaaaaccggattttttttttgtttgaaacccttcgctttaagttgtgtcaatgtgcaggaatatgaggtaaaagacaaatgcgaaagtgcacacttttccacgtgcttttgaaatcgtttcccccggcatttgctgattcagaattattattttttcaatccctgatcgccttaacagcatttaaataagtgattggaaattttttgaaaaatcatcaattcttcaaaacaacatgattaatgcccccaattaactagaagactacgatttcttaattttaatgctgtttaggctatcagggcttgaaaaaatttataatttgaatccgattcaggaaatagcgcaaatgtccggggctcctttgaaattatgagaattttaaatctttttttaactttttttcaggtcccactgatcgacaaattccattgtccgacctgtcgctttgcgcacggggacagcatcagtgggttttggcaaaaaattattttctaaaaattccagccttttttcaaaaaaagacccctccaatgattttaaataaattcgatttactcattttccttttctttttgcagtgaaagtgcgccgtctttcccatcgctatgcctttgatgatgagtcggagcgggagatgcccgagcaaatcggcaccgagcaatggattcggcactttcgggagcgctacaaccaattcccggaggcgtaagttggcggacggtgcggtggttacaggggctgtggctgtactccccccttcgctccttttaaaaatttcagttttttaatactttcagtgccccccccccctttatggcaaaattttttgttcttttagttgcattgatttgggcattttttgggatcgctggtcacgaaatggtgacatccattttagcctgttccgaagtcgaacaaaaagtcgaattttaaaatttgcactttcaacatcaaaaaaaaaagtcataccgattcaaacacaatacacaattgtggatttttgttgatttccttgtgactaaaattaaaccaaaataaaatcgaaattttaattcattttatttttctctttttctgtcaatatttgttgagtgctgatttgtccccatttttcagtcatcagccgtcgctgatccaagtgtttgaccacggcgccgaaatgttggccaacttcgactttgagaagggttggcatttgcccatcaaagtgtgccatccgcatgggctcggcctgcgcatgccggacgacccgtactttgacgtgttggacgtgtgccgtcttttgagtgcgttttgaacgcgcatttcttggcaaaataaaattgacatattatgttcaaaaacaaggtttttttgatttttttttttcaaataaacgaaaaatctatggtccaaagaatcttgcggagactttttcagggatattccaagggcaccccaaatttttaaggtaaaaatgcaaggcctacctcatcaaaattcccaaagaattttttgtaaggaatttttgtcgtttttttctatgtgctcttagcaaattttgtttttgccagaaaacataaattggacggcacggcataaaatgcgtacataaaaagccattcaaattgccccatttttcaacttttccccaggcgacgccgtcaccgtggacaccatcgacgtgtacgcccagcgctcgtacacaatgagtttgggccgcttttacggcctgtggcgcaagcgg

SEQ ID NO: 78697 - DNA, 2182 bp, Heterodera glycines
  misc_feature (243)..(243): n is a, c, g, or t
  Genomic contig location: Contig_ID=SeqID_14616; Location=203..2384; Strand=+
  SCN-specific regions: Sequence locations=1-387,411-434,457-597,620 -714,736-782,804-822,853-1111,1133-1159,1190-1622,1647-1866,1888-2182
  Gene Ontology: Mol. function=Hsp70/Hsp90 organizing protein activity; Cellular component=cytoplasm; Biological process=protein folding
atgcttgatgcggagaagctggaacatgcggtgaagatgaaggagcgtggcaccacctttttgaaccagggcaagcacaatctggcacttgccaaataccaagtgagtgactttggcagaacatatcagatgttgcgttttgatcaatattttctgacaattttttgcaatggagccaaaaaagccgaaatttcaaaaaaaaaaattcagcggcaagattttcgagtgcacccgccatattanattgtccaattttttttttgtatcattttttttcaagtcggtcatttctctattggaatacgcaaagcccaccaaatcggacgaagaaagcggcaaggagttgagggagcaatttgagcagacattcatcgcagcattggtatgtttttctgggattgtttgtttctaatagatcggacaattttcggggcaaagataaagaaagaaagaaaactgtcttacaatggcatcaggggcgtatctagaaaaaaaattttcggggggaggacccgatctgaagactttttttttgtattcacccaataaaaaaaaatttttgccgttttaaggcaaaaaaaaacttgtaaaaataatggaaaatggaggtccggcggtgccgatatgcgccgcaggaattttcgcccgaaatcctgtcctggaggtccgtctcgaaatttgttttatttatgaaaatttttctaattgtaagattttttccttgaaaaatttctgtgttgcaattttttttaaatttctccggttcgacagacattgatgacatgtccatattttcagaaaatcttatttcttaattaatcgtattatttgttttttaatttttttttttttgtagctaaactcggctttggtcagcctgcgcatgggcgagtcggtggaggccatcaaacactgtgacaaagtgttggagaagcagccgaccaatgtgaaggcgttgtaccgtaaagcgcaggtcaacaaaacgataaaaccgaggaggctctttcaggggaaaatgagagagtgtgtgtttaatgaatcaatcgaaaaaatacggaaattttttcttgatacaaacaatgtttcgaatagaaaatttaaaaaattttcattacaaataaattttgttttctttaggaaaggggatttagttgcttggtttttttaaaatataaaattttgaaaatttcagttcgaaatttcttttaaaaagtgtttgtgggggaaacgatcgggggagggggcgtgggtagaacgttttgtgcaaacgacggggtagagaaaaatatgcatttagatttcttatctcataattttttgggtttcaatttttttttttttgcaggccctgcaaaaccgcaaggattacgcggaggccattgagcagtacaagcatgtccaccagttggatccatccaaccgcgccgcggcgcaacaaattttggaatgtggccaacagctggccgcccagcgggaggcggagcgcaaaaagtaccgcggaatgttcgaacggatggccaaagggacggacagcaaaagcggtggtggaggtgacggtggagcatctgctgctactccttcagcgtccgacaacaatgcggaaggggtgaaaaaaacaattcttttgtttttcaaaaaattaaatcaattttcatagaggggggggggggtagcaaaaaaaggggtcaaagtccgtgaaaaaaatgtttatcttttgtcattaacctaatccataccattgagcgcgaggttgatgcgtgacaaacctttgagaccggaattttgcaacgaatgggactggaacttgacggtggaccggaatttccgactaactttctcccttccataccccacccccccttgtttggaaaaaatttttcttagaaaattgtagaaatagaaaatagtgtttttgtgaatgtaattattttgaaaaacaaatcttatcttaatcatttcaacaattttttttaaattttccgcggtcgggaaacgaacgaactgcttcagtatccaaatatgacggaatagattaaacattttttcacacctctgctgtcaattaatttttttgttttatttgtcagcagccgtcgagtggcgccgcctgaactgagagaggagcaagcagtacatcacgataaaacagaccggaaaagaaatgaaaatggagaatcacaaa

SEQ ID NO: 78698 - DNA, 675 bp, Heterodera glycines
  Genomic contig location: Contig_ID=SeqID_14617; Location=530..1204; Strand=-
  SCN-specific regions: Sequence locations=1-60,84-108,165-194,216 -224,246-280,324-326,358-479,501-675
atggcgaaaatgaaattgatttttaatgtgaatacaaatgacgacagaaaatctaaaatcaattttgaccaattttgcatattaaaaatgtgaattttgatgatcaggaaaaattatatatgtaatgttttttatttatatttttaaatttaaaagaaaaaattcccgcacatttggacggaaattggacactaaaaattagacattaatggaaaattggacattatttgatataaataaataaatggagcatattaaaataatatcttttagccaaaccaaaatttttgtttatttatttttaatttattatatttttataagcgtatattgttattattattttaccatcactataagaaagccatcacttatcattcataaagaaaaagttttcttttagatagagttcccatttttcgtgcattttttggcacatgacaaatcattgtgcctattgaatgcttgatcaacagaaatcattaattcattaatccatttttcgcgcgaaaagtcaacttgttcctgcatttttgctaattctaaaggctctaaaatcaaatccaaatttgaatggatgcgcgagtgggtcaacagtgagcttcactgccgaaaaccttgagaaattttgatttgcaattgcaaaaacaaccgataaaatttatgaggaataaa

SEQ ID NO: 78699 - DNA, 1455 bp, Heterodera glycines
  Genomic contig location: Contig_ID=SeqID_14618; Location=483..1937; Strand=+
  SCN-specific regions: Sequence locations=1-366,403-442,491-716,739 -827,863-1189,1216-1284,1306-1455
atgcctttgaaagtgccgcattctccgcagctcccttctctggtcattaacaatccatcgggagcggaagcaaaaaaaggaatgccaattgctgtaatggtaagtcgcgaatacattatcaccgattaaaaaaaccaaaaaatttaatttctattcaatgaaaaataagaactaaatttaattggttgtaattaatcacaataaaaaggattactgttggatgagctgttcaattttgttagtttttgaatattttagaatacattattgtcaaaaaatgtcgaattagagaaaaaagaacagcagcgaccggcgacgaaattgaacaatacgcaaccaatgagccaacatgatcaagtgcagcactttaattatatattttaaaatcaattgaatatttttcagccaaaaactgttcgcgtcgccaaaaaatcaaccagtgatttttatgattaaaaatttcatatttaaaaaaattaatcatttaatagtgaataatgggaccacactaatggcaaatgccctgcagatcagcaaaaattcaactggtgagtgttttatttacattttattttaaccttatttgaaataactttatttatagaatttttattttcagattatttgatcgacgaagtgttatctttgcgaacaaaaatcaacgaaattgagaacaaaatggacaataacaatgtgagaaaaaatgtttaagggtctttttaaatatttatacttaattagcaatttttggcattaaatttacgtggcaccaacagtcaaatccatttgctgtgttgattgaactttttgctagagcttaatattccttttttggttttaataaatttttacatttacataaaggtcattcaattcaatgaattacgacagaacatcacgaaaatcgaacaactcattgtaagtattgtacaaacacaaacgtgtgaagaatatttgaaaattcaaggataattcataaatttattaatatgctctagttaatattttttacttccattagcaatttttcgctttaattttcattacccctatgggcaaagccaatcatgtttgtttggttgaaacatttaagcttaatattccttttttaaacggttggatatttttcagccaacaaatatcagcgtcgccaataattcaagcagtgattttatgtttaaaaattgcgtatttttaaaagaaatttaaatatttgtagacagcgtgaagaagaaactgtcagtgcattcttaaagcgattgactccattagtggaggttgtttatgctaatttggggaaaaagcaactacgagagcgtctggtagaagagcttcttgaccgtttgaagcctaatatttcatttttggtgagagttgcaggattggctaaggagaaggatttagaccaagtgaaagctcaggctgaagaattggagacacttctagcaactcaag

SEQ ID NO: 78700 - DNA, 2501 bp, Heterodera glycines
  Genomic contig location: Contig_ID=SeqID_14619; Location=587..3087; Strand=-
  SCN-specific regions: Sequence locations=1-26,48-82,104-113,161 -558,580-580,604-629,652-770,799-804,871-892,921-1356,1388-1615,1657 -1736,1758-1806,1862-2301,2323-2368,2390-2501
atggcgattcaattttgggctgcaagtacaattaagttggttttttcgtcttagtggtctgtgagttagtcaaaaaaaggggggtctcaggttcaaatcctcctgtgtttgtgtataaatttcaattttttaaagcaaataaataaaataataataaaaacagaacgccaaaagaacaaatacaaacagtaaaaagtagacactatattttacccttgattttatgaaatttttttagcttataactttgtcaattatagaccaaataaaaccattttatgctcattttgaagggaaaattctgaagaatatttctaagttagtcaaaagtttaaaaaaattgtttattggcaaataaatgattcatgtgttattttatatgtcagagacatggaaatagtatgccaaaatgagagaaaacgaaaaaactttgtcctggtcaaaaatgttttcctagggtcagatttttttgaaattttgcatagactcatacttttactccatttataggataatgctttgtttatttaccaaaatgctttttaattcgagatcggctctttccatttttacaagggaaaatcctaacaaaaatttttaatttagaaaagttttggcgttctgattactaaataaaaaataaacttatttgcactgggagcccaaaattgactcgccgtgtatgatatttcgcttaatgtattctccattctctccctaccagtgattgcatggaatttctgagttccggcttccgaaatttttggggtcggaatccagactttttggggtcggaattccgcctgaaaatttttggggttggaatccagactttttggggtcggaatccagactttttggggtcggaattccgcccgaaaatttttggggtcggaatccagactttttggggtcggaattccgcccgaaaatttttggggcctcggaatgccatccctgctccctaccatcgttgtgcaaaaatatgacctttcctctctcatacagtatcactcctaatttacaattccactagttgtaaaaaatttttgcaattttaatgaatttgtaaatgaatttattccaaattttcaacaattttcgcttttctcccttcgccggcattcaatttctctccttaattttctgaccgcctttgattacaaagagccccccccccctcctcccctctttccagcttcaattacgaaagttacacattttcatgaaatttcttacgtattaaatcgcagcgagaaaaaaaatatagaaattttaatgaaattattaagagagctgtatgaattatcatttttctttcgtttctctcttattctcttcccccccccctcgtcgaccctttctccccttttctccctatgagccctcacccgactccaattacgaacccccccccccccccggttgtatgtttgtttggcaagggtggcttacaaattggcgctgtggtgcctaaagctgaatgctgatgatttggcaatatcgattctgaggtggaaaatgatgaaataattagattatgtttgctaatattaatccatataaaaatatgtcccccatctttaccatttattcatttttctaattctgaaaacaaaaaccatgcatttcttattgttttcttttactttggcattgctttgctatttttcctcaagcaatggcaatgagcagcttctcggtgaaattagaggtgcttgagattcatttttagcaaaaaatgaaaacataatcaaagtttaggagttatgaaaagtgaagaatacaagaaagaccaaaacaggcaaattttattatttttttagttttttattcaaatttaaatgttttaaattatttacattgttttggtcaattttagcgttttattcgagtgggcattggaaaaggggtgccaaacaatttctaatgctagtgttattcaaattaaagagttcgcccaagaaatcaacgagattaagcaaatcgttgaacaaatttgtgccaaaaagggcatcaacgaacaaggaatacgaattcttggccaaaaagttttggaccaattgaaagtgtcagaaaagaaacaaaccaaagtgccgctcgaaaattttggcacccaattgatgcaattggccaagggattgcccgatgaattgccggtaaagagtgccgtcatcaaacaattggaaccaatcaacgggtcattagcaacgccaaatgatgcatttaaatttctgaatggcatggtgtcgtcgacattgaacaacagtgacagtgccaaaaagcaagtaaatagccagaaaaatttgattgtcttaaagaattcttctgcccgtcgtcgccgacgatttgaccgacgtaaattgcccattgtggtagtgattgaggtcttattggtttttgctattatgttgcaaaagcctattttggtttttattgcttgttccatattctttagcttccttccatttttgcttcaaattagagatgatattgaatga

SEQ ID NO: 78701 - DNA, 656 bp, Heterodera glycines
  Genomic contig location: Contig_ID=SeqID_14620; Location=848..1503; Strand=-
  SCN-specific regions: Sequence locations=1-365,389-498,520-656
atggtttgtcttcgaagcgggatgattcgtcctccgcggtgtaatatgaagggattatgtgacttggtcagtgagcgatttcgtcagtaaattatttctacttttcttcactatttgctgtgtgtctaagacaacgtgtgaatttgtcagagatggattttgacagtacagagtaattttaaaaacaaataagagtatgtcgaaaagatcaccatttcaaaattgtcgtccagggattatggtggattcgtgatttgctttcaacgtattttgtggtgtgcctacgcctatgaaggagtgatttgatcaagttggtgtaaaataattttttgatgatgatcgaaagataagcaagcatgaatatcttatatttttaaattaagtataaggtgctttttcaggcatttgtcatcacttttccgaccatccattgacagaaagtcgcgccttcgcggagacgcgacgtagagacctccctcattcaaaggccattttgtagagaattttgtgctctttctgttcgtcataatcatcttctacggaaaattttttccaaccccctagaatttttttttcgaatttactcagattttcgtattttttcacccgcaaaaattttgtgtttaatgccttttttatggcataaaatgaataaa

SEQ ID NO: 78702 - DNA, 811 bp, Heterodera glycines
  Genomic contig location: Contig_ID=SeqID_14621; Location=574..1384; Strand=-
  SCN-specific regions: Sequence locations=1-437,466-811
atgtccaattttttgatgtccaatatttcggcggtgtccatttttccggaacctcattttaattttgtgaccttttgggtcggtgatctattggagtggtgggggtgtcattttgaattggtggtattttgggcggcgttttggctggtggtgtttttggttgacccccaatttaacagatatacgacgacctattaattgcttttataaaaaatgagcaagaaattcaaatgattagtgaatatacattgaaaaaacaagcagcttaccttggcattgtgtattttatgcgaaagaattggcaatgtgacaaaattggggcgaaatctgaacaatatgaacgaacggaatgccaaaaatatcgaaattatttggacattttgtacgaatatttgtacagagaatatgccgcaattcccacagcaaaaccaaattttgttattaaaaagaaacaaattggaattgacgggccattaatttatgtgttgaattgtttggtcagaatttcgcagttttattttaatgaaccgatcagtttgaaatatgaatatgaattaaacaaattgttcgaattggaatttgagccaaaattattgaatgaggaaagatttaattatcataatcaaccactaatcacaattaataaactgattttgaaattggcaacagaaacagcgaatgggcgcccaacaaatgaaaacgttgaagggataatccgtcaaaattttgaaaaatatttgaaaaaattgtttggaaaagcggaggaaaatgcactagagggtgtttgatggttgagaaccaatcaaataaa

SEQ ID NO: 78703 - DNA, 1070 bp, Heterodera glycines
  Genomic contig location: Contig_ID=SeqID_14621; Location=1641..2710; Strand=-
  SCN-specific regions: Sequence locations=1-198,229-283,306-370,392 -560,583-734,758-1039
atgatgccgaaaaaattgaaatggtgcaaaaatttgagaaatacaaagcccaaaacccaaatgtgagtgatcgaaaaattgaagagaagcttaacattagtagaaaaaatgttcaatattggaaggaaaaatatgatttataatatggaaaaaatatttcctaataattagcgaatttttatactaatgaattagaagaaaaattatttttaaattaaataataattagaagaaaggtttttctgttttccgtttaataaaattgtcttttcatgttgaaaggaatgcataaaattaaatacataatgttacacattttcaatctgaaaatacgtttcaggattcggagtatttatttcctttatgcttttagtcattaattttttatatttattcgatttcttataaaactaacaaaaaatgaaaatcaaaattcatacttttaacggaaatatttattcaaatgaaaaatgcaaaaaggaaatgtttattaaaatgaaaatagtgcaaaaatcaaaaatcaattataaatgatattcaaaaaaaaaaatcggaaatgtataaaatgaaaatattagagaaatcgattctaaatattcataaacccctataaaaagtcgtgcaaattgtttttttaattacacgaaaactgaaaacatgtttattcctgcagctataattttattgctcattattattgtagttccattttcaggtgcgaatctatcggtgagtttcactttttaaataattttttcaaacaacttaatgggcctcctacctacccaaaacgtcaccctccaagtgtctccgcccaaaatttgaccagctaaaaatatttcttactgaatataatcaaaatgaagaaatgagttttcaaaaatgctcgtgtcacaattaagtcaagcgaatttttaatggggaccggaaaattggacacttgaaatttggacttcagaaaattggacaccaagcggaaatttggacaccggaagattgggcaccaagcggaaatttggacaccggaagattgggcaccaaatattatttatttaaaaaaaagaaataaa

SEQ ID NO: 78704 - DNA, 739 bp, Heterodera glycines
  Genomic contig location: Contig_ID=SeqID_14622; Location=55..793; Strand=+
  SCN-specific regions: Sequence locations=1-186,235-585,615-739
atggccaaattgatggaccattttatggctggacttcgctcactttggcacatcataaaaagtagggaatgataaaatggtggacattatgacggattataatgataagttataacgtcttaatgctcaaaatttgcattatgtcataaataatcaagacttataaaattatctctctttaatctcaaaatttatttatttcattaaaataattttaaacattctaaatatttagacaagcatttgcttcctaaagatggcaaacaccaaaaaaggctgacgcgaagaaaaaagcgaatgtatgctgacgattacaaccccaactacgaaaggccaacagcaaattttttcggtgccaccagctcaaaattcatcgtgtgctttggcagtctgatccttttttcattttttggcggttttggcattttttttgcccttaagctggcccaacatttacagaatgagcacaatgatatgacttgggtggacggtggtttgatttccattctcatcttttgtgtccttgttttgatgcttagtggcttggcgttttatcgctcgtgcattagtgctaattaatggggctaaataattttttttaaatatttatttatgtacacgttcatcgaaactcttcattcagtcatggcaaactttgttatattgtcataacagtaaagaaaatttataatttggcaccatttgttagagctttccatgtgcctaatgttttcagtaa

SEQ ID NO: 78705 - DNA, 1209 bp, Heterodera glycines
  misc_feature (347)..(347): n is a, c, g, or t
  Genomic contig location: Contig_ID=SeqID_14623; Location=604..1812; Strand=+
  SCN-specific regions: Sequence locations=1-26,51-242,264-440,465 -1038,1061-1170,1192-1209
atggccattttcgacccgtcccctctgatcgccattttggcattttccctttacacgcccctcgccctcgccactcttttgctgaatctttttgccattgtcgtgttggcacatggccatcgctatttctcacaacgcttcttcttcattgttggacgtcatctgttggccgctgaccttatgtccaccgctgcgcaactgtccatcgccgtgcccgtttcagcaatgtcaacggagagtgccaaaagtgggaaaagcagaaaatactccatacccagagtcaaaatctcaaatcgttggccaaaaaaccgagacccaattttttgctcttgagcgttcggtatatntggtaaatacaattcctgccttgtttatgaggaggtctcccaaccgaactgattttgttgcaaaatgcctctcattaaggccaaaagcctcagattattgtttttccaaaagattaaataccctaaaattccataaaagcaataaaaaacccttaaattcccttttcaaaaaattcttattgacaaatacattgttgaaagacatcacatcttggagctctgttaagattgccttacttctgatgatcagagggggcttctctttttatttaaattcctaatatgatttttattgccatattttagcttatctcgaatcaacgtttgcccagtttatgttgaccttggaggcattggcccatttggacacttttcattttgtcaccctccaggcatgctcatttctgggctgttttcaacaagagcaaatggcattccgattaaatgcatttgggtccatcatcggtctcgttgtgtggatgctaattgcaggtaattagctactaatcattgtgctattgtatcttagggtaatattgaatagggaataaataataatatttttgctcaacacatagcgtcactccttgcttaggccaactacttctgttcggtttcgtcccatgtgccaaacggttcgacccggtcactttgcacttcttcgacagttgcaattggccaaatccgaatgcgcgtggctctggatttgccttgctgaacatttggcttaccgtactgctctgtagcgcattttccatttacgcaattgcactgtctcatgtgcgccgtcgaattcagtaatctttttttaatattttcccatctttcaattcaatagctttggcacaaacttcgaattgaa

SEQ ID NO: 78706 - DNA, 804 bp, Heterodera glycines
  Genomic contig location: Contig_ID=SeqID_14623; Location=2587..3390; Strand=+
  SCN-specific regions: Sequence locations=1-190,213-264,286-659,682-804
atgccatcccaaactttgatgccatccgctctcggcagcgtgccatccacatcgccaagcggctcactttcgccaaaaagcagagagcttaaagaacgaaaacagatcaaagagttggcccggttgcgggaaatgatcatgcaagtgcgttttttatcaaaaaaattaatggaggaatccatttgtgtaatttttatttatactatgataaagaattttttaatgggggcgataatttagatttaccacaaaaaattaaaattgttaaagaaatttaaagtgccaaaatctgcatataatggattaattagggtgaactcaaaagctgaaactattttataatggcttcttatgaaaaagtcaattctgaataatggcttcattagggtgaagtcaaagcttaaatttttttttactgtgttgccaaagccaccctaaaaatgcttcggcaattgtaattcagcaaattcataaattttgtcaaaataacaaaacttattctgtttagggttttttgatcatgcaatcgctgcttttgcgctttgtcggcttcttcgttttgccttggttggcattcgctgccggtgccaatggcattgaccaacgagcgcttctctgtgtgctggccaacactttaattttggtaggcttgatttttgaaaatttatttatatttaaaaagaacttttttagctgagcttgatcagtcattcattgatttattggtggtggaactcgaaaattcgtgaactgtgcaaagaagttgttgaaactctgcacaaaaagctccttaaatcgcgctaa

SEQ ID NO: 78707 - DNA, 960 bp, Heterodera glycines
  Genomic contig location: Contig_ID=SeqID_14624; Location=310..1269; Strand=-
  SCN-specific regions: Sequence locations=1-192,326-326,452-691,714 -783,814-960
atgattaaaagaggtacaaaagtgattagaagagttacaaaaatgattaaaagaggtggtacaaaagtgattagaagaggtacaacaatgattagatgaggtacaactgataagaagatgttcaaccgtgattagaagaggtccaacagtgattagatgagtccaacagtgatcagaagaggtacaacatggtttaaaattaaataaataatgaaaagtttttataaaaatcgaatgcattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaattttaaaaaatttttcacaaaaaaataatttaatttaaattaaaaaattaattaaaaaaaacaaacactcttttaaatgaattaaaaacattaaaaataaccaaaaatgcatagcaaaaagaatgtacaccgcccggattcgaacttcccccccccccctcaaaatgatgcctcagaatccccaatcacacagggattctgaggtcttaacgatgtcaaaagtaaaatctgatcacgttttcgtgatcagcgtcataaactacccctaaagacatgtttttggaatattttcggtgaaaaaatttttccacccaaaaatcctggtcacccccctttggtcccgaaaccaaaaatcacttttatttttataacaattcgcaaaaaagagataaaaatgtaaaataaaatttatattatagagaaaaaaattgcggatttttgtagtatattacttttacagaatgacttttcagaagcgagttctgaatttttttctgaaaaatctaaaatttccagaatttctggaataacttctttcatattgaagttagaaaacccaaataaa

SEQ ID NO: 78708 - DNA, 3615 bp, Heterodera glycines
  Genomic contig location: Contig_ID=SeqID_2249; Location=1211..4825; Strand=-
  SCN-specific regions: Sequence locations=1-776,799-1874,1896 -2538,2560-2633,2655-2944,2981-3141,3170-3251,3273-3584,3613-3615
atgagtcgcagtcgttttcgcccttttccaaaacttcaaacgacgctcttgttattgaccccctgtgcctttacttcatgtgccagggcacaagttgtctcaatcactgcctctgctgagaaatgccaaaggtccgacttcggctcggtgtgccatctcgagagctcgacaacagttactcttctcccatcgggtctgccggtacgtctactccttcgacatcccgacgagagagtccttggcacgcttgaaatcagcatgcgctcactgactttgcattgcctgccaaaatctgagcaatggcttcggtcctatcacattgagacagtttcggtaaaacggtgcccgagtcgtggaaattgtacacgcgagttctgcgatgacgtcaacaacggaaggaagacagaagttcatgagctgagcgaatggaccaagcatcccggattcaacagatgctcagcatcttgctccttttggtggtgcgggtgtttaaatgccggtgccagctgcatcttctaccgtccacatgccattgctaactcgccaattgtttacgagcaaatctcctgtcccacatgggaataccgcttgcgcacttcactcaaactgtcggtcaacgcaaacttcacgaaagagccgtccgtgtcgctcacacccggcattactttccgttggaaggatttgagcatcacacctattgcctcttcggttcctccggccccaatcatggcaaccaagttcctctcggatggcaataacatggcaatcagtgatgaaatccaaagtgaccttcaatgccccagtcgtgccaatgccaaacgcctcaactgcacactcagatggggctcatgtccgatgtgcctgcctgaccacgattcagcaaaaatcaactgccaatgccgagatgtcaaactcgaaccagcactcgccgatcctgagaagcgcctaccaattcagctcaaaaacttgcttctccggaacgaaaggcgggacatttttgccgaaatcacctacgcgccgattcagttgtccattcaattcgaggggcttcgaatcgctacggaagaggacctaacaaaatgccatgccatgtccaagggtcttttcggatgctattcgtgccacactggagctcatctccatttgcaatgccacaccgactttggctccgcacttggctacgttcgttgttcggatggcacagaattcacagccctctgccacaaaacaccagaagttttgaatgtcagcctgtcattcaaccgtgccgaggtcgacatcaattgcaccattgaatgcagtggaggacggaacccattcgtgattaatggtcatctccgctatgtgccaaaacacttccaagcacctaatgaaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcgtctatatccttttgcgttgcaaccctgcccttcgatcttggagagccataagccgagtcgtccttttgttccttgctctttggcctacgactgattcttctgcagcgggagggctgagccatctactcagcattcaaaattcagcaccaaagctgcagtttgaaggccattcttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccttttccaatggccacactgctctctttcctcgccaacacaatgaacatcgaggtggaacgctttggtcttgccgtgaccacatcgctgagccgttggaacgaggcccgaacaatcgttgagggactgcatgaacgcggctacgaactcaagacgaggcatctgcacccacgtgagcgaaatgtgcgacttcacggatctgagctgagccgaagtggtgcgaatcgtctcggtgcctacaatggaagtgcccgtggcccaactgtctccgagctgtaccgctctcgacatggcatcactcttcgccacccctctgccccatgcctgatggagcccggcgggaatggacaccatgattttttccccatcgaaatgatccgagtcgtggcccctgaccaagtttctacaccacggggtttgtccacacgccctcttccccgccctcgcccgtctcacttcgcgctctgggacagaattgatcatccgccccggtcccgagaattggtgatcaacgttatgccccatggtgattcaacgagtcgaggtgccgcggaggaataccgcatcggtgttggccgcgaactcacgatctctggccccctcgttctacgaatctatgctggtgcccttcttcttgccctattctctgttgcccttgtcgatggccaatcatctattgccggtctctgccctgctcattcttttgccctttgctcttcacggctgcacaaattttcttgccttggtccgtcgctttttggtccttccgcgtttgattttgtgcaaatcacgaacaaatttgcttcgttggcttactcaccgcttcctggcagcgaacacttcgctgaaagctatgccgaagcagctgactcacccatctctccgctgtgttctgccattctgccatttttgctctctggcctagttcgtatttggccgctatttaagccatggatcgcaagaacgggccaccattcatttccctccgactacccaattctcaacaccttctgtgccatgcccgccaaacctaatcttctctcgcaggagcttgccgaattggaaagaaggaaaatggagctggaacagatgatcgcctcagctaagaaagaagtgccggaagggaagagccgtcgtccaaagaagtgccaaagttcggacgagcccgcccctcaagacgagcccgaggaaaagggacctaaggcggcagctctttctgatgctccgactactcagccatcccatccgccgctcggcatcgtgcctccaccacccccatcacctgttggctccgatatggccgaccttttgcatggtcacgtcaataagtgggcaatggaacgtgaggaggccgtgcattttttgcagaagaaaaaacgagatgtcgccgtgcctgttcacgatgcactcaaaaagttcaacggcggcatcaaacgcctgagaacggcgctggacgacgtccaggaaagtgtcggctcgatagctgctggtgtgaacgaattggccagctccaccagtgacggcttggtcattgccgtcactcttctgcaagctgaagtcgatcgccaggcggttgagttacgatcgttgcgccgagcactgcacccgccacccgacgtcgaaactttgtcggttgcctcgtctgatgaaggcacaatcgtggctgaaccatcttcggcggcgagtgtcgccaaagcgactaagaaagaggagaaaaagaagaaatga

SEQ ID NO: 78709 - DNA, 2675 bp, Heterodera glycines
  Genomic contig location: Contig_ID=SeqID_2250; Location=245..2919; Strand=-
  SCN-specific regions: Sequence locations=1-393,418-583,605-2087,2109 -2675
atgtcttcagctcgatgccggatggctttggggcccgcgctgttccgacttcggcaacatgtcactacggccgaaaatttgctggacgagcccgtgatcaatgccaagacgaccgaaaaccttgaacaggaacgggggcacatcacccgtatcctgtcaaggatggaggtcgagctggacgcgtggggtgccatcatgaacggactgcaaggccctgcgagagaggcggaggaagcgctcttcactgcctttgttcgagatgaccggcacttgacggagtggttggaagatgcgcgggaaatgctggctcacatagcagcagaactcgcagatgagcccaaccagcaaatcgcggcgggaggacagcaaccagctgttgctgtgaatccacccgtgccagccgtgccattcgtcaacaatgccgtatttccaggcggtgccaatgctcaacagccagctgctgttgccaatgctgcaaatcaaccaccaccgatgccaatcaatgccggtggtgtccatggtcaacagccatttgctgttgccaaccctgccaatctggcactaccggtgccaatcaatgccgcacctgtgccattagctactgcacgccttccacagctcagtcttcccattttttcgggcgaaccaatggaatggccagcattttggcagagtttcgagagtgccgtcgaccgtgccgcccttgagcccgtcgacaaactcaactatcttcacggttgcctacgcggtaaggctgctcgtgccgtaaccgcctaccgtggaggggagaattacgcccatgccgttgccgcactcaggcgactcttcggagatccacggaaaattgccgaagcacttcagtccgaactgatcaatctccggcctgtggacgatagcgttggatcactgcaacacttcctcgagactttggagcgtgtgtgccgccaacttttgaacctcaacatgccggatgacagcccattcatgtaccaaatcatccgcagcaaattgccgtcgactgttctgtccgaactcatcaaaatggaacgtgcggcaggcattccatggagtactcctcagctcagagctggacttgccgaagttctcggagtcagagaagaggtcgaacgatgcctgcgcgaagccaatgccgacagacaaacacgatttcggcacgaagcaaggccaaatcgacctcagcgaccagaacggcatgaaaatgcgcgagtttttccgttgctcagtccgtcagaaattctgatgacaagcgagttccgtcctgcctgttctgccctggccagcattgggcctcggagtgcaacaaagtgacagatgcagagactcgaaaacgttgccttttgcagcagaaccggtgcctcaattgcctacggaagggtcaccaattgagggagtgccggtcaaagcaagtatgccgagtgtgcaaagaacggcatcattctgcaatctgccctagtgccaaagggacatcttctgcccgttcaaagcaacagaagccctcgcccaggaacaaacagagtttcggaaatgagcgcaactcaaggccattggtgtcatccgcggttgccaatgaggctgactcaatccctgagccgaaaactgttaacacaatcatggcaattgtctccccatccgttcctcatctcgtcatgctcatggccctccgagctcctgtgttctcagaatccgcaccgaacaagcgccgtgacgcactcttcttctttgaccctggtgcgcaagtcactatggtcaagacaccattgataaggcaactgagccttccgaaactacaagacgatcagctagaggtgaatcctttccacacgcggcaacccatcaagatgaaagcgccgcaacacgttttgtgcgtccaacgagaggacggcggatacgaaactctggttgcccatcggacggattggatagtgccatcagtgcgccgtgccacattcctccagggaatgttagtgcctgtggatgaagaaccggacattctcgttggaatggcagacttttggaagtttttcaacggtgtccaacgagtctctccgcaacttttcaaagtccaaacttcgatcggttccactgtctgcggacgcgatgaaattccatcccgcccaactgccgaccatccactgtccgttatgcccgtcactgtccatgttcctgccaatgaagacgagatgcccaatacggctgtcagcggaattcagagaaacgaatccatctctgatcttgactcgctacgacaattctgggaccttcaaaacattggcatcagagatgatccactcgaaaacgatgacgagacggcacaacaaatcttcgaccagacgactacgcgcctggcaaacggaagatacagcgtaggatggccatggaagaattttccgccggacctgccctcaaattttgccatcactcgctcaaaaaccaaagcactggcctccgttctgttcattctgatgtgcctatttctgattggcgcttcccaaaccaacgccagtagcacgactaagccaaagcgtaggaatggccatccaattcgttgtcgtggatgcgaactaacctgcacaaaaaccggcgtggacattttgatcccaaatgggattgccaaattcttgctatgttgtgccgatgggactcacaaaggagag

SEQ ID NO: 78710 - DNA, 255 bp, Heterodera glycines
  misc_feature (9)..(9): n is a, c, g, or t
  Genomic contig location: Contig_ID=SeqID_2250; Location=1..255; Strand=+
  SCN-specific regions: Sequence locations=1-25,47-106,129-156,181-255
acagggttnggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgt

SEQ ID NO: 78711 - DNA, 582 bp, Heterodera glycines
  Genomic contig location: Contig_ID=SeqID_2250; Location=3392..3973; Strand=-
  SCN-specific regions: Sequence locations=1-336,358-532,555-582
tcgacatccccagacgggttaccttatatattgaataagcaatgcgcagattgcagatttattggcacctattataagtgaactcttccgaataatcttagattatggggaaatcccaaacttatggcatacatcttttatcattctaatttataaaaaaggagacaaatctaatccaaataattaccgtcccatctctctgacatgtactttatgtagggtttttgaacgactattagcatggaatattgttaaacatcttgaaaaaacaagattttaacagatgaacaatttgggtttttgaaaaccaggtctactaccacactgttgttggtctccctggattatttttaaaaatcaatagaaaatggacaaaatattgatataatttttatagattttgaaaaagcatttgattcggtaccaataaatttgttaattgttaaacttcagaacataggtatctctggaaaaattttgaagtttctccaaaattttctatatgcaggtcatatcaagttaaaattggagaaaacttttccaaaagctttaaaacttactcgggggttccacagggcagtt

SEQ ID NO: 78712 - DNA, 67 bp, Heterodera glycines
  Genomic contig location: Contig_ID=SeqID_2250; Location=484..550; Strand=+
  SCN-specific regions: Sequence locations=1-67
tggcaaaatttgagggcaggtccggcggaaaattcttccatggccatcctacgctgtatcttccgtt

SEQ ID NO: 78713 - DNA, 122 bp, Heterodera glycines
  Genomic contig location: Contig_ID=SeqID_14625; Location=169..290; Strand=-
  SCN-specific regions: Sequence locations=1-70,92-122
atacacaaacacaaggaggaattgaacttgagaccccctttttgttgactaactcacagaccactaagacgaaaaaaccaacttaattgtacttggagcccaaaattgaatcgccgtgatta

SEQ ID NO: 78714 - DNA, 915 bp, Heterodera glycines
  Genomic contig location: Contig_ID=SeqID_14626; Location=276..1190; Strand=-
  SCN-specific regions: Sequence locations=1-172,194-327,363-392,414 -496,536-556,590-648,670-915
atggattttcagaatatctttttgcactgtcagacgacaaatgaagcggcactttgtctatatcgggcccatggttttgaggtcgttcagcaaattcatggccattatcagtgcagggcaattgacggcgaatcggcggatgcttttctactcgagcgacggtttaccaatgaaaatgatgaggagagaaaagttcgacaaaatgcggcatttcactagaacaatttttttgcgatcaattcagaaatttgttttgccattatttgtacaattgcgcgtttttgcctcatcactttgctttttttaatttctactttggttcttaactttaaagtcaatttaaatattttctgtaaataaatcacattgatagaatcttagcttttactcaatttaagcaaaatatggagccctccgccaattgtttgaaggtgagaaaattctttgtttccaagacatgggtattgttaagcaaatttttgtctatttaaattgtaggaagtcatttgtggatttttgtgaatttcaagaaaattatgccatcttttctctgcagttaaaaattataaaaaaaattttttttttaattgattcgtcaccttcgccccgatttcccaaattttcagtctgtcgccaccgcactgcacacggaggagcgactgcgcgcgctgcaggaccgttgctgggcattgtgttggcaccacaacggcaaactgttggcctcctgcggcgaggattgcacggtgaaagtgtggcattgcgttgacacggcggcgatggtgccaatgtgcagcaaaagtgacgccactactgatattgaagggaatggcgacggaatttgggggagtaccggcaacacaaccagcacaaagttggcgttgttgtgcacaatgcgcggagaccaaacacgctcca

SEQ ID NO: 78715 - DNA, 253 bp, Heterodera glycines
  Genomic contig location: Contig_ID=SeqID_14626; Location=2331..2583; Strand=-
  SCN-specific regions: Sequence locations=1-253
attcttgattatgtctatgctcgatttttgcatcaacaatgcggtgattcgcatcggcacctatgcgttggccattttcatgttttctcgaacggcgtggagagagttgagcggaaatgaaaaatttgtcaaacacttggaaaatgaggcgaccggggtgcgcaagatggacaagaaaaacattgtgacatttaattagcgtattatgtataaaatttgatttatgttgttttttgaataaattattgagttt

SEQ ID NO: 78716 - DNA, 1524 bp, Heterodera glycines
  Genomic contig location: Contig_ID=SeqID_14629; Location=847..2370; Strand=-
  SCN-specific regions: Sequence locations=1-180,203-409,449-1502
atgcatttacttttcgccttttttgtttcggcacttcaatttcattcaaacgcaaatccaaatggtcttatttatgcttacatcaataaaaaaattggaactcggcctgggacccaaaattattaatgaattttctttcttaattaatatttcgttaaaatattttcaaatctgacggagtgttttaaaattttgaaaaagaacacattaaatacattgtataggtagtctaagtttttttttacataaaacaaatgtacatatttttctacttagggtgttaactaggttttgtcgcaattcaaaaatgtgtaaaaacctaaaaaccgatggattctttctggcttttttaaatttttcttttttatacttcttttcttttttatttcatattttgagatttttagggaattttttataaaaataaatcataatgaaaaaaattattcggaatttttttacatattttatgattttcttacaattggcacctctaattatgtgaaactctaaaatttcccaccaatttgcagtagcaatcagcaatccagcggttgaagcggtgaggagcagcgaccaattggccacgctggtgcaagccgccgtcgatgtggcccacgaatttggactgatcaaacgcttgtcggacgacgactcgcggaaacggtgcgcaagtgatagaacggcgcaaggacagctgtttagggcgtgggttcgcttcccactcagtgccgaacatttttgcccattttaacgaaatcgatgccactttgggcgcttaatttgattgatgcaaactccaagtcaaatctgtttaagaaggaacagcgatgtggtttccattcagccgttcagtctcttcccgtccccattcccacgttcggcttaccaacaggcgatggatgtgcacaccgtacgcttttttcaccaataatttgcaaagcattcaaaatttgtcgtttttcaaaatcgggtacaagtaaaatttagggtctgggattcgtcctgaaaattcctattagccgaatccaggatggggccctgacccaaacgaaaccgtgactctctgcacccccgactagcccgacctcgacccgtcaccccgagtcgtacaaccctaagaattgcatttttgtgagggaatgagaaaaaattttgtgcacattttggattttcattaacttttccaaaagttttttattcaaaattatttttggttagcctattattgtttctatctaactatgattttttaaaaccatacgttttctattgtaattcaatgccatggaatgctaactctacgatgatgcaccaatttttttaggggatgcaaaaattgtactttctcgtttcttgtgacttcgactttttggtgaaagcgacagaaggaatggtcaagtcgaataatttgtatggtcgaatgatcgaaatgatgaaggaaattcatcgagaaggccaacggcagccgtacactttgtttttgacacgatcggtcattgaaatattttattaaataataaa

SEQ ID NO: 78717 - DNA, 632 bp, Heterodera glycines
  Genomic contig location: Contig_ID=SeqID_14629; Location=2682..3313; Strand=+
  SCN-specific regions: Sequence locations=1-318,368-372,424-632
atgagaatgtcctggattgtcggatggtccttttgtatccctttattccccaaaaatacagtttgcaacagtacgcctgaatgtcataagttttgttgactttgtgtgtaaacagcagcgacgttcgaattagcagcgtataatcacttaatatgtgatttgatcatgataaaaaaaaagaagcatggattaatgtatataactgttttgaaaaattcagcaattcgattaaagaaatgagaatttgacgcgaattcaatgaaattgcaatttttataaatatgacaaggaataatttttttctatgggtaaatgaactataaaatcattttatacaattttgtaaatattagaaaataaaatatttggctaaaaattttagtacaattttgtagtggttgaaaaaattttgagggaaatgattgagccctttttgcgaacaggggatcgtttttttagcccatccctgagatatcaaaagaacttaactcactttccttccaccgttctacgaattattcatccattccaaaaaattttgctcaaatagtggccaaaagtatatgctcaaaaatttcaaaattttagagctaggctatgcgaaaattctgaaacaattactgctagcttag

SEQ ID NO: 78718 - DNA, 2981 bp, Heterodera glycines
  misc_feature (2706)..(2706): n is a, c, g, or t
  Genomic contig location: Contig_ID=SeqID_14630; Location=292..3272; Strand=-
  SCN-specific regions: Sequence locations=1-202,267-270,335-611,640 -807,829-1037,1059-1566,1588-1683,1705-2850,2872-2875,2897-2981
acaaagcgccggcggccgatgaccaaatggcgcgccttttggaccgtctgaatgaatgtgttggacaactgaaaaaggaggccaacggaggggaagaaaaggttttaaataaaatgagaaaattgttattttaagtggacgagacaaaatcgcggccaaaattttaaaaaatcaaaagaaatttttccaaaaaaaactttggaattttttaagaatataacaagtataaattttattttttttattataaaatttcaaaatttttagcgattttttggaaaaattttgaaattattcatcataaaatttccaaaaaacatttaaaaaatttgcttttttctgtcttaacgatccctttttttattttttgagatgccattaatgaaaatttgtattaatttttttagggcattgacacaaaaagtggagaaggtcaaactgctgccgacgatgggacaaccgccatggaaatgaggggggatgaggaggagcagcaacaaaaacagcccgacgaagacgccgaagagaaagcgccgaagcgaacgccaccacaacaacaaaaggaacagcacgacgaagacggtgtggcagcaaaaatgcaataatttgagaattatttttttatttttcaaatattttggcaaccgggaaaggcccttaaatcaaaaaaaaattgggttgggtgtagaaatccgaaatatatttttaaattacaaaatgggatagtatttttgtcacactctctctgtcatttggccaatttttggtgccaatttcccccgcgtgcgaatcggcatttttgtgccattcttattatactttcattttaggcccttcgttggctgattgcgttcgtgaacttggccaactcgtggacacatttgcagagtaagaactaaacacaaggggggttttttgccatagttatgggcttttgtgctatattttgggggtttttgtgccataattttgtggcttttgtgccattcccccaaatttttttcagctttgccacccctccgcccactaattgttggcttccattccgtgaaaatttcatccatcgacggcatcggcccgccattctgacgttggcctccgtctacgccatttatcgtgtgctcaaatccgccgatgaagtacaaaaatggcatttaaaaaaaataaaatttgaggcacattttcctccccattttgtcacaggttgcagacgcatttctgaccctaagccaagtgctgggcataagccatgaacaaatggtgaaggatttgctacgggccggctttctcatccaggtgaacgaggagaagcacatcaatttggatcatccaaaaaatttggcatggatttctaggatattgtgaccgaaaaaaatatattgggtcatggcaaacggacgggggaagtccgggcttttcaagatgtgctctctaataataattgaaaattttttgcggatttcaacgatatatctgacataaattattatagacggaatttcgacaattccctgtgaaaaccgaaaacctgtacaaaagaggtcaactttcttgtattagttagaccttttttcaaataatacctattctaattttttcccgttctcagcttgaaacagtttcctcctccgttgacggcgaccgccgcgagcgcgaggcgttggccgacgttttcgttttcttcaaattgcccaaagttttgaggtgcgcgaacactgtcgacaagttatttgaaaaaaaaattttaaatccgaatttgaaattacaaatttttcaaaaaagatttctcattttttaaatatattttttcgaatttaatagacttttttgttaaatttcttatggggcgacttatgccaaacatgtggagtatgcatttggagtattaaatcttggcattttgcaaccaaattgcacaaaaaatatcccattcatttttaattgtcctgtatcttggtgccatcctccccgccaccttcgtcggcattggcatttccgctttattccaatcccccccctttttgcagcaaaatgttgtcccgtggggtgccccgcgcgtcggtcaccgccgcgttgggccatttgtgtgctagcgcgtcgctgttggacgaattggacgccaaaaagtcggacaacatgttccgcttcttcatggacgcgctccgtcgtgcggacattgtcggccaaactgaccacgaggcgttggtacttcgccggtgggtggacgcgccaattttcggcatttttggacacggccctcaccccctccgtttttcatcccgaaaatttattccaaaaactggaaaattaaattaaaaaaaagaaaatacacagaaagttggaaacttaaaccttttttaaacctgatttgagactgattttttaaaactggaattaaattaaattcttaattcaaattcaaataaaaattccattttaaaaaactattacaattttttcccaataaaaataaattacctaaatgtgtccccattattcattataaattattataattcaatatggccctaatttaatcaaattttgtgtttcagtgatgccgaccggggccaaaacgatgaactgcttcagcagttgcgctccaccattgtcggcatttcctcatcagcaacaagttgggcaaggaatcaacaacttttaaatgctttttttgcaattttcagcggccgccgaggccgctcaaantggtgaaggcgcgctcggagctgatcaaccgggtgcagaaggccaagagtgccattgaccgggtggtgccggagaagacggaggaaatgttgcgaaaattgatcccccacggtgtcattttggcacaaaaaaagccgtgaaaaaatttttccccaatttcagaggtccccattgacatgctgtgctccatttacagtgccagcggtgaactgtcccaattttcgggttggcttgccgcgctcaatgcgcagacgcaaatgggcggcaccaatgag

SEQ ID NO: 78719 - DNA, 1217 bp, Heterodera glycines
  Genomic contig location: Contig_ID=SeqID_14631; Location=343..1559; Strand=+
  SCN-specific regions: Sequence locations=1-342,364-496,518-606,628 -784,806-1217
ttcctttcgataaattcactcaacgaacgcaagcaatcgaaggcttattgggtatgcattgatttgttggagttattgtttgaatttaaaaaaataaaaacacattaaattctttgttgtttattttcaggcgaaatttcaccaaaagaggacgagaagggaaaatatggtaacgaaaataagagatataaatcgaaaataattcaaaaaaactttttttttaagtttctgctgagcaattcacacaattgcaaaatgatcagaagaaacttttggaacgcgtcaacgaattggaaaaacaagggccgactatcggtagcattatgataaaataatattgatcattttttaccatgttttagcaatgatcaatgaacaattcgaacagttgcaaaatgatcagaagaaacttttggaacggatcaataaagtggcaaattcccaacagcaggaaaaatacggtaggtttacgatgaataatttacaatcatattgttttgaaattaacttttctctttttaagtttccgttgaacaattcgaacagtttcaaagtgatcagaagaaggcaatttttgaacggatcagtgaattggaaaagcagatgaaagaacggatgcagaaacaggctgatgaggaaacggggccattggcaaagaaaggtaagtgggttcagagagcccgatacgccacttaatccgccggggtgggattttgagggattcccaaaattgcgggattaatcctgcgggattcagtcccacacggctcgcgccgtaaaacgattttgagataataatttgtgctcattgtcatgatttaatttgttaatcaatctttggctttttgtgaattctttaattgtttaagcattattggtcgatgaacaattcgtgcaactgcaaaatgatcagaaggcaattttggaacggatcaacgaaatagaaaacaaacgatacggtaggtttacgataagtgcttttgaattttgaagaatcaaagtttacgcaatgtcaatttctttcatttttcagctgcagctgattacgtaattggtgtgaagaatgacttaaacaaagaagcaaaagaattgaaagaaaaacaaaagcagtttgcgcgagaaaccattggtgagttgatttgaacaatgtaattttatgcatttaaataaacatttggttatttcagcgaatttcgaacggttgtcgaaaaaatacg

SEQ ID NO: 78720 - DNA, 3052 bp, Heterodera glycines
  Genomic contig location: Contig_ID=SeqID_14633; Location=616..3667; Strand=+
  SCN-specific regions: Sequence locations=1-291,326-640,662-687,718 -723,747-1151,1173-2357,2381-2542,2566-2787,2809-2816,2844-3052
atgtcctgtaatccttgctgctgtttgaagcttaaggatgccgctattagcatcggaatttggtcaacggtgggtaatttcggttaaatatcggaggaaaaaataagacaaaactcagtgatttcttttgctgatattccctcactttgtcaattttgattaattttgttactccaatcactaagtgatgcagccaatttcaatagttttggccgtaatttccgtgctcagttttcaaatgcgacggtcggcttctctgtccccaatttcacacccatttgataattacagattaatttttattttaattatcaaatttaaaaatgatgagtgaagtgcattatgcatgattagaagaaatcgctgccctttgtgcgatggtttcacattataatttgcatttgacattttgtcgagactatcagcagaatactgtaatttcgcattcgttctgtttgtttcatcccaattaaagatttactctctcgcccaaattgccgttttcggatggcaattcagcgtcctcgcccagtgccaacatgttataatggcacagtccaacctccaatgtgactattactgtccctgtgttggcgcttcaaccgcgcgaacttccgcaataattgagggtattttgtggaaaatgtaaaatattaaaatgcatttttacgataatttgtttacacattgcattttttgcactttaatttcagtatttattcctttttaattatttattttttattctttgtttctctctcaacttctgctgctgatcattttcattattattttttgtgttccaacttttgtgttgatttttttatgtattttaaagtgagggaatgtttcggtgttttaaattttttcgcattttaaatttccaattttttgtcccattttctttcattgatcaatcaatccaacaactccaacagatatacagcataatgcaattggccattttcggttggcaaatggccgccataaaatacgaaaaggaccgcgcagcgaacactcttctgcccaattacaacacttatggtcgctacgacattccgacttattacgaaagctattggcaatcaccggaagaacgctattacagctgtaaaagcattgtttaagtgaaaagagtgtgaaaaatgcaatgtttaaacaaaatgaaaattgtcattaattacttttttaatcattttgttttgcccggcccaaattacccaaaatttcagggcttttcgtaatccaaatcctttgtctgatcgccgccttctttcttctgttcgcttccattatgatgatttatggggtgcacacggtaaatgaggtgtcattcaaccaaaatgaaattccgtccccgttgacagtggtcgcgcttccttctcgtgccgtggatggtaacaatgtgcgcttccatcctcacttcgttcgcctattgtgcccatttgcttctggtccccaaaaatgcttttctcctcctccccattaaggtttaatttggtgggctggcgatgtgagggattattggcttctgctaaccatcgtcgaaatgttcggcgttttgctcaatgtgtgccattggctaattctctttcctcatttgggcattcgcttaaggtgtactgtttcctcgttattgttatgttccatcggcgaatgctggtcgaacttgagtattatgcgagaagacgaaagtacgaccgattcagccaattgccaagtgaaacggcacaccagcaaagaacagaacgaggcaagaaatgatgagcaagaagagcatggctaattgggtaaaacattcagcagaaatggacagaaccgacccgaggcccagcaaagagacggcacttacgtgccaacgccccggcgcggaaagccaatggccctaccaatcgcctcatcatccattggccggtgctcaattggcgggtgattttgatgcaacaacaaaccaacggccgaatgaaatggcagacgaaattcacacggcacgacaattggaacaacggcaccaaaaaaggggtaaaagagagggggggggggtggcatggcaaaatgtgaattcaaatatatgctagtttaaagagtcagtctccctaattgtttaccaaagtgttatccttctcggcattagattcaccgatcattttgtctcatcttcaccaaattcggtccctctcggcgatggaacgtccgctacaaaagcctcaatttgatgaatacggcgaaatgccaaggagagatagacggaggaggccaacttcgcacaggaaaaagtgggtgacatcgaattcagttgattacttgtccctcatcgtcgtcatttcggctttcagaagcactccctgcggaatgtgccacagggaccaatcccaccgccggtgccattgttgccacgcgtctaagcattgtcattggcacggtcattccgctgaaaggcatcacaaagggtcgttctcatcgtcaagttcgaattctgcacttggcgaatattcggcagaggaattgccggcctttggacgaagaacaagcagaaaaggacgacggagtaggagaaaaaggagcagagaaagagcacgtgaaaacaccgcatggtcggacagagagagcgaattgtaaaagaggggggggggggcagagaaagagagggcggcgcatttcgggccaattaagcagcgaattgggccatacggtgcgaagtgaacgcgagtacggtaatgtgggctcattggaaaggcgatggacaagaccggcaccccacaagcaattcccaactttcgaggagaggcggagacagcagcagcaacaaagcatccgcaaggggtgggaaggggggcggggaagagaaaccatttttggagtttgggtcaatttgtagccatagggagccgatgccccgggcggactcggccagcggcactttgccgcttcagccccagcccatttcggcacccccaccaccggctggcattgctatcccacagcatattgtgatccctcccgcacaaatgggtgcgcgaaggagcgaaacatggactcgcgggtaattaat

SEQ ID NO: 78721 - DNA, 796 bp, Heterodera glycines
  Genomic contig location: Contig_ID=SeqID_14634; Location=206..1001; Strand=-
  SCN-specific regions: Sequence locations=1-254,276-371,403-469,510 -748,770-796
atgtccatatcgattctcaccctctacgagccgttccaccaatttttccaatttttcaagccgttcgatgattgggataagggtaggattcccagacccctggagcaatttttcgagtcgttctagacgaacgagaaattttcattttgaataccacaaacaaaacaaaacaaaaaatcagatataaattttaacatcattgagacacaaatacttaagaaaactgccaaataaaaatggtacttctccggataatatttcctataaaactaaaaaactgccactcttcattgccaactgttattctgacttgtttcgattatctttagacagtggttctcttccaaacatttagaaggaatcaatcgtctttccactttttaaaaagggggataaatttaatccagaaaattatagacctatttccttaacctgctcactttgcagggttatggaaagaattctcagcaaaaatatttataattttctattaaaaaataataaaatttcagagttccaatttggttttgttagaaataggtctacaacaagtaaattaatatcagttgttgaagattggtacgaagcaatcatagaaggaaaaaatgttgattgtatttatattgactttcaaaaagcttttgattctgtccctcacaatttactattatataaattagaaaaaattggtattaggggcaagcttttaaaatggataaaagaattcttaagtaacagattttctgatcacattttacaaataacaagaaatgcatattcacgtatgcgatccttg

SEQ ID NO: 78722 - DNA, 1208 bp, Heterodera glycines
  Genomic contig location: Contig_ID=SeqID_14634; Location=1179..2386; Strand=+
  SCN-specific regions: Sequence locations=1-724,746-828,850-972,997 -1208
atgccggaggcgatggacggacgggcattggtggaacaaattgcagaagaatgtggcatcaaagacaaactttcgccggacattcaccgccatccaaggacaccacctgagagcggggcaaaaagggaccgaattttgaaggtgccgtttttggataaattatcacgtgacaaattcctttacaattttcgtaatgcactgaaaaaatttcctaattttccacaattcatcaaagttcgcagggatatgacccaaagcgaactcaaaattttgtactccctgcggcaacaagcctatcaggccaatattgccgcaggtgagtacaaatattttgtggtcgatttggagatcaaatctctgaaaaacccccgcccgctcagaactcgctagggatacgcgagcaaaccaaacaaaaaaattaggaataagggagaaaaaaatccctgggtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaattcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaattcatttcggaccagagtaattctgaaaatatcatatattgtggggattttaacatcccaaatattttatgggacgacaataaggtacttcaaagaaatgagcctgtgtcaaatttattgattgagtttattgaccaaaaacaattgaaacagcatgtcaaacaaccaacaagagaaaaagctattttagatttagtaattactagtgaatcagaaataattaatgatttaacagtacttgaaaatttttcaacttccgatcacaaaatggtcggattcaaaataaagggaaaatttagtcgtaataatcacagagtttatagaagagatttaaaaatattaatttttcgaaattaagtcaggcgatacttgaaaatcgaaatgatttagca

SEQ ID NO: 78723 - DNA, 583 bp, Heterodera glycines
  Genomic contig location: Contig_ID=SeqID_14635; Location=214..796; Strand=-
  SCN-specific regions: Sequence locations=1-48,70-583
atggcgggggggggggggtggagcggtaatcgaagaatggtggaaggcagtggaaggaggaggagagaagtggtgaggggaggaaaacattggtaaatggaaggaaggggtaattcacaatcagcagtggaagagggatgagaagtgggaagtgttgcctggtactaaaacattcattcgtttgtgagagaaactgaatatgacagtaaacgtgtacatgtacgtcgtacatgcgattatcatgaaaacaaaaaaaaagaaaacgcaacttcattacaggaggaggataagtatactgtatacatatttgtggagcaaaaaaaatatatgcttcagtacccgtatgcataaagatcaggatcggatccccggatcgtgatccacgaatcactgattcgaggatcgaaaaatccgtggatcaaaatccgtatgcataaagatcggattgggtatcccatggatctcgatccgtggattgtattccttttcttttcctcagtagttctcatcaaatccaacgctattttcctttcctctaaatcgacctgatccgcggatcactttatttaccatgaataataaa

SEQ ID NO: 78724 - DNA, 1655 bp, Heterodera glycines
  Genomic contig location: Contig_ID=SeqID_14635; Location=339..1993; Strand=+
  SCN-specific regions: Sequence locations=1-389,411-460,482-782,956 -996,1230-1270,1402-1402,1504-1544
atgggatacccaatccgatctttatgcatacggattttgatccacggatttttcgatcctcgaatcagtgattcgtggatcacgatccggggatccgatcctgatctttatgcatacgggtactgaagcatatattttttttgctccacaaatatgtatacagtatacttatcctcctcctgtaatgaagttgcgttttctttttttttgttttcatgataatcgcatgtacgacgtacatgtacacgtttactgtcatattcagtttctctcacaaacgaatgaatgttttagtaccaggcaacacttcccacttctcatccctcttccactgctgattgtgaattaccccttccttccatttaccaatgttttcctcccctcaccacttctctcctcctccttccactgccttccaccattcttcgattaccgctccacccccccccccccgccataattttgcttccttttctttccacatacagctagctctttacatctctgcatttctctgttcttttattttcgctctgtctctctcttttcacaatcatcatccacacatactacattcggcttgttccccgtgacatttaattatttccacttctgggtctttccatttcatcatttattctttccatttcatcatttattcttttctaatttgtacattccgtcatttggtcatatgacagctaattgaatttaactcaacgcatttatatttgtcccattttttatttaactcaatcatttatctattttgttccttctaattttttagcgaatactctttattcattataatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggacggtcgaaccctcgcggactacaacatccagaaggagtctactctccatcttgtcctgcgtcttcgtggaggaatgcagatctttgtgaagactctcaccggcaagacgatcactctcgaagttgaggcgagcgacaccatcgagaatgtgaaggcgaagatccaggacaaggagggcatcccaccggaccaacagcgtctcatcttcgctggtaaaattccctttgctagacattctcgtaaacaattactgttcaggaaagcagctggaggacggtcgaaccctcgcggactacaacatccagaaggagtctactctccatcttgtcctgcgtcttcgtggaggaaagaactgtattgatgaatga

SEQ ID NO: 78725 - DNA, 106 bp, Heterodera glycines
  Genomic contig location: Contig_ID=SeqID_14636; Location=652..757; Strand=+
  SCN-specific regions: Sequence locations=1-106
atgacagccttctcggtgacgacgagtgcgatgacgacggcgaattggcgcagaatggaaattccgaccatttcgacgaaccttcggctgctgctttgcacgaatg

SEQ ID NO: 78726 - DNA, 742 bp, Heterodera glycines
  Genomic contig location: Contig_ID=SeqID_14637; Location=578..1319; Strand=+
  SCN-specific regions: Sequence locations=1-212,398-516,538-742
atggaaccaacacaacatatactgataaaggtaggtgcgtaacatgttagagttagttacgtgcaagtgtcgcaatccatttttgagtcaaattttcagaattttcacaggcaacgcctttcgacatcgtcggacccattactgaaaagaaatttttgtaaaagtctaggtctcgagtcttgtctcgggtttttggttctcggtatcgagtctcggggtcaagtctcggaatcggtttcgagtctcggggtcaagtctcggaatcggtctcgagtctcggggtcaagtctcggtctcgagtctcgactcgagaaaagtctcgggttttttggttctcggtatcgagtctcggggtcaagtctcggaatcggtctcgagtctcggggtcaagtctcggtctcgactcgagaaaagtctcgggttttttggttctcggtatcgagtctcggggtcaagtctcggaatcggtctcgagtctcggggtcaagtctcggtctcgagtctcgactcgagaaaagtctcgagttttttgggtctcggtatcgagtctcgggtcaagtctcggaatcggtctcgagtctcggggtcaagtttcggtctcgagtctcgggaaatttttggtctcgagcatcactactatcggcaccgctggccctgctcccaatgccacgccaagacattgtgccattttttgaccattctgattagtctaatttctcaattactgtactgcaaaatgaaa

SEQ ID NO: 78727 - DNA, 62 bp, Heterodera glycines
  Genomic contig location: Contig_ID=SeqID_14638; Location=1281..1342; Strand=-
  SCN-specific regions: Sequence locations=1-62
atgtggaagaactacgatttcatcaacaacaattgcaagaattggacccgtgatatgatcgg

SEQ ID NO: 78728 - DNA, 739 bp, Heterodera glycines
  Genomic contig location: Contig_ID=SeqID_2251; Location=548..1286; Strand=+
  SCN-specific regions: Sequence locations=1-90,112-412,443-695
atgtacaccgatcgagggctggagtttgtggcaaaaccgttgaaggagttttacgcggagaagggcattcaaaagtttgagaccagttcaaagaagaaggccgccgtggcggagcgtgccatccgcaccctaaagactcggctgtacaaatatttttccgccaacaacacttcggtttgggtggatgtgctgccaaagtttttgagtgccatcaacaactcggtgtgccgcgcgaccggccttaggcccaacgaaatcagcgacgccaatgcgagggaggtgtggaagagggtgtacggcgaaggactcgcacaattggacaagtcaccaaaaatcagagccggggaaacggtcagaattcccgagcctaagcacattttcgagaagggtactgtatttcacacattttttcggtcaatttattttaattttaggttatatacccaattactctgatcacgtttacacagtggatgaggcccgctcaaccaacccccagcattatttgctcaaagactattatggcacaaagttgaagagaaaattttatttgccagaattaacaaaagtacaagtggatgaaaacacaatgtatcgaattgaaaagaaatacaaagaacgagtgagagatggtaaaagagaaatgttggtgaaattcattggatttccggaaaaatattgggtcacaaatgaagaaataaatgaataaaaatattacaaatttaatgaaaattaaaaa

SEQ ID NO: 78729 - DNA, 314 bp, Heterodera glycines
  Genomic contig location: Contig_ID=SeqID_2251; Location=34..347; Strand=+
  SCN-specific regions: Sequence locations=1-314
tttgtttggtcattgacgcggacggtctgttcttcgtcaagaaatgttcgcagctgttcaaagggtgcacagacaaagtgatcattacgccaaaccacagaggcaaaacgcaccccaaaagcaaagcaaacaaaatgcatgtttcttaagattttgttcgggtttatacccaaatgttccctaaccagcagaagggagaggacacggacgaattgaaaattcaatgcgaaatggcggaacaattggcaaagatttggaagtgactgtgatgagaaagggtcggtggcacagaaacgcaaccgaaaaatatgagg

SEQ ID NO: 78730 - DNA, 2189 bp, Heterodera glycines
  Genomic contig location: Contig_ID=SeqID_2251; Location=1297..3485; Strand=-
  SCN-specific regions: Sequence locations=1-722,745-797,819-924,960 -1038,1061-1176,1204-1380,1402-1486,1508-1712,1741-2189
aacagattcaaagacatctgtcaaatggaaggcacaagagaagacagcaagaaacaccgtactattcaacgggagattgaggtcgcagttgattgggagagccacccgattgcaatatctggaggacagcccagccatgaaggcgttcttcgacaactgcccggactccggaccaattgacttccacgacgccttctttggcggtatttttgggtttaaatttgcaaaataattttgggcacaggtcgaacagggcccgaatatttgggcgcttcggtgatcaaccctgagacgggcgactggaagagccgtacgatcaaagtgaaggactttaacagtctttatccgtcgcggtaagaaatgtcggaaaaaaaaatgaatagttgaaaaatctttggcactttaaggaatatgttcaccaattatccggttggccacccgaccgtggtgcagtttgacaaggacgtggaatggaggcgtcaggaggacgttgttggcgacgacggcatccgccttgagggaatcatcaagtgcttcgtagtgccgccccgccactgccactacgatatcccggtccttccgtaccggctcaacaaccgcacgctgtttcccctctgccggacgtgttccgaaatgtacccgcgcggcttgatcgaccccgagtacaattgcgatcattttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagttcctcaaaatgaaatttgagggtaaaatttgaaaaacttaataaaaaaaaaaaaaaaaaaaaaataaacaaacaaaattttaagcaagcggatatccagcgtcttgtacggaggcgggcatcagcgaggaggagtcggcacggagaaagcaggaacacatcgacaaggccaaagaaaaggcccaagtccctcttgaggcggaccgaatcaaacacaaccccggactccgctacctgtccaagctgtgtttgaattcgctgtggggccggttcgcacttcggtaaaactttttagaaaaatttataaaaaattaaaaaaaatcaatagaaatcggctcaccaaaaccgaaatcgtcgagtgccatgcggagctggccaaactgctgaacgactcgaagattgaggtcagcagcatcgatcagctgacggaaaagttttggatggtctgctacaaggccaaggatgagcatgtggtggaacacagcacgagcaacgtaagaaaaaatttgaaaatttgaaatttatttgcctttctcaggtggccattgccttatggactacctctgctgcgcgaatccatctgctggaatcgctgaaaaagttgtatgggcctgctccgggtgttgagcggtacgacacccgtattctctacatggtaaaaaaatttggaaataaatgaaaatatgaagtaatttttataatcaggacacggacagcatcttctacgactacctgacgcagctgggtgacccacttccgggtggtgagcagctcggggagctcgccgacgagtacccgaaccacacgattatggaattcatttgtggtaagactcattaaaaattaaacaaaataaatggaatgtttgtttagccggccggacccaaggcatatggattgtggctgcgcaacaacgcaacgggggaggacgagtacaagctgaaggtgcgcggcatcacgctcgactcggatgcctgcgagcgcatcaccttcgagaagatgaaggacatggtgcagaacaagctgggacagccggacaacaacgtccgcttcaactacccaacgaagaactttcggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgcacctgtctgttcaacccagacctcaatgtgaacatgttcacagaagaggagctgaacgaccccgacattatgccataa

SEQ ID NO: 78731 - DNA, 1188 bp, Heterodera glycines
  Genomic contig location: Contig_ID=SeqID_2252; Location=626..1813; Strand=-
  SCN-specific regions: Sequence locations=1-523,565-729,773-996,1018 -1188
atggagcccggagcgaagaagcgcagaaagaggaaaaacattgacaacaccaacggcgaagccatggaatgcgaagaagaagaggatgccgtagatgaggacgccgagaacaactggatgctggggtatgaagaagccggggagaagccggagtcggtgacaacgtacgcatacgcccacgccggtatatttgaaaataaaatttttgtaaacataataaattgaaggatctcgatatgatcacgtgctgatttatggtgaaatgttgcgcatgggagcccgccccgaactcatccgccaaggcaaccatctcctggaaatgaaggcgcgcaaaacaggagtctacacacccaccgtgtttcgggacaggtaaaaattcgaagatttaaattatttaaattgttattcattcagttataagctgataccgatcaaattggcaaattttgtctagacgtttggcctggaaattgagggcgtggaaaacaagaaatattttccacacaaattcaataaggtaaggataatttattgaaaaattgataaaaaattaataaaaatttaggcggaaaattatggcactgtgttggacaccctgcaaccaattgagaattattacccaggtggactcttcccggcagagcgcacaaagtttgagcagtggtacgaagagaaccgagaaactgggtttgagctgagcgaggtcatcgcggactactgcaagactggtaaaaaaaaatatataaataagaaaaattttaacaaatattttgaagatgttcaaatcctggcacatggtatggtaaaaatgcggcagatgttcttgtccgagactcggcatgacatcacggattcggttaccatcccatccggctgcatgaagtattgggtgcagttggcacaccacgacaaagagcgcgtcgccattattcctcacttgggatacgagaagcgcggcaagcaaagctccatcgccaggaaatatttgaaggtgtgccaaaaaatattttaaatttacattttcccatctctcagtggcgtgctgaggaggagttgcgtgagaacggccgggtcctgcgccatgtcgaaagccctggaggggagttcaagttcggcaactacagcttggacgggatgatggagcggccggatgaggacaaaaacttggccattgaggtcaacgggtaa

SEQ ID NO: 78732 - DNA, 630 bp, Heterodera glycines
  Genomic contig location: Contig_ID=SeqID_2253; Location=3086..3715; Strand=+
  SCN-specific regions: Sequence locations=1-2,25-48,85-159,192-225,256- 593,615-630
caagagtgaaaataatttttaaatttgaaaaaaacagaatgccaagggttaaaataatttttaaatttgaaaaaaaaaaaaaatgcaaagggttgaaataatttttaaatttgaaaaaacagaatgccataatttaattttgaaaaaaaacagaacgccaagattttaaatattttttaaacgagaaaatggggaaaacaaatgcaagaaattggccagaaataaataaggaaatttggcacaaaaatgtgcaaaaatttggcaagaaataaatagggaaatttggcacaaaaatgtgcaaaaattggcaaaagaaagggttaaaaattgtggcaaaagaatgccaaaaattggcaagaaataaatagggaaatttggcacaaaaatgtgcaaaattagcaaaataaagggttaaaaatttgggcaaaacaatgccaaaaattgacaagaaataaattgggaaataagggggcaaaacaatgccaaaagattgcggcaaaatggcacaaaaaacggtgccatagtaataataatgccaatctggcacataaataataaatggcaaaaaaacaaatgccaaagaaggaaaaattaatgcataaataaatgataatggattattgattggct

SEQ ID NO: 78733 - DNA, 1285 bp, Heterodera glycines
  Genomic contig location: Contig_ID=SeqID_2253; Location=681..1965; Strand=-
  SCN-specific regions: Sequence locations=1-347,415-1125,1147-1285
atgagtcaattttctgatacttcccagcccccaatgctttatgggccctattcccctgttggggatgatggtaccgaactgatggataaagcgccgcctctagaagacatcatcaaacacatgcctaataccgtaagttttggcttaatgtttttctaaaattcattgctaattatgcgagacgttttcaggttgtgccgtcggaagagaatgagtgcaaggcccgaagggagccatcgattacccgcgagctggacgcggagttgttcaacggtgacggatttgcttgtctctctgccgcacaggcggaagctggacggttcaaaggtgtggttgtaatcccaaccttttttaattttaaaatttccaattttattaatgaattttcaattaagatttgtaaaattattttttcaaattcaattattgtccattttgaacgaaatatttttaatacaccgtttagcgtttcggtttattggccaatttttgatgagcatttcgttcggcgctgttttcccagaggacatattgcgcaacctgtttaccatgtgccttgcctatgcgattgaaggagctgagtcaatgaagatcacggcggaccacttcattttcctcctgacgtcaaaacaccttgactacgaagtggctgtacactttaaaaaaatcgacaacacggcaactgagaggattctaactcgcttcgaaatggtcgaccaaagcaacaaagctaaggaaaggccgtcgctcctcgaggagccttttgtaattgacatcacggcgatcgagagcaagtgcgccaaaccgaaaatggctggaaaggggcgtaacgacctcaatatcgattaccgtatcgccgatggtgcaacgtatgagcttctgaacaacgacaatctctgtctcttccggtcgtttgaaatgctacggatgaaatttgtcctcgcgcaacagcgattttcggaatacaagagggatgagagaaagcagcttgagggtgtttatgcatagtgccgtggatgcgacattgacgtgaatcagcccttttattccattgaggaatacggagaaaggattcaggcattgataaaaaattttattaagttaagttattaattaaggaatattatgctgcgcttcatccaggaatgtttcgacttttttgctttgacacatttggaaaaatgaaaccatcgtggaaagcgaatatcaatgaatacatgcatgagctctgtgtggttttttatgagggtgctgatggcggtgtggggcattacgacgcaataaa

SEQ ID NO: 78734 - DNA, 340 bp, Heterodera glycines
  Genomic contig location: Contig_ID=SeqID_14639; Location=7..346; Strand=-
  SCN-specific regions: Sequence locations=1-237,284-340
atgccatttttccatgccacctgtaatcaatgcaaaaaccatccgaactcagagacatatttggagaaccaagagttgcgcctttacattggcattgtggactttttcacgccattcagtggaactcggaaacaaaaatatattggtggtcttaaaaattatattaatgtggaaacaaaggatgctaaggatttgatggcatatgtgaagacggggagaatttgggtaaattaatcgaaaaataattttaatttgaaaataaatcaaattatttataattttaggaaacgtttggaccgattccgcctccaatgtatgcagatcgtatgttggcttttag

SEQ ID NO: 78735 - DNA, 1782 bp, Heterodera glycines
  Genomic contig location: Contig_ID=SeqID_14640; Location=37..1818; Strand=-
  SCN-specific regions: Sequence locations=1-52,74-251,317-616,641 -836,868-1040,1062-1120,1142-1354,1404-1527,1564-1665,1688-1782
atggtcggcaaattaaatttttatgctgccggaatattatacaaagaaaaagatgaaaaagtgcaaccaattgataaagggccagatgagaaattggcaattgagaaaatgccagatgagaaagtgccagatgagaaattggcaattgagaaagtgccagatgaaaaagtgccaattgggaaatggcacaaattcgaagggcaagaaattgaactgatgccaagagaaattgatatgacaggtgaataacgaaaatattaatttattatttaattcactatatgatttaaaattaaattaaatataattaaattttgccatttgaaagatgaaaatgacaacatttgcattgaatttttggcattggctgatgctgatgaaatgaaagacgatgcgcactttaaaatggacgataaagaacgaattcaagcaaaattgggcaaatatatttgcaaaaacatgaaagaaaatgaaaaaaacaagcaaaaaaatcccaaaaagctaaattacgactttgattggacaacggtggacgatgttcaattttatgcggaagaagcaatgggcgaaatgcgggtgaaatttggaattacttacaagaaattagcggtaaaacttataataataatattaatttatacgcaagtgcgtacgccgcaaataaaaagtggtgaacaacaaataaaaatatcaaataagaaaacggatcaaaattaacggtttcaaggagttaagtaaattcattaggattatgtaatctcgcgccttaggtagaagcctatagaggcgagacatttgcacaaaaaatgaattgtatcgaacgaatgtggattagcaaaatatagatttaataatatttaataataacattatcattttcttaaattaggtcaaggcaatgtataagattcatttcgctaattttagtatacctaaaatttgtcgtaaaataattcttagacttttacctacgattttaagagattcttgacgaaaaaagaatattcttcaagtggatttttattgcctaatctaacaccaagcatttgtattcataaaaacatggaaaacctatttatttacgataaaagtcaatttaaattttgaacaattaatagactaaaaattaaaactttttaggattcttttctatcggatgacttaactgaccttggtgtcaaagggaaaagctcaaacggattctatcgtacgaaagacgagatttttttgttaaagcaaattccaaaggacgacgaagcgaaaataattgaaaaaactttagaaaattattttgaacatatgatgaaaatgggagacaaatcatttatcaacaaaatctttatggtgtttcgagtgcaaattaaggtaattaaaatttcaaattaaataaaaacaccattaaatcaaatgtgtattttttattatttcatttttttattgtaaacaaattttcgtttcctttttttgtggtacttattttgtttaggggatacttttaacatacaatttcagatgcgtataaatgtgttttataaattaataaaataagttttaacaaattttcgaattttacatatatgttcatatggtttttaaacaatttttgctgataaaaatcctttcccagaacactccaacactctttctgctgatggaaaatgtgttcaaaaatgccaaggatttgccacttttgaactttgatgtgaagggcgtcttctcccgtcagcccaaattggtcgaagttgacccaaaacagcgtttaaacgacgtcgtgctcaaatg

SEQ ID NO: 78736 - DNA, 1052 bp, Heterodera glycines
  Genomic contig location: Contig_ID=SeqID_14642; Location=659..1710; Strand=-
  SCN-specific regions: Sequence locations=1-49,72-78,100-203,227 -504,526-633,669-922,945-1052
atgaccgcagcggcaaaactcagccgtttcttccgccgtttggtgcacgtccgacagatggactttgaattcgctgcttggcaaatgctttacctgctggtcaatccgcaaaaggtgtacaggaatttcatgtacagaaaaagtttgttgtccctctcaattaattcattaatttctaatttcgttcagaagccaaagatcaatgggcccgcgatgaccccgcctttctcctccttttggcactttctctgctcggctcgagtgttctgtttgcattagcgctcaatttgtccttttcttcgttttgcgcctttttcctttgggttgtgttcatcgattgcatcggaattggcattgccattgcaaccgcactttggtcgctattttgcgatatttactctccgatttcacatatttttgtgtccctccctttttaggttcatttcaaatcgctttttgcgtcggacgagggattgcgacgtggtcgagtgggcctattgcttcgatgtccatttgaatgcttttttcccgttgctcattcttctccacgtcattttacctttgcttttctacggtccctctttttttctttttttgaacaaaatattttttaggattggttgattaccaaaattttctcgcccgcttttttggcaattccatttggtgcattgccaccatttattataattacattactttcctcggctataccggttgtattttaatgatcaattgaaatatatttaacaatgtttgttttcagcacttcccacgctgaaaaacacgcaattcttcctctacccaatcactttccttttcattttcttcgttgccgccacaagcgccggttggaacgtttcgatcaccgcgatggacttttaccatttccgagtaacgaacgcagaccttagaggatgacatggagagagagaaagaggaagcaaaatagacgaaggaccatccccaacttaaaaccaacccaagtcattgtccgttccaaaagagtgcataaatatattccatagacaaaaacaacgtgttcaaataaa

SEQ ID NO: 78737 - DNA, 587 bp, Heterodera glycines
  Genomic contig location: Contig_ID=SeqID_14643; Location=236..822; Strand=+
  SCN-specific regions: Sequence locations=1-289,311-323,495-587
atgtcaggatcagggtcttatatcaacttgccgagatcaggattgacattaggaatccagctaggatatgattaccgtagttcaaatcccggtcaaaaaacttcttctttttagctaatcgaggcaaattacgaaaaagcaaatctccagcactattaggcgctgaagcattctcagacagagaacagaggacgttagaaaaatttcatgagagattcgaaagggaaagaaaaatagcacgggaagagagaaaaagacggagtaatgaacgacggctagagagtgaaacagaagaagagagtgatgaagaaatggtattggacaaagaaaacacagacagtgaagagatggaaaaaacagacataagaaagggtggagaaagcgatgagaaaggaagaaataacaatggcaaagaaaaagtggaacggaatgataaaagaaaaagccacagcggagacagagaagaaaagaaagcacagaaaggaagaaaagaatattgaaaatgaacggagagtaatgagtagggatgggaattttaaaaaaaaattttgaaaatgttaaactaaaaaatcgggttttttcaaaaa

SEQ ID NO: 78738 - DNA, 511 bp, Heterodera glycines
  Genomic contig location: Contig_ID=SeqID_14644; Location=1365..1875; Strand=-
  SCN-specific regions: Sequence locations=1-511
atggaacatttccattgcactgcaaaacctgcacaagcgcctaatttccgaaggacttcaaaaggtaatttcctgttatcagaaaaagaaattgtctccttctcaaaaaaaattgtctcccgtttaacgctaccgaagtgaccccgttttcgtagaaacggcgcgtatgatcaccgcgctcatttttgccaaatcagcatttaactgctgcaaactgcgctgaacgacatcgtggggcaagaactggaccacaatttgcttataaaataagttccttcagtgttccctacaatttcgcgcttcatcgaagttcttcgaatggatcagcgtgcgcgcgacgccgattatgtgaacatcgtgaacggcgaagaaccaccgatgaagaaaaagaagtttggaaggcggaaaagcgaatttttgaatgttatcgaaaattttgatgcccaaaatattattgtttctcaggggaattttaaataattgtgttatggaccgtggttttgttaataaa

SEQ ID NO: 78739 - DNA, 1664 bp, Heterodera glycines
  misc_feature (1287)..(1287): n is a, c, g, or t
  Genomic contig location: Contig_ID=SeqID_14644; Location=1..1664; Strand=+
  SCN-specific regions: Sequence locations=1-636,658-769,793-1029,1051 -1664
atcggcgctgaagcttctctatcgggcgcgacatcttttgcttttggcccatggcgagcagcatccgtatatgggtcaaattgatgtaatattctacagataatatttcaagaagcaattacaataattggcaggccaatatcggcatcattctgtacgccttgcaagaatttgacacgtcgctaaagttcctcaacaatgctttaaccctctaccaaaagtacggcgtccctgtcaagacggcccttctccaccacgtgatcgcccgtgcccattcgtgccgtggcgatttccgcacggctctgaattttgagaaggaaacattcaacatttactcacgtgtattcggcaaagaacacgagaagacgttggtcagcaacgaatgtttgcgtcacctcaccaaacaggcggtcaatttccaaaagcatatgaacgacgcatcgcaaggcctcaaaacgtccaagagtctcgtgccaaacgtaattgattcagttaccattccctgtcattttcgttctctttttagtttcaagtacattctccttctcttcccaacattgtcgagctgctcaacgcatttaacaactttttgtaagtcttactttttgagacttactttccgattttaaatatttcgtttcaggttttggaagttgcaaattcacacggaatgaagcagccttcgtcatttcttccctaagacaaaatatattgacatttgttgttgcgtttctcttcaccattttcttattcttggcacttattgcagttgttatttgttgtttttgttttcgcgctgatatattctaattaacttagatttaccatttgcctcaaaagttcaatccatataattttgtttgtttatcttttgtttttttataaagcacaccaccattgctcatctgcgcagctttattaaatgatacacttgtaattcgaatggtattcaatttcatttcatgggtactgtagataatgcttccttcctttaacatttttaagctcggaaaccgttccgaatactgctcagaaatctgactccatttaattgcatttttgttaatatttttgggaaaaaactaaaataggatctaaaaactcgaaaaatagcttaacaacaacaacagaaaagatgtttttcgtgctttttaggtcctggaaactttttggcataaatatttttctcgctaagattgacttatttttcggaatttctccgataaaattctaattttgccttaaaagaaaaaaattcattaggggtcggggtcacttcgccgcggngccaactcgccgcgccttgtttttttttttgttaaaaagtagtcatctctcagtattttaattataaaattcagatgtttattaacaaaaccacggtccataacacaattatttaaaattcccctgagaaacaataatattttgggcatcaaaattttcgataacattcaaaaattcgcttttccgccttccaaacttctttttcttcatcggtggttcttcgccgttcacgatgttcacataatcggcgtcgcgcgcacgctgatccattcgaagaacttcgatgaagcgcgaaattgtagggaacactgaaggaacttattttataagcaaattgtggtccagttcttgccccacgatgtcgttcagcgcagttt

SEQ ID NO: 78740 - DNA, 801 bp, Heterodera glycines
  misc_feature (783)..(783): n is a, c, g, or t
  Genomic contig location: Contig_ID=SeqID_14645; Location=839..1639; Strand=+
  SCN-specific regions: Sequence locations=1-288,311-387,409-413,442 -445,467-568,593-801
atggataatgaatgcgcacagcttaaatttgaaaaagccgaaaaagagaagcacattaagtacctcgaggtagagggcgcaaagaaagacgaacaattggataaaaaggatgaccaaatcaaaaatatgcaaaatgatgccacaaaaaaggtggaaatctgataggggagggaggagggggtagggggttaacggccaatttacaaagagtgtatatacaagccccgtaaattgaatttttgattttttctgttacttaaatgtttgttcaatttttgcgagataaagcaaaaattcaaaaaataattagttattaccgaaaggtgttgctctgcttgtagtgtgtcgacttcgcttgaacattgaagcatgcctcgggcattttgcccaatttttcaaatttcttactctcggaatattcccaaaggggaaaaccctccatttatccattttcctctgtgtctctcccgcccattgcttcttcttctccaatgtcctttcctccacgtggcagaccattgattgtttttgtcttcactgccatttgcttctttctctctccggtttattgctcttcttatttttgttggttgtataccagggatggcacggaattccgacttccgagttccgacttccgacatttttggggtcggaattccgacttccgacttccgaaaatttttggggcctcggaatcccgacttccgacttccgaaatttttgatgaaaagtcggaatttttcggaatttttttgagttttttttcaaaaattagcattntttgtacaatttatgtta

SEQ ID NO: 78741 - DNA, 479 bp, Heterodera glycines
  Genomic contig location: Contig_ID=SeqID_14646; Location=942..1420; Strand=+
  SCN-specific regions: Sequence locations=1-479
atgcgggtgacctggccacggtttggtaagtgctcgtccggtagcaactcccattcccatttcggtcgttcatccacacaaaattgtacacctttttccaaattttaaacacttccagcaattgaaatcgctcacattttcttggtagcccctgtcacggcattggctttgtgtccgaacattttgtgccggttctttgctaccagttgaatgagtgagcaaaaagaataacaaatgccgaattattgggcgcctgtttctgccagtggcatcaccaattgaaaaggaatttgctaaattaaggaaaagcggtcaaaaacgtttaaagagtgatgcctgtgtcgttgagataggcatcgatttgtcggtcattagtggcatttgttagcgtgcggaaaagcggacatgaccaattggcaacgaaaaaacactcgcccaattctttcgcctgtaacgtaccaaaagataaccgaaaaata

SEQ ID NO: 78742 - DNA, 999 bp, Heterodera glycines
  Genomic contig location: Contig_ID=SeqID_14646; Location=1264..2262; Strand=-
  SCN-specific regions: Sequence locations=1-999
atggactctttctccaccttccgtggtgccaaaggtggcgatttgtcagtgctcagttcgctcgtttcccttctgctcgttgcccattctgttggccaaaaaatggacatattcaatcggctcgccagtctgtcccgtcgtcagttgttgttcgcctttttgcacggcgagtcgctcggttacattggcagcagtcgatgggtgtgggacatgggacgagggcatttccctgccgtggcaaagaacttctccgaagagtcgaagaatgtccgacagattggcgtggacgaactgtcctttttcatggaacttcaacaaatcggcgcgtcccccaaactttacgcacacaccgacgcacaaatctacaagcaaaacaaaagcctggtttgttaacttaattaaaagacgattttagcatttcttatcacactgttcagattgatacggttcttcataatgcaaaaggaagcggtgaacatttccatttcgtcgatccttcctcagtgccttttggtgccgctcctccgtccagttaccactccattatgaaggcatctgataaagtccccggtctaattctgagctcatttggatccgccgactacgaatatccgtattttctatcttgatctttttatcagcataaccattgtttgaggtatttgaactcattcttggatgaccaaattcgtactcaccccaaacagttggacgagtttctccgcaagattattgacgcatcaaacattgctttgagggcagcactttcttatttatttgctaataataatgcaactgaagtggaccaattcaaaatcgacgagaattatgtacagatttattatttttcggttatcttttggtacgttacaggcgaaagaattgggcgagtgttttttcgttgccaattggtcatgtccgcttttccgcacgctaacaaatgccactaatgaccgacaaatcgatgcctatctcaacgacacaggcatcactctttaa

SEQ ID NO: 78743 - DNA, 1012 bp, Heterodera glycines
  Genomic contig location: Contig_ID=SeqID_14646; Location=2352..3363; Strand=-
  SCN-specific regions: Sequence locations=1-1012
  Gene Ontology: Cellular component=integral to membrane; Biological process=N receptor processing
tctttgcttatgatggcgtagaagatcaaatttttatcagactcaataacaccgatgtccaatgtgttcgaatgttgaatggtacacattcaattggatgtcagtgtaagtattcacactttttaacttaatttggatttattagaattctcgattacatattaagcgagtcgcaatgggaatgttggcgtcctgactgaaattgtccatgcaaaagacgtacaaaatgcgattggcattttaccattggggctatccaacataatcgctgttattcaactcacaaatattaatgagtaagtgacgaaaagataaagttctgaattaacgaaaggtaaataataaattttagtgctttaatcggaatccttcgttcacacgcgcaagttgttgggattctgttgatacatcgtgggaaagataagcctaaagagttttctgaggatggctcatgtccaaatcgtcagttcagtgagttttgaagttgtgaccgctaacaatcacatctcaataagctgagttttttagcattttattccaatgagaaaactatcgaaagttgccatggatggaaccaaaagaacgcgattcactcggatgggcttaagtttatcgacttcaacaaacctcttcgtcttgtcaccagcaacgaagagatcgacttaatctttgataaggttttaccagcacaatttgcatttactaatcttttgcttcagtgcattgagccatttaacaaaaaactgatggccgagggattgcgttgtgtggggcgcatgacacaatttatgtccgctgctgggaataccaaaatttgtttggaacggacggctgactttggcgaaaggtggggtttttaaatttaatttcttcaattttgctcttaagttctttatgtgaagtacttgaagatatgaatgtttttctgatgttgcctccactgagtaagcagaatcacagtgccgaccaatttgtgttagctgcccgggtcagttccctttttcacacttaa

SEQ ID NO: 78744 - DNA, 170 bp, Heterodera glycines
  Genomic contig location: Contig_ID=SeqID_14646; Location=3604..3773; Strand=-
  SCN-specific regions: Sequence locations=1-170
aatttaaatttccgactttttgttcgaattcgggtccgggattaagaattggtctaaatgggcgccggattcgtgatcagcgatcccgaaaaccccataaaaagtgtttttatgacttttgaaaacataaaaaaatttcgaaaaagggggtgggacaaactgaactatta

SEQ ID NO: 78745 - DNA, 837 bp, Heterodera glycines
  Genomic contig location: Contig_ID=SeqID_14647; Location=724..1560; Strand=-
  SCN-specific regions: Sequence locations=1-283,305-775,800-837
atgcgggtgacggtgtgtcttacagcacggaataacggacaaaaactcaagccgtacgtgctggtcaacagaaagcgaccggtgccgcaaattgtcaaacaatttgctggaaaattggttatcaatttcgctgggccgatatggatgaacgatgacacaacggaggactacctgcacaaaataatcggggcaaagctgttcgttggcgaacgcctcttggtttgggatgcgtttggcagccacaagagcgagagaacgacgaaggtggtgaaagaattgggagtggaaacggtttttgtccctggcggttgcaccaaattcattcaggtggagtgtcatctttctcagtaaagtttatttccttctctaggctcccgatgtctcgtggaacaagccgctcaaggagcgaattcggcatttctacaacacttggatgtccaatgatgcagaaaaagagttcacaccggcaggcaacccgaaggcaccagcgcttcacatggtacttgactggatccaccgatcgtggcaggaaatttccaaagccgtgatcatcaaatcattcgagggtcagtttaaaaaataaaaatgcctacgaaagacgccgaaacttttaagtctgtgggttgactacgccattggacggaacaggagacgaaaaaattgcttgcttcaagccggaaggagcaattggaccgatagggacaaaatttttgcgcgagtttagagaaaatgaaacggtgaaagatggacgaaacgatcacgaagaagccggcttatctgatgatgatggtgatgtagagctggatggagtcggagatgacgatgaatttttcattt

SEQ ID NO: 78746 - DNA, 1509 bp, Heterodera glycines
  Genomic contig location: Contig_ID=SeqID_14648; Location=95..1603; Strand=-
  SCN-specific regions: Sequence locations=1-254,276-801,823-929,951 -1170,1192-1509
atggcccataaaagggtaataattttttttatctgttttattgttttattttttgatttttcaatttgcagaagcgacaaaacaaggatgcgccgtgttcatcaacaaattccgaccttgtcaaccagtgttcgtttccgcttgaccagctcccactgaacgcacttgtcattgtcgcctcacaactcccgttcaaggacttcaagcgggtcggcacgatctccaagcagttcaaccgagtgcgtacaatcggcagaatttgtttatttttccgtccaaacgatttcctttttttgacaggctcaacgaatgaccaggttcagcagaaagcgagtctcggtcgacctgttgcgcaagctgttccctgacgaagtgcccgacacggacgtggaagacgacgacggcactgagcgcagcgttggcatgatggaagtgatggacccgctacgtcagcacctgcgaagttcgcggcccagaacatccgcgagggtggacatgagcaagttcagctcgttccgcgagtcgcacttcgtcgaattgtttcgtgtcagtgattttggcgtcgcccattgatttgattcatttgtctcctccaaatttcagtcaatcagcaacggcagagaactgttcacggaagtacgacgcctcaatgtgcagaagtgcgtgatcgagttgcgcgacatggaatttttggcccaactgatgcccaaagtgtggtacattcgctgctccggccaaacgcttgtcatcccggaagagtgagcgaaggccaagcggcccccccccgtccgataaaccccaatttgatcatcgcgccattttcagcatcgatcagtccaaaatggcactcagcgtggaacagatgcgccaactgcacgccaagctggacaacttcgactacgtggcgagcaagtgcaccaaaaaacatctgtggttcatcaacaaactcaccgaattgttcgccgagctcgaaatcatacaattggacaattgacgagccaacggcggtggtggcgcgaaaggatttgagaagaaaatcgggcgaaagtgatcgatcaatccgatgctattttctatatgtttgttcataatgtaaataccgccattattatacctatgtatatgttgtacatatgtgcatcattatgaatattattttcatgagttttatttgtataaaaaggaatttaatttactaacaaataagtggaaatagtgctgctactcccccagccgcccctccaatttttgaccgactttttgtatcaaattcgaaccctaaagctaagtcgacaaaaatcgaaatttttgaaattgcatcagtgtttcggtacttgttcggtttgtaccacacagggacggtcccagggggggggggtacgcggggggtgctgggtcgtttcttaaaaactgccactatgggcgtttcttaaatactgccaagtgggcgtttcttaaatactgccaagtgggcgtttcttaaatactgccaagttgtagtaaaataaa

SEQ ID NO: 78747 - DNA, 1432 bp, Heterodera glycines
  Genomic contig location: Contig_ID=SeqID_14648; Location=1432..2863; Strand=+
  SCN-specific regions: Sequence locations=1-495,521-815,837-1432
atgacaagtgcgttcagtgggagctggtcaagcggaaacgaacactggttgacaaggtcggaatttgttgatgaacacggcgcatccttgttttgtcgcttctgcaaattgaaaaatcaaaaaataaaacaataaaacagataaaaaaaattattacccttttatgggccattttcgttttttggtgaatgttgtaaaataaaatgcgttgtgtgtgataattccttctcttttatagacaattctacagcaataaattgtataaatttcgagaaatttcaaaatgttgaatgaatgcgttgtataaaagggaattgatttagcatttctggccattccattccaaaacatattaataattcattcctaaatattattaccgcctctgttctccgtccgtgccgtcatcaacaaatcaaatcaacggcagctcagccagcagcagaagtgcgcacaaatcgacgacatcaaacaaaactgggcaccgcacaatcaaaaccatcatcttcatcatcatcggacgaagaagaaaaaaaggtggcgcaggaggagccgaccgttgacaaacagaaacaatcagaagcaaagcaagcggagcagcaccagcaaccgcagcaggaagagaagggacagcaagacgcaccaccgcggcgacgcatggacaacacgtgagaaagtggaaaatttcttaaattttgttttttaagctgcacttttagcgaccaaatttggctggacacattggcatggcttaaccgtggagaggtcggcacgaacattgcgctggtcaacgcccgcttcgccaaactggtggacaagcagctgcagcaaaggcactggtggttggaggagttgcacatctgtgagcagaaaccgaaagggacaggcgccgaagcgatgagcttgaacagcgacggctcctactactcgttgccattggccaccgtaccattgccggaaaatgtcgtcggcttcaacagcacattcaacatttggtggccatttcttcaactacttcccaattgaattttaattgttcccacgttttctgcaggtatttcgacgctgaagtgatcgttttcctgcaccgaatgcgccgtctcttcaccacggacatctctctgcagttcgccattcggatgacggaatatcgcgcttggaaagcaatggcacgtcacatttggcccctgctgaagaacggactcatcattctggtcaacctgaagcggaagcaactgtccatgatgcgcaaacacgtgtcgccgaccgtcctcctcgactgcccgaaccttgttcaaatcaccagctctgttttgcccgaacgtccgaccgatgacgacactttttctgctgacttatcgggccgtgacctgtacatgtggctgcacacgccgcgccccgacgatcgtctgctggtgtacaaactgaccaa

SEQ ID NO: 78748 - DNA, 871 bp, Heterodera glycines
  Genomic contig location: Contig_ID=SeqID_14649; Location=86..956; Strand=-
  SCN-specific regions: Sequence locations=1-87,112-363,403-565,588 -595,617-680,702-871
atggggtgatcgtttgggggttttttattccttttctttgtcgggcatcgctgttgcggccggttcttcacatgcactcgctgagttgaaaaaggaaaataaaaccaaagactcaatatatcaaaaaattaaaaaaagggggagccataaacccatcagaccacattgtaagataaattgaaatttaaaatccaaaaaaaataaaatttcagaatcaaaaaggaattaatcgctttttttgcaaaagaaaaggtcgaatttgagacccgaattgaatgtctggagagtggggccctgctgcccgccccagaggaatttgttacaattgggaggtccaatgcagtggaggatgttgtgccggttaaaagaaaaaattaaaaaataaaagaaaataaaagaaaattataggattcaattttggatggcgacacagcgcgatctgagggcggtgagagcacaaaaaagaggcgcaacagaggaggaggacagagaaagagagagaggaggaggaacgcggaagaagcgcaaagtcgggcgggggacgacagcgcggcaccacagctcaatgagcagcagcagcaactgaatgccaatggggaggaggagggggaagaaacaatcgccaatccaatgccaaagacacgggcattggacgagcaatcgaacgcctcgtccacgctctcgagcaaacagaggcggaccgaggaatggcaagcgaagcagtggtacaaaaatgcgagaggaaagggcagcggcggcaaagaaaaagaaaattgaaatgaaaaaaagattggaaaatttaattggattggatatggaggggccaagtgggcaatgatttaaaatgcccttttaattgtttgttaataaa

SEQ ID NO: 78749 - DNA, 1491 bp, Heterodera glycines
  Genomic contig location: Contig_ID=SeqID_14650; Location=150..1640; Strand=-
  SCN-specific regions: Sequence locations=23-80,110-177,199-622,644 -872,894-1064,1102-1449,1479-1491
atggaaggatgggaggttgtgttcaaacagcagcaagaagaacattttgaatcgtcggcagcggccatcaaacggttgtgttttttaaatgttttaattatttttttaacagtttgaaagatgcttgtccgttacttacgcatacgcattcatcatctgtgcacacgactgcaaagaaaccaacattgaggcagggacgtagttcaagtactataagtctagggcgcttaccgcgaaatgcgagaccagcggatgagattgaattgttgcaaaagtatgatgtgcagcaactaattcgttgtttttgctgtggcgtgcaacggccattgggcaggggcggccacacgcaattgtcatgcccatatcgtcatcccgatagttaccgtaagagaaaaatatttacttcttataattaggaactattcatttatattttatagcactttgtgagaatgcaagcgcacgggatccggacaaatgctggaattgtgcgagtatagcgcacaaaacgaatcaatgtccggagccacgtcgtaaaccgtctcgccgaaacaaagttgctttgccgcgtgagcaattgttggacaaaaatctgtgagtttgtatctttcttctttattgatctatttattacatttttaagctgctcgtcctgcaacactacggggcattttgcaaagaactgtcctaagaagcgtcaacgacatgggcaacagaatcagaaaaatacaaaaatgccgtcaacatcaaattgtttttcatatcagcatgatagtagtggcagctctgtgaacgacgagtcggatgatgtgatttacttgtcttctgatgattaaaaagtgattcgatgagtatcgcattgatggcaggggcttagaacaaaacaaaatttaataggacattcgggacatttattaaattttttgttctttttcatttaatacatataaagagggtatatacgctatatcataatgctttttagatggtttatatatctatataaattcaaaccatttatattttttctttgtgtaaggtgcattctttagcatgttgctttcattttattattacatttacaatatttttattaaaaatcatctaaaattatgacgattcagcaagtttaaattacgatgagataaatgaaaaaaataatttatgtatgtgccaattacatcatagatcggttcaaccacggataggagaggtattccaatggttggaaaggtgcaaacacgtattgatgagccacaatccatgcctttatgtctgataggaaaggctgcagaaaaactgagaaattcagtattccattcgataaaaatttaaaagaaaaaaaatgaagtatggtttgagaaaaatgtatatttattgactttttatgtggcctaaactgcacaaatatcgatatttttattgtcaattgtttcaatgtgacttgagataaattattttaaaatcaaaaattattaccaagaaaataaa

SEQ ID NO: 78750 - DNA, 1030 bp, Heterodera glycines
  Genomic contig location: Contig_ID=SeqID_14652; Location=490..1519; Strand=+
  SCN-specific regions: Sequence locations=1-166,189-571,651-989,1014 -1030
atggaggacagcggatggtaccgggctaattacaggtcaattaaccgatggagtcttcttttggcccaacttattcatgtgattagcattgccgagcagctccactggggacacgggttgggctgttcgtttgccatggaaagttgcgggaaatggatttgggagaagttggaaaggtgggccaagaaaaggcatttgggggagggggagaaactggcacttttaagcaatcagtcgacggcaccgttttgtgccaatataaaacacgatggaagccgatcattggccaccacacgctgcacagatcagagggtagggaggaaaacagacagatgaaagtgccattgcgttgataatcaaccaaaacacagaaatataaaagagcaaattattacagaaaacaaaaactttacaggagaagcacaaaaaacatattttctccactcaattttcgaattttagcgaacttttagcaaataaaaaatattggagtttagcaaatagatatctttgcttgtgtccaaaaagtttgctaagaaaaaggcattaaaatataaaaaaatttctctcgaaaatttaaataatattttttataaaacaaatattataaatatattacatcataaaatactttataaaaatttaaaaaactcttttttgtggatattttgaagcacaatttaaacatttcgagaaaatggcctgttttgaacaattttttgaatttttctcgagtttatcacaaattttgagtcttttttggcacataaatcccatccctggccattagtcaattttaacacaccataaataagtgaatccccaggattcgttggcattgtgcaatttggtgccttataaaaagccgctgcccgttgactatcgcaactttgcacatttgcatggagttcgtcacgaaggcaccaaatattatggaggttctgtggaattggcagacttttgcccatacaatcaggtggatgtgtctccggagggcgggggaggaggggggacagtacggtcgggatga

SEQ ID NO: 78751 - DNA, 369 bp, Heterodera glycines
  Genomic contig location: Contig_ID=SeqID_14654; Location=838..1206; Strand=+
  SCN-specific regions: Sequence locations=1-2,134-369
atgaacgaaacggataaagaggagggaaaagcacaaagggggggggggcgagaaggaaaaacagagagaaaagaaagggcaaaaggaagagagaaggaggaaaaaggaaaagaagaagaggaggatgaagagagcggaggtgtggtggtctgcccactcacaactcaccgatcagtcattgtcacttgtgacatttgcgtaggccgcgcaaaaatgatcaaggggaaagtgacggagtgtggccaagtgggaggtgcagacgaacagcgaattggaaaatgggcgagaaagcaagacaatgtcagagggcagcagacacaacgaggaaacaatgcaatgccggaggcaaaaaaggtgatcagaaaatga

SEQ ID NO: 78752 - DNA, 652 bp, Heterodera glycines
  Genomic contig location: Contig_ID=SeqID_14654; Location=1933..2584; Strand=+
  SCN-specific regions: Sequence locations=1-222,276-287,309-321,343 -365,417-423,468-559,592-652
ttcagtccaattctttctctttgtctcgtccaatcatctttgccaatgtttgtccgttgtttcattttgcctttcatttctttggcattttttgtgtccttttgcacggcaatgagaagaaatccatcgggtaaattgccattttaaaatgaatgtatttggagttaattaagattatgatcagtcacgggtgccgcccaatctgaggataatttcatggtcaatttattttctattaattgtatttaaataattaagattcattaaaatattttcgcattgaatatttttaataattgttttcttccaaaataatttatttaaatatctaagttttttaaagaaatctttaagtaattctgcacataaataaaattaattatatttatttaaaaattatttaagtttaaaatattcagaaaaaatgcaaaattaaatatttttgtgaaaattgctgtataattcttttgtggggttgaattctgtccgattattaattttaaggcttctcggcgtttggcgttcagagcatgacggcaaagcggtgaaaaattcacgctaattaattttatttttttgatatttttttaagatgtttcccaccatcccaaaattcacttacggcgaagaaatttcaattgcactttcggac

SEQ ID NO: 78753 - DNA, 267 bp, Heterodera glycines
  Genomic contig location: Contig_ID=SeqID_2254; Location=1644..1910; Strand=-
  SCN-specific regions: Sequence locations=1-129,151-152,184-267
atgtgccaaaaagccgaaattaagcaacgcgtaaatatgttcaggtgttggatgccgatgacaactctcaggaggaattggaacactactacagccaaaacttttattatacgcccaggacgacgcgccaatgtcaaagaataataattcactaattaataaatatcattataattaattaatgtgttttcagtgtatacaattgaggacacggaggaggagcagacagtgcttaatcgtgaagtaaatttgttaaattttaataaa

SEQ ID NO: 78754 - DNA, 1447 bp, Heterodera glycines
  Genomic contig location: Contig_ID=SeqID_2254; Location=2294..3740; Strand=-
  SCN-specific regions: Sequence locations=1-294,323-360,383-481,504 -529,551-691,745-783,807-1117,1139-1245,1267-1289,1311-1447
atggaagatccctggtctccgtcactttgcgcaccgcccaattcgctgctgatggatgacggcggtgcagcagacgcaaaaagcacaaaaagtattagtcgttgatcttatcattattggcgcataatcaacctaagacaattattctaacaatgataatttttcaccaaaattagagccatttaaaaaaaggccactgactgatcagtcgatcattttcagcatctttggccccccacccggtgccaccgatcattaccgtaacgacaacggatgacagggccaatgccgagggctcggaggaggaagaggaggtggaaacggcggacgagcaccaccggcggcccagttccagctcgtccgaggaagaggaggacggcgattatccggacactgtgcagccggtgaattggaaaaattatatggcacaccaattatgtctagaccaatttttgggttcgatcagtgctatttaataaattcagaattcaatttgtttattagcgtgtaaactttcgagagtctcgactattttcttttttgaaaatttgcaccttttctgactgattttgggttttttcgaaaaagataataggagatgtataacaatataatatttaaaattcccttgattctgaccccgataaaatcattaaaacataaagtatcgctttgaataattttcgaattcaaaaaatagaaataatttaaaaaaaggaaaattaaattaattaagtataattacaggtgcccactgtgtctgccgcaaccatcgcacaactgcaggaacagcaggagatggagcagcaaaaaatggctgcccaagtgctgcagcaaatccaagcatttggcgaggcggccgacgacgaattcgacgtccaatgggccaagccgaagaccaaagtgggtataaagcaggggctactcgggattctcagtcttggcttaactcaattaatggttcagtctcggcggttaattctcgctctttgttcttctcgagttttctgaaaaaaatgactcacagatttccgttgacgacaaccaaatgcatcagccaacagagcagcgggacaactttttcttggaggaccaagctaatgtttattcaccgcccgaagcagaagaagaagcagcatcggcaaagtcaatcggcattgccagaagatgctccggcactgatcagtcggctgcacaaagcggagaagttcagcagcaacgggacggtggcggcgcttgcgaagaagcgtccggcagcagcagcagatcaacaaccattgtttatcgaaatcagcaacagcagcagatgacgaacccgttcctaagcgatgagaacggcacgctgcacaacgacggggacgaggaggaggaggaggacgaacagagcggagagggccatgagggcggcattgttgtgcgacaagtggtaaatgccaccattgaataa

SEQ ID NO: 78755 - DNA, 1760 bp, Heterodera glycines
  Genomic contig location: Contig_ID=SeqID_2255; Location=39..1798; Strand=-
  SCN-specific regions: Sequence locations=1-858,880-1499,1523-1760
atgttcttctcaagcgcccaaaaaccagcaacagccacgtcgacggcatttgccggctttggcaacaaatttggcaaatttgcctccgaaacgctgaagggtgccaagcaggccaaggaaatggcggtgacggcgatggcacaggcgggccaaacgctggaaacggccatggtcggttgacaactaataaaaaaaagctccccccgggggtcatcacatcattaaatggttgtcaagtccggcaaagcctaaccgcttgccagaccagggctaatggattaaactatttgatattgttgtactggcttatgtttttctacgtgcaaaatttcacgcccacttcccagaccaccaccattccggcttcgtctcaacaggatgaccaacaaccgcaaactgtccagctgcaaccggaaacggtgccgcaacggccccattcctcgttgggactgtccgccgcgggccccgctggcggagaccagcaaatcgccccgggcactggcggtggtagcgcttcgctgaacaaatccgcctccctgtacgatgttgcgcttccgcccggctttgaccatctgtcggaggaggaacagttgtgcatcatttcagtgatgcaatgtgccgaacttgacgcccaaatggatgcggaacgagcgcaagcggtacaagcagcaccaccacttccacaaacagtaccgagtgcgctgcggcacaaagctacggatgatgtcactaccatcaccgcttttggcattatgtcgcagccattggccaaatttgaaccgtctcaggcggaacaaactgctgttcccccatcatcaagtgcagcatttgctgatcaacagcatcaaggcaatgctggagcagaaacagcaattgaattggccgtagaagtacgtgctgacgaggcggagggtaacaacggacttggcacggctgcgttcatcgacacttctgctgctgctgcagttcagcttgaccttgcccgatatggccatccgcttggtctgttccaaacagaaactgagcaaagtgcagcggaaaagggacaagatcaaacggttgaggaccaaaagcggcacaacatcgaagaggacgatgagccatggatgcaaccgccaacccagaaattcacggtaaatatttatttcggcatcagtttttagggacttatggcacaacttgtgactgaccccttaatccgagaaatccccaagcctcggttactggccttttggactcagattggttctgcaacaaaattttaatgatttttttgggatttaaattacttttgagactgaaatttaatttgaaaatctctgccgagtcgcggaatgcacaattttgcgatatttctctaatttaaaattagatttctattctcgcgtaattaaatttcaaattcaaaggcaccgcttgaccaatgggacgacatgcccatgaacacagtaacaccgcgcaaacagctgtggactacggtgttcactgaggacactgatcagcagcaacagcatcaacaacaccaacagccgaatgtgctacaagctgacggagcagtagcagcaccaaatgcggaggagacggaggaggacgaactgttggagcaaatcagcatggaaacagtgcgcgggtgttgggagcggagcaacggcgacgacagaatcgctaatcagtttggcagggcaagaataaacactgatcagattgataagcggaaggaaggccaacagatgatgatggaggaggacgagctgaccaga

SEQ ID NO: 78756 - DNA, 357 bp, Heterodera glycines
  Genomic contig location: Contig_ID=SeqID_2255; Location=1629..1985; Strand=+
  SCN-specific regions: Sequence locations=1-357
atggccgtttccagcgtttggcccgcctgtgccatcgccgtcaccgccatttccttggcctgcttggcacccttcagcgtttcggaggcaaatttgccaaatttgttgccaaagccggcaaatgccgtcgacgtggctgttgctggtttttgggcgcttgagaagaacattttgccaatatttaaggatggtgccgattgttcggcagatgatgatgcaatggcaacaccaaaagtagaagatggtttgggtggaagcggcggtggtggcggacgaggcacggcaggacgagctaatcaaaaaatatgattttttaagcgaaaaattatttaaggtttattttttttgattttttaa

SEQ ID NO: 78757 - DNA, 2077 bp, Heterodera glycines
  Genomic contig location: Contig_ID=SeqID_2255; Location=2154..4230; Strand=-
  SCN-specific regions: Sequence locations=1-373,395-415,438-734,756 -756,778-884,930-1222,1244-1266,1288-1330,1466-1536,1568-1586,1643 -1732,1761-1953,1978-2077
atggagagaggcagagaaagtggagaaaaacccctgagggggacagaggaaaaagagaaaaagagtgagagaacaagcatcgctgagaatgacatggggacagaagcagagtccgacgagggaaaattgagcgacaatgatgccgcaccgcttgcggtgacattggcacagccaatggagcggcaagacgaagaaaacggggacgacatattggcatattctttcaacgccagcggcagtgccgtcgtccgtcccaactgtgcttcccctcaaataatgccaacgccatgcgaatacagcgaaagaggcatttgtttagccggtgatggtggttttgatggacaaattgtgccaccggcgtggcagatggaaaaagaggacgacgacgagagaatgggaagcattacagatgctagagaaagagaggacgatgagagaggtggaaagtgcattgccgatgccaaagaaaaagcggatgacgagaaagtgggaagcacgggtgatgccagagaaaaagagggtgacgaaatagtaggaagctttgccaatgctagagagagactgagagatgagaatgtgagaagcattggtgagaccacagaatgggaagacgacgagcgtgtgagaagctttgcaaatgtcgatgtcatggccagcagtggccaacccgtgcacgcgtccctctctgtcatcgcttcccgtggtttagagctgtccccctcgtccccggcaaagacgacgacgtctacggcatcggcggcggtggtggcaccgccgcttgctgatgctaacccattctcattaccccaatttccttgccccgcggcgtcaatagtgcaccagcagcagcagaaaggggaagaagaaaatcaaaaaacaaagcaaaacgccgccgctgccgccgccgttgcttttccctttcctttcattgtgccgccggcggatgcttcttcttcttcttctatttcttcccattgttcagcagcagcggtgccaattgtaagccaagaacagaaacagcatcagcagcaacggcaaaatgccgaaactgaacacggcacagagtcagccgatggacaacaacacggcggaagcacgaaagagcaaaagtaaaccatgcatttgtattgtgtaggggggggggcataagaaaatggaaggccaatttgaaagtaaatatatgaatggtatgcttattgttagtcagtctttgcttgttcttattaatgccatttttggcatcatttcgaaaagaagttttatgggtttaaataattctttttatttatgccattttgaaaaagtctgtctcatttgtataggtaaattcatttaattattaaaaatataaattcattttaggcaatacaataatttattttaaaataattttacgaataaaaacaaatttttatttataaaattttttacctggttttaaaatatttatttgtttttattttttcgagaagattgccgaggcaataaaagtgccatttttagacttaattacttttcaatgaatgtttaatgcccttaaaattaaaaatttaagtataataatattgatcaaccaaaccgttcccttaaattaatatttttaatttattattattatttttataattgttttttaattttaggtcattaagcgtagcgcaagaaattggcgatgctttttggacagaagagggacaaccgcagcagaacaatttgtccacaaataccaccacatcaaaaacaacaacaacaaccactgccatcggcactaattaccatcatcaacaacaacggcaccaccaatttgttggtggtcaaaaagatgggaagagagtgccgaaaccatttgtaggggacgaagaaggtgaagacgagcaacagaagcagaagcatactgtacaagaagcagtgccaattgcaaaagcagcagcggcgggaggtaagcaaggaaataaatgaaaacaaatgaaaaactatgaaatttggcgcggaaaatgccggattattttgggattgaacgggaatttggttgggattcaaaatttcatcggttttttgcaatttttttttaggctga

SEQ ID NO: 78758 - DNA, 352 bp, Heterodera glycines
  Genomic contig location: Contig_ID=SeqID_2257; Location=9..360; Strand=+
  SCN-specific regions: Sequence locations=1-180,203-352
atgtgctcccgctcttccgtgctgagcccggccagcgcactctcaggcaactcttccgtcaccgccgccgcgccatcctctggcgatccgccgttggatgtcctccgcaacagttccatgatgtcgccaccaccgccagcggctgtttcgcctgccgccgctccgccaatggacaaacgtttggtggtggtgttgctgctgccgcttgtggcggtggttgtggttgtactgatcgaaaatgtggttgcccgtggggccaaaaaaggtgtcaatttggcggaccagggacgagcactacttgatgactagaaaatgggcgaaactataactttaaattttaaatgtgaaaata

SEQ ID NO: 78759 - DNA, 719 bp, Heterodera glycines
  Genomic contig location: Contig_ID=SeqID_2257; Location=619..1337; Strand=-
  SCN-specific regions: Sequence locations=1-8,30-478,500-551,591-719
ggccctttactttgatgacaaatactgtgaactgctcaaagatgggccacaacattcgcatgagcaacaaccgcaacaaatgtgctcatcgcctgactccgacggatggtcagtacagtattttatacgttggggtgtactgtagttttccagtcgattctatgaaccatggtttaaccgcatttcggcaccctttggagccggaatttttcgcatttcgaattctggcattatctttgcggctattaattttattattgtccttttgatcaattttaaattttgatcactagcgacgccttacaaccaatcagccagtgtttttcatttctcattgttagttggattatctgcttaattaggttaaataagctccgtatgccaatcaatcaatgccaactcattgaccacgtttcatatgatcatgcccataaaacaattaaagggacggtgccgaaatgtcatgttggcaagcaacggcagaacatcaccatgccaacaaagaggaggaggagctattgttgtatgaagtgcaccacgaaatgggcgaacagcagcagcaggaggagcagccagcagaagcagcggcacgtgccggcttcaagcaggagctgatcagcggactgaacgtgttcgctggcctaatgcgacgcagttcaaccgcaacaacgacagcggtgagcatgcgcaatgtcattctggacattctgggaaattga

SEQ ID NO: 78760 - DNA, 2775 bp, Heterodera glycines
  Genomic contig location: Contig_ID=SeqID_2258; Location=385..3159; Strand=-
  SCN-specific regions: Sequence locations=1-146,168-276,302-356,378 -566,588-686,708-851,873-1034,1056-1217,1246-1589,1611-1913,1935 -1946,1968-2775
  Gene Ontology: Mol. function=cytoskeletal protein binding; Cellular component=cell-cell adherens junction; Biological process =intercellular junction assembly and/or maintenance
atggcacgaattgaagcagtccagagaagggcacaagaagaagagatggcacgaattgaagcagctcagagaagagcacaagaagaagagatggcacaaattgaagcagttcagagatggacaaaagaaggggaaccaaagatgccagaactgacagatgaagaaatggcacaaattcaatccgttcagagaagggcacaagaagaagagatggcacgaattgaagcagtccagagaagggcacaagaagaagagatggcacgaattgaagcagctcagagaagagcacaagaagaagagatggcacaaattgaagcagttcagagatggacaaaagaaggggaaccaaagatgccagaactgacagatgaagaaatggcacaaattcaatccgttcagagaagggctgaagaagacgagatggcacgaattgcagcagctcaaagaagggtacaagaagaagagatggcccaaattgaagcagctcagagaagggcacaagaagaagaaatggcacgaattgaagcagttcagagatgggcaaaagaaggggaaccaaagatgccagaactgacagatgaagaaatggcacaaattcaatccgttcagagaagggcacaagaagaagaaatggcacgaattgaagcagttcagagatgggcaaaagaaggggaaccaaagatgccagaactgacagatgaagaaatggcacaaattcaatccgttcagagaagggctgaagaagacgagatggcacgaattgcagcagctcagagaaggccacaagaagaagaaatggcacgaattgaagcagttcagagatgggcaaaagaaggggaaccaaagatgccagaactgacagatgaagaaatggcacaaattcaatccgttcagagaagggcacaagaagaagagatggcacgaattgaagcagtccagagaagggcacaagaagaggaacgaaaggtgctaaaacttaccgatgatgcaattaaaaaattcaatcgcaccgatgatgatgaacatgaaatgatttcatcttctacttctccagctgactccaatccttccccgttggattcatcaacggatttgcattcaattaaagaatttcatggtgatcactttgttcgacaagattttcgacatctttcgacaaatgcttttccgcctgactctcggcatgacccccatgaaattgttcatgaagttcagtctgtccaacaacagcaacaacaaccacctgtggatgctgcatgtccctctccagctccttcttcatctccttcaacttccggtgccgattccatccgttcttctgccgaacattctcaactctacgagccatcaactccgttgctgctttctgacaatgacatggaaccacttgatgctgctcaacaccgacaaaatctgccacaaaaagttgaaccggatttgagtgccgaaacaacgatgtcacaatctgagaaaactttggcacaaagccgagtgccattgtacaacgagtgtccgtctgagttcgatgtgccgttgtcgcaagaagggaatgactcaatgccgccggaacagttgccaactcaaccattggtattgccatttgcagaatttccaaacgtgccaatggaaactgactatgaaaataaccttgttggaatgagtcataagcggcgccaatctggtggtggtgatgccagttgcactgtcatgttgctgtctggtcggcatcaacaacggtggttgtccctcggcaccgtctccggcatgatggcagacagcttcgacggtggagacaatatactgacgccgctcccgtcattaccatttctacagacggcaaaactttacggtgataatgccaagaatattgttgctgatgtagctgaaccagcggtggtagagcatcagcaacagttcaagcggaacagcagcagtacaaaggcgacgaacagccgaagcagaagcagtagctgcacatccagcaacgtgaacatcatgttcactgacgaatgcttgcgtcgatcattttgcgacgatcaggcggatgatagtgaaaagcagcacgaagccgagggtgagcagtaccgtcggcacggtgccgtcgatactgtcaacattggcacggacaacaggaacagcattgttttacagagaacaaatcgaatggcatttggagagaaaagcatgaccgaaaatgggggaagtgtggagaaggatgacgaaacagacacggaagccaacaaacaatgggcggagcaacaacagacggactgggcgaacgatgtcgacttcatgtataaagtaagcggcattttgtttttttagttttaatgacgagatcccggcattttgaaaagcgccacatggaaattgaaaatgatctggcttttcgagagtaagagccagtttaatcagtggatggcccggtggccaatcataatacgaacgacaaatttcagaaaacacgttaatttttcgtttatcgccaatcacaattaaaaattatgtcgtttgactccttaaatcagatttcccacaaagtgtcctccaaattacccgggtccaaaaaattgggctgtttaagccgggcactggagctggaccgggcgggaccaggatcactgggactaaaattgatcaacctgatccagggattttttttaccaaaaaggcttaccaagaatgccgtaaaaatgtattttttcagttgaatttcttcgctcagcgactttctgagcaaattgcggaagaagcggcacgggacataacaaatat

SEQ ID NO: 78761 - DNA, 561 bp, Heterodera glycines
  Genomic contig location: Contig_ID=SeqID_14656; Location=183..743; Strand=-
  SCN-specific regions: Sequence locations=1-85,120-365,416-421,444 -466,488-561
atgccctttttcgtttcgttttcgtatacgaaaatttttttttgtgattttcgcacatccctgcttccaatgaatgtgagtgattgttttcatttatttgtgttaattaatgctttaagctaactctgtaatataaaatccgccatatgttcgtttttccatcagaaaattagttataaatagagacaaaacacaattttgcaaatccgcctagtcgggcaggggtgttaattccaaaagaaaccgattcccggtcccgacatcttcaaagccagtcaaaccgggattttgaattgccgggccgaactggtttacgagttgataaaaatttaaattctcacattataagttattaccctttatacatttaattttaaattatttacctcataaattaaattatataaattatttaggtgaaaaatcacataaagcaaatactccgtcaaaaaggaaagtcgttggatgaaaaagaaactgaattggaagaatatgttcaatcattgcaagaggacaagccaaaagaagcatgaacataacaaaattgtatacagaattaaa

SEQ ID NO: 78762 - DNA, 280 bp, Heterodera glycines
  Genomic contig location: Contig_ID=SeqID_14656; Location=1458..1737; Strand=-
  SCN-specific regions: Sequence locations=1-123,145-248,274-280
atgacttttttggtaagaaaaaataagatatttcttgaagtattatattaaatctgccaggaaattgtatgtaaagtttgaaacgttgatattttttttagagagcgacatttggcgaaaatacggatcaggatcaggactacggactaggcatccatacggactacagacttacggactaaaaacccggaaaacccttactccgtataagtccgtatgcaggaaaaatacggacccgtatacggatcagggttttttgaaaagttttttaatcaataaa

SEQ ID NO: 78763 - DNA, 2725 bp, Heterodera glycines
  Genomic contig location: Contig_ID=SeqID_14660; Location=944..3668; Strand=+
  SCN-specific regions: Sequence locations=1-200,222-320,342-482,505 -635,662-1399,1423-1444,1558-1650,1697-2147,2169-2262,2285-2699,2722 -2725
attgggtcgttggagatgccacgctccgaatggcttttctcctccgtcgcgacctttcagcagagttacggccaagtgcacccctatttggccgctgttttatgtattgtcggtgagtaaactgagtaaataaggagcaaatgaaaggcaattaggagagacattaaggacaattaataatttttacggcttttttcgtttggctgaaaatagcagcactcatttgggctgatttgtgctgctgttggcatttcgttttgagttccctttgtcttttccgattacagaaactaattaattgtcccttgggtaattattaattgcccattggccaacttttaatggccctttgctaattgcccccccccccctccaaggcactttgatgaatgctatcactgttttggtgctcactcgcccctcaatgcgttcccccgtcaatgttttgctcagtgcggtcgccgtctgcgacatcgtcgttatgtcctcctatttggtttttgttgttcactttttgttgaccgccgcttcgcgctgcgagcccagcgacttcagttacggatgggcactgttcatggcaagtgaaaaagggcagaaaaagggaaaaaggaaatgaaaatttaaattaaatggagatataaaataaataaataataaaattcaacagaattcctaataaattgttcagattttccatgcccatgcttctgtcatttttcatgccgcttcaatttggatgacggtgagaaatgagaatcgaaatgccccccctttttcccccgaaaatgctaattactattagctaatgcacaaatgcttttccgctgaagtgcttggcatccaaattcactttcactttgcaatttgtcaaggtttccctagcccaaattcgcgtgctgaccattcgccgtgccaccgccggcccttcctctccgctggtcacagaacgttttacggtgctattagctgtgctgatgctttgtgccatgaccctcgtcaatttgccaaattttctaaccttcgaagtttgttgcctctgcccgatcaataaaaactcaatcattcgataatcgacgatcgattgccggatcaattaataaaacgatctttacagataatggaagtgccctccagctcaatgttgccctgcttacattcgcccgactccaccgaattagaaaatgacggctctttgcaaaatgtggcaaaagtcatcggcacagacttttcacaaaatgacaccgcagtgaaaaatgaatcaaatgctattttaaacggaaaaatgctcaatgacagcgaactgaacatatccaatcactcttctgataacttaacatttacaacaataacgactgcacaccggatgagaaggcacagagagacgaatatcagcatgtggggaaagaagcagaaagaaaggaatgataaggaaggatatcaaaacagagaagagagagagagagagagaatgggagaaagagaaagtagagagagagagaggaatagaaatagagtgagagggagggagagagagagaaaaggggggagaaagagagatcggaaaagaaagaagagatacagatgagtcataccgtatgacaaatggtcgatgcgatcactgatcagattaggatctgctgatgggatggggttgaaaaacaaaggcttccccatttaaaggcattcccgtggaaattcggagccctttggcaccaaagacagtttcgcctacaccgtccgagcacatgacagcgattgcatgaaattgaaagtaatttgaaaagtgccggggaatatgccaatccatttcttccgattttcccatgcctttgcctcttcagttggccttttggtctaacggaatgatcttcaaagtgatcccgtgccttttgctgactttgtccatttgggctttgctgcgcataattgcggacgtggcacacaaaaggcgcaatttggcacaggttaattaaggtagaggagggacacgtgccaatgccaatgccaacgatatttgaggtgatgcgcaagaaagtggtgccaaaggaccacacgacgccaatggtgagggaggaaacgcaatttaaattcaaattgaattcaaaatatttcgggcaaaggctccaatttgattctcttttagctcgccgctgttctgctcatttttctgctggctgagcttccccaaggccttttcctggtgctcaatggcattttctccgccgaatccttccacaaacgcgtttatttgccgttgggcgatctgatggatttgctttctctgctcaattcggccgtcggctttttcatttacgtgggaatgtcccgtaaattccgcaccgttttcctgcaattgctcttctccgtcctcagctttctcacgaggtgatcaattgttctgatcagtccataaaatttcgaccattccccttgtgccatccctttttttcaatttgtcattttttgccattatttttttcttttgtttttcgattggcttccgccgatcgttttttggcctttttgccgttttgtgtttgatcagtagggctcggatttttaggggcgaaaaagtccaaaatagggacctaaataggggcaaaaaaatcgcgaaataggtgcgaaaataggggcgaaaaagtttcaaatgtaggggtgaaatttattaaaattgctgttttctctatctaaataagttaaaattaaggcaaacaattttatcact

SEQ ID NO: 78764 - DNA, 1105 bp, Heterodera glycines
  Genomic contig location: Contig_ID=SeqID_14662; Location=214..1318; Strand=+
  SCN-specific regions: Sequence locations=1-101,176-234,486-507,619 -715,776-805,827-880,945-1105
accaatccaagtccttttcaccattggcctttatcaaatcattgaagtgaacgagccgcaacaatacattcttctcaattcgtggattgttgaagtaaaacatatattagtttaaaaattttctaataattataattacttaaaaagcatttaaaataattaagattaattttaacgcatattttggaatagaaactaatgaataaatatcttacactttaagcgatgaataagtttaattatttaattaatttttaaagaattaaaaaataattttaaattatatttcaaataaaacttaattattatattttatttgtaatcacattaagtgataaatgaatttatttacttaattgaatttaaagcacttaaatagtataaaattaatttacacatttcgaatatataatttattaattatttgttaatatgtaagcgataatatattatatttacataaaaattataaaaacataaaaaatcaatgattttttcgaataaaatttaattaataatttataaattaataacttatttaaattttaaaccattaaaaatatttaaaattaattagttttttgaataaaatttatttaataattttatttattaatttaacacattaagcgatggcgcgatgatttgctgcactgggcgcccgctcaatttggtggattgcgtgaaattgtgctcccacgtgattcagtgattgatttttttaaaattttacttctattaaatgtatatttttaaataataaaacataattataggtgtggattccggacacaacattatacaattcattggtcatggatgatgagcaaagccgtcgaattttaaatgtcaaagtacggtaaaagaaaattataattggaaataatatttaattttattaaaaattatcaaattgattaattttatttataatttattaataagcttttcagttgaatacactacaaaaggagaaatcggctttagtagagtgagtttaactgacagaaatgtttaaattttcaatgtttttagaatgctttatccgacattatatcaattttcttgcatgttagaccttcggtttttcccgtacgacattcag

SEQ ID NO: 78765 - DNA, 278 bp, Heterodera glycines
  Genomic contig location: Contig_ID=SeqID_14663; Location=2126..2403; Strand=+
  SCN-specific regions: Sequence locations=1-173,203-278
atggttcctggacaaatacaaagtcagtgcaaaacatttgagaagcctttattgtgaagtggcctctcttttttctcaggttgacaacgtgaactttcaaacgaatggcgccgaaattggccaatttttgcacaaacttttcaacgccaaaaaattattgcttttggtcggtctttaaaaaaattcttataataataattaagtatactgcttcagaaggcagaaaatacggacagtggaaatgttttggagcccgcaaagttcccgggaatggacag

SEQ ID NO: 78766 - DNA, 2093 bp, Heterodera glycines
  misc_feature (26)..(26): n is a, c, g, or t
  misc_feature (37)..(37): n is a, c, g, or t
  Genomic contig location: Contig_ID=SeqID_14664; Location=524..2616; Strand=-
  SCN-specific regions: Sequence locations=1-42,65-736,761-839,864 -867,890-906,935-1007,1030-1145,1210-1304,1337-1842,1864-2036,2081 -2093
  Gene Ontology: Mol. function=serotonin receptor activity; Cellular component=integral to membrane; Biological process=synaptic transmission
gtgcgtgttgtttcacttgcattttntgggaatttcnttttgaaaattcaaatttattctaatatttttttaattgtaatactcaaaattgcttttccccttttttggccatttctcgtccattaatgccatgccatgcttcttggcaattgcattagttaatttggtaatattcgctctaaaacatctcagatttgtgatcactgccatcctaattgagcgcgatttgcgctgccgccctcaatattatttggtcttctcattagcagtggccgatttaatggtaatttgaaagggcacttacattcattaaattacatcattaaaaagcacactttgttgtcaggttggtctgatcgtcactccgctgggtgctctgagcacattgagacaatcgtgggagttgggggtaagccaattaattaattatccgattaattagtgccatgctcgagagtcttgcggaattattcattcatttatttctaaaccccctttaaggtcactttgtgtgacttttggataagtgtcgacggtaatccttcccctttcgtatttgttcttctaccgtattctttcagtgctcgtctgtacttcgtccattctccatttggtggccattgcacttgacaggtgccgggggatgccacttttttttcccaattagtttggcattttgccgaacatttcgtcccgttttctgtcacatttttattcaaaaaattcctgcctttcctttattattaaatttttaattttagtctttaccctttttaataaataataaatgtgtttttttagatattggtccgtcaccaacatatcctactcaaatgtacaattaaattatttatttattaatacggtattttaaaaattaaagcaaaattaaaccccaccgaggggtttttttaatttaaaatatttattttttcaaaacaacggattgcatagggttaatcaaagaaatggaaaacttaattcatcgcaaggccaagtctcgaacataatttatttacattttttaaagaatcgaacgccgcgacgcattttttcaatgctaatggtcatttgggtactttcactgctcatttccttggcacctcaattcggcttaaaggatggtgagtggggaaaactaatggaaatataattaaattaaattaaaattttaattaattaattttatataaatataattaattaaataacttttaaattgataataaaaaaaacagagaattttgtgacacgagttcgggagcagcaagtgtgtttgatttcgcaggacattgcctaccaagtaattattcattaattagttaattaattaatttgctaatgacccttcaaattgttcccttgctaaggttttctccacttcgaccgccttttacattccgttgtttgccattatgctcatttactacaaaattatgcgagcggccaaaaagcgctttcggcgcgaaagggacagaagaacggtgaacagaacggtggtggagacagtgccaccgaaggccagcaaaatgctaattgcacaacaacacgtgggtgatgggcaaagaattcagaggcccaaaatttgaaaattgaaattccatttaatccctaccggtggggcacatttggcacgacaaattgaccggcatttgcttagtgcgttttttgggcccggatcttccgattcgggtaccgaatattagatttaaaaaaagaagagtccaggtcttgaaaaagccgtgtgtccgggaatggacccgtcggatacccggaacagtttaaccctcttaattaagcattagcccattttttatttttgtacaataaagcattaataaaaagaacagaaaaatggaccaattttttttttgcgttttctctcctttcatcggttaaaaaatgttatttaaatagaaaagtaaaaaaatcaaaaaaaaatgtctacaataaaatggtcggtctttcccacgcgttgctttttcccctccgccgtttcagtctccgctgaaccgccactctcagcccaatggttccaccagcaacaacaacaactacagtaacagccacagtaacaacatgttgggcgcaaa

SEQ ID NO: 78767 - DNA, 1900 bp, Heterodera glycines
  misc_feature (888)..(888): n is a, c, g, or t
  misc_feature (1047)..(1047): n is a, c, g, or t
  Genomic contig location: Contig_ID=SeqID_14666; Location=983..2882; Strand=+
  SCN-specific regions: Sequence locations=1-177,199-528,574-613,722 -920,956-959,1023-1111,1133-1251,1291-1466,1492-1503,1542-1752,1774 -1798,1821-1900
atgactatatccgataatttatttgatgatatttggaagaggagcggcattttaaatttgccaagaaaaagtgaaaatgtgccgaaaataaaagtaataaacgcggaaatttcccaaaattatttgaaatatttatttttcatttttaaggttgagccatttgacgagcattcttcggcagcagcagcagatgcaaaggcaaatacgaaatttgggaaaataaaaaaagaaaattttgaaattttcgaaaaaaatgctaaaattaaacaagaagaatttggtggcagcgaatcgcgccaatttggagcaattaaaattaaaactgagaatgcttcaaacacagaagttaaagaggagaacgaaaattatcgaaatttgtccgaaatttatgaaaaatggaacaaaaatgagcatgaaaagactgttataagccggacagatcagcaaaatccgagtttatcaagtaatgtgaaaaggaaattaattaaatatttatgggccattttagtcggcaaaaaaggattagagaaataattatttattttctaagttaaagttaaatttatttaatttgaatttgcataaaaatcaatatgtgtaatttttgagttgcaaaataaaaattaaaatatattagtttaaagtaataatttttatgaatatagatttattttatatatttttttacaaaattcttttttttataaattttttaaattatctagcttttttagtctatacgtcatcgagcactaattatggtgacagtaattacacgaatgatgattgcagtaattatggtaatgatgatgccagtattacggtaatgataatgacagtaattacgaaagcgagtacagtacagcaaatacatatgaagatgaattnggatgatatgattttgaagatcaaaatgaagtcacaaattcaaaatccccaaatttacaaagagtaattacttttttaaatttttaaatgatttttttttgtatgatttgggaatattttttttataattttttgcagttttgccattttgggaatttntaatttgtttctaattaatttaatttcacagaggaaaagcgttattacagtgaatcggaaaaggaagaatttgtgaggaaatacaaccaaattcagagggaaaagccggaaatgaaagacgaagaaactgttcaaatgttgaacataccaaggcggacaatattcagatggaggaagcaattagcagaaaaaagtaagcgccacaattaattaattaattaatttaacaaagtaattaattaagtcaaattatccgaaaatgacgaaatgcgtgaaattgtgagcgaatttgagagaagaaaggaacaattggcacaacaatgggggagagtgcccgagagaaggacgcaaaataaaattgcgaaggaattgggcgtcagcgcacgagcaattgcattttggaaaaaggaatttggaggtaattaattttaattaattagttttggcgaattcattaaatattaattatcatgaaaaagaatttgtgaaaaataacaaagttttctaagaatttgttccagaaagaaaagcataataagaacaactcttttgcgctctgtttagagcttctttggtcatttttataatgtatgtttttgcctattttggcatttttatcttggtttttggattttagaaatatcaaattcacatcctaacaatggcactaaatatttcaaaaaaaaatccctatgaatagcgagatttttcaaaaattttcccatatattagagtacccccaagcatttcgtaaagaaaatttggggtttgaaaatatttttcaatatttttgtctattttacaatttgcgtgcgaaatattgatcgaatccctgttaatttgcattttaaaa

SEQ ID NO: 78768 - DNA, 272 bp, Heterodera glycines
  Genomic contig location: Contig_ID=SeqID_14667; Location=345..616; Strand=+
  SCN-specific regions: Sequence locations=1-159,181-182,204-222,262-272
atgcgaatatcccaaaatttgtcagttaaatgttataatgacgccgagaaaaaagaattgctgaaattgtatgaaaaaattaaaaagaaacaccccgaattggacaaagaaaaaattgggaaaattctaaatgtgacgggacgaaccctaacaaattggaaaaaccaattttatgggaatgattccaagaacaaatgtgaaaatgtacagaagaaaagtaagttttttttattcaaaattaaataaatttttgaaatttaaggcaaataaaa

SEQ ID NO: 78769 - DNA, 157 bp, Heterodera glycines; identical to SEQ ID NO: 67642
  Genomic contig location: Contig_ID=SeqID_14667; Location=759..915; Strand=+
  SCN-specific regions: Sequence locations=1-42,64-97,119-157

SEQ ID NO: 78770 - DNA, 1563 bp, Heterodera glycines
  misc_feature (1390)..(1390): n is a, c, g, or t
  Genomic contig location: Contig_ID=SeqID_14668; Location=39..1601; Strand=-
  SCN-specific regions: Sequence locations=1-1563
atgccaacgttgtggaaacgcccgcatgctcaaggactgcacttatcgaaaggatgtcaaatgtcaaatgttatggttgtggtaatctcggccatataagaccaatgtgcccatccgccgtgtctcagtcgcattgtgtggcgtcaaccttcagtgttgttcaggcgcgagattggatcatggttccgatccaaatcaatggacacaaaatcgaattggcagccgactcatgctcacatctcacaatcattcaaaggccgatgtggttaagtctcggagggccaaaattgattaaaagtggtaaaattgtgggatctttttcaggccataagctttgtttgctaggccaattcaaatgttcggttgagtttaaaggtgttcacaagtgcctcgattgttatgtggccgacaccaacgcaccaaatttaatgggtttggattggattgctccttttgaacaggcaactgaacaaccaatcgcaacgacgttgagttccgaacattttcaaccgaaaactttggcaattgcaattcccgatgaacctcaagggctggcggaacagcttaaaaatgcttttccccaagttttcgcccccggaattggcagatgttcaaagatgaaagccattctgcatctgaagcctgatgcatctcccattttctgtcgagcacgtcaagtgccacatgatgttcaagacgcagtggacaaggaattggatcggttgctcgaaatggatgccatcagaccagtcgacttctctcgttgggctgcacccgtgctctacgttcgtaagaaaaatggagcagtaagaatctgcattgatttttcgacgggtcttaatgatgcgctagaactaaataggcaccccttgccccgaacagatgacattttccatgcattgcgctgctcgaaaattttctctcagttggatttccgtgatgcatatttgcagttggaattggacgacaaatcgaaaactcttgtgggaataaacactcgcaggggtcttttccaatttcagcgtcttccgtttggagttaaatcagctccatcgatttttcaaaagaccatggaccagttgacagccggaattcctggtgtgttcacatatctcgacgatgtcatcatcgcttcaaggaacgcaaatgagcatgtttcaacacttttgaaattattttctcgaatccattcgtatggtttccgaattcaaattgagaagtgtcactttttcaaaaaggagatcaaatttttggggcacgttgtttcaacggaaggcattcaccctgatccggaacgatcagcagcaatccgcgacatgcctccgccccatgatctcccaactctccgatcatttctcggtgccctcaactattatgggcgttttgttanagagatgcgtaagttgcgctctcctctcgctttgttgcataaaaaggatactccttggttttggggtgaagagcagcaatccgctattgaaaaagccaaacaggttttacagtcggactttggtctcactcagtatgacccgaaaaagcccgtaatcgtggcagctgacgcaa

SEQ ID NO: 78771 - DNA, 684 bp, Heterodera glycines
  Genomic contig location: Contig_ID=SeqID_14669; Location=391..1074; Strand=-
  SCN-specific regions: Sequence locations=1-396,419-684
atgcaacaaaggcaaatggactcgcagcaaaagcaatttttggatttgttgaatgctttcactaatcggacggcacccgttgccaataattccgatctcttttcccaaattaatggacagattccggagttccgctatgatccggagcaggactcaacctttgcactatggttcgacaggttcggcccattcattgaaaaggatggcatggcattgggagaggatatgcgagtacggttagtcctggtaaattgtcttccacagattatgttctttatgaacagcaggttttccaaaaaaccgactgaattaaattttcaggaaacaattacatgcctcaaaaatttgatcggtgaaacgaaattaatttttgttcgtcgatttgagtgctttcagctctcctgtgctccctctcagaatgtgctcgactttggcgcgcttgtcaactccaaatgcgaaagagccgacatgaacatcaccaaggaggagataaaatgtctgattttcatttcaggccttggtgacgcgcacaaagatttgaggcacgaatgtttgcgacaaatggagaaaaacgacaggaacaaagacagaaatgccaacgttgtgcaaacgcgcacatgctcaaggactgcacttatcgaaaggatgtcaaatgttatggttgtggcaatctcggccatataa

SEQ ID NO: 78772 - DNA, 50 bp, Heterodera glycines
  Genomic contig location: Contig_ID=SeqID_14670; Location=134..183; Strand=-
  SCN-specific regions: Sequence locations=1-50
atggttgtgatcattctgccattgctcttctgcttctacggagagtgtcg

SEQ ID NO: 78773 - DNA, 423 bp, Heterodera glycines
  Genomic contig location: Contig_ID=SeqID_14671; Location=53..475; Strand=-
  SCN-specific regions: Sequence locations=1-61,83-423
atgcccaccgatctttacgaagtgatcggatgtccgaaagaggcgacagtgagtgatcagtgaaaagagcgaagaaaaatgactgattggcacttttgacaacagaaagagcaaattttggctgagtaccgacggaaagtgttggcattgcatccggacaaagtcagcggaggggcggcggaactgcgcaatttgagggacgacgaagcgaacaaacgattccaacagctgcaggtggttttggcaattagcagggatttacaaggctggcacagcaaaaattaatgataattaaacggattaaaacttactaccctaaagtttgcaaaggaagtgctgtccgatgagaagaagcgcaaacactacgaccgttggcttttgagtgggcaagggatggcactggccgatttggatggcaatcag

SEQ ID NO: 78774 - DNA, 310 bp, Heterodera glycines
  misc_feature (90)..(90): n is a, c, g, or t
  Genomic contig location: Contig_ID=SeqID_14672; Location=642..951; Strand=-
  SCN-specific regions: Sequence locations=1-271,294-310
aaaacggagccgacaaaagtcagactgatgccaaaggtcagttcttgatggcattaattagccaataaaaaacaaattaaaagggagacncgcgctcgcatttgccgatgacctgcgcgattcgaaagaacgtaaccagcttttgaagttgttgagtgaccgctgaagtgagaggaaagggacggtgatcagaaaattctttgtcagtgattagaaaatgttttgccgttgttgattttgaccgtttaatgtgttcatttctaaattcgttggtgcttctttttactcatccataaagcgcctttacaac

SEQ ID NO: 78775 - DNA, 2150 bp, Heterodera glycines
  Genomic contig location: Contig_ID=SeqID_14673; Location=147..2296; Strand=-
  SCN-specific regions: Sequence locations=1-384,408-976,998-1367,1389 -1820,1842-1904,1926-1941,1992-2150
  Gene Ontology: Mol. function=signal transducer activity; Cellular component=actin cytoskeleton; Biological process=regulation of muscle contraction
atggagtgtcgggcagcggccaaatttgtgaatggagagcccagcgacgatgtctttttttcaagaatcgtttttacggcacggccttgtccggactacgattcagtcccagtcagaaatggacacaccagtacccgattttttaaataaaatggcaatcgcgcccctaacttggctttttccaaaatcacagctctggtttaaatagtgttaaaccgttcgaccacgacgcttaactccgatttgggtttataagatttgcttaagtatgaacgaacccaatcaattccaattccagacattccattggccaatatcccccccccccccctccacattctcatttatgggatctgttttttttttgttcccacccgatttaatctgctacagaagtgactaatgggagcgttgaaaaggcaattatccaccgattaacacttttctttccatctcgtgtacagctacataaaaatcatttttaaatttagttgtattttatttatttgccttttttcgcattcatatcccatttttcacactcttgcgacacaaaaaatttcctcggttaatctaaaacctattaaaactaaagatcggctacggaccggagccgtatacggatttttacggactaggatttttatccgtaatcctgaatcctgatccgtattttctaaaaatgccgttctctaattaaaaccgtcttttattctaattttactgacattaaaatttggaacttaggtaaacattaaaaaatatttgtattctgtttcttttattgtttatgattctccattaaattctaaaaaatttcgtagtgttccgttgttcagctcgtttactgtctctgttcgattaccccaggcatttagtattaatcttcaatttttaagcaagacaaataccttcaatcattttcattgtgtaaaatggccagtaattcaaatgcccaactgttggatgcatgcgaaaaaggggcggaattaaaaaacagtacgtttgagaatttatggttaaaattggcaatggcaattcaaaataagtttttaatatgctttaaagtgacaaatcattttgtttttattcctttttagtcaaatccctaattgagcgcggggcgaatgtgaactttgccgatgaagacggtctttcccctttgatgggggcatgcgtcttcggtaacgttgggattgcgcactgtcttgtcgagttgggcgcgacaattgagcaaaaagatgacgagggtcagttaccgtatttatctgctaattaggcctctggcacttttttagatggagagacaatgcttttaatttgggggggggattttttaggaaaaagcaaatggctaattctttggttgtatgaaattttcagaaaagtttgtccccaaacattctccccagacaatataagtgccagtgttatgatcagatcttggaaaaatagaataaacaatacttgctagaaaaattgggaccaaattttccatttaaaaaaagaatggtcaagcacccggtaattgtaccggtggtagcccccctttttcgaaaaaaatttcaatgtgaaactcgaaaaatttgaagttttgactttttgttcgctattgcgtcagattacggaattgaatcgaaatgggagtaaaaaccgaattcgcagaccccgaaaactccaaaatagctttagtttgagaaaaaaaaaaaatttttttcactaaaagtaggattaccagcgatattattatgagcaaacacccttcattcaaatgagtgaaaacagagccctttgagctgtaatttgaacaattagagtacttaattatgttaatttgtaattctagcagcgtaagatcttttatgtagatatttcaattgctaaaatgtgcagaattttgaatttttcttattaacttttttcactttgttcgtgtgtatcttataaaattattaaaaatatttttcaatgcttaaataatataaataaatcattttaggtttgaccgcccttgggcatgctgtcattgcagggcagctcgagtccgtcaaaatgttgaccggaaaaaacgcgaactgtttggtgtttgccgaagacaatcgctcgccgttggtcatcgcctgtcaggaaggccgcatggaaatccgtca

SEQ ID NO: 78776 - DNA, 349 bp, Heterodera glycines
  Genomic contig location: Contig_ID=SeqID_14673; Location=2717..3065; Strand=+
  SCN-specific regions: Sequence locations=1-115,155-349
atgaatacttcaagtgacaaaaatgccgaaaagggacccgcaggagagaagccagttcgagagcggcaccttcgccattcaaatgtagaagaagccgaagttgaagcaatggatgtggaagctgaagcggaggaggaggaggacgacgacgacattcattactcgccgttttccaatgacgccaagctgctgccagccctgcataagcccgccttccaagtcaagcagttcacgctgaaggtgaaccagctgcctacatgccctaccgttgaaaatgcaacactttttgcagaccttctttgaactgcacttggaagtgatgggccgacgcgacacccgggcgagctga

SEQ ID NO: 78777 - DNA, 419 bp, Heterodera glycines
  Genomic contig location: Contig_ID=SeqID_2260; Location=876..1294; Strand=+
  SCN-specific regions: Sequence locations=1-220,242-322,344-419
aaaaagagaggcgaggaacaaataaaatggacccaaaaatgaatgacgaagaggtggcgagggagggacccgttgtcttaaaaagggaataattttgtattttttccaggactttcattccaattgtaaggacaggccaatccataaattattttcgaatttattttcaaggatattttttaaacattttccctgaatttcgtataaaaaattgcagggttgtgggccagaggaggacctttgtaacaatccaatggaattcttgaaaaaaggacccgttgctcttgtccatgtgcccttcaaaataagggcaaattaagtgcacatagggaggagccctgacttggctctatttttttcgtataaaatgcggaatgaaaaattgtttcgattggatgcatttatttgtatggcgaata

SEQ ID NO: 78778 - DNA, 1071 bp, Heterodera glycines
  Genomic contig location: Contig_ID=SeqID_2262; Location=365..1435; Strand=-
  SCN-specific regions: Sequence locations=1-188,211-508,531-563,624 -1010,1032-1071
atgggacctggatcccgcaggattttctgggcccatatcccggcttttaaaaacggctcaggaccgggaccccagcaaaagcaggatttgagtcccggggtagggctcaaattccggaaaaatggagtttcaatcccccgtaatcttatctcggtctcaggccaatccaaattcccgactttatattgttttaagtttgaatttaaaaatttttcagcattttttctgcaatatgaatacgcttgctaatcgctgctctttttctaaattgtcgtccttttctcgttcgtttcactttttggcgaccggaaaagatttgcaaaaggttttattaccatgaggagaaaatgtgttggcactgttctgaaaatgccaatttttagttcaatccgaagaaaatgccatccgattttaaaagtgccgttggacgtcgtcagttgtcagtccaatgcaattccaaccgatttttttcacgagaggcatcagatttggaatcattggaggtacaataagtcaacaaataaaaatttacatgacccatacggagaaatcttggtttgtacaaaaaaaaataatatcaaaacataattttttatcaaaaaaaatattaaatttattaatttcgtggggcgggctcgaacctccaccacccctcttctcactttctcacaaaaaccactgagctacagctttttcaattttgaggccaaaaattgaaagggtttataaaatagtacgccttattttcttcatttttttaggcgcgattgcagcgctcacgcaaatctttcgaggagtcactaaacaaattggatgagatgactaaaatgcttgaaagagacaatttgcgtattcaatattgtatttactttcttgttttttccattgttgcctattgttgttatgatttcatctccgaaacgtcatctcgaaaatgagctccatttaccaaaaattatggtatacatacctaagttggttttttgaaaaacctcttgaagtgacctcattttggtgtggatttaaaatgttgagagaaaaaaaaacacagcgaattgttagttcattaaa

SEQ ID NO: 78779 - DNA, 1746 bp, Heterodera glycines
  Genomic contig location: Contig_ID=SeqID_2263; Location=239..1984; Strand=-
  SCN-specific regions: Sequence locations=1-266,289-422,444-824,848 -856,886-1103,1126-1310,1332-1682,1705-1746
atgaatacgcttgctaatcgctgctctttttctaatttgtccttcttttctcgttcgtttcactttttggcgacggcaaaagatttgcaaaaggttttattacaatgtggagaaaatgtgttggcactgttctgaaaatgccaatttttagttcaatccgatgaaaatgccatccgactttaaaagtgccgttggacgtcgtcagctgtcagtccaaagcaattccatttcacgagaggcatcaaatttgaaatcatttgacgaactttttactgaggtacatacacaattcaacttttttgaattattatgccccagggcataaaaaatattgatgttgtggtgaggcgggctcgaacctccgccaccccctcttcccactttcttgcaaaacccactgagctacagctttctgaattttgtggccaaaattgaatgtttaagtagaattgagcgggaccgggacctgaacacggacaactgagtaccgaagtcccgattttgaccgggactagtcccggtgttttcccggtttttcaacccgaataggtccccggttccgggtttgcccaaaattcccggtcccgctcaactctatgtttaagtaaagtaaaagtcaccttattttcttaatttttaggcggatttgcagcgcgtacgcaaagcttacgaagagaaactcaaaaaattcgaggaactcaaaaaaaccgctgcggatttggaagcgctcgatcaaaaatttgtttgtctaaaaaagaaaaaaatttttggttttcagggtcgcagaacccatggctgacaatccatttcgaatcctgaaatcgaacaaaaattcaaaacccaaaaaacagtctcgaaattttttttttaaatttttcttttttacgaaaatggggctaccatcgacaatatcaccgggttttctagtaaaaataaattcgtgtaccttattttttcaattttttagttggaattgcaacgcaatcgcaaacttggcgaagaagaaatcaaaagattcgaggaactcaaaaaaatcgctgcggatttggaagcgctcgaccaaaaacttgttctttggaaatatgccagtggttccttggtattcaaatttttaaataaaattctcttttctatggtaatttgtggcgctgatcaacgagtattaccttaatttttcagaagaataccgaacccctgatccgaacttgaacaaaattcgaaactaaaaattacactgactttggcataggcttacgcttaggcccaagcttaggcttcacggttttgttgcgtattttgaatttttgacgaaaattaaatttcaaatttttgctataatccacttgtcatgggttcgtaatgggccgaaatggatgttgaaatcgggttctccgaccttgaaaatttggaggccaaaaatgaaaggatgtgtaaaaccatatgcctaattttcttaattttttaggcggatttgcagcgcgcacgcaaagctgacgagcagaaacaaaaagcaaaaagagtcgtacgaaacactgttattcttgtatgtggcttttgctttttttgttttttcgttgtttcctatgtttggtatcttataatcttcgacccattatccagtagaaaaaaagtatgtaaaacgtagcaaattgctagttcatctatcattttttgagcatggtatgttttatgttaatcattttcttccattgatgacggacggcaaatttaaatgatgacaataaa

SEQ ID NO: 78780 - DNA, 1160 bp, Heterodera glycines
  Genomic contig location: Contig_ID=SeqID_2263; Location=2380..3539; Strand=+
  SCN-specific regions: Sequence locations=1-53,75-115,206-364,396 -512,534-537,559-636,658-763,862-872,908-1010,1059-1160
atgcacaggattcgaacccaggacccctttttgtttaccttctcgttaccactgacaagggaacattccgagctgtaactcggaaaacatttatttttgcttattttcactaaagaaaaattatcatatatttttttagtctaaaaaatcattttttaaatgatttaattatattatatcttaattaaaatttatttatttttatgttggatttgaacccgagctccaaaaatgcgaatttaaccaactgaaaaccaattttagtgaaaacacagccaaaatttcgatttttgaggcctcataacttttttatttttgatctcacaccgctaatattaaaaattcacaacagcagaagtcgaccctgctctatccaatgataccaaatttatacctactttttaactaacagttcgcgaggttcccttgtaagccaatccttaggaaactgataaattttacaccgtttggatggtcatattagtattttttttgatgttgtcaattatctgtgctcctctatctttgtgtttgtaccttattttcttgtctcgattctcggaaaaaaaatatttctcgcaatgccctacttattttttgtaaattcttaaattttttttgatttaaaaagatattttcattacacacctacatatttacccatttaaaaaaatcaatcatatccacgtatttatattatatggccctattcgaatttctgtttttttgccaattcataaagacatttatcaataataaaagcatattttaatattatatttcatattataatttgtctattatatattaggattttatatgtaatattaaaaagaaaatttaaaaaaaattgaaatttatcccattttcgcaaaaataaattttaattacctaatttaaaaatatacaggtgaaattttataaaatattcattgaatgtctactttcattatacctttgcttctgtttataattattgaattcagcagttccgtctgctccgaaattggttaaaatattattaaaaaataaaataaataatttttttaaaaaatttagcattgagcgtggaagaattggacaatttttatgcaaaatttctcattttatgcgcagaagaaaataatgcagcaatcttaaatattaaaattagacaacaa

SEQ ID NO: 78781 - DNA, 1990 bp, Heterodera glycines
  Genomic contig location: Contig_ID=SeqID_2263; Location=3669..5658; Strand=+
  SCN-specific regions: Sequence locations=1-93,170-749,821-826,866 -885,919-974,1028-1035,1069-1265,1287-1289,1312-1326,1510-1516,1538 -1713,1735-1830,1852-1894,1917-1990
atggacaaattttcacacataaacaactgcaaaatgttgaaatttcgcggggaagtcatccagtttatgggtgggttttcatcttaaacatacattttattaaattttttataattaaaaattttattttttttgattgaaatttcaaaaattttcaaaaaaaaaatttcttttggtgtgggtcagaggtggggcgcggacagaaaagtcccgcagtcgcggatcgctctgcgcggattaaaattgccgcagtcgcagatcgatcttcgcggactcaaattgccgcggtcgcggatcgatcttcgaggaacataattgccccagtcgcggatttcgccaaagcggtcgcgaatcgcggattcaaattgcttcggtcgcggatcgcgccaaagaatcccgcggtcgcgaatcgcggccgcgtcccacccctgctgatatagttataaagtcaaatcttttttatgatattaattatctcccaaattaaagtggaaaatcaattgatggatgaagatgattctttgtacacgaagcggaacctattgtcaatggcaaattgtgccaaaattggcaaatttctggaagaaaatgaacctaacaaaagcaataaaaataatgccgtgccaccggaagtagcggagtatttgaatgaagtgaaagaggcacattacaaagtttttttcagccttttattttccgattcaatttggtaataattttgcttttttttaattttctgtatgtttacctttttttttatttaaaaaaaatatcatttttttacaaatttattattttattatttaaaatttaaattattgaaaaatggttttggttttttgaatttattatttcaagtggccagtgactttttttgaagttttcaaaaaatgattaaataaattttaaaaaataattgaactcgaaaatttttacagttcgacttatgctcgagtttttgaaaagcttcggtctatttattgaataatataaataaataaataatttttatattattaatttattacggatttgttattattaaaatttcattttcagtgatttttcacaatattttgactcgaaaagaatggaaaacgaaaaaaactttgcgtttagcatgcgaatgcttcggttggaaaacttggagtcaaatgaaaaaattgccaaaattaaaactaatattgaacaagcattttttgacactgaattaatgcgccaaattgaattaaaatttccgttttacatggcaataggtttgttgaatcaaataaatttaatgacctttttattaataattttgtgtttcaataaattttcttcatcttattaattattttacataaattcttaataataaatttagcttttaattttcgttgctattttaattttctgaaaattatttaatttattgttattttttatattaatattttgcgattctataagaattatgtaaaaattttaaaattttgaaattttttcattaatttttttgttaattatcccatcagatatcattaatgatcacagcttagctgagacatatgctaatattttgtcaagagacgaaacaacacggcataatgctgaacatttgttggccattcgaatttgttccgcacgaatttggcaaatttttcagcaaattcatttggcactcaagcagcagcataatggcaaaaaagccaaattaaaggatgccaaaacaaatgaaattttggcacaaattcaatcaaattggcgtcgcttttggaaaacacggcacgcaacttacaaatatatgccaaatgatttgtatgcacattgggttgcagtgcaagatcaatggcaagatttgacatttttggcgtgccaattagtccaacaattagcgaccgataaagataatgttgctaaatattttcaacacataaagcaattgttgccagagcggaatctgttttatcagttggctgaggagcatgccaaaaacataaccaggtga

SEQ ID NO: 78782 - DNA, 753 bp, Heterodera glycines
  Genomic contig location: Contig_ID=SeqID_14674; Location=429..1181; Strand=+
  SCN-specific regions: Sequence locations=1-199,226-386,410-591,625-753
  Gene Ontology: Mol. function=enoyl-CoA hydratase activity; Cellular component=mitochondrion; Biological process=mRNA catabolism
ttctgcttgcagcaccccgttccgagttgggcctgcccgagactcggctggccatcatccccggctgtggcggcacccagcggttgccccgggtggtcggcgttgcaaaagccaaggagctgattttgaccggacgcaaagttcggggggacgaagcggcacaaattggactggtgagtgagccatggcagcaattggcaaattattttaaattttttaataaatggggcctctgggtatcataaaattttttggatttttttttttgctctaatatcccttcatttgattaaatttttacattaaatttcattccccccgttaagctcaaccatttgacggacgacccttatgccaaagcgttggaaattgcgcgggatgtgctcaaaactgtaattaatttatttttgagcaattttccctcattttacatttttttttgtttccgcagggccctctcgcaaatcgggtggcaaaattggccgtggagcagggctttgacttggaattgcgcagtggtcttgtggtggagcaacagtgctatgcacaggttggccccacaaagcgcaaattattattttctctctgcccaattttaaaaaaaataaataaaatgttaaaaatggacgagaatgttttttaaaacaacaaaaaaataatgtgccaatttccatttagctgatgccgacaaaggaccgtttggaagcgttggaggcgttcgcgcaaaagcggccccccaaattcaaaggggaa

SEQ ID NO: 78783 - DNA, 629 bp, Heterodera glycines
  Genomic contig location: Contig_ID=SeqID_14674; Location=1475..2103; Strand=-
  SCN-specific regions: Sequence locations=1-231,255-578,602-629
atggtcgctgacggtgtgctgagcgagttggtgctgtgcgagtcgcgtccaacagtcgccgacgcggcggcgtcagcggagaacgctgggccaccagcaggcacaaccggcgacaatgagacgtcgccacaaccgcaccaccagcaacagtgccatcgaccgcagcgagtgtatgacgcgttgcggcaacggtcggccgaagttgcggactttttgatgcccactgacaatgaggcggaggagttgggggagggcggtctgttctacgcgtgtggcgacgtgaagaacatgagcagagagttgtgggcatgtctcagcgatattttgcagcgcgagaaaggcgagcgttatttggctgacttaaacagggacggcattgagcccatggttttggttgagacaaatcccgaatatccattcgttaaaaaaccccaaggtcgggcccactcaaaatccctgtggccgcaccccaattcggcccctaacccgacagggaaatcaggatagatttggtcgacttgatcagaccgaaaattattttttttccaggcttttcccctgtcgaagcgattcaattgttgaaaaaactgcgtgaaaaggagcgcctaattgaagatgtttggtcctaa

SEQ ID NO: 78784 - DNA, 504 bp, Heterodera glycines
  Genomic contig location: Contig_ID=SeqID_14675; Location=134..637; Strand=-
  SCN-specific regions: Sequence locations=1-120,156-365,394-504
atgtctagtaaaaaaaattcttatttcaaaaaaaaatttcattctttcttccttgatcccttcggtgtattttatctccgacggtatggggtgctctggattccaagtttccgaggatcggaatttgtggaaaactttattaattttctatgatttttaaaatctatttttacttaagaactatgaaacatttgaatgctcaacatgttctccagttctttttcgtattcacattacaaatttcattgaacactggcatcgaatccgctgcagatgaaccactgatcacttacaccgacgatgatggaaacaaattgcaaatgaaacttcctggtaattatttggtcaaggcataaaaaagtggcatttttttattataaacatttttttattggccctatcaaaaatttagaatgaatttgttagttgatttcgaagtggacatttaaatagtttctaatgactaaccacaagtaaactaaacacagaagaatgataaataaa

SEQ ID NO: 78785 - DNA, 312 bp, Heterodera glycines
  Genomic contig location: Contig_ID=SeqID_14677; Location=108..419; Strand=-
  SCN-specific regions: Sequence locations=1-112,134-237,259-312
atgtggtaccacaagcgcattggggcctccaaccccaatgcggaaccagcagtccagctgcctgtagcgggtccgcgcaacacagttgaagaaccaatatgtggtgccgccagacagggaagccagcacacccgcatgttgctgccacccggaggcttcaacgcggtgcccttcgccggtgcgcaggacacagttggagaccgcgagcggacccgctggcgtttgctgagctggtcggtgatcaaccgaaacgacgatcaggcacagcgggctaaaaactcaacacattacgaaatggcatttgtaaattaa

SEQ ID NO: 78786 - DNA, 316 bp, Heterodera glycines
  Genomic contig location: Contig_ID=SeqID_14678; Location=1015..1330; Strand=-
  SCN-specific regions: Sequence locations=1-316
atgacgaaacagcgcatggaggcagaaaagaagaaaagaaaagaaatgagagatttgaagcaaaaaattaagaagaagaaaaaatctttaactgatcaattaaagcagttaaagagagagattgcggatggtgactattcctttctcgaacacctaaaaattgttgcctatagagaatgtccaaacccggttcaatattgttctgaatcgccagtttattgcccaacatataattaccacgatctttaatttgaaattacaaaccgtgctgagaacaacaaaaaatatgcaaaatattatttgatttgctaataaa

SEQ ID NO: 78787 - DNA, 93 bp, Heterodera glycines
  Genomic contig location: Contig_ID=SeqID_14679; Location=1127..1219; Strand=+
  SCN-specific regions: Sequence locations=1-60,82-93
gacgaatgcaaggaattgtttgcccaggaagaggaaaaccgcaaacgattggatattatgatggtggtgaacccccattggtctcgtgtataa

SEQ ID NO: 78788 - DNA, 75 bp, Heterodera glycines; identical to SEQ ID NO: 69209
  Genomic contig location: Contig_ID=SeqID_14679; Location=644..718; Strand=+
  SCN-specific regions: Sequence locations=1-36,58-75

SEQ ID NO: 78789 - DNA, 187 bp, Heterodera glycines
  Genomic contig location: Contig_ID=SeqID_14680; Location=354..540; Strand=+
  SCN-specific regions: Sequence locations=1-29,52-187
atgttctctgtcatcaatctggtaaaaactagcaacaacgacaacaacaaagccaccgcaaccagtaacaacggaaatggaagtggaaatgctgcgcaacaaccgcagcactcacaaccattgcatggaggcgtggactatctgttgggcattggccaaagcgttcagcgtgcgttgatgaattttg

SEQ ID NO: 78790 - DNA, 2206 bp, Heterodera glycines
  Genomic contig location: Contig_ID=SeqID_14681; Location=616..2821; Strand=+
  SCN-specific regions: Sequence locations=1-71,98-570,592-827,849 -1686,1708-1735,1757-1846,1868-2206
atgtattttaagtccgcaaattcgtcgtcccccaacactccgtccgctccgttgccgcctcgtcctgcgttggaccagcagcagcagcaggcggctctgatggctgccattgcgatggcacaggacacggtgaagaagacgcttcccgtcgctctgtccggacttgaggcaacgtcggcggtgattggcgaatttttgtctggcttcgacccgtccactggacaggcggcaaaccgtgttggacaaacggtggtgagcaaagctcgacaaggcgtggaaaatgtacggcacatcttcaaatgaattgaattttacaaattaaaaaatgcatttcctgatatattttctgtcgctattcattcgcattttttaaattgtacaaccgacaagaattgaccatcaaattcttcccattttagctgaccgaaatgttgagtcccgaattcgcggccagcgttttgcagttgccaacgcccgtcgttgtgccgccgacaaaccacggacagaccaacggagaaccgaagcagcaaaccgatgagaagaaaactgcagacaaacgtatggactgacaaaaatttaatattaaaaaatgaacttttttcaaaattgtagactcacccaatgccaacccggacaacaacaccagcatcaactccgaagcagcatcggttgaccaaaatttgccgcatttgatgcatcgtatggaagaattgcagacgaaattgatgtcattgaacatgaacttggccaatcgcaatcgcgacgaaattgtaaatgatggcaaagaaaaggaggaaccgaagaaaggggacaaggcggaggacgaggccaacaaggaggaggaaattgttgtccttaacccatacctttatctgaccaacgaagcaatggaaaagacggagaaggagcacaaagaaaaggattccgctgaagccaattcggacacggtgaaccatttttgtgattaaatacagattgatacagtgcctagtactactaatttatacttttttaaagtttaactaatcgttatccgtataaatggaaacattttttatgaatttaaatatttttcgattcactttcagaccaatgccaattcgttggacaaagaaaagcagccaacggcacccatccaattgggcaacaagcgcaaattgggagacggagtgaacaaagacaacggcgaagaagaccttatgaagttgagcacgcacaactcggaggaaccagttgacaatggaaatggtaaaattcacttaaaaacaacattagctatatacctagtcttaattggttgcaaatcgttttccgtttcttcgcgttgcttgggagtcgatgatgaattgttccctttgccatccactcataattcaatagatattattttttagtatcatacgtctcttcgttctcgtcccgctcctccacgactactatgtcttccgttgaggacgaggaggacagtggcaccaacacgggtgacgacggttggatggtggtgaagaaggagtcgttcaagaagttgtgcgacttctacgagaagcgtcgtcgcgtggagtgcggcggtggcaccgtcgccgctgacccattcgcggaacaattggagcgcgaatttcgcgaggcaacgatggctgacaacaaccgcaccgatgaacgcgtggatgagaaattgacggcggagagtggtgagttgggggagggggataattttcgaagattttttaacttctaagttaggaaatttttaaaaattgggggattatgaaaagttcaatttggtctactaaaataactgaatttacggtttataataaatttattagtccaataattgagtctcttgtttaaaacttaaaagatattcacaattttagcctaatatgctcgaactttctacatgacaaagccatttagtgttttatttccctcaaatgcttcattttgattgctgtatttatttgtagaaccgaaaaaggcagacgaattcgtgaaggaagttggacaagaaccggctgccgaggtttatgtggcacaaattgtggatttgaccaccgaaaaagatggaaagtcagaaaaatcggagaaggtggtacataattcttcagtaaaagagggaaaaggaacattttttaagaccactccctgtgtccattcggttgtgatgcgcggcgtatgtgccggatgtggacaggattttcgtcag

SEQ ID NO: 78791 - DNA, 147 bp, Heterodera glycines
  Genomic contig location: Contig_ID=SeqID_14681; Location=364..510; Strand=+
  SCN-specific regions: Sequence locations=1-79,102-147
aaccaatggcaaaacgaacggtggcattgaaacgcaaccgaaaaagacgacggaaaaaacgtaaaggcatttggcaattttcaaaaggttttccaaattttcagttctgccttttgccctttcgttgtgaatcaggcgcctgttaag

SEQ ID NO: 78792 - DNA, 289 bp, Heterodera glycines
  Genomic contig location: Contig_ID=SeqID_14683; Location=234..522; Strand=+
  SCN-specific regions: Sequence locations=1-152,174-217,245-289
atgccttccctttttgcccagtgccgttttctgccacttatgcgaaaatgccaattgccttttccattcgtaaattttgtgccggtaagtgcccaattccatggcaatttctttctcaatttggaagcgattttcttttttgaaagcatttctaactttgtagctgttctttattttctcaaattcgttaacaattctcaacattttggcagttaactttttctataaaatttctttttacatttatggaatgtttctgagagattcgcccaattccttagcaatttaa

SEQ ID NO: 78793 - DNA, 244 bp, Heterodera glycines
  Genomic contig location: Contig_ID=SeqID_14683; Location=549..792; Strand=-
  SCN-specific regions: Sequence locations=1-111,144-244
atgtccattcgtgagcaaaataatacgagcaaagaagcaattgaccagcaggattatccatcaagttcaattgagcatcatcagtctaatgacctggtaattagttatacgaaaaaatatataaattaaaatatgaatttaaactaaacttatgcaggaaacaaaagttaaaatggaaaaggtgcgaattgttaatgtattcctggaaaggagaaaataaagcaaaaacagaaatgaaaataaa

SEQ ID NO: 78794 - DNA, 927 bp, Heterodera glycines
  Genomic contig location: Contig_ID=SeqID_14683; Location=963..1889; Strand=+
  SCN-specific regions: Sequence locations=1-861,894-927
atgtacaaattaacatactatttttgtctgatattttcatttgatcagttttttgatcatttttccgccgaagccaaaaaaacaaaaaattggcaattcaaatggacaatgctttatatgaaaagtgttttaaaagtgatttggacactgacagttccaaatgttcccttgtctcgaacttttgctttgccaccaaacccgacacactaccactctgccatgagaccacttgctagaaaaaggataattgcccactatatgctgcaaagacgatcacgtcaccactgcgaggggtactgtatcccggtgaaaaatccaataaattagccacaggcaagcggactcgaactttcggtctgtcactaaacccaacacactactttttgaaataagttgagcgaataaagcaaaaattacacggaccaagttaacaatcagactgcacggaaatattgaacatcttggcaacccatctgcaggatatgtgccgctgaattatcttttcgtcgcaggattctcatagagaagtcggtcgatgaatctgttgtccattacgaattctctctcgcaagaataaatagaatcctactgctgccgccttcctcgacatggaagcggaatatgagggcagtgattacaacgatgccgaaaacaactacatgctcggctacgatgaagagggagagaagccgcggtccgtcacgacatacgcctacgcaccagggatgggccaaattgaaaaataaaaagcgaaaagcgaaatttgcgaaactgaaaaatgcgaaatgaaaaaaaaagcgaaatgcgaaaagccaaaatatgcgaaaatgcgaaatgcgaaaagcgaaatttttctacaactttttaatagttaaaatcataaagcaaaaatcatttttttaaattttattccaaatttaaaaatca

SEQ ID NO: 78795 - DNA, 947 bp, Heterodera glycines
  Genomic contig location: Contig_ID=SeqID_14684; Location=98..1044; Strand=+
  SCN-specific regions: Sequence locations=1-400,422-637,682-947
atgatcacctcgatggcttttcttcctgtccaccatctccgtgctggcctcaatgttttgcagacacaactccctcaacaacttattggcgtcttcgattggtgagttttttggaatgttaaatcaatttttttttatcttaaaggttcatggacaattacaccggaaggccgtggttcaatggtggtttgacagtgccacggttcgcacaggaagaatggagtgtgcatcaacggacgttggatggaggagacagaaccaacaattacgcagaagcattccatagaaaacttcaacaggcatttgattgtacccatcctagtgtcttccacttcatcaacacaattcgatgtgagcaaaagtcaattgatgctgacatctcacgatgcgtcgctggtgaatccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgcttctcgaaattatgaaatgcgcccgtaatttttcaatgctttgttatttttttttgttgttaacacattgataaatattttttgataataaattaaacatttttagaaaaaaatcagaatataacccatgtggcacaaaaacagcttgccagactaaaacgaccccctgactaaaacgtcccctcagactaaaccggccagactaaaacggccagactaaaacggccagactaaactggccagactaaactgacccggtccgctacgcaaaatcatttcccagcaatccggggatttaactacactacggcaacatacgccaagtattttagaatgaaaacaaaaaatatttcatctcatcatttaaccacttaatttaa

SEQ ID NO: 78796 - DNA, 234 bp, Heterodera glycines
  Genomic contig location: Contig_ID=SeqID_14685; Location=431..664; Strand=-
  SCN-specific regions: Sequence locations=1-40,63-234
atgagcaaagtgaggtaattgatggggtcacggaatgccctaattaaaattttttttaaatagattttggtaaaaaaaattgttgtgatttcaattttttacccactttgtcttaactattacaaaaatgacagaaacattgaaaacgatcacgagcagagcgatgattacaacaattgcagcgcaattgagatcagtgccaaactcggattggcatctttgaatgtcaaatag

SEQ ID NO: 78797 - DNA, 189 bp, Heterodera glycines
  Genomic contig location: Contig_ID=SeqID_14685; Location=835..1023; Strand=+
  SCN-specific regions: Sequence locations=1-64,87-124,168-189
atgtttttcactggaattgacagactttatgtcgtaatttttgatgaaatgtaagaaaaaaatagcttatttaattttttgattaccatttttctaatgtaatgtcaattttaatgtggatccgaaattttataaaaatttacaaaatttttaaattaatattaaatgtttaggtatgccatctgctga

SEQ ID NO: 78798 - DNA, 420 bp, Heterodera glycines
  Genomic contig location: Contig_ID=SeqID_14685; Location=1123..1542; Strand=+
  SCN-specific regions: Sequence locations=1-420
atgttagaagggtcagggaaccccacattggtcccagtcatcgaacgacttgaaaagttagaaaagttagaaaagttggtggaacggctaattgcgggtgagaatcggtatgggaatcgatttgctgacccccagcatatctcatcctcaccatcggcacacacttccaacaacggccctcaactccaatggggtcaaccgccgcccttcgctgggaatggcgctgtttcgcgtatgataaccgacgcaatcatcaactccgagcagcttaaggagaaggcgaaccgggcagtcattgaaaaattgccggaggcaatcgacgaacgggcattggtggagcaaattgccgatgaatgcggggtcaaggacaaactgtcgtcggacattcatcgccacccaaggacgcggactgatggaggg

SEQ ID NO: 78799 - DNA, 587 bp, Heterodera glycines
  Genomic contig location: Contig_ID=SeqID_14688; Location=801..1387; Strand=-
  SCN-specific regions: Sequence locations=1-22,44-141,163-249,315 -547,569-587
caaaagtgccgaaagaggctgctgagaatgagtcggatgaaatcggcattttacggactcgtacctatgacttacacatcacttacgacaaatactatcaggtggtacgggatgaaggattgccttcatcacaccataaatgaaatggttggggcttcataaaggtcgggcgggagttggacagttcacacacatagataaaaagagaaatatctgtccggggctgtaaacggtgcacgggagaataggaaatttatataaaaaaatatcctaaattctcaataatttttttaattaaaaattagttaattttactgcctacctttatcacttccggactcaatttctttttttataaaatgatgcaagaatccataaaattggaaactttgatctttcggaaaaaactaaaaagtttaaaaacttcccctggcgctgtcatcatcggccgacccttggaccacctcccccgccccattatctcaactattctttaggttccacgcttttggttgattggctatgatgagaatggcacgcctttgacggtggaacagatgaaggaggacttctcacaggtcgaatga

SEQ ID NO: 78800 - DNA, 648 bp, Heterodera glycines
  Genomic contig location: Contig_ID=SeqID_14689; Location=256..903; Strand=-
  SCN-specific regions: Sequence locations=1-648
  Gene Ontology: Biological process=autophagy
atgaatgtcaatgacctggtaaatcagtttaaaagtgccgcacttagtgtgggtgaatatttgacgccggttttgcgcgagtccaaattccgtgagactggagtgcttactcctgaggaatttatcgcaggttaaacctccaaaaagctaaaagtaatcaatggatggtgaattcagctggcgatcactttgtccacctttgcccgacttggctttggtcaaaggccagtgattcaagcaggtttcgactgttcattttattcttttaaatctttttttaagagcgcgcgattatttaccaattgacaagcaatttctgatcagcaaaaaagtgccatgccatcatagatgttcagaaatgaactacaacgattcattggagaaggtggaaatttttattgaggggatgaaatcagcttttcgcataccccgaacaaaaacagtctaatgggaagttgaaaacaaacaccgagagagttcaaaaaacaagagggaagacagttagagattgatgagagatttttagcctcaattcgcactacatctatcttataaatttatcagatcatcaaggaggagggcgacgaatgggtggacacgcaccatttcgacacccaaaccaatttggcaccaaaagaattggacgat

SEQ ID NO: 78801 - DNA, 232 bp, Heterodera glycines
  Genomic contig location: Contig_ID=SeqID_14689; Location=1626..1857; Strand=+
  SCN-specific regions: Sequence locations=1-232
atgcggagtgtcaaaaccggaaaacgtcaattcgaaccgaggcgaaaccgcagcggatgggtcttggttttgcatcaagtgaagcatttctcagtgttcaattatcttaatcgatgttcagatgtgggtttgccaatcaaccgatccgggatacttgtttttgctgtgacacaatggtcactgagaaacaattgcacgaagttctcaaaaaaagcggcatttgggaatgcag

SEQ ID NO: 78802 - DNA, 643 bp, Heterodera glycines
  Genomic contig location: Contig_ID=SeqID_14690; Location=483..1125; Strand=-
  SCN-specific regions: Sequence locations=1-643
atgcttgttgctgctggtcagctgcggaaaaatggggcaggcattttttcactgtttctggcatttgcaggcaatgagtacggtgttgtgcgcgggtgcatgtccgacttttaccatggtcaaacaacgtcgacaaacactgacaagtcggtattctaccacttggcaacacgtagtccattcttaaaacaaacatccttaattggtcctaattaacgtgtcttaattattccacttaattgggtcattcatccatttgttcttttttctctttgcaggtgttactttggtgaatacccacacaatgtgaccatttatgacccaaccaatggtgccaagacgtacagtcagctgtacgtgggcgtgcgctactgctccaccgtgaatggcgcgtgcaacaacaaattcatgccaaagaaagaggcggccgaaggaagcggcgcttttgccgaaacattttgtcgtcagacccaacaaatgccaagttaactgtgaaaacaaaacaaaaaagcaaaaaactgtccaagtgcagcaacggcttgtctgagctgctggcgctacgactcggccggcgattgcaattcgaattggaaggagacgtgccaaggacagtggtgcacgaagactacgggatatgtgaacg

SEQ ID NO: 78803 - DNA, 793 bp, Heterodera glycines
  Genomic contig location: Contig_ID=SeqID_2265; Location=926..1718; Strand=-
  SCN-specific regions: Sequence locations=1-367,396-447,470-793
atgtcgcagcaaaagttggcctgtaatctgaaggattgtgccacatggagtcagtgggtaagttcacatttttggggccaggtactgccaatctacgcgctaattaggggcaattaactacctaattgattaattaaattgctcattaattggccagggggcatggagtgattgctcattgttgtgcggcaaaggaatgcgatcgaggagtcggtgagtggtgcattttctgatgggtcaattgatggggcgggcgtttcgtaaaagtgccaaatttacagaaaatttttttgagaaaaagtttcataacatatcttaaaacaaccaaactaatagcttttcgattgtgctctattagcatgaaaaatttcaaaaaattttatttgatttttcagaaagttaatgaccaaaattattcaaaaaattgccataactttctgaaaattcaatgaaattttctgaaacttttcatgctatagaacaatccaagagctatcgaatgacacaaagataatgtcgactttttcttgaaaaatctataaatttggcgctttttacgaaacgacccagcattctgccgcgcaagcgcatactgttgcatattatgattctttttcgtcttgctcacacgaaacgggccagttgcgtctgagccaagtttagagcatcataacttttttctttgttgaccaaatccaacaatgttggtatcattcgaaagctcttaacaagctctatcggctatccaaaaatcacaaagacgtaccgacatataaaaaagttataaattaaa

SEQ ID NO: 78804 - DNA, 627 bp, Heterodera glycines
  Genomic contig location: Contig_ID=SeqID_2266; Location=346..972; Strand=-
  SCN-specific regions: Sequence locations=1-288,310-365,399-463,492-627
gtcttcatggtccccatgtacggcatcgtgcggaagtgctggcgttcagttccgttctcgcgtgtgccccgcgggcggtcggtgcgatggcgggccgagcagcgagagtcagccgtgcaatcggatctgtcagtgagagggatggctcaaaatttgtccttattttctaggactgtccttatttgggagagaaatggccagattttcttacgaaaattcgattttttaaaaatattttcgatgaaaatttttattttgttgatcaagcgccacatatacaaaatttggatttcatcttaaccttggcaaggacatttcaaggacatagattgacacaaaaatgaatagaacccgtaggaatgagctaaaaattcataaattattatttttatttttttgtctttatttcagcatgtccagcacctttggctggtgatgctgtcaaatggtcggaatgggtcagtttttaaaataataaattttaatttttactccgacgcccatttcagtccccgtggacacggtgttccgtcagctgcggtcgtggcagccaagcgcgttaccgtcgatgcacaacaacaccctcaacactcacacagcacaccgtgtcctatacatgctcaccag

SEQ ID NO: 78805 - DNA, 5286 bp, Heterodera glycines
  Genomic contig location: Contig_ID=SeqID_2267; Location=1..5286; Strand=-
  SCN-specific regions: Sequence locations=1-22,68-250,272-424,447 -680,707-719,742-816,844-1125,1147-1372,1394-1484,1507-1535,1568 -1698,1721-2203,2225-2724,2748-3191,3221-3226,3260-3768,3791 -3817,3865-4597,4619-4634,4656-5286
  Gene Ontology: Cellular component=extracellular space
tttcattttaatcccctcaaaatgtttaatcatttttgtatatatttatttatttatgttattttttggccttttctttttacatattgcttaaaatgacacgctcaattgatcagctgaacaccaaagcactttttttcatgttttttgagtcattttggcgccaacccaagttttttaactttaactttttttcattgtcaaccagatcaaaaatcttggtattattcgatctcttaaaaggctctattagccttacaattagaaaaatcacaaaagtgttttctagcttataaaaaagaggtttcgaaaaaatttcaataattttgacttttttgcaatttttgtgttataacttttttgggaattgtcgaatctccaagcaatagcatacaaacagcttctaaacatgcactaagctttcggttgatacataccaagattgttggatttggttgataaaagaaaaaaaaagttacaacccaaaaacccgggctggcgccaaaaaacgatggtccaaaacgagccccactcatttcggtgcactattcacaacaattgtcaaatttaattatttttttggataaactaattaactaattatgtaccacttttcctaattaattacgtttacaaaccattttttaactccctgctgcccaacctttagttacgaattgattaaaaattttaattaaattttaaaggaaatttaattttgtccacataagtgacctttgtttgtcttttcaaagtgatctttgctctttgatcttttgatgatctttgatctttaatctatgattgttcgtctccctttgatctttagcctttctctcttttttattgtatccgtttgaccttgaatttttttttctcgcaattttccgctctttccctcataattacctgtattttcttgttgtaattttcccactttttttttttgcctatctctcgctccgtttcaaagtgtggcgctcgtcaaattttaaaatttgcactattttttttgccttactttcccctccggcgatgtttttggctccgccctttcgcccctttcatttgcacaatttaattaaatgcgaaaatttgcacgcggcggaaattttgcgattaaaaattaaattcaatcttttttccaattgatccctgtccttttcagtcccaagttgacggccaatggtccgactggtcaccgttcgagtgccatcaatgcttctgctcggacatcagcggtgccattggagttgtgggtttttttgccggttaatccaaaattcttgagatttcagacatcatgaattacttggaacactaatgcccccgaattcccaactttgggcacattcccgagcccccaagaattctggcccagattccggggccacacccttgaaaaaatatgaaagtttccatgatctggggcattttggcatttttttgacttctaaaaggtacaccccttacggcatttccatcggatcagttcccctcccctccggccgaataaaaattttcaaatttggaagttttttaaaaaaacttttaaaatttttataaagaaaagttcctaagatttttttaaaaatttcgaagattaaaaacaaataattgggatacgatccccgccaaaattattaattgcttaggattttcaaatttatcacaataaaaatccttttatttcgggatgcatgcggatttttaaaataacttttttgtcctttggcacagacactttccgaacggaactgctccaatccggcaccacagaacggaggtgccgagtgcagtgggcctgcgcatcgtgccgccgtctgttcgcgcaaatgcccgcaggagcgccagtcggtcaaccaggtggaccaattagggtcaatgacgccactcgtgaaattgccgaaatactttttcggctatatcactgaatttaataatggatatttgaaatgccattgatgagacaggtcataaatgagtttagtcctttgggaaagcaagaaaatttatcaattaacggattaatttattcgtgataagtctcttcatccattagcacgattgggtcattttgtaaattggttaattagcgagtttattccattaacggtccgatcattagtggtcattagcctggctcatagcaaatggctcattagccaattgattcattagggaatgtgtgggttatttattaacaaatggctcataataaatatttgggccattagcgaattgacttattataaatgtttgggtcattagcgagttggctcattatgaaaagtgtgggtcattagcaaattggctaattactaatgataacaaacaacaactgtccagtacatttcggcaaaatgcacggagcaccaacgcgttcgccaggaccccgagctgaccggcaccggcagtcagctgacccgctttccccagagggcatgcaaagtgttttgtgacgtcaaaaatgaaggcggagcgccgcgcaactaccgcttttacggggacgacttgccggacgggggtgagagaggcctaagccttaggaatttcttgaaattttttttctaatcaataaactggttttcctacgcacttttcggttaggggttggaataaaactaaagggagtgcccaccaaaatttttttactaccccaaaaaaaaattattttttcattatttgagtaaacaaatttaattataagttttgaaaattcccaaaagttaattttttgggcctgggccaggttagaccctcaaatctcgaaacccgacatttttctcgcaaccaagttttttggtcgtctcgacccgaattccaatccaatattttttttcgactcgcggaagtccttttttggaacttttttttttgcacatttgttcattaattttcgtcattttgtttttcatttaaataatgactagggattctttttttaggcaaatgcctaaaatttttgcgcacttgatacgctcagataagcacaaaaaacgcgttttccgcttggtttggggtgtcgtctacaatgacttttataatgcctgtttttgcctatttcggggtttttgtgcctaaagtgcctatttaaggattttcgaaaaaatccttaacaaaaatgcaataaaaacgaaaaattcacccctaagaaaaggcccgaaaaaatttcagaaattacatcccctaagaattgaaaaaatatttttaaaaattgatcaccaaaatttatttatttttttttaataaaaattttgctctaaaaatgtatccttatttgaaaaaaagtttatgcaattgaagtttttatgtgttttgctacctatttgcctattttagtgcctatttgaggatttttgtgcctatttaatgcctattttgcgatttttttgtgcctttttaggtgcctatttcgcgattttttgtgcctaaaaaaagaatccttaataatgactatggattgtaattttacaaattgacagctccctgcggttggaatcgttactgtctgaacggcgagtgtacggtaagtgcctttgaaatacaattttttcattttcattttgtttttacacatttattctttattaacattttcatccattatttttggcactaaacatgccacttaaaccaataacattcaacgggactcacacttttttgttacaaaatcattgggtttggcttacggtatggtaccctatcgccggttactgtacttcgttttttaatttatcaattaatttgctcccctcccatgcttttgcccttctccctttaagttttcaataacaattttgctttaattaccatataatatatataaaataatatatgcatatattatatatatatatactgtatacagtaacgagtcgctaccatataccttttgcctttttcgtttccataacaaaaacattctctcatccatcagtagattgtccacaaatacttttggcgcgattgccttcggcaacaaacaataatgacgccgaccagcactgtcgccacacccgcaccattccggcgagttacaagtggtgaaaagtcgccaagcgacagcgaccggcgagttttgagcgacggcgagtcgtcgagcgacagcgaccgaaagattttgagcggcggtgagtctccgggaggcagcgatcggcgagttttgagcgacgacgagtcgccgagcgacagagaccgaaaaattttgagcggcggcgagtctccgggcggcagtgatcggcgagttttgagcgacggcgagtcgtcgagcgacagcgaccgaaagatttttagcggcggcgagtctccgggcggcagcgatcggcgagttttgagtgagtcgccgaacgacgccggcgactctggcattccctcgggcgtgctcgttggaccaaagcgttggcgtgaccttttggtgttggaggacagaaaatggcttcaacttgatctactcacaaacaattagctaacaccacacacttattacacttattcaacagaatacgggggacttttgttgcttgtgacggaaacactctattttttgtttttgtaataacattttttatttcttggcattttgcttataaactctgtgatctctgatctgttttaatcattagggaccgaatttatatggacaaaaaatacgaaaatatggacaaaaatttctgaaaattatctgaatttttgtaaaatctaaacccacaaaattttttgtcaagaggaaaaaaaaatcatttaatacatgaattatagaatttgttaactgagacttacgaaaaatattgaacaaagaaaaaagattgcaaaaattagtaaattttgcaaaaaattcattgttattttttccaaaatttttcatattaataggggtgtatttttcgtttttttttttgtgaaaatgccgaaacatcgatataaaatatggataaatcaagcaaaaaagatcttttccttgccgaaataagtgtacaaaaataatccatacaaatccggtccctattgatcactgatcaaagtcaattgtttttgtgaaggcgctcagctgtgatagttcgctgttgctaatcggtgaatacggtgagcattgtccggccaaggaagaacggtgcccgacaagtgccgtcgacgagccaaaaacggcggcacagttgaacatgccacggcatttcgccattgggcagtgggagcaatggtatagtgtatacatctaactgtatttctccgatcacttgggagctctgaagctaactgatcggttgatcaatgttttgatta

SEQ ID NO: 78806 - DNA, 644 bp, Heterodera glycines
  Genomic contig location: Contig_ID=SeqID_14691; Location=1394..2037; Strand=-
  SCN-specific regions: Sequence locations=1-79,101-220,243-644
atggcattccttaccaagatgttcatgttcattacagtactcgaagattctgttgaatcgaaggtaatgcaagaaactgtaagtggaattgaatatttaattgactattttatacaaagaatataactcttagtatgatgaaatcagaagaatatccctttcctacacccagttggtcaggcgaggctgctaattgaatttaggattctcagaaaaggcttaaaaatttcagaatttttaagcctccggttcaggaggacctttacgtataaatttattgccttaataatgaagtagcactagttgaaggcactttttggatgctctttgttgctctttgaatgatgcctttcatttcttgcgaccatttcgttttattggtgcccaatttattttttgcaaattccacaattctttcataattaacagatctgataaattgaaccgactcgtccacatacaaatagggcgggtcaagtgggtaattacccacaaaaacggggcgtaacaatccgtcatttattttaacatagattctttcctcctgcaattccaattggtgcccaatgcatgcgttctgaagctggacaatgaagagaacaagaatatggaaaagcataattagactaattaggggcaataaa

SEQ ID NO: 78807 - DNA, 416 bp, Heterodera glycines
  Genomic contig location: Contig_ID=SeqID_14693; Location=1..416; Strand=+
  SCN-specific regions: Sequence locations=1-223,245-416
cgcccgtcctgaggccgcgaagcggccgaatgttccccacaaaattaaaaaacgggcgcgaagcgcccgtcctgaggccgcgaagcggccgaatgttctcaataaaattaaaaacgggcgcaaagcgcccgtcctgaggccgcgaagcggccgaatgttccccacaaaattaaaaaacgggcgcgaagcgcccgtcctgaggccgcgaagcggccgaatgctctcaacaaaattaaaaatgggcgcgaagcgcccgtcctgaaaccgcgaagcggccgaatgtcccccaaaaaattaaaaaacgggcgcgaagcgcccgtcctgaggctgcgatgaattgctaaattacatcaatttctagcgacgcggcgaagccgcgtccctgagcgcgaagcgctttccccacagcaacagaa

SEQ ID NO: 78808 - DNA, 142 bp, Heterodera glycines
  Genomic contig location: Contig_ID=SeqID_14694; Location=1015..1156; Strand=+
  SCN-specific regions: Sequence locations=1-142
atggtcacccaaaacgaccatttgatggcaaatttgtccgaccaactcacaaatctgcaaaaggaattggacacactgaaaaaggacatgacggcgaacaacgacgcatttttcaattgtgccatggcactgatcatttttc

SEQ ID NO: 78809 - DNA, 228 bp, Heterodera glycines
  Genomic contig location: Contig_ID=SeqID_14694; Location=1..228; Strand=-
  SCN-specific regions: Sequence locations=1-189,211-228
gctttcaaatccacgcaattacttccgctgcgaaagatgccgtggaacaatcggcggacgaaggccaagagacggcggacaaaattgcgcggtcgcttttgcatgccacgcggcacagagagcgaacatttttttgcataaaatcgtaaattttaatgaggggacaaattgagaaaattaatgaaaataagtttttcatttagtcaatgctttgtcactgtgctttat

SEQ ID NO: 78810 - DNA, 588 bp, Heterodera glycines
  Genomic contig location: Contig_ID=SeqID_14695; Location=198..785; Strand=+
  SCN-specific regions: Sequence locations=1-588
ggttggatggcagccagcggatttgtagtcgacgacgctcaccaagtcacttacgtggactttgccggctccggaatggttcatgtgtgcggcggcactatctctttgatcgccgccgtactgatggggccacggatcggacgcttcccggagaggacagtcagcgtgccggtggggggaccgaggcggaagcagaaggagcccaaaagtgtggagatcaaaggccattcagtgccggtgactaacgaacattttaaagaggaagcaaattaaaatgcaaaaaattcgaatccgatcaatatcaaaatttttgtgccgaagtgtccagaatttatgcaaattaaattggcacagttcgcctctttggggggcttcattctgatgttcggctttttggcgtttaatggcggctccaccagtgaaatttcctcgccgggcattggccaaacagtggccaaagcgatggtcaacacaattctgtgcggagcattcgccgcactttcatatttgttcgtccatttcatccgaaagggcaaatggaccgttctgttgacgataaatgcatgtctaactggtattttaccctaa

SEQ ID NO: 78811 - DNA, 270 bp, Heterodera glycines
  Genomic contig location: Contig_ID=SeqID_14696; Location=41..310; Strand=+
  SCN-specific regions: Sequence locations=1-201,228-270
atgtatggaagccaagcattcactcttcgacaaaacccacaacactatgaacacccggagcattgggagagggcccgagagccgaacatttacaaaagagtgagagagtgggagaatgattactgtacaaatagggattactgtaaccacagttttacaacaccaaagcgaacagtgtgggaccaatggaaggacactgacaaatgaagaagaaaagacgcaaaaaatgagcaaaatatgcaacagtgaaaactaattcagtgcataata

SEQ ID NO: 78812 - DNA, 718 bp, Heterodera glycines
  Genomic contig location: Contig_ID=SeqID_14697; Location=415..1132; Strand=+
  SCN-specific regions: Sequence locations=1-148,177-251,273-426,493 -566,588-718
atgtactacaaggcacgcgtgttcggcgacgaggccagtgccgtggccattctccgctcgcaggacccaaaagccatcaaacggtttggcgcgcacatccgactgttcgacacggccaagtggagaaaagtgtccattttggtaggtcggcattttttaatttaaaaaattccaaactttgcggcaagggaaagggaaaaagattcaaattgatgggtttagtagagtttttgtccgatagatcggtaaaattttaaaatcatcaaaatttttagattttggaaccaaaataattcgtgtccacatgccctttctcctttgccatcctaaatttccatttcaaaatagccaaaatttaatcattttctaaattttgggtattatttttttctggtgcattaaggccccctttaaaatttgtcatgctattttattataaaaagtttacctatttttttgttatttaattttttaatttttttttgataatttcttaagtgaaattcttcaaattttccaaatcggtttgaaaatcaaagtttatctatgggttcattatactcacaatttttgtaaaatataataattgcaggagatgctaatcggcaattggaaaaaatacgagcagaacccaatgttgcgccagtttctgttcgaaactggggacgcgtggctggtcgaagcgagtccggacgacatttactggggctgcggagtg

SEQ ID NO: 78813 - DNA, 382 bp, Heterodera glycines
  Genomic contig location: Contig_ID=SeqID_14698; Location=218..599; Strand=+
  SCN-specific regions: Sequence locations=1-309,331-382
atggcgcggacgtggcgccaaaaatgtgttgggccggctgctgacccggatccgggacacgttcaaggagcgcgaccagttcaagcacgagtgggcagaggtgcagtcgaagttgcccgaattgtatggcatcagcagtggcggcggcggagggatgccgagacggacgatttgaatggacggagtgccaaaaagttttcgattgattatgccgtactcaaactttatttatggcagtagttcccctccccttcgtgtgtttatgttatatttttccccattcgtccaccattcccattttagtatggcgttttgtgcgtgtgtctgtgttggcattttgcccattcattttactcaaaaaaacccaaattctccttctcca

SEQ ID NO: 78814 - DNA, 625 bp, Heterodera glycines
  Genomic contig location: Contig_ID=SeqID_14698; Location=743..1367; Strand=+
  SCN-specific regions: Sequence locations=1-185,208-625
atggttgcaagagagaatatttctgaattcttcaatcagcggttgccacaaatgccggacgaagtgcggcattatttgacaggtaagagggcgggagcagctcgtttccccccccccccgcatcgtttccccccgagaaaatttttttttgcgctcttttcgaaaattactaaaatttctgcaataagcaaatttctaggtatttttggacgctgggcttgaatatggcatcattcatttttaccaataatcccatgacctgaatgtgaaaactcgatagaatgtgaattttgaagaatttaattttttgatcaaattcgggtctgtcgtttagaaatgggttaaaattatcatttcaagatcagcgaccctaaaaaaagctccttccaaagcactagtcttgccaaaagcgggacatttgcccagtttccgtcatttatatgttttgcagatctgctcaaggagaacgaggatgacatgggaacggagcaggacctgacggaaatggtcggagatcatattcaggttggacaattaaacgaatgttgatgaaaaatccaaattaaaatcccattttccttgtacagcgtctggcatgaaatttgctgacttgagacacttttaa

SEQ ID NO: 78815 - DNA, 618 bp, Heterodera glycines
  Genomic contig location: Contig_ID=SeqID_14699; Location=869..1486; Strand=-
  SCN-specific regions: Sequence locations=1-27,50-56,78-107,146 -187,219-414,436-538,563-618
atgagccgtggaaagaagatgcaacatgaagagacaagcaaagaagaaaatcaaagaaataaaattcataaaacaaaatgtagcactaatgcctaatgattttgcggaataaatttaaattctttaaaaaaattcttaaaaaaaacattcttcaactttttattacaggaatttcatttcttgtttcttttttttatgtattttatttaaaaatttaagttgaaaggaaaatttgagtgtcgaacattggcatttcactcatttttgtccattctgcttagttcaatccattttcttaacatgtctttggcatattagttaaatacgttcgtattggagactaattagcaaataacaaatttgttaattaggtttctctgtctgagactaattagtcaaccaaataaaagtatatttacatttcttttataataattgaagtttctaattacttttttacacgataaagaagaaattcgtcagaatgtcttcgccgattttttttcatgttcatttgcattaagttttatgttaatagtaaatttaattttttatttttttagcggcgcaaaataaattatatttcaccaatcgagactaattattcacccaaataaa

SEQ ID NO: 78816 - DNA, 230 bp, Heterodera glycines
  Genomic contig location: Contig_ID=SeqID_14699; Location=1960..2189; Strand=-
  SCN-specific regions: Sequence locations=1-77,100-230
gcatgtaatccgcccaaaagtgtgggaagaggcaacttggcactcaaacgatggtggtgggacggccgtagttgtaaggtacaacaagcaatcaaacaatttaatggatgagataagcaccggcttttcccattttctgatttttgagatttaagcaattcacctacaaagggcagggcggcaacacaaacaatttcccatcaaagaagcattgtgtccaagtgtgcaag

SEQ ID NO: 78817 - DNA, 502 bp, Heterodera glycines
  Genomic contig location: Contig_ID=SeqID_14700; Location=616..1117; Strand=-
  SCN-specific regions: Sequence locations=1-14,37-39,61-169,205 -239,264-502
atgactccacccacgattgaatcttttctcacaattaaaaattctccctctgcagctttatctgctgatcattgggtaggcaaaatgaaagagtgatttagcaaattgtgataattattttttgtaatgagccgattatgcacatttacccactgactgattggaaatgaataaattatttattatttttcaaaaaataaataaccaaaacaaatttacacatagtagatatagtgaagcaaaataaatgaattaaaaaagaaatatgtaatgcttggaaatgtgatatttcgatattcacatcattaattagttaattatcaattatcgcgtttttaaaccgattttcaggaaaaaatcggtcaaaagtcgcaattttcgcaatccatgatcacatcaaatgcacttctcgccattgctccttattttgtaatcggatattgatcagtccgccatacccaaaaatgtcttgaattgatataaacaattaatgataaataaa

SEQ ID NO: 78818 - DNA, 77 bp, Heterodera glycines
  Genomic contig location: Contig_ID=SeqID_14700; Location=1..77; Strand=-
  SCN-specific regions: Sequence locations=1-77
attcagtctcgaaaaagaaatgaagccatcattcaacttccagcttttcgcatccgtctttcttgtgctttgtgtgg

SEQ ID NO: 78819 - DNA, 603 bp, Heterodera glycines
  Genomic contig location: Contig_ID=SeqID_14701; Location=769..1371; Strand=-
  SCN-specific regions: Sequence locations=1-389,412-441,463-558,581-603
atgtgttgtggtgatgcactttttctgtgtgtttggggcttcgctaaccaaatgactaatgggagaagaaacggacaaatggaaaatgagagggacaaacggtcgacagacaatacgcaaaatcaatgcttctacagtatgtgaaaacacaataagcaatatctaaacaaaaagaagaagcataaaatggtatattttgcgataaattttaggggggggggaggtaaacttttaaaataatgcagaaaatgaaaaaacgaaacgaatgcttttggtggatttagcaacaaaatttgcacacgacggagaatttgaattgtaaaattaaagagagagagagctcaaaaagggcgatgaaagcacgaaattggtgggagagattgttgggaaaacagcagcggaagacaaaaatagcacgtcattttaggagggcagggaggagaaaagagaaagaggaaaaaactgaccgatcggtttgatttgatcaatcacttcagctgatcaatgaaaggcaacttcatgtgtcaattatcgcctctgttttttgattaatatccttttgtctgttttcacattcttattttagggattttcaccaataaa

SEQ ID NO: 78820 - DNA, 433 bp, Heterodera glycines
  misc_feature (170)..(170): n is a, c, g, or t
  misc_feature (279)..(279): n is a, c, g, or t
  misc_feature (291)..(291): n is a, c, g, or t
  misc_feature (414)..(414): n is a, c, g, or t
  Genomic contig location: Contig_ID=SeqID_14702; Location=69..501; Strand=-
  SCN-specific regions: Sequence locations=1-106,128-196,218-433
atgaaaaacgacagcagagaaaatgcggaagaaggacaacaatcggtgggccgaggagaaaactgcagacagcagcagaacaaagcgatggacggaacagatcaaatttcttttacaaataaatttttacggaatgaatgggcaaagggaaaagaaactaagacccccgngggtgaattgtgccagctagttcatatgttactttgattttggcaaaaatgcctttcccagtaacggcgtccaaatttttggtattcacatttattttcaattcttttnttggttttgggncgcgttttttgaatatttaattttaaatctaaattattcagtaatttcgtataaatcttttaattcccaaaaattccgtccacttatggccacattccgtggtgccccgccttggccatgccnttcgcaaatgtgcacataa

SEQ ID NO: 78821 - DNA, 1803 bp, Heterodera glycines
  Genomic contig location: Contig_ID=SeqID_14703; Location=725..2527; Strand=+
  SCN-specific regions: Sequence locations=1-233,255-256,294-871,894 -929,952-1489,1511-1595,1621-1678,1702-1703,1727-1803
  Gene Ontology: Mol. function=oxidoreductase activity; Cellular component=membrane; Biological process=lipid metabolism
atgactctgacggttggtgcccataggtctaacccccttgaaaattaaaagggaattcgttaaaataaaaatctccatcatttaaaaaaaaatttttttgtctaggcctgcatttgccacaccattcactatgccaagcgattgtacgagacacaatttgtgcatcggttcagcaacggcacaatgccattccaaaacttgttcaaggttggctgattgggtagaggagggcctcacaaatgcaaaaattttcatgaaaaattcaaaaaaaaaaattttttttttttttttttgtaaaccaaaatttctaaaattccagggtccaatttatatatttaactaaatcatagaactgcacgtactactggggcttctccgcgttcatcgcctattttgtcaaccatccgttgtacacgtcgcccagcttcacccaagtgatgattggccttgtcggcttcacaatcagtgaacttggtgagtttttgtttttgttttggctaccccctggaaaatttttttgcttttcacaagctccaccctcgggtttttttcaaattaaaaagcgataaatttgaagaaatcctggttccgaactctaatgcattaaattgtcaattttttttttaattcagaatttttttaacgatgttattagaaaaaaaaaccaataaaaatttgcaaattctcttcataaacattaaaaaaaatacatgttgtcctcaaaattaattgtaagaagaaacacaaaagtcaaaattctttttaatgctcaatttccactgaaatttgtgccagtagtaagtgtgaactgcttggcccagtggttagtgcatttgttttgttttgtgtgttgttgttgttgttggttcgattccttcttccccctttctcccgtttgaccgcactttggctctctcaactttgttgtggccaaattgtgaaattgtgcttcagtggcgggtaaatgaatttggaggactgagtgcagaactcgtttctctgggactaaggtcccgcgggtgcaccccaaaatcacgccgccgaaatcacgccgggacaaaatcacgccgctagaaatttaaaaaatgttttcaaaattttttcccttaaattttcctataaaaaaattttctaagaattttttcttgaaaaaattttagggttgaaaattttttaaaaaatttctagcggcatgatttcggcggtgggattctggcgccgtgattttgtcctgttcccggttccgctgatgcgttgaaatttgaactctttgacgtggtcattcggtctacatttttccattttttttttgtttttttctaaattttttttcgagttttcagccttttctacaggccgagaattcaaaatttgaagttgcctatacatttccaaaaaactttggcatacaaacatttttgaaaactcttttttttgtttttgcattttatttaaatattcctgaatttttgcccaattttaggcaatttgtccatccatcttctgctgcgtgaccttcgccccccgggctcccgtgagcgcaaaattccctaccccaactccaacccgttgacgctgatgtacaactttgtcagctgtcccaactacacttatgaggtgtgataggccaggccattgtgcgcttttgatttttaagattttcaaaaaaaaatcactcaaaaaattaattaaaaaaaatttcgttttaaaaaatctctatttaaatccccttttcatttcaggtgtattcctgggttttcttctgcgtcatgactcaatcgcttcccggttaatcaatgcgca

SEQ ID NO: 78822 - DNA, 1104 bp, Heterodera glycines
  Genomic contig location: Contig_ID=SeqID_14703; Location=2712..3815; Strand=-
  SCN-specific regions: Sequence locations=1-155,179-296,319-394,426 -446,468-515,537-594,636-1035,1062-1104
atggccgcccgtgatcttcagtgtgttcaatgccaacaattcatgcataattggggcgtatgtgttgcctaaatcatcctagtaatttatttcgaaaaaatgataaataaatggggaaatacgtcactaaagtggtggtcgtacaaaaccggtcgaatttaaaagatttttaaacttttggaaagtttcgaaaaacaaaaaatctaatttaagttaactaattttgataaaccggttttgctggcaaaggtcaaacttattattagtgtgatatgcatttaacatggccaaggcataatatattttgataagtgaaatgaagtgcatattttttgttttttaaatggcaacaaacagcggcaattttgtggtggtgtgacaatgctaaactgatcaacaaaaataataataatttagagagaaggaaattggcgtggacaattaattaatttattgggtaattacggtgtagagaatggtagaaatgctgatggtgtcttactccgtcatttttgagaataatttatgaaaaaagcgggtttccggagcatttcaaggtcaacattgatcaaagtgatcacaaaaatgacattcaaaataattttttgaaaaaatacaaatttaattaattatatgcctctggaaaagtgttcaaatgagggaaaatcaccatcaacaagcagtagtagtcagtgtattgtaatatcgagaattaagaagtttttctatggcaaaaacgaaaaaaaaacattaaatttcgttggaccgatcattcggctgctgatcaaatcaattttcgaattagccgatcaccaaccattcaatcagagacaacacaacgccaaagaaccccacatcaaatctgatcatcattatcatatccctatcataatcttccattcatcagcagaggaacggaatgattggcattcgcttgcgcgggtaagcggcaaagtcctttttgtacgcccggtgtttgccgtccgcccaaattttcatctgcgcaaagccggccaaagtgaagaaaacggctgcaaaaaaaaaaaaaaaaattaaatttagattagtgagcggaaaatttaattgatttatggcaacaataaa

SEQ ID NO: 78823 - DNA, 468 bp, Heterodera glycines
  Genomic contig location: Contig_ID=SeqID_14706; Location=585..1052; Strand=-
  SCN-specific regions: Sequence locations=1-53,159-351,376-468
tccaaaatggcaaaaattacaatcatgaaattgaacgggtttaaatttaaattaacaaaaatgattaaaaagtaaaaaattaattaacgaaaaaattaaactaaaaattgccaaaaaagggcaaaaaaataaatatataaaaaataaaaataatagtattttttaaacttaaaaattattgcaagaaatttctcaaacgccctccggccggagaaaaagggaaaagtgccatttttggagtggtgccatttcttgtggtgggaaaaatgccaacaaaaaatggcacaaacactcactcattctaacgcctttaattgagggcttgagggtggtggaaaatggtgaaacaataggacaacaacaagaacaagaactagggacggagaagaagccccctgtatgggttggcacatttttaatttggcacaatttgtggcgaaatgacaaaaaacaaataaaaataaaaaa

SEQ ID NO: 78824 - DNA, 1146 bp, Heterodera glycines
  Genomic contig location: Contig_ID=SeqID_14708; Location=502..1647; Strand=+
  SCN-specific regions: Sequence locations=1-64,86-201,236-245,267 -340,362-386,419-579,608-700,731-759,781-1146
atgttgcacgaggccagcctgatgcactcggtgaagcatgagcatttgctgccggtcgccggcatttgtatgggcgccgccggggggctcaaaattgtgacacttttgcgtccgttgggctcgatgctcaaatttctgcaggaaaacgaaaaattgctgggttctaagcatctgatgctgtactgcttccaaatttcttccgtaaatatttctaatttttcttgaatttttccattttaatttataggccatggaatatttggccaacaaaaaggtggtccatcgcgacttggccgctcgaaatgtgctggtccgcaacgtaatgcacgtggaggtgggcaaaaaacaaattatggaatttataataaaaaacgaactatttaaggaatattataataataattaattaattaattttgcaatcgatgccctttaggtgaccgacttcggcttggctgccatgctgcaacagcccggcgattcggtggtggtggacggacgcgtggcggtcaaatggctggcgctggaaagtctaaggcgccaaatttacaatcagaagacggatgtgtggtaagcgcgtaaataattgttaattaattttaaaaatcaatgcatgacaataaaaaactaagaaattctcaaattttattattttgagcgcttttctcttcttacaatcgcatttttgacatttctttcgtttaattttttttttttacattttttaattgagctgacgaatttgggactaattttgtgattttttaaattaaatattttcaggtcctttggcgttacgtgctgggaaattttgacgtttggcgagtcgccctacaaggatttgctgctgagaagggagaaattggcttccgagttggcctatgagttggagcggggataccgtctccgacagccgaccaactgtagccaggaactgtaccaggagctgctcaactgtgagcattggaattgaagccgaaatttggggttatgccgttccaacacccgccaaaaaattccggaatgcggaattttaaattttgaaatttttccaaaaggaaaaaatcggttttcttcaaattttcatttcataaaattgccgagatgcgttttctcatatttggtattgtagtgaagatcaaaaaa

SEQ ID NO: 78825 - DNA, 471 bp, Heterodera glycines
  Genomic contig location: Contig_ID=SeqID_14709; Location=286..756; Strand=+
  SCN-specific regions: Sequence locations=1-471
atgacccacagtaatatctcaaaaaataatttctcagatggcgcttcttcctgcagaggtgatgatgacgaagtgcattatctgatgccaaaacggtcaaaaagtgccgacccaaggaccagtcgcagtagtgacgacggcacaacgcaaccacagcaacaccctactacggtagggtacaacactgtagttggaggaggaaaggaaacggtgggcgcacgcgtttcggaactgtacacaccggtggtggaaggtgccaaaattagtttttaaaaactcagctattttttgctgttttcagccgagcatttgccaaattacataaatggaatgccaaaaaatgtcattgaatatgcgaatgggacgctggtgccgcagccaatgccgaatggttaccaaaatacgccgaactcaatggcaccaacgatgaccaagattaatgcaaaatgtcaaagtgaatcagtcatgtga

SEQ ID NO: 78826 - DNA, 337 bp, Heterodera glycines
  Genomic contig location: Contig_ID=SeqID_230; Location=359..695; Strand=+
  SCN-specific regions: Sequence locations=1-211,242-337
atgccgtcgccgttgttcttgcccggggcatttccgggcgtgactcttcgccctacgggcatcaatttggtcgaagaggtgcggttttgttttctcattaaatcctgtgagcaaattttgtatttttcaagcgcactgaagatcacgcggtggatgccggcccggtgtatgcgccgactgtatcttccgccaggatcgatgtccacacagaacaggcagaagaagaagaagatgatgagttttaagatgttcggaggaatttacgatcttttatttttaattattcgatcttttatttttaatcattcgatcttttttaatcctgcgatcattttaa

SEQ ID NO: 78827 - DNA, 952 bp, Heterodera glycines
  Genomic contig location: Contig_ID=SeqID_230; Location=1834..2785; Strand=+
  SCN-specific regions: Sequence locations=1-86,122-161,186-236,258-952
atggcagatgcgatgcaggacggtgcgcgttggaagaaagcaaaaaccgcaatcaatgttctgggtaatctccttttggcggaatcgttggacaacaacaataacaacaaagtgacaaacagcccagcagcggaggaagacaatgtacaggaggaggaacataaagaagaagaaaagaatgaggacctcggagacattgacaagactctggacgagttcttcaacagtattaaagcttccacctcaaacttgtaaatcatttttgtccacaaaaatgcttaacacacaatcctttacaaataaagatgtttgtttcaaattaccgtttggcctgattatttctggtccctcctcatcagggaagactgagtttttattaaaattcattgcggaatcggaccaattaatcaccccaaagcccatctcaatgctctactgctttggtgaaatgaacgcggcggtaccggcgcttcaaaaggcgggagtcgatgtgtacgcaggagttccatccgaagaattggtcaagcgtctccctaagccactcttgctaattctcgatgacctaatgctgtctattgatgagaagtatttgtccgatttgttcaccaaaaagtcacaccatcaacaatttgcggtggtgttcgtcacacaaaatttgtttgaacggaagatcaaagtggcccgcctgtccgctcaatacctggtgctgatgagggccccgaattctttgttgtctatccgtaacattggtgttcaactcttcccccgtaagctcgactttttccttgatgcctatcgcaaagcgaccgcccgtccctatggctatttgttgattgatatgcatgccgcgtccgatccatcgctacggctgcgaaccaacatatttaaggacgagcaggaggatgaagacgaaggaacagttgtattcatccccaaaaatggagcggcataa

SEQ ID NO: 78828 - DNA, 1403 bp, Heterodera glycines
  misc_feature (1336)..(1336): n is a, c, g, or t
  Genomic contig location: Contig_ID=SeqID_230; Location=2873..4275; Strand=+
  SCN-specific regions: Sequence locations=1-626,703-705,728-1109,1130 -1228,1251-1403
  Gene Ontology: Mol. function=SH3-domain binding; Cellular component =lamellipodium; Biological process=mRNA processing
atgcaagaaactgataaagaaagcgaacacagaacaattgctttcacttgtggaaatttgtctaaacctagtcgcttcgcgtttccgactgaccacccgccagaaaaagagattgctaccccatgtggataccgtacgccaaatgagcagagcgagaagtgagcggggcgcccgacgtgtgcttgtccagaaaggcgcaggatttggaggactgtttgctgccgtattaacccccgttctaattgaattggcaaagtctgttatgaccaaaaatgcataaatacccacaactgctttgtttttatgtgcattcatcatcatcattcattcaataaaacatggcaaataagtttttacttgtcccacaagaaatttacaggggtttgacctcaatgtcggacacgggtgacattaatttggatgctgtacgacacgatttgaaccgaaccaggggcgaacgaacaaatccctctgctaaaaatgtcaactacaatcaacaacttaggcggtatttgaaaatgaggagggaactaacaaacatgccgacaaaagttgagatgtcaaaaggaataagtatactgttaaggagaggtggcgaagatgaagatggagaggttgtggatactccacctcgaccacccgctccaccaccaccaccacctccaccgtcaggtaaatgccctccacgtggaccaaatcctcccgctcctccaccacctccaccgcctgggagacgtcctccacgtccacccagccctcgttctccaccaggaagtccaccgcctcgtccacaacgtccccctagaccatgtagagctgctgcaccttctcggagaggtggtctcatagagcaatggcggaaaagacgatatgatatacaacaacggcggcccgtggtgcgggatcttttggcggaagcagctgctgctccattgcccgaaagtgacgatgaatatgactatatgctggagagtggattcgcgctgccagcaccatcacagtactatggagatttgcctgtactacccgacaacgcagacgaaattgaggagatggacactgttcagcgcaggattgccaccagacgaagattaaaaaaggacttggcagatgatgatgatgatgatgaagttgatttacagcgaaaaagaaataggatttatcacccttcacctccacggctcccatctccgccacggaaatctgagccaagacctcctctaacagccaagagagaacaccaaaaacaaacaaaggcagaattgaaatcctcgacatcaaagaaaaccggtcaccccacccctacgcctcgtccaaaaagagagccggagtttgngctggaccccgcacatccacatcaaggaaagctgggtacaacccgcctccctcaacacctaaaataa

SEQ ID NO: 78829 - DNA, 3607 bp, Heterodera glycines; identical to SEQ ID NO: 231
  Genomic contig location: Contig_ID=SeqID_231; Location=1..3607; Strand=+
  SCN-specific regions: Sequence locations=1-280,328-1396,1418 -1805,1827-2281,2307-2499,2522-2592,2614-2797,2819-3231,3253-3607
  Gene Ontology: Mol. function=actin binding; Cellular component=actin filament; Biological process=signal transduction

SEQ ID NO: 78830 - DNA, 861 bp, Heterodera glycines
  Genomic contig location: Contig_ID=SeqID_232; Location=3916..4776; Strand=-
  SCN-specific regions: Sequence locations=1-245,269-861
atgtgcaacaacgacaacaacaaacgtcgtttaccatccgaacttgtttgggaaattgtagctgctatcccaatcatgtacctgttcggaggagttgtgaaaaaaccaggttttttacacctttatttaatcaactaattaaattttgaaggagttacacgcccaccatctggcataccggttgtaaaccgtgggttcgaaatttttcgagcaaaccgacactgtttcttcgtaaaattggtttgtgatcacatttttaggactttaatattaatatttttagatcgaaattgctctggatttcgaattggcttgcgcaaaaaggaacctccctggtggagagctcttcatccagttcagcttcaaagatgaccaactgctggatcctcaatacttcaccgactttgtgcactacttgtgctttgggcgctcgggcacaattgcaacgacgagaatcatcacatatgcggcagtaagcgcggataatttaatcataaaaaattgttattgctatttaagtcagctcaaatcggtgagcttttcggcattctgctcgactatgcattgagcagcgtaaatccgctgaccatgaagaagcgaactgcgggaggttatctgtctcgtcagcattttccaccgatcctcaagctcactgccactgagatggcatcgcggggagttggactgttggtgcgcaccgacggaatggaaatgtatcgactgatgaacccgcaccactcaaatgatgttggtcaactgattgtcattgaaagatctcgacaccctggctcgttttatttcaatttttcagttgagtaattctcgtacaaatgttaacaatttattattttacgtaataaa

SEQ ID NO: 78831 - DNA, 2398 bp, Heterodera glycines
  Genomic contig location: Contig_ID=SeqID_232; Location=6089..8486; Strand=+
  SCN-specific regions: Sequence locations=1-159,189-633,655-1081,1103 -1872,1894-2188,2210-2398
atggccacgatggaagttttacgattatctacaaaaccgacatggacaacgggagaacttcaacatgatgcaattcagcttatgaatcaaattggtgcacctttgaatttgaacgcgtatgatgcagatacttatgtgccgcgcgttatcaactattggaacaacaacaacaacaacaatcaacagcatcgattctctgtcttcatcttcggtgcaacaggccactacaagcccatctacaaatatgtggacaacacctacaacacaccactgctcctttatttcaacaacagccattttgatggggtgcagaagcagggtggccttttcggaaagccttactgtttggagtgtgaacgaccatactcgagggcaccgcaacacaataaatcgtgcagggctcgctgtttgttatgctcacggacgggcccactatttccatgtcaagcacatgctggattctttatgcattgcgatgggtgcaacaaaaacttcaacaacaatgactgcttccggcaccatctccagtcaggtttctgcaagaggtccaaaaagtgtaaggactgtggtgttgtttgggacgtgaatgataacaacagaaatggaagaaaaggtcacgtgtgtggcgaacgctactgcaacctctgcaaaaacttccacaatcccgaacgtggctgcttcatccaaccgcttgagccaagggaaatggagccttatcggattgttgcgtttgatctcgaaacaatgcagcaccagcctgttagtcctcgtgagccagagaaaagggagcatcagccaaactttatcgcagcaaaagtgttctgccctgagtgcattgacaacagcagatggcggaacggaactgcgggttgcaaagtgtgcggtcctcaccgaacagttgccttttgtcagcgccgctttgtcaacactaccgtcgacaaacaagttgtcgctgacaaccctttggaggcctttgtcggctggctcatcaacgctctgcccaaaaaattcgacacatacgcgttctctcactttggaggacgcttcgacatggtcctcgtgttccgcgaactattcaaaattgggttcaatcctgaaatgatccgacaggtaacttaattgttatatttttttattgtgttattatttttagggcaataaaatgttcgagatgaaagtcaagaagcagaagaaccgcaaccccaacatcgtgttccacgactcgttcaacctaatgccctgcgcattggcgcagctggtaccttcctatgggctggaggtcgaggacaagcccttcttcccacatttggccaaccgcccggaaaactacggtcgacacatttacccaacagtggatgactacctcgcaaatggaatgatgccggagaagcgacgacaatttgacctgtggtacgagcagcatcagcatgagccatttcaactggatgaggcattggcttcctattgcaccaatgacgtggaaatcttatcggctgctctcatcgccttccgccgcgaattctttgaagtctcgaagcggaatgactacgtcgatggagttgatgaccgcgaaaaccacgacggcatcgacgcccttcggcaatgcatgaccattgcgggcgcctgcatgaaacacttccggctaaaccacctaccagcagaacaccttgccatagtccccgaaaagggctatgacaacgctcaaaaccaaagccggctggcacttcagttcctccactggtacgctgaggaaaacaacgtacaaatacagacagcctattcgcctcaaggagaaaaaagaattgccaattacacagtggatgggtggattgaagaggagcgcagggttattgaagtgaacggtaatttttatctatcataataataatttttatgagaaatttttacaggttgtgtctggcacggctgcaaaagatgctttccatcggacaacatgatgctaccaaatggaaaatctgcaggagaacaacggaggagggatgccaaccggctggaattcttgaggacgcaagtggcacgagtcgacatcttttgggaatgcgatattcagcaaatggtggagcggagcaaagcgataaggaagtcatttgcggactatgtggatgctggaccgctgatcatccgcgacgcgttcacgggaggtcggacgggtcctctgaagctcttccagaaggcaggcgaagggcagaagatttcctactacgatttcacgtctctgtacccgtttatcaagtgagaaaaacgtaaagatttttttttgatttttgaaattttcagtttcacgactcgttatccagtgggccacccgaaggtgcatgtgttgaatgaggatgttaattggaccaacccagcagacaacccttccctttggcactga

SEQ ID NO: 78832 - DNA, 996 bp, Heterodera glycines
  Genomic contig location: Contig_ID=SeqID_232; Location=8903..9898; Strand=+
  SCN-specific regions: Sequence locations=1-328,351-529,552-619,641-996
atggctgtcaacaaaggaaagcggtcgattgcaaagctgtgtctgaataatttatgtgggttttccttttcaagtgtcaataataattggattaatttcaggggggcgtttctcattgcgcaactttggactttcgcagacgctgataaccgacgatccggttttcttcagagagcacttggacaaccggtcaatcgatgtcactgccattgatgagctcgatgaggagcacatcctcctcagctacgaaaataagaaagagtgggttgaggagcacgactgctccaacataggtatggatcaataaattagcgcacaaataataattataaatgttcagtgatatccctgtggacgacctcggctgcacggctcctactcctaaaggcaatgcagaaggtggtgcgaacgcctgggtgcggactgctatacactggttagattattattattttgtggcaataaaaaaaaatttacatttttcagacactgattcactggtctttctccacccggaagacatttgcccgctcaaaactggcccacatttgggtcagttcaccgatgagtacccacaacatgaaattgtggagtactgtagtgggggtgcaaaacaggtaatgttttattttttacaaaggtaaattaaagcttttgttttagtatggtttgaaactgaggaggctgaacgcacctgcagatgcggagtttgaatatgtgctgaaggtgcgagggatgacgctgaactacgacgtcatcaacaaccaaggactgcgctacgattcaagcagcaggtgctgaacttcactgcgacgggtgactatgaaccaatcatcgtcacatatcccaacttcctgagaccaagcattaaagatggagggaaagtggtgtcgggaccccttcagaaatgttataggccatatgtaggaaaaggaattgttaactctaattttgatgttttgaattttggtcacacattgtaaaacttacttttga

SEQ ID NO: 78833 - DNA, 387 bp, Heterodera glycines
  Genomic contig location: Contig_ID=SeqID_233; Location=805..1191; Strand=+
  SCN-specific regions: Sequence locations=1-60,85-181,221-352,374-387
atggaagctaattcgggatccttgacggcttcattgcaagcagcagaagctgaaattggcgctctgaaggaaatggtcaagctgcagaatgagaaaatgaaggacatgcgccaccgttttgtgaacttccgctcccggctagatcagctggaggcgtgggctgctgacgtaaaatttaaacttttttatttttattttttttttatttttttatttttttaatcattaaaatgtgtttagaacaagcaaacgaaatttgtgcgccccgacacacgcaaacgcgtgttgttgaacgattcgccagagaaggaaatgccggcgacatcaaatgctgctgcttcaggcaactttttcttagttatcaatttgacattatttacattatga

SEQ ID NO: 78834 - DNA, 1990 bp, Heterodera glycines
  Genomic contig location: Contig_ID=SeqID_2269; Location=1474..3463; Strand=+
  SCN-specific regions: Sequence locations=1-171,193-562,584-889,911 -1058,1087-1266,1298-1357,1416-1453,1475-1557,1602-1728,1750 -1835,1857-1990
atgcttttgccatcgtttaaccgtgccggattcgttggcctccttttgctttgccaattggccttggctccgtttgccacggcatttccattggcgacggatgcgcagcgaatggccacagaagaaagtgccgtcgttaaaactcaacgaaggcatgaacaaagcaattaaaagggggccaattatcggcttcttttggtttagccatcgttcgccgggcctttggaagaatgtggcggtgggtgccgcgatcggagttggcggcgcgttgctttaccacgcgtacaaaaagagcaaaagcgggcagacggcggcggcaccgacggagggcaaataatttaaataaatcgcaaaaatccaatgaatggcactgattaatgatgaagccttattcagatgcaggcacagaaactgaacagcccgcaaatttgagaagaggctaaaggcgcagaagaagaaaaaaggggggggcaatttggcgaaaggaaaactcattaagaaataattaattaataatctacgacggcattcttttaactgtgagtgttttatcggtttttactttgcataaatacataatgtatcatttcaagtttaattgttgggaaaaagagacactgaacggtgccgggcattatcggctctttcccaacggcactcgttttttgccgagcaaataacttccaacttctcactcgttgacaatagtgctgcgcgagacagaaaatttcccggaacagagacttgacctcgagaccgagaccaaaaaaaacccgatacttttctcgagagcgagactctcgagcagcactcctgacatataattttgaaatttgcgcaaataaatgatattttaagtttctttgcctttttcattttcaattcttcccaaaattgggcaaacaaagcgaataatattaaaaaaagaatggacaaaaaataatttccggttgaagtggcacttttaatgtgagtgcccaacacaaagagagattatttatgtgctgttgccgtccgtccgttctttctcacggccttttttcgtgccgtcgtcgaatgccccggggagggggggggggggggcgcaatttgccaccgattttcccaaaatgctcacatttcagcagcaattggaactcatggggctgttcgagagcattgagtagaaaaatttcccaggctttttttggggtctcgagcctgattaaaatattaggctttgaaacagccttaaaatgttgtaaaacccagaagaattcactatactattttgttgtctctctctcttttctcctctaaccatttatcacagtctctccaatgtctgaccatttagtgagtgtctactatgtactatctcttctttcctttcttctctcctcctcatattctccttccttttttatcttttccttgcaactgtatatcattccaatggtcatacacacaaaacataaataggtaaatggtgtttgattttgtagttctcgaggtaaagtccgacctcgagactgaccgatgaaacggtgagtcattcgtctcattctcaaataaccctaattaaatcaaatacatttataaaaaaaattattaattttttagaacatcaattatcttgacaaattgactcccctccgaattctttgcaaattactccttttctccccaaaatatggactttaacctgaaaagattggccggggaggcgtccgggatgttcagccgagccaaacaagtgccaaaaatattgaaaaatgtccatttttgaaaattaaatttcagctaaccgaggaaaagctattgaacgcggagaagacggaacttggtaaaagtggaaatggaaaattaaaattgcaaaatggcattggcattttcagaccctcatttcgagcaattgctcgccaaggcggataaaacggaggaacagtcgaagaaactgttgtccgccatggaggcgtatctgcagccgaacccaggccagtgccaatga

SEQ ID NO: 78835 - DNA, 330 bp, Heterodera glycines
  Genomic contig location: Contig_ID=SeqID_2270; Location=547..876; Strand=+
  SCN-specific regions: Sequence locations=1-28,50-152,188-290,313-330
atgaaaaagcttcttctctgtgtgtttctgctgcttcagtttctgctcgccaccgatgcgatttcagtgcaaagcgaagttggccaaccattttttgaccaacagagcgaatttggcacagtgccattgagcgaaatggaaaagtgacaaagaaaaataaataaataaataaaaatttaaaaatttagacgtcgccgtaggcgcttttccaaactaaaagccgccgccttgggagcagctgccggattgggagccgccgtcattgccaaacacgcgggatgaagcggaacgacggaagggagtaaaagaaaggagccgaagatcaaaaaa

SEQ ID NO: 78836 - DNA, 99 bp, Heterodera glycines
  Genomic contig location: Contig_ID=SeqID_2271; Location=1573..1671; Strand=+
  SCN-specific regions: Sequence locations=1-99
atgcgaaggtcgatccagcgcaaaactgacaaggccgaattggtcaattatgagggcaaacaattgccatttgccaaggcgccgcctccgaatggaatt

SEQ ID NO: 78837 - DNA, 1381 bp, Heterodera glycines
  Genomic contig location: Contig_ID=SeqID_2272; Location=286..1666; Strand=+
  SCN-specific regions: Sequence locations=1-36,59-509,532-709,731-1381
atggctctcagccaacgtttgttggttcgcctgcgccgtctctgtggcccggccgttctctgcgcctgtgccaaccttcgcttcgtcaacgtcgatgatgaaaactttgccatgaaatctccggcggacgacgccgccggcgcttcgccgggccaagcgctgctcaaatggctctacacaccacgggaggacgggcagccgaaagtgttgacgatgaaggagaagccgaaaaagatgatggacgacatcgcaaaggcaaaaaagggtctcaaaaagcgaccaaatccattgggttttaatgccttttaggactgaattcatacatgaaaaaaagggggagggtgagggtcaacacgccaattttgcgaatgcgtccggccatgtatcgaagaagttttttttatccttttaaaaacgctttttacggcgccctattttccaaaaaaacttttggggaaaggggtctgtaggcgctgttggaatttttttttttgaaaagttgactgattttttaacaaattttatccaaaaaatgacccatttttgcgatttgaaacatttttcgcgcaaacatttccatggtaacacttatttccatgtccctcctttaaggaattctccactgccaccactcccgtcagtttcattgtccgctttcgcaaatcgtcctgggatgcctacgatgacgcggccctcaagccgtttgagctgtccaacgaattgacgggtgagcgactgacacttcgccatgtcatcgaccagcagagaaacgacctcggccttcctgctccgcctccaccacgcccttctaacaataagaagatgatcacctattcttctgttgtgtctcgccgttccaagttcgacatttggctgttggagcgcactccgagcgaaagggacgaaaagcaatggacgcattgggctaatgaggggccattcgacacgtgctattgggaggaggacaacgtggtttatgtgaactttgacgagcgacgccaactcgggtgggttcggattcggaaaaggaagggcacaaatgctgtgatggcatagtccgtcttgatctattggggccactggaattgggtcagacaaacagtttattgttttgtagttgagtcttggctatggtcccaaaggggggatattaccatggtgtgaccggggctggctgtcaaaacatttcgggcacccgaaaagcgtggaactgggtcgcctccgattaaacaaacgtcgattacacgctaattataatagacttttatacccgttttacgaaaaggtcttttgtcagttgagttatcttttccaggccattatggaagcatttgacaattcacttttgacgtttccaggccgagaatggtccgacgaatga

SEQ ID NO: 78838 - DNA, 217 bp, Heterodera glycines
  Genomic contig location: Contig_ID=SeqID_14710; Location=71..287; Strand=-
  SCN-specific regions: Sequence locations=1-217
atggcgctgggtgaactgcgaaagtacgttaatcatcttgaactgttcgccgacggtgggtgaatcgctgtttttatttagtattgcaattttttcagatcgtcagaaaattttcttcaaaatcgacattgacatttcttctgtgccagagtcaacgcctgaagctaggcccgcgttgcgaggatggttcgttttacctttgattttatggctctag

SEQ ID NO: 78839 - DNA, 1892 bp, Heterodera glycines
  misc_feature (42)..(42): n is a, c, g, or t
  Genomic contig location: Contig_ID=SeqID_14711; Location=715..2606; Strand=-
  SCN-specific regions: Sequence locations=1-130,157-325,347-442,471 -816,838-981,1004-1090,1113-1497,1520-1704,1730-1776,1800-1892
gacaaatatgaaaaagatatcgccaaattgggcctcgaattntgtacagcagcaaattcaacatgggaatggccgtcgacagaacactttggaaggcggtgcagaactgttcaaaagttgtcttggtttcatattttaaattaattaatttaataacattttgcagttgttttgctcctacgacgattacaattgggactggactttgctccaactcagtgtcaaatgtatggcttcgaaaatgcgcgtcatttacaccaaagcaccgaggtgacaaatgacaacgactgatttgaacaaaatgggctcattcctccattacccatcttccacttcctctgattcttctttccctgtttagagttctccatatcggcgattgtggcgttcacacccatcgatgcaaagccgaacgtgctgcaaatgatgctttgtttgttcctttatttttaatttgtatttttaaaaatggattggggatggattcagcgacggttcaactaattattcttttgaatttaataggcgtaacgagagaacaggaatttttgatgccgggccgttataaaaaaacaccataaaaaaacatcaaatgaaaattttcaacaaaaaactacccataaatttgctcaaactaactaaatttttaattttcgatatcattcgatagctctaaaattctctattagctggcaaaacttcaaaaaatttcgtcaaagtttgaacaaagttatggccaaaagtactcaagaaccaggttttcagatttttggtcattaattttttgaaattttttcaatccctgatagcttagatagcattaaaattaagaaaacatagtcttttagtttcttaagcattaattctgtttttgaataattgatgattttttcaaaaaaggcgcaaatgtccgaggtgaaaatctctgggcacgatcgaataatatcaagaattaaaattttaggtttaagcaaaattatgggtggtttttgttgaatattttgcgtttgatggttttttataacgacatagcaccgaatttttgacagaattgcatacattttcgaaattcgcttgccttaatcattgcttaatttcttttcttcaaatttgcatattttttttaaacctttttaggaaacttttcgaacgcgtaaattcctcctttttccccgcctcaatgcgcgtcttggaaattggcaagcgaatgttaaagccggcgaaaccgaacggagggtggggcgacccgcgggacattcgtttgtgtgaactgaacacgcacccaacggagtcgaacacggcgacggtgctcaaagaagcgcggcacgcactcccaacgaacgaattgtgagactggaatggccgcaatgggagcgaaggacgacaaaacggcaccagcggagggaattaccgtatttgctctaattatccctcatgggggattatttttcaacctcctcgtagactgggggataattggagactgggggattaagatagagggattatttttcaaacccatcctagactgggggataattggagattgggggattaatggagattgggggataattagagaaaatacggtatccctcaaaagtcggtctctagcagggctgttgcaagtttcgctttttttgggcctttcgctttcgctttttggctgaaaagcgaaataaaagtacacccctaaagattgggtttttaaaataataattaatataaacattaaaggagaaaatctatagaatttatcttttaagcttttttatgaaatgtctttaatttggaatttcttcaaactttctgggcgggttgctttctgcaaatcatgtaattataaaaaggattttcctccgcgatcaactggcattccgatttctttctgc

SEQ ID NO: 78840 - DNA, 1029 bp, Heterodera glycines
  Genomic contig location: Contig_ID=SeqID_14712; Location=2270..3298; Strand=-
  SCN-specific regions: Sequence locations=1-347,438-1029
atggcggtacttatcatttacattacgatgcacgggaaggcgcagtcgaaagaccccgcccctccaaaccccgatggaccaatggtacttctggtgattttttattgtaaaattatactattcaaaattcattcagcttttattgaatggcaaacaatcggcggctaatgaaaagggaaaagcgtcctctggcgaaagtaatccaaatccggggcagaatccgagcggagaacggtgaaagagggacgttttggggcacgccggcggatacgtcggaggatggggccatcccattgactcgtcactgtaagagcataaatttaataaaaatggcatattcaaaaatgaaaaatacattttaaattaaataattattattaattgagttattatttttaaaaagtttacaaattaaaatatttcttttgaatttaattgtcctttattttagtgattgggcaaagagtcagtggaatgatgccaattggctcgccgatgttgtcaacagaaacggatgggaaaacaccggcactccaaccggcggacgatgaatcagtgaattgtgccgaccaaagaacgaaagacggcatttttgtttgggaatttaattgacttttcggaatcaaacacactttcctttttagttgcctatttattgttcattttctacgcaaaacaaattttttacatattttttggttggggattatcccaatggtcccatttttcgcataaatatgaattgctaatccgtgggctttgcccaccatttctctcttcccataaatccccacaggcattttggtgacttgcactgataaaatccggaattggcttggcgttcttggccctgctcccccctcccccacggtccgattgtgccccaccctcgccgttgcccgtccatctgttgcccgttgctcacccggcactgtcgcccaaccaccggttggcccaccaatcagaattacccacccaccaccaatcacccggacactgtggaccgcccatcccatttggcccaataaa

SEQ ID NO: 78841 - DNA, 321 bp, Heterodera glycines
  Genomic contig location: Contig_ID=SeqID_14712; Location=762..1082; Strand=-
  SCN-specific regions: Sequence locations=1-321
atgtctcatcacactcaaatccaacaatacttttgccctccttcggcccctgctgtgacctattacaattacggcaacatcaccaacattgacctctcgccgcaacaagccgttccacagggctttcaacagcaagttcagctaactgcgccggcttatacggtggctcagtattggcacgacgtcccttcacaaaatggcggttatcaaatgccacaaaacaatggacaccacgcggctgcctattcgtcgggggatcacccgaaaatgggaaagcacaaaggcattgggaaacgttttcatccgcagaagcatcagcag

SEQ ID NO: 78842 - DNA, 357 bp, Heterodera glycines
  Genomic contig location: Contig_ID=SeqID_14715; Location=815..1171; Strand=+
  SCN-specific regions: Sequence locations=1-82,117-126,158-357
atgatgagtcattcttcgattcaaattccttctgctgtccctgccgatgtttctgttgtcgtcgaacaatgccaacaaaagaaggaaatggaagaagaaaaagtgaaacatttgttcaaattagcatttcaattttaaattaatttttcagtttttcgtgttcaaagaatggctccattggttgcattccgtcgccgcggacgaacggctcaaattggtggcacggcaacgaatcacaattcggcattttattgtacgggcattgaaaggcacaaaatttgccaaatttttcagtggttcacgcaaatgcgcgaagaattttgggaacgacgggcggcgattgtcgaccacttgctg

SEQ ID NO: 78843 - DNA, 1051 bp, Heterodera glycines
  misc_feature (931)..(931): n is a, c, g, or t
  Genomic contig location: Contig_ID=SeqID_14716; Location=420..1470; Strand=-
  SCN-specific regions: Sequence locations=1-133,155-223,245-538,560 -596,618-638,682-933,955-1005,1027-1051
atgccaacaaatcaagaggctgaattttatgtgcaagcagttaaactttttcgtcaaattgagcgggagcacatggccaatttcaaaatgagcacatatgattatgaacgactaaaacgcagtaatttaagacaatattttaatcattctttcaatgcattttgggttcacgttcccgataagtataaaatgttaaaatcatatgataattccgagatttttgatggttttgaaatgagaatcaccgtatctcgagcccgtagcgaaacgggatccccgcgcgaacggaattttaggtgctaaaaacgcaaaataggtacctaaatagttgctaaaaaactgccaaaatagttgttaaaaactgaaaaacgccaaaatagttgctaaaaagttgccaaaaattggaaaacatgccaataaatttgtgaattttgcaaaatttctcatctttatcctttttggttgcacaattgtaaatcaacacatttgaaaattttcaagcgtaaaaatttttcgatcgtccgccaaatcatggcaagaatttttgctttttgaaaaaccgattcttgggggagggtgcattttttcaaaaaaaggggtgtatttttgaaaaaattaacatcgcttcttagaggtgcattttatttattttttattgcatttttcataataattttttttgttgaaaagcagaaatagttgaaaaatagttttttttaaatttcacaagtcaaaatagttgttaaaaagtttcataagcgaaaatagttgaaaatagttgctaaaaagtcgctctaaatcgaaaattgatcgaagaaaatgtgttttttgcgcttatctcaccatatgctatccgcaaaaaaataggtgaaaacctaaaaatccgttccctgattattaaaatacaaaaaaattcggtgatggatatctntcattaaaatatttttaatataacacatttattatatgctttattatttcagttttatttgataattggacatcattcttcacaaatttctgtggtgtagcaaagtaggtttttaataaa

SEQ ID NO: 78844 - DNA, 150 bp, Heterodera glycines
  Genomic contig location: Contig_ID=SeqID_14716; Location=2729..2878; Strand=+
  SCN-specific regions: Sequence locations=1-1,45-150
gaatttttaaaaaattttaaaaatttttttgaatttttaaatttcccggttggtcccggttcccggtcccgaagaaaaatcgaggtcctggtcccggcttctcaggcccggcaagtcccggtcccggttttgcccaaaattcccggtccc

SEQ ID NO: 78845 - DNA, 188 bp, Heterodera glycines
  Genomic contig location: Contig_ID=SeqID_14716; Location=3247..3434; Strand=+
  SCN-specific regions: Sequence locations=1-150,174-188
atgaggggattgccgatctttgcagcggctaacaaagcccgctttgtagtgagttcggtttccgtacgggtcaatgatatcaaaataaaaacgctcaatttcaactattgggtcggtaacgacctaaaacaaaattttgttaatagttcgtttttataaataaaattattatagtgcagctcatgtag

SEQ ID NO: 78846 - DNA, 158 bp, Heterodera glycines
  misc_feature (141)..(141): n is a, c, g, or t
  Genomic contig location: Contig_ID=SeqID_14716; Location=4074..4231; Strand=+
  SCN-specific regions: Sequence locations=1-158
atggttcgaactccaccggaaaagcaacttcggcaccggcagctaacaaacttccgattgggcccgaatagcgaacaaacgttgctgcatgcttgcttatgtgcttcaacttttgcactacgtcccaagtcgcttgagtanatgttgagaattcggaa

SEQ ID NO: 78847 - DNA, 595 bp, Heterodera glycines
  Genomic contig location: Contig_ID=SeqID_14719; Location=291..885; Strand=+
  SCN-specific regions: Sequence locations=1-595
atgagcagaggtacaactgtgattaggagaggtacaacagtgatcaaaagaggtacaacagtaaatagaagaggtacaacagcgattagaagaggtgcaacagtgattagaagaggtgcaacagtgattagaagaggtaaaacagtgatttaagaggtgcaacagtgatcagaagatatacaacaatgatgagaagaggtacaacagagattagaagaggtacaaatttgatgaagaggtacaaatgtgatttaaagaggtacaaaagtgataaaagaggtacaaaagtgattagaagaggtacaaaagtgattataagaggtacaaaagtgatagaagaggtgtaacagtgattagaagaggtacaacagagaagagattagaagaggtacaacagagattagaagaggtacaaatttgatgaagagttacaaatgtgatttaaagaggtacaaaagtgatttaaataggtaaaaaagtgataacagaggtacaaaagtgatgagaagaggtacaaaagtgatgagaagaggtacaactgtgattagaagtggtacaacattgttaggagaggtacaatattgtttaaaattaa

SEQ ID NO: 78848 - DNA, 654 bp, Heterodera glycines
  misc_feature (614)..(614): n is a, c, g, or t
  Genomic contig location: Contig_ID=SeqID_14721; Location=1447..2100; Strand=-
  SCN-specific regions: Sequence locations=1-35,57-107,129-213,235 -241,263-341,368-430,535-555
ctctctctcaatgcttttctcgccgtctgtttttacctgtggctgctgtactctgcccgttttccattttgtcctcttgctcatacacactctctccattatttcaagcgtgtgaaattgatgatgaagcgaatgggctggggagggtaaagcccaaaagtgtaagccaatccgcgggaaattgagcctgtggattaagtgtaccacctacctacaataacaaagaaaaacaaatatctttttcaaaaagccaaataccaaagccattttgaattgaaaactggcatttctgttccgacaattccgtttcaaccaattcaacctttgacctgttgaaaagctaattaaaattatattttttaaatatgaagaagaagaagccaacaaattagaaaattcactttcttctcgttctatcatgtttcttttactctctctctctctcttccccctctctctctccctctctctttctcttcctcgttgtctctccctcactctagcttcctctctctctctctctcttcctctttcattaacctatatatccttctgctttttcttcctctctctgttcctctctctgtatcattctcttccattgccctctttcnctttgactcctcttcttctctctctctgttccctcctctc

SEQ ID NO: 78849 - DNA, 2119 bp, Heterodera glycines
  Genomic contig location: Contig_ID=SeqID_14722; Location=661..2779; Strand=+
  SCN-specific regions: Sequence locations=1-372,459-530,553-574,608 -777,799-1066,1125-1182,1211-1262,1371-1444,1510-1589,1725-1885,1907 -1937,1973-2119
  Gene Ontology: Mol. function=ATP binding; Cellular component =extracellular space; Biological process=cell surface receptor linked signal transduction
atggcaccgtttggttgggtaaaaatcaaagttcttttttctcataccattgcaccgcctcccccacacacaccgcaggaggaacgcgttgccgactgccgcaccaagcttggcgcgctcaaggaacgcattgcgatggcacgcgacaaggcgaaccgggtccgtctcggcgcgcactttgagcaacgcggcggcgttggcgcatttctcgagttgccgttgtcggccgcggacgaactgtccgtctacaacgacatccgcttcttcttccgcacgcgcgaaacaaacggtgcgttaattgttttttaattgttcattttggcgatcgacacattttttttaatgaacttgcggaacattcgtcctgcagagaatattaaaaatttaatttttgtttttttttactaattatttttcacaatttatattttttaagatttattaataaaattaattttgcattttaatattcttttgagattttctaataaaaataaaatgctgaacagtttataacccaaaaaaaaaaatccaaaggaatttcttaattaaaaatctaaaagatttttgacagaaaatatttttctaaataaaattaaatataaaacacgctctttttttgggaagcagctcgtttgtcgtttcccgccccctcctttaaaaaaatcgctagaaaaatcctaggggtttttttttggggaatttctaattttgatctttgcaacctactcacaaaaaaatatatgaaaattcaaaaacaaaatcttcccaactcttaaaggccaactgctgtttttgggtgcggacaatgcccatctgtccggcgaatacattggcgtcgagttggaaaatgagcgcccaaaactgacggttagccttggcgcgcgaagcgtcgatgcggcccagttgcaaacgcccgtcaacgacatgcagtggcgtgagctggtggtcaagcgtgtgggccgcgctgtcacgcttgcgctcagcaaaccgagcacggacgagcgcgcggaggaaaaggtgcgtgcaattcctgcttaagaatttttaaaatccgcacaaattcaataaattttgattaaatatgttaataattattgtcagaaattttttttattaattttggcaaaatataattcaattatacaattaactgagggtgcaaagccataaaatatagtcattgaaaattttttgatttcaagtcttaattaagtctttttttgggggatgcattacgttttcacccccgcatcgctccgtattttttttttaatttacaaaaaatattttaaaaattttgttataagaatatctcttaaaaaaatttgaaaattttttcactatttaaaaaaatatatatatttaatggacttatttgtttgtaatttatcatcaaatattgaaaaatttgttagaaaattttgtttgtttttttttcttgaaattttcttttattttcattattttttaaaaaggttttaaatttggaaaaaatttttaatttttcgctcttcttttggttctctcattttccattcgttgtacttcttttaaatttttaataaaggtcaatgaaatttttgttcaaaatattataaaatatactaatttattcataaaatttaaaaaaaaaacggttaaacttttaatttttcctgaaattttttaagaaaaattttaaatttttaaaaattttcaaatctttattttttttaaaatttcagtcatttactgttggtggacctccacccaaatcggtgctgaatttgtttgacgattcgcgccgtttgtttgtgggcggcacgccgcgcgacttccgcatgcccgccacgctgaagcagaaccaattcacgggcgacatggacaagctgcgcatcaacggcgagctggtcggcttctggaacagtgagagaacacaggtgtggtaactatgcaatttttgaatatttatttatacaaaatttattttgccatggtaattattagggatggaatttcatgtaaatttgagagttttttaaggaatttttcttgaataccccaaaattaaacatttttaattgctactgttcgaattagcttgacaaattcaattcaaattttttgttcagctaca

SEQ ID NO: 78850 - DNA, 379 bp, Heterodera glycines
  Genomic contig location: Contig_ID=SeqID_14723; Location=781..1159; Strand=+
  SCN-specific regions: Sequence locations=1-104,140-379
atgggcaaagaccgtgatcagctgatggtggagcttgttggtggtcgaatcagtttgtcatttgaccttggctcagggcttggcaaattgttgaggtaaggggctataaaaaaaattttttttgaaaatttattaataactttttccagcaatggccaacggtacaacgatggaaaatggcatcttgtgcagatggatcggcaagaacgttcggccaaactaaaaattgacgacacggataaagtgaggaagaaataattttttgcatattttttgtttattattggaattttaggtctcaaaattttcttggaattggaaagataattgtgttttctatgattaaaaatttaaactttttactcaaattacttgatca

SEQ ID NO: 78851 - DNA, 1640 bp, Heterodera glycines
  Genomic contig location: Contig_ID=SeqID_14725; Location=1287..2926; Strand=+
  SCN-specific regions: Sequence locations=1-53,76-195,292-654,677 -1005,1028-1112,1134-1143,1165-1640
atgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgacctagagaatgaatcaattgatgaagagcaagaaaacgatgatgaagaagccggagaagaagaagatgaagatgaaaaggaatatgatagtgatcaagaagacgaatcacaagaaatgcattcaagtgatcaaacacatcgtaatcgcataccatttgttcatcaacgatcaagaataaagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttattaataaaaattacccaataataataaaattgctgaaatcacgttacggtaaccccgaattaatcagagaaaatcttcacagtgaattacgtaacttgaaaaggcctagtgaatccacgattgaattaagaaaatttattttactaattgatcgaataattttgcaattaaaatccgaaggcgaagacataaatcatccccaaattaagcagtctatagaaacaaaacttccatataatctaagacttaaattgagagaaaaatttaaaatttattcaacaaagcagttaatggactttttaaatgctcacacacaagcgcgtgaagacatggaacgaatggaagacttaaatcgtcaaatccggaactttccttctaatcgaccaaactcaaacaggatacagagacaaccatatcaaaatttctctcaaaacaaaccaaaatttaaccaaagaaatcaatatcaaaccccaattacaccttttccatatacttctgcattaacaacaaaatcaaaaccattgcatccggcacagattaaaccaatacctacacaaaccaaaactcaatataaaatattttgtcgtttctgtgaaagagaaaaccatacaagtaaagaatgtaaaatatattcaaccccggagaaacgaaatgaacgagtacgtgaactcaaactttgtctcaattgtctaaataagggacatatggtcaatgaatgtaaatcgacctatttatgttataactgcaaacacaaacataatactctcctgtgcactcgtaaacaaactcagtacaaaacgaaggaacaaaaaaccagagtgaatatggctcaaaattacgaaaatcatgaagagactcagacattcatgacaatggagggtgataaaaatttaccaaattctgatgaagaagaattgcttatgactactgaagtaaactgcataaatcccgacaaatataaagtaaaaagggaaataattttgtttgataatgggtcacaaaaaagctatataaccgaagaatgtgctcagactctgcaattaaacacgattgaagaaaagttattagcaatttccacttttcaaccaaaataagccaaagatca

SEQ ID NO: 78852 - DNA, 447 bp, Heterodera glycines
  Genomic contig location: Contig_ID=SeqID_14725; Location=3025..3471; Strand=+
  SCN-specific regions: Sequence locations=1-156,178-447
atggttaataaagaaactgttgatgtacttggagtaaaaatcccaatcagtcatgcacgtcctcaaattttaattggaatcgactattactggcacttcatgctaccaaattcacaaattcaattacttccatcaggattttactcaataaatacaaaattaggaaaaatattatctggaaaaggaactattgaggacaccaattgtaactcagtgaccgaaaaaagaaaaaaagacgaaacgaaccaaatacttcagaaattttgggaattagaaaacattggaattatcgactcaccacatatgacggatgaagatgcagcaatgatacactttgataaaaatgttacatttaaaaataatagataccatgttcgatggccttataaaagagagaacccgaatttaccaacaaattttggattatgcatgggaagactaagaaat

SEQ ID NO: 78853 - DNA, 868 bp, Heterodera glycines
  Genomic contig location: Contig_ID=SeqID_14726; Location=92..959; Strand=-
  SCN-specific regions: Sequence locations=1-324,346-801,828-868
  Gene Ontology: Mol. function=metallopeptidase activity; Cellular component=extracellular matrix; Biological process=development
atgaatccgggacccttatccgatcaagaccgaccaattgaatttcgttttggtttcagttgtggtgatggtgttcagcgacgggagggcatgtgcgttcgtgagcctgatgggcaacgattggaagagaaggattgcgaaccaagggaacgaattgtggagaagcaatgccaaatggccgcttgtccccattggtcagttaattatggctaatccaatttcatttatcagggttttgttatccaacaaaagcttattcaccattgatcagtcaataagttttcgagtcgacctaattttgtatcgcaaaatgaacgggcatctaaattttttgaacattttctaaggaaactcggcacgtggagtccatgttccgtcagttgtggccaggacggcttccaaacgcgccttgtccaatgcgtggattcggaaggacgaaaagtttcggaccaaaagtgtatgggcatcaaaaaacaacagcagacggagaagccacaaagctacaaagtgtgtagtccggggccatgcccatattggtaagaaatgaatggtttgtgctgaactgggcgaactcgttggattttttgaaggcgtgccgccaaatggggccattgttctgtgtcatgtggcaacggcgttcgcatgcgacatgtcgagtgtgttttgaagggccaaattgtggacgattcgctgtgcatgaaggcgatgaggccgaaaaccagctttcgatgtgtattgttggcatgcacagtttggcatggagttccacaggcggcggcgactgggcaaatcggagagcgacgggtggatttaaaaattaaattgaaagcgcaggagggggaggtggatggaatgtttgatcatccag

SEQ ID NO: 78854 - DNA, 1305 bp, Heterodera glycines
  misc_feature (548)..(548): n is a, c, g, or t
  Genomic contig location: Contig_ID=SeqID_14727; Location=348..1652; Strand=-
  SCN-specific regions: Sequence locations=1-269,312-623,646-1305
  Gene Ontology: Mol. function=metallopeptidase activity; Cellular component=extracellular space; Biological process=development
cccaaggtgccgctggcattgacatcacacagacggcacacaatggattaaaagaagatgacaattatttggcattgcgcacaaccaccggagagtatttgttgaacggacaattccaagtgtcggtgtttcgtcaacaaatcccaatattggacactgtgcttgaggtgggtggacaaaataaaactcataaaataacatttagcgaaaatctatttgctaaattgcttttttaaactaaacacaaattatttatttttttcacttggaaaatattaaattaatttttttaaatatctattaaattaattgtctcattataaaattaaatgcatttaaaaattttgggttacggattgcagtgattacggcctttgtttgcttacctttacattagtttgttgctcaaggattagctaaatcgtcagcaacaacagcagtcccagtgttcgctccttttcagtattccggaagtgatctgcccattgaacgcatcaatggcagtggaccgctgcgatcggacatttatttgcatgtgctcagtgtgngcaacataaataagccgaacattcgctaccatttcatgacaccaattgcaagcagtacaaaatctgaagcagcagcaacacaacaaattcaaacgaaacagagcaacacaacgcagggagcaacagcttttattggcaggcggaaaacaattggacagaatgctcaatgaagtgccaaggaacgcaggtggagcctttagtgtaccggttcccgacccagggaatttcccggatctttgctcatggtcgcagtcccggttgccaacttgggaaattcccggatttttggtcatgatggtcgcagttccggttgccaacttgggaaattcccggatttttggtcatggtggtcgcagttccggttgccaacttggaaatttcccggatttgatcatggtcgcagttccgttaccaacgtggggaatcacccggtttttggtcatggtcgcacttccggtccccgtccagggaaatctcacttttttttttctgttttgcttcttttgattcgcttcccaactcagggaattcacggttttttttttttttgctaaccggtctcggtcctcgtccccgactcggtaaatctcccggtacacagaatcagcatgtccgttgtgtggaagcattctccaacaattttgttatggacgcccactgtgccgcggtcgtgcgtccgaacacacaaaagcgaatgtgcaatgtggactgtttttacaaatatttgcagagacttaacactgattcgtcgggaaaa

SEQ ID NO: 78855 - DNA, 761 bp, Heterodera glycines
  Genomic contig location: Contig_ID=SeqID_2274; Location=287..1047; Strand=-
  SCN-specific regions: Sequence locations=1-536,559-761
atttttgtgacagtaacggcatttgtcacctcttttcgccaccataccacgcacagtcaaacggagcagccgaaaagtttgttgatttcttcaaaagacagttgaagaaatgcagtggggataaaaattggttgaagcaatcacttttgtcttatcgctccatcccaattgcagtcttaaacaatcggtcaccagcagaattgttcctcggccgaccactccggaccaaactttctcttatgaaaccggaacggccgagtccattcttccgaggcccgtatcagcaacgcatggcacaacagtttgataagaagcatggagcaaaaagggtagagtttaacatcggcgacaaggtgcaatttgtgaattaccgtgatggaaaaacattgtggttatttggggaggttgtcaccaaaaaagggttaatttttggcattcgttccccacaaatcgcaaacagaattgtcactcgccatgcaaatgccatgcgactcacacaagcattgggcactgatcaaacatggccaaattttgatgaagagcccaagaagaacagatcacccgttcgagcaccacaaattcagcaaaatgtcacaccaacaccaccagccgaaagaaaccatgatcaatttgaacagaacgaagaacaagaacggaaccaacagcaaacaccagtgcttcgacgatcagaaagagttccaaaacgtgtccgtttcctgagtccaagcatgacgggacaacggcacaatattcgccagtga

SEQ ID NO: 78856 - DNA, 1661 bp, Heterodera glycines
  Genomic contig location: Contig_ID=SeqID_2275; Location=680..2340; Strand=-
  SCN-specific regions: Sequence locations=1-890,913-1041,1063 -1298,1320-1661
atgaaggactgggactcattttcgcaattcaaaaatttcaccaatacatttttggtcgaaaattcattttacgcactgatcaccgtccattgttggggatttttgggtccaaaaacggaatcccgattttttcagcgtctcgtctacagagatgggcactgattctactgaattatgacttcagcttggaattcgttcgcaccgacaacactggacaggcggatgcactgagtcgtttgatcagtgaacagcgcaattccgcagcaagcgaagacatggtcattgctcaggtgacagtagacgaaattcaaacagcacaataggacgacgaattgataaaggaagtgatcaaatttactcaaaacaaatggccaaaccatggcattaatcccgaaatcaaaccatttttctcgggaaggcacaaactatcaattgtttcaggatgtttggtgtttaatggtcgatcggttatacccccatcactcaggcaccgcgttttgaaggcacttcacttggcacatccaggaatcgttcgcatgaaaaatctcgcgcgaactcttgtgtactggccttcgatcgattccgacatcgaagaaatcgtgcgaaaatgccgccaatgtcaagaagcagcaaaacaaccgcaaaaacaaccgctacaaccatggccaacaacaacacaagttttccaacgtgttcacattgacttggcaggaccttgtagtgatggaaacacgtatttggtaattgtagactcattttcgcggtggcccgaagtgtttatgcttcgccacacgtcatcacaacatgttattgaacaattacaatggctttttgaccgatttggcattccgaaaacgctagtttcggataatggtcctcaattcagttcatcccattttaaagatttttgtgacagtaacggcatttgtcaccttttttcgccaccataccacgcacagtcaaacggagcagccgaaaagtttgttgatttcttcaaaagacagttgaagaaatgcactggggataaaaattggttgaagcaatcacttttatcttatcgctccatcccaattgcagtcttaaacaatcggtcaccagcagaattgttcctcggccgaccactccggaccaaactttctcttatgaaaccggaacggccgagtccattcttccgaggcccgtatcagcaacgcatggcacaacagtttgataagaagcatggagcaaaaagggtagagtttaacatcggcgacaaggtgcaatttgtgaattaccgtgatggaaaaacattatggttatttggggaagttgtcaccaaaaaagggttaatttttggcattcgttccccacaaatcgcaaacagaattgtcactcgccatgcaaacgccatgcgactcacacaagcattgggcactgatcaaacatggccaaattttgatgaagagcccaagaagaacaaatcacccgttcgagcaccacaaattcagcgaaatgtcacaccaacaccaccagccgaaagaaaccatgatcaatttgaacagaacgaagaagaacagaaccaacagcaaacaccagtgcttcggcgatcagaaagagttccaaaacgtgtccgtttcctgagtccaagcatgacgggacaacggcacaatattcgccagtga

SEQ ID NO: 78857 - DNA, 394 bp, Heterodera glycines
  Genomic contig location: Contig_ID=SeqID_2275; Location=1..394; Strand=+
  SCN-specific regions: Sequence locations=1-394
acttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatgg

SEQ ID NO: 78858 - DNA, 2832 bp, Heterodera glycines
  misc_feature (2797)..(2797): n is a, c, g, or t
  misc_feature (2800)..(2800): n is a, c, g, or t
  Genomic contig location: Contig_ID=SeqID_2276; Location=47..2878; Strand=-
  SCN-specific regions: Sequence locations=1-397,419-739,761-1306,1328 -1810,1832-1978,2000-2173,2195-2832
atgtcaatcacctcggaacaattaaaagccattttggctgaccaacaaaatcaatttgtcaaattgctacaaaacatgcaattaaacaccggccaaggacagcacaatcaagcacagtcctctgatatggacttgttttgtaaattgagtggccaaatttcggaattcctttacagtccagacgacaaccacacgttcgaggaatggtacgagcgattcggtccttttgtcgaacaggagggaaagcacatgccggaccagagtaaagcgagactcattgtgagtaagttgggccctgacgagtaccgccgctacacggaagtcatacaaccaaaaacaccggatcaagtcggtttgaatgagacgttagcaaagttgcgacaaatttttcccgaaatcaaatcaatttttattaagcgcttcgaatgttttcagcttaagtgtggacaaaatcaagacgttctcgcatttggctcaacagtgaatgccatggccgaaagatcgaaactggacctgactaaagaccaaatcaaatccctcatttttgtcacaggtttgggagatcacaacatggagttgcgacatcggtgtatcaaattgttggacaacaacgcgacattcgaccaactcctgtccgagtgcaaggaagtcattgcccttcgccaaagttcggccgcactttccagcaaacaggatttcaattccaatgcaatccaaattcgtccacataaaattcaggattttccaaagaaaaggaagccgtcgcacacacgcacaccgtcgcgcacacgctcgtggtccagtcaaccaaacaacaactcaaacaccccgcatggtggaacgcgtcaatcaaggacatttccaagcagtccatgcacacgatgtggtggtcaacattggaattcggactgccggtatccgatttcggttaagtgtcacatttgtggtaagaccgggcacatttcaaccatttgccgggctcggaaacccaaatcaaataattttggcaaaaacaccaatgtagttgagtgtctgcacattacgccaactgaacggcaatgctcatggtcaacaccacgagtcgaacacgagccttacattgaacaggaagtgaaatttgggacaaagagcgtaaaaatggttgcggacaccgggtcaaagttgacaattttgacaaaggtaacatggcataagctgggaaagccgaagttattcaaaacaaatttgtgtggtcgatcatatacgggcgacattttccaatttataggcaaaggccaagcttatgttgctttaagcggtggatgccaactatttttggacttttatgtgacggacaaaggctccctggatttgctcggagttggttggatccgtgcattcgagcgagagtacaaccgccccgttgcaacaacactgccattcgaccatacaacgaacaacattcaacacatcaacaactgtgagctcacgtcagaacagctcaaagacaaattgcaagcacaatttcccagtgtgttcgccaatggtttggggttgtgtaccaaagttcaggcacaactcaaactcaagggaagttcaactccggttttctgtggggcacgtccggtacccttgggtgttcaaaatgatgttgacaccgaattggacagattgatcgagttgggtgttctcaaaaaagttgactacagcagatgggccgcaccaattgtggcagtgcgcaaagcaaatgggaaagtgcgcatatgtttcgactttagcactggactcaacgcggcactcgaaccacatcatcacccgctcccacggcctgagaaactttttgccaaattaaacggcgcaaaaatattttcccaaattgattttaaggacgcttatttgcaaattagcgttgatgaacagtcgcgtcaactcttaggcgttaacactcacaagggactttatcaatgccaacgcctggcattcggaatcaaaagcgcaccaggcatttttcaatggacaatggaccaattggcagccggaattcctggtgttgttggctatatggacgacttcatcattgcttcaagcacagcgaacgagcatttttcaacaatttttaaattttttaagcgaattcaagaattcgggttccgaattcaaatggacaaatgcaaatttttagttaaggaaatcaaatttttgggtcaaattgtttcgtccgatggtatccgtcctgatcaaaacagaacacgagcactgcaggaaatgccagcaccgacggacatcacaacactccgatcattcctcggggcaatcaattactatggaaagtacatcaaaaacatccatcaaatcagagcaccactggatgaattgctcaaacagggagtggaatggcaatggaatgaaaagcaccgcgaagcttttgaacaagcgaaatcaattcttttgtccgatttagccttaacgcattacgacccaaatttgccaattattgtcacagctgacgccagcaacaaaggaatcggcgcaacaatttctcaccgttttccggacggaaaagaaaaagtttttcaacatgctgcccgaacattgtcaaagacggaacagaattattcgcaaattgagaaagaaggacttggactcattttcgcaattcaaaaatttcaccaatacatttttggtcgaaaattcattttacgcactgatcaccgtccactgctggggatttttgggtccaaaaacggaatcccgattttttcagcgtctcgtctacagagatgggcactgattctactgaattacgacttcagcttgnaanttcgtcgcaccgacaacactggacaggcggat

SEQ ID NO: 78859 - DNA, 595 bp, Heterodera glycines
  Genomic contig location: Contig_ID=SeqID_2276; Location=3577..4171; Strand=-
  SCN-specific regions: Sequence locations=1-183,205-346,368-595
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccat

SEQ ID NO: 78860 - DNA, 3297 bp, Heterodera glycines
  Genomic contig location: Contig_ID=SeqID_14731; Location=155..3451; Strand=+
  SCN-specific regions: Sequence locations=1-482,505-707,729-2516,2538 -2752,2774-3058,3080-3297
atgtgcaaatggggtttctgtgcagtgggctgttgttatttagtatgggcatatggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcaggggttcctgatggatgcctaccgacaggcatgttccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcggctaaacagcaaaaattgatcgagaagaaggaccgcctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgcgccatcgccaagcggaaccaaagagttgaagaggaaactcgcacagaatccgctcgccagtagcctactcaatcgactgtttgttgggtctgggttcgtcggacaagtcaaacaaagcgggcgttttattccctcaaaatggacaagaaaataaacaaaatatacaccgatccggccaatccgagcgggtatgcgggggcgagtgctctgtacgcggcggtgaaggagaagcacccgaagttgaagcgtgccgagtttgaggactttttgcaaaggaacaccacctacacgctgttcaagccaaagagagacaagttccgacgcctacgcactgtgcctacgggtttcatgaccggtaagttgtaccggggcttattgcgcacaattcagggttcagatgttcaggctgacttggcagatttccaagccctttcgcgcaagaacagcggctaccgttacttgctgttggcggtggatgttctatcgaggcgaatgttcggcgcgcccgtaaagagtaagcgcccggtggacatgaaaagggcgtttgaggagctatttgagcaaatgccaagggtgccggacacactgtacaccgatcgcgggctggagtttgtggcaaaaccgttgaaggagttttacgcggagaagggcattcaaaagtttgagaccagttcaaagaaaaaggccgccgtggcggagcgtgccatccgcaccctaaagactcggctgtacaaatatttttccgccaacaatacgtcggtgtgggtggatgtggtgccaaagtttttgagtgccatcaacaactcggtgtgccgcgcgaccggacttagacccaacgaaatcagcgacaccaatgcgagggaggtctggaagagggtgtacggcgaagggctcgcacaattggacaagacaccaaaaatcagagcaggggaaacggtcagaattcccgagcctaagcacattttcgagaagggtattgtaattcacacattttccggtcattttttaaatttttaaggaaatatcgctcatactgcgttcaacttcccccaatcgaggcgccgcgcagtaccgcgcgccatccttcatcccgaaccctctattaggcacgcaccccccacccctccccctcccaccacaccacccaataggcaccgaccccccagctgatcctctctcccttcattgggtcaaattcacttggaaaaaatgcggctttgaacaaaataacagcaatatgaattttcaaaaagagaaccaaagaattaggaccgacaatttaccgagagcaaaaattttcccaaaagtctccgcccctaaacgagcaaaggatgaccgaagcgaaagcaatttgtcgcagaaaccgatagagtcagccgatgtttcaacaatttttgtaggtctttttgcttcatttttggttgttgccaacgcgttttcgaatgtgaaggctaaaactcatagccgccgaatcagctctatggctagtagcagctcgaaattgccggcattatggaatccgttgaatgttgcatttgaaaaattgaggaaaagggaaaattccaaagaaaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagtcacgctatcaggcctgttcaaaatt

SEQ ID NO: 78861 - DNA, 597 bp, Heterodera glycines
  Genomic contig location: Contig_ID=SeqID_14732; Location=58..654; Strand=+
  SCN-specific regions: Sequence locations=1-95,127-333,355-597
atgtttgtcggctgttgtgccattctttggctttattgggaccgcttcagaaaaccacgaggccatcacaaaaagaaaatgtaaaaaaaaactacaaaatttttttttaatttcaatttaatttttcagtttcatctccggcgacggttggctttgtgtgttcgatttgcttgagccttctcaattgggccttggaattgcacttgtcagccaccgttttgacttttacgtcgacgaacacttcaagacgcggcgttgggcgctcaaagccatggaaattaaagccaaatttgaagcggacggcacaaaagaaatggaaattgtcaattgcgatggaaatccgttgccaattccacaaaaagcattgccaaagaaagtcgtcggaaaaattttcgttgttcgacaaaaagttcgatttagggttatggtgtacggaattagttgaaatttacgccagattcttaatcagcgatgttgaaaacccccggaactattttacatgaatttagacaaaaaaaatttatgtcgggtaaagtgcattagtagtacacgaaaatggggcaattgtgaagattattggtcccacaaaaaaaagga

SEQ ID NO: 78862 - DNA, 148 bp, Heterodera glycines
  Genomic contig location: Contig_ID=SeqID_14732; Location=179..326; Strand=-
  SCN-specific regions: Sequence locations=1-148
ctttgagcgcccaacgccgcgtcttgaagtgttcgtcgacgtaaaagtcaaaacggtggctgacaagtgcaattccaaggcccaattgagaaggctcaagcaaatcgaacacacaaagccaaccgtcgccggagatgaaactgaaaaa

SEQ ID NO: 78863 - DNA, 235 bp, Heterodera glycines
  Genomic contig location: Contig_ID=SeqID_14732; Location=3873..4107; Strand=-
  SCN-specific regions: Sequence locations=1-135,157-235
aatttttgcttgagttaatgagttgcctcaaaattccgcttgataaatcctgtcatttttgtttgcaaattaagaatattatgtggatttctttcgctgcaaggagctgatgggcgaagactacaaaccgtgcaaattcttccagaatgtctacaaagacatttgcccatcattttggaccgagaaatgggatgagctccgtgaggagggacgttttcctgcgaagttcgaccgt

SEQ ID NO: 78864 - DNA, 1204 bp, Heterodera glycines
  Genomic contig location: Contig_ID=SeqID_14732; Location=1547..2750; Strand=-
  SCN-specific regions: Sequence locations=1-755,777-1204
  Gene Ontology: Mol. function=co-chaperonin activity; Cellular component=microtubule; Biological process=beta-tubulin folding
gtttactttttctcaaaaacccgagaaacgcccaaaaaaggatgacagaaatgagaacaatgacacatttgagcacaatacgcaatcgaactcattcgttggggctgcaatttccgcgctccaattatcagctaaagacgtggacacgacctttcagggcatcgttgagcagacggtgttcagagggtcaggtactgcagtacaaatgggacggactgttttggctctgtttggggcatagtgccttttaaaccatgccccagaaaataaagtattttcagccgatggcaacccatttgcaattcgcgaatgcacggtaacaaatcgcattcatttttttttttatttattgttacgcttcggattctccttaagggctctgtgcttgtactgcttggccacgctgccaccatcacaattgacaagtgcagcaattgtgtgatcatttgcggcccgtgcagaggcaggtccgccgtggggggcattttggcatacaaagcggtcatatgattgttttatgacgaattcggctttagatgaaatgtttatatttttttcagcatttttatgcgcaactgtgccaattgccttcttctcgctgcttgccaccaatttcgtctgcaaaattcgcgcgacattgaggcgcacttacactgcagcacaaacccagttggtggcattacaattcttattttttatgaaaactgcttttccggtatttttctttaaaattaaaggcacttaatttggggctattccagagtttctttgccaaatcaatggctatttcattagaccacaattttttattgcttacaattagctttgttagtcaatgcctactcttggtatcacttgaaatttatagtcagcccataaatttctaaccctccattcattgacagacaattgaagactcggatttgattgtggccccgttgctgatgagatacgacggcttcaaaggcgtgttccatgacgacgttttttttttgtttgacttgaacgttgttcagaggacatggaatccgccagactggacaacgcgccgaatttgtgggacaaagtgcagaatttcaccgcggaaacgggccaattccaacggatgaatttcgacccctttgccaacggtgccattagcagcgaagtggtcagtgatgaactgctggagaagctgagcacgttcatggaggagcccgaggcg

SEQ ID NO: 78865 - DNA, 187 bp, Heterodera glycines
  Genomic contig location: Contig_ID=SeqID_14733; Location=52..238; Strand=-
  SCN-specific regions: Sequence locations=1-187
ttgttggtgacattggccgacctttacgatgactacgaacagtgcaaatcttctggccattttggggcagaggacggctcgccatctttggtgtgcgactcggagggacggttgacgccgcaggcgctggcccaactgaacggaattctgacggatatggggagagacgcggggtgccaatgtgcag

SEQ ID NO: 78866 - DNA, 1711 bp, Heterodera glycines
  Genomic contig location: Contig_ID=SeqID_14735; Location=1628..3338; Strand=+
  SCN-specific regions: Sequence locations=1-159,181-353,375-433,456 -552,574-1644,1667-1686,1708-1711
atgcaaaataatttaatatgcaaaacttattggttatcgttgctaaccgaccataagccacttcttgccattttcggaagcaaaaagggagtgcgccagtgcagtgccaaccgacttctccgatggtcgctgatcctcctcgcatacgattttagcattgagtacatcagcaccaatgattttggtcaagccgatgtgctttcaaggctgatcgcaaagggaaaaagcgacgaagaccgagtgattgcatctctccgatcagattcggaaattgacgacattttgatcggatcaattgaagcactgcccattaaatttaaggaaattgtcgcagctgctgaagccgacaaaaccattcaaaaagtcaagaaatttttgacgaatggttggccaaggaacgtcggagacgaaagtgccgaaataaagctttttcatttgatcaaagaacagctttgcatcacgagaaattgcctgatgtacgccgaccgagttgtcatccccgaaaaacttcgacagaaaactcttcattcattccacaagggacacccgggaatcaaaagaatgaagcagttggcgagaaattatgcctattggccaaatatggacgccgacatccaacagatggtagaaaactgccaaccgtgccaaatggaagcaaaggcaccagttaaaagtaatcttcaaccatggccaaaaccatcacttccatggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacacggcatcccggaaattttggtgtccgacaatggcgcccaatttacgagcaacgaatttgctaaatttatggccatcaacggtgtcaaccacctgttttcagcgccgtataatccaatgtccaacggccaggctgaacgtttcgtggacacgttcaaaagaacatttcgaaattgaaaggggagggagccccaagcaaagacggccgccaccagcacaaccgatcgaaagagacgtagaaatggcgagacgcttcaataagcgatttggaaccaaattaagggagttttcgatcggaaacaaggtctttgcccgccacagaatttcccaaaattggcaacagggcaagatttcaaagcgaactggtgtgatttacgacgtgacattcgccgatggtaagtcagggcgataccacgccaatcagcttcgtcctcgcaaaacatctgactctgacgaacagctctcggtgatgctcgaagtcttcgacatcccaagaccggttgctgttgaggagcaaagggaaatcccagtggaaatgccattggaggacccgcaaatttgggaggtcaaattgaccatggacagcaacgacggtaccctcagcgaaatcgccgtccgccgcagcgcttttcaccgtaacctcggaaccgcgcttaaggggggaggtgttcggggcactgccgccgaagtttgaatgacatgacataatgccaatcgatttctgttccatttcatgttccttccctcgcccataaatatgctcccattccattttagattgtattcccttcattcatttttcatttatatatttgttccccaaattgttgtgattttattttcttctcca

SEQ ID NO: 78867 - DNA, 1813 bp, Heterodera glycines
  Genomic contig location: Contig_ID=SeqID_14737; Location=84..1896; Strand=+
  SCN-specific regions: Sequence locations=1-146,171-191,236-287,318 -333,356-452,514-517,678-927,952-973,1033-1093,1186-1541,1563 -1570,1592-1813
atgattttccgcggcggcgattggccaaggggcattgattgtgccacaatctgtggccaaatgtttggcccatggggcatcaaatcagcagaagcggcggcagatgtttggctttgctttgctggtttaattggggagatcggtccatattttttaaaatttcaaattttatcgcgaaaaattttgccctcattaaaataaaaatttcttatttttgaataaatcaatttaattagcaaaaagaggagaaatatgtaatattatttaccattatttgctttgtgttgtataaaaaatctttttaattattaataaaaccaatttacttacgcacaaaaaatgtttctttctttttggtgttaccactttctatgaaggaaattgagcacataaactccccaaaactttgttattttatcgccaaaattgtgaaaaaattgcaattttaatcgattttaatttataaataattttttataaaaaatttaattatataattaatatttataaaaagaattttatttattcattttaataaataaataaataaatatttataaaagaaattttaattaattaattattgaattatttttaagaaatttatttatttattcaattaaatttaattaattttatttttgcagatttatttagagcaatttatttgttttttttaaatcttttttgtgtaaatgttcccaatttttggccaaattccgcgttttgctccctttccattttatttgcccatttatttctcttggccacccaaaaatgtgtgctctctgtgaaaatttatgggcttttggccatccaacggcgagctgacgacatttattttattatcatcgacaacacaacagaagttcaattgggtcaaataatattattctgctgcaaagggacgattcatttagtgcaaaaaattatttatttgccaaattttggcatttaattaccgaaaaagtggaaaattaaattagaaaataattttaaaatcacttttaaagaaaattcaaaattttaaatcgatgcttatattaatttcgattttataatgagcggttaaaaatagatacacaatatttaatgttttaatttcttattttatttttaaattttcctttttatttttattaatctatattttgtattttagttaatcatttttcatttccatttgtcctttcaaactttacaaattgcttcaatggatgaacacatcgccgccgctggtgccaaatcgtttgtgccacccgcgccggcgggcacaactcatcaaaagacttcagtgcagcacgagttggacagagttgaacgtgaaaaattttggaacgaagtgagttggaatgggccaattttgcgctgccaaagtgccaaatggccagcttttgggttggctatgtgcccgattaaggcgggtcccgaacagggatggacgtaactgattttcaattacggaaatccataattatggggtccaaaaacgccgtagtttttgttttaatgcctaaagaaccgtaattttttatctgtgtaaatttaaaaattaaacatttcgccaaaagatgcgcgacgaggaggaggcgaggcgacgcgaagatgctgtacgtcgacaaaagcagcaggaactgttcgccaaggagcaacgtgaactgaccgacaaactgcacaaggcgcacttggaacatcagcaggcgaaaagcgcagtgcaacaggtggccacgtcattggcattgccagggagaaattgacccacattggcatttaacaatatgccatgccatccatccccagcagcaggggggta

SEQ ID NO: 78868 - DNA, 624 bp, Heterodera glycines
  Genomic contig location: Contig_ID=SeqID_14741; Location=1..624; Strand=-
  SCN-specific regions: Sequence locations=1-624
gtcacaatcacaaggtctgcctcgtgaccctgcattgaatcagctgtggctgaagcagccatccgctccaagccattcgctctcagttcacacccaatttgtgctgcttggcctgagtaaagtgaaatgatccggactgaaccaggaaaacccctccagctccttaaaaggtcaatgacagtccgagtttgaccagaattggtcgcagaaaaactcgtttcttccgcttccattggcgaatcttggtgaatgagcacaattggagattcagcaattggcattttggcaaaactcgtcaacatcctaaagattcccggtcccgatcttagcctttcaccatggggtgtgtatgccgcatattcaacgcaattgacaatttctggatgtgaacggtagttcacttccaacgttgttttgtccacaccaggagatgagtctgtgttgagtaaaactgtgtcaaagccgaagccgactcggagttgttcagggatgtccttcatgctcacggccagccgataacgatcaccagtgatgaacagcttaagagcttcctgaaggggtgagaggaccgagcagaccgccagaagaggcgcttgacccgattcgtcaagcactatcatgttt

SEQ ID NO: 78869 - DNA, 1154 bp, Heterodera glycines
  Genomic contig location: Contig_ID=SeqID_2279; Location=1..1154; Strand=-
  SCN-specific regions: Sequence locations=1-14,49-76,98-416,438-1154
  Gene Ontology: Mol. function=sodium:phosphate symporter activity; Cellular component=integral to plasma membrane; Biological process =hermaphrodite genital morphogenesis
ttgttggggccaccattgggtttgtttttatttttaattattgaatttgcccgtaattacaccgactcacacattaatttgttttcagttattcaatgcttctccatggtacagaaggcatccgatgggtcaaagtgactaaaatttgtgagtaattttttaatttttcggaatgaattgccaaattcgaatgatggattaattttctctttttcagttgcttcttggttcgtctcccccattctgtccggctgtgtttccattctcatttttctcttcattgaccattccgtcctccgaagggttcgtttgtcccgtcttttgccccataactttcgattttcgactgtttttcctcccaaattatttctttcgattgtttcttttaggataggcccctccattgtggccttctgttgctccctttcctttactttgtctgtgtttctgtgaatatgttcgccatcacttaccaaggatcgcactgtaaaatagccaacttttgctttgcaattactcatttccgctctaatattaattgtcagatattggcttggacaaatggcctttgtgggctgtggtcgcacttagtgttgtgtccggattggttacgatggttgtgacccgatttttcgtggtcagcagattgaaacgatacattttgggtacggtatttttgttttttttttgtggattatcatttcatatttggatagagcacacaatagggccggaaacatgcgaaggacagcaacaaaatgggctgggaaaaagcttaaacggagtggtgactaacaaaagcgcaaaaagtttgacggagggcaaaatggcgctactcgaagaaggaaagacggaacagaatggagacgaaccatcgacaaaagtgaaaatggcggaaaatggaggcggaggaggggcagaggtggcccaaaacaaatttggtaccacaaaatcgaaattcattggacattgccatgtttcccgcaggttcctcttcaattcgcccggcttcatctgtgctcagtttcttccgttcctcaaaaccggaggatccgtacgcctcgaaactgttcacttttctgcaggtgctcacagcctgtttttccggatttgcacacggtggaaacgatgtcaggtaactaaagtctgaattg

SEQ ID NO: 78870 - DNA, 992 bp, Heterodera glycines
  Genomic contig location: Contig_ID=SeqID_2280; Location=89..1080; Strand=-
  SCN-specific regions: Sequence locations=1-5,27-52,85-100,122-337,359- 458,480-691,726-753,775-992
  Gene Ontology: Mol. function=sodium:phosphate symporter activity; Cellular component=integral to plasma membrane; Biological process =hermaphrodite genital morphogenesis
atggtcgttgctgatttggccgtcttccaattggaccttttttggacaattgtaaattaaattatttatttatttgtttattttgctcatatttttgcagtattaacaaaaatatttttcacagatattgggctttcttatcgcatttgttttggcttttgcaattggaggtaagcgaaaaagcaaataaacgcaaaagtcgctaatgaattgccattattcagccaatgacacggcaaattccttcggcacgagtgtcggctcccgcgtgctcaccctccaacaagcgtatttactcgcctccattttcgaaacgatgggcgctgcccttttgggtgattttttatcccttttaattcaaatgggaataaacaattgtactcgttgtttttagggtatcaagtgacggacacaatgcgcaagggagtgattgaccttaacatttacgagggacgcgagaaggaactgatgttgggacagatcgccgtgttggtaatgccattccgtttcgaatgtcttcattttttcatcccctcttcttcaattagaccggttgtggtgcttggctgctcattgccactttctttaaaatgcccgtctccaccacgcgtaagtgaatgtttcaattttggcacttttgtcatgtgtgattttgattaaataattgtcagactccattgttggggccaccattgggtttgtttttatttttaattattgaatttgcccgtaattacaccgactcacacattaatttgttttcagttattcaatgcttctccatggtacagaaggcatacgatgggtcaaagtgactaaaatttgtgagtaattttttaatttttcggaatgaattgccaaattcgaatgatggattaattttctctttttcattctctttttcagttgcttcttggttcgtctcccccattctgtccggctgtgtttccattctcatttttctcttcattgaccattccgtcctccgaagg

SEQ ID NO: 78871 - DNA, 1812 bp, Heterodera glycines
  Genomic contig location: Contig_ID=SeqID_14743; Location=1417..3228; Strand=+
  SCN-specific regions: Sequence locations=1-774,796-899,941-1145,1167 -1221,1243-1622,1645-1687,1709-1758,1780-1812
atggcagaatggcagaacacagcggagagatgggtgagtcagctgatttggaatggctttcagcaaagtgttcgctgccgggaagtggtgaataagccagcggagcaaatttgttcacgatttgcacaaaatcggaaggtgaaggaccaaaaagcgacgaagaatagggcaacaagaagtgcaccagcatagattcataggatgagggggccagagatcgtgagttctcgaccaacaccgatgcggtattcctccgcggcacctcgactcgttgaatcaccatggggcataacgttgatcaccaattctcgggaccggggcggatggtcaattctgtcccagaacacgaagtgagacggccgggggcgtggatgtgggcatgttgacaagccccgtggtgtggaaatttggtcaggggccacgacgcggatcatttcgattgggaaaaaatcatggtgtccattaccgccgggctccatcaagcatggggcagaggggtgccgaagagtgatgtcatggcgagagcggtacagctcggagatagttgggccacgggcacttccattgtaggcaccgagacggttcgcaccacttcggctcagctcagatccctgaagccgcacattcctctcacgtgggtacagatgccttgtcttgagttcgtagccgcgactgtgcagtccctctttgtagaaatggtgaattgagtggcgcagaaacagcttttatagagcagccatgtggcaatttttgatctttggcgagatgaattcatagaaatatttgaaaaataatgaggatgagttggaaaaaggactattgaaacagttaaataaagacgacaaagaaaagattcaaaaaagacgaaatcgaagattgtacaaattgggtagcattactctgataatttttctcattattaatacaattatccaaataacggatggagcagcagaagttgtagtaatacaatcgaattccgaagattgtgaaagaaagtcaaatggatcagtatgcagaatacgcggaactgcagaattaactatattaccggctggacaaaaaatcactttagctttaaaagatgataatggaaaattagcaggttccttggatttaactttacaatttttacgacttcactgtaatcaaaacactgtaaaatggttacggtcctataaaataaatgttgtgtctaaaaaacggtgtccaactatgggatcatgtacaaaaggcaaatgcaaacacacacgaatgagtgatcaattaccggaaatgaaagattatgaaaaatttccaggaaataatttttgtaaagaaggcgaggctatttggggccacaaatgtgctttaccttccgcgggttgtttcttttatcggacttatgccaaaccaacatcagaaaaattatgggaattaatccgatacacaggatgggattacgaattaaaaatgaatttgtcgtttaccatgggaaatttgacaaaaaatacggaattaattatgtttcctggattaacaaataattggaatgaattttcatttacgccggaggcaataactcctccaatttctccaattttaaatgattattttattgtatcagaagatgaaatcatttatggtggaaaagaattaaaaagtgatttgttttgcgcaggccctattgaggcaaagaaattttcgtgtaatatatctaaagaagcatgtcccgaatgttggatagatagagaaaaggatatagttgaatgcgcatgtcatgattcaattttagaaaaaatggagccaaaattaccatttacaacagcaaaa

SEQ ID NO: 78872 - DNA, 999 bp, Heterodera glycines
  Genomic contig location: Contig_ID=SeqID_14746; Location=289..1287; Strand=+
  SCN-specific regions: Sequence locations=1-131,153-511,535-999
  Gene Ontology: Mol. function=iron ion binding; Cellular component =ferritin complex; Biological process=iron ion homeostasis
atggcatatcaagcggcacaggcgcgacagaacttctcgccttctgtggaggaggcagtcaacaagcaaatccgaaatgagctcaacgcttcctatgcatatctggccatggtttcaaatttcaacttttctctcttgtttgagttggttttttccattttcaggcaaactatttcaaccgcgtggatgttgcgttgtccggggccactgagttctttggcaaacaatcggtggaggagagggcacacgctctgaagttgatcgactacgtgaatgcacgtggcggacacgtcaaactgatgcctttgcctgtgagtcacttgtttatttaggtattcatgttcgatgttctctttgttttcaaggcgcccgctcaacaggaatgggtgaatttgcactccgcacttcttgacgcattggaattggagaaggcgaacaacgcgaatctgctgaaactgcataagttggcttctgacaacaatgaccccgatgtgcgacgtagggagcagaaaaacccattaaattttgcttttagtttaccaacttcctcgaagagttttacctccgtgagcaagtggatgagattcagcgccttgcacgcatggccaatcagctgttgcgcatgggtaccagcggactcagcgagcacttgttcgaccaggaactccgaaaagggacggtgctttcggatgaataagcgatggaacacatgggaccaaggaataatgcgatttaatgagtctatcaaatgcagttaattataatacctaattagaaatggaattttaaaaagcacgaagagggttaacaaataattttttgtttatgatcattgtttttgaaatatagaccaaatgacaaaacgccaaaatggatcaggaaaagcctcaaaattccattcctaatgtgacagttttattggtcgatgtctgtttaacaaaattaatccccaattccactaatgtaatgtttaatgatacccatttattaagtataaaa

SEQ ID NO: 78873 - DNA, 1123 bp, Heterodera glycines
  Genomic contig location: Contig_ID=SeqID_14747; Location=728..1850; Strand=+
  SCN-specific regions: Sequence locations=1-107,130-479,501-535,562 -814,851-1123
atgccgatgttggcacaaagccaaaagtgagtttaatcgcaattgtcgggacggactcaattcgattttattttttggttgggtaatccaattaagtgttttagacaatttaccttatttttctttctcaaccaacaaaacactgaaatgatttcaaggggcccaaattggcacagaaaatgccaacggttttttcctttcattttgccaatttcgcttcagctgccggcatccccgactttcgggggccccgcggcgtttggactttggagcgacagagtcgcgaggcggacagtgtccgctttgagtgcgctcggccgacctttgcgcactttgcgctcaatgcgctggagaggcgtggcattgtcaagtttctaatcacccaaaatgtcgactctctgcacgcggccgcgggctttccgatcgatcggatggcggaattacacggcaatgttttcgtggagaaatgcgagcggtgcggcaggtggaaaaaggggaaacagacagagttagacacacagagttagaattaatccaaaacttctccaaaagggaattcccaattccatcggcagggctttttctcttacaatttgaaccattctttttttatttacataaatttgacttagttttaattaagttttttttgctggtgacactaaaatttacaccgaattgtattagagacttttaaacgattgaatcactgaaaaacttttatttttgatggaattccgttggaaaacactttaaaatttgggacagctcgtcctcccgaaaaattttgtggttttcgccctttatggaagtgataaataaataaagaaaattaaatttaaaaatatttctccgactctcagaaaattcttccgtccgtcgcccattccgtcgattggcctcaaacccacggggcgaagttgcgactcggctcgcccgaggggaaaatgccgcggaaagctgcgcgacacaacgctcgactgggaggacgcgctgcccaccgccgaattccaaagggcgtgggaatatgccaagttggccatggcaagcggataatttgtgcatgcatttgttttccttcagaagggccgacctcgtcctctgtctgggcacaacgctccaa

SEQ ID NO: 78874 - DNA, 1151 bp, Heterodera glycines
  Genomic contig location: Contig_ID=SeqID_14748; Location=204..1354; Strand=+
  SCN-specific regions: Sequence locations=1-162,184-375,399-748,778 -983,1005-1039,1061-1100,1147-1151
gacgacaagcccctgaagggatcagaccgattaaaaatcagcagccaaaaggacgaaaaagatccgcagggaatggtgttgttgttggacattcacgaaccacagaaggaggaccaggccaagtgagacaaacaaatggggtgggacaaaatgccgacaaagacagaataaaatgctgacaaaaatgagaacgtgacgacaaaattggacataatattgaaaaaaatgggacaaaatgtcgacaaaaataggaatgtgtgggaaaaatgggataaaacgtcgacaaaaaggaacaaaacgtcgacaaaaatgggacaaaatgaaaacaaaatgggacgctgtgtcgacaaagacagaataaataaaatgttgacaaaatggacaaaatgatacaaattaacagaatgttgacaaaaatgagaacgtgtcgacaaaatgggacaaaatatctactaaaaggaacaaaatgtcgacaaaaaatgggataaaatgtcgacaaattagcagagacaaaaggtcaaaataagtagacaatttatagttgctaaatactagaaaattataataaataatagaggaaacaatgggaaaaagtgtcgacaaacacgcgaaaaacgacatcaaaaaaacaaaatgtcaaaaattgtttgtcgtgaaatgcatagattaaacaagaagacaaaattgccacattaagagggcacaaatggcaaaatgtcccaacaaaattcaaaaaaattgcaaattcaaaatttaaaatttttaaatttaaattttcgaaatttttttaggtacaaatgcgtggtgaaaaacgcggagggtcgcaatgaacagtcgctgaacctgcagtttgaataacagcaccagccaggcgatgaaaatccgatgaaaattttgagaaaaaaaaattggcaagaaattttcggcaattttttcttgccaaattctcgtgccaacctttgtgtatcttttaatttgcataaccattattcatacaaataattagcttagtaaagcatgaaatttcgaaatggtatttgaaaaaatcttttaaaattcgagaaaacgtggcacaaaaaatccggcatctccgaaaattcaaaatttttttaaaaattgaaattttaagacaatttttttaaaaatgtaaa

SEQ ID NO: 78875 - DNA, 1933 bp, Heterodera glycines
  Genomic contig location: Contig_ID=SeqID_14750; Location=740..2672; Strand=-
  SCN-specific regions: Sequence locations=1-140,166-205,229-346,378 -590,612-840,865-1402,1424-1493,1518-1933
atgtcgggaggcaaaagcggcaaagagagaacccttctgaattttagtctggccggtttagtcagagggtcggtttagtctggcaagtcgttttcgccttttcgcccataattcttacaaatgtttttttctgtcaattatttacaagtaaaaacttaaaatactatgtttagctacaaacacgaatggggaacaacgcaatcaggaaataaagacaaagcgaaacaagcaaaagctggaacatgaaggtgcactttatgttcttcaccaaatcagtgacgatggacttcggaagtattggcgctgcgagtttttcggacctaacaacaaatgcaaaggtgtatgcaaaaaataaaatatagattattttttaaattcagggcgacttcacactgacattaatggtaatgtcctcaaaattattggaagccacacatgcgacatgagtgccgcacaagtggaatgtcagcgacgcgtgacccagctcaagcggcgtgcagttgagacgtgcgaagcgcctgcaacaatccgtgcgcaagtcttgcagaatacagcaacccccgtgttggctgcttttgctaccaaagctgcgacaaaaaaggtcaacttttacgaatttttctgccaaagtatgatttgttcacttattttaggttataaaacgtgttcgccatgacgaagatgtaccacctgctgcaccactcagtttggaagcattggaattgccgcctgaatacagaatgtacaatcgaacagagactgaagaggagaatttcttattggcggacaccggcgtttttcaaattcagggacaggctggaccgcaaaggtaaaaaaaataaaaccattaatttttaaaaaattccgtgttaagaattctgatatttgctcgcgcttcgacttcggaatgggccggtattatgaaaaatgtgtacgcagatggcactttcagtttggcgccgcctttgttcagtcaaatttatgttctacttacaaagtaaaaccttaatttttaccacttttttttgtctttttaggcgtgataaatggggttttccgattgcgtactgccttctcacttcaaaatgtgaagtgatatatacacacggatgctttaactgattgtccaaagatggccaaattttgcacctgacaccatatcgttggacttcgagcaagcgacggtcgctgctgtccgcacagtctttccactttgtcgtgtgcaattctgcttttttcacttggtgagaagtatgaagaaacgaattgcttccgagggtttaacacaggcattgattgcatttttgtattttccaatagaatttttcatattaagacatacaacaatgatgccgtctttgctgaaaaaagcaaaatgatcacttctatggcgttttttcctgtccaccatctccctgctgccctcaatgctttgcaggcacaacttcctcaacaacttatgggcatcttaaattggtgactttttaggaacgaaaaattaaaaaaattattttaaaggttcatgtacaattacacctgaaggccgatgttcaatgggctttgacagtgcctcggttcgcatcggatgaatggagtgtgcatcaacggacgttggatggaggagacagaaccaacaattacgcagaagcataccatagaaaacttcaacgggcatttgattgtacacatccaactgtcttccgcttcatcaacacaattcgatgtgagcaaaagtctattgatgcagaaatctcacgatgcatcgctggtgaactccctcctcaaaaggcgcccaaatattgtgccgccgatgcgagaattcttcgactcttgcagagctacagtgccatcaacaataaccaggctcaccaaaatgatcacaattaccatgcccttatcaataacccctataacatcatcaattttctccttg

SEQ ID NO: 78876 - DNA, 1368 bp, Heterodera glycines
  Genomic contig location: Contig_ID=SeqID_14751; Location=53..1420; Strand=+
  SCN-specific regions: Sequence locations=1-192
atgctcggctacgcggatgcggagagcgctagtgataataagagactgaggtatgtgctcttcttatctccttttgaagttgttgctcttattttaaacaactttgcggtgttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataa

SEQ ID NO: 78877 - DNA, 811 bp, Heterodera glycines
  Genomic contig location: Contig_ID=SeqID_14752; Location=340..1150; Strand=-
  SCN-specific regions: Sequence locations=1-192,216-811
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 78878 - DNA, 497 bp, Heterodera glycines
  Genomic contig location: Contig_ID=SeqID_14753; Location=294..790; Strand=+
  SCN-specific regions: Sequence locations=1-497
  Gene Ontology: Mol. function=tryptophan-tRNA ligase activity; Cellular component=cytoplasm; Biological process=tRNA modification
cgatttggctgcaggaaaataactgatgatttggtgacccgaatcgaaaatctgacggggaaaaaagcacatgcgatgttacggcgtcgcctcttcttcgctcaccggtccaattggaactaaattttgttgcttttggtggtggggggggggggaagggcgttggaaaaaagtatatccgatttcaaaaaaacttcatttttctctttagtgaccttacatcaattttggaccggtttgagcagaaaaagcccttctatctttacaccggccgtgggccgagcagtgggagtctccacctcggccatctcatcccatttttcttctgtaaaagtttacaagactcttttgacattccgctgatcatccaggttcgtatttccatcgtcaaaaaggggcgtacgccggcacttcgtcaggggatgaattttctattggcagattaccgacgatgaaaaatttttgtggaaagacatggacctggagcggtctaaaaa

SEQ ID NO: 78879 - DNA, 638 bp, Heterodera glycines
  Genomic contig location: Contig_ID=SeqID_14754; Location=664..1301; Strand=-
  SCN-specific regions: Sequence locations=1-6,28-190,219-263,293 -364,387-388,411-496,542-638
atgagtgaggagcagaaggaatatgaaatgatgaaacttgtcgattgtatggacaaaatgatggtattcgaagaaattaaacaggtaataaacagaaactacaggaacagggaatgatcaaaccgggagtgattggagaggacggaaaactgagacaagcgaagcacgtggcggaactgatcaaagatgtgaaagaaggggaggagagcgaagaggactgaaaccagggagagaggagggtaataccgcagaattgtggtccctattaaaaattaaattaaaatttttttttgtttttcctggtgcaaaaataaactcaataactttgcaaactctgagctcacaaccagataattaaacggcatttttacccaaaataaaaatttaaccttgttttttatcgggaccataattctgccgggaggagaacacacaaagtgtgagagtgatctcgaaaactagtcaaaacaatctcacaaatgattttggttctcctttttgtaattctaaacaaaataaattaaaaaatcaacagtttgaagaacgatcacttcatttttctttcgacaatttgttcaaaaacagtatttctcacgaaatcagctaaaagtcatatgccaacttccttggcgtggtga

SEQ ID NO: 78880 - DNA, 454 bp, Heterodera glycines
  Genomic contig location: Contig_ID=SeqID_14755; Location=1..454; Strand=-
  SCN-specific regions: Sequence locations=1-89,111-187,209-454
tggcctgttactaatacaccatgaatattcgatctgaccagcaccggtatcctttttgcattgtttggacgccaatccccctcatcagttggttatttccctttattggacacattggtattgcaactagcaaaggtataaacaattctttcctttttgcaatattaaatttaaagctgcagttttttaaattgattatattttttgagtagaaaaggagataagcggataattactaattaagttcatttaattgacaaggtataattcgtgattttgccggcagcaattatgtctctgaggacaatatggcatttggatggccgacgctttatcatcaactaaatcctgaaaaagttaatggaggttcagaggcatgggataattctgtggcagaagctagcgatgtaagcatattttattattccaacgtcgaaatcgcttttttaggaat

SEQ ID NO: 78881 - DNA, 956 bp, Heterodera glycines
  Genomic contig location: Contig_ID=SeqID_14756; Location=729..1684; Strand=+
  SCN-specific regions: Sequence locations=1-151,173-956
  Gene Ontology: Mol. function=triose-phosphate isomerase activity; Cellular component=cytosol; Biological process=gluconeogenesis
atgacttcacgaaaattttttgtcggtgggaattggaaaatgaacggcacttttacgtcaatcgctgagttggtcaatttgctcaaccaaagtggtggtaattctgacgtggatatcgttgttgcgcctccaggtcagttggatttactgtggaatatatattcaattatcatttctttaattaagcaccttttcttcaccatgtgaaacaaaaattggaacatggcatccaagtagctgcacaaaactgttacaaagtaagctaatacttggcaaatttggtaaaatgttcagttacaaaggttgccaaaggcgcttttactggagagatcagtccagaaatgatcaaggacgtaggcgcgacttacgttatcctcgggcactctgaaaggcgtcacgttttcggagaagaggacgcattgattgcggagaaagcggcgcatgcactcagcaccggtttaagtgtgatttattgtattggagagaaattagaagagcgtgaagcggagaagacaaaagaggtggtagagattttaatttaatctattatactaattttacgcaagatttaaggtgaatttcaaacagttggaagctttactttccgtcaaaaatttggtctggccaaagatcgtcattgcttatgagccagtgtgggcgattggcaccggaaaaaccgccacccccgaacaggcgcaggaagtgcacggatggatccgcaaatttttgagcgagaaagtatcgcaagaaattgctgagaaaactcgaattatttatggaggtagtttattcaattctctgatatatattcagcgtttaaatgctttttttgtctaggttctgtgacagccgaaaattgcaaagatttggcagctaagcaagacattgatggatttttggttggcggagcatcgcttaagccggattttgtgaacatcattaatgcgaaatcctaa

SEQ ID NO: 78882 - DNA, 188 bp, Heterodera glycines
  misc_feature (107)..(107): n is a, c, g, or t
  Genomic contig location: Contig_ID=SeqID_14756; Location=1..188; Strand=-
  SCN-specific regions: Sequence locations=1-133,155-188
ccatttctgagctttttagtccatataatttcgagccctactgatggcactatttagtcatttttaattttattatttgtgaatgggctgctactaatacaccatgnatattcgatctgaccagcaccggtatcctttttgcatttgttggacgccatccccctcatcagttggttatttccctttat

SEQ ID NO: 78883 - DNA, 1221 bp, Heterodera glycines
  Genomic contig location: Contig_ID=SeqID_2283; Location=387..1607; Strand=+
  SCN-specific regions: Sequence locations=1-247,269-285,367-485,538 -828,860-866,888-1122,1144-1221
atggcccaactgtttggctttttcgtttgggcccacgcacttttccattgtgagtgagcaaatggaaaacaaaaagctcaccgaaaattgaactttgaaaaattaccaaaaaaagaattttcctaataaacttaacaaatcaaaaaaaaggaatgaaattttaaaaaatgaatttagaattttttgtatttcttattttcttttttcatccatctctcccaccattagagcacgggaagggattttttaaagtataattcattttatagttgtccgaattggaccataattattatattattatttatgtgaattttttgaaaaaatttaaatgataatttatttttaaaacattaaagttttattgaaagttagctgatgaatatttggaaatgaatttgaggcatacttttgaaattttccgtcaaaagaaatagggctgttatggtgccttttacactttgtccctgctcttcccaccagacattttgaatgtgcacaaaaatggttcaaaattaaaccagggatttcatgccaggtttaagaccggctggtcgacgagtacaatgaaacagtgtgagaaagagtattttttgagtaaaattttaattccttagcggttttttcaattttattttactgtattttaccaattcctccaaatttatccttttcactcatttttagtggcaatcaaatggtgcgcgagagcaaaagccgcctgaagaggctgaactggtcaaatcgacgctcgctctgctgctgatgcgtcggtttggcaatgagctagctgtgtgtgccgcgttaaaaattgtcaattaaacccatccaaatattgttttttaattaatttgagtggccgaccgaattaattttttttttaatttggcatttttgttttcttagtccattaatatgtacagtattccttgtatttatgaaatcacaagaaggaatgcatttctgattaggagcttttcaggggggggaatgattaatcattgaaaaacatccccctgagcgaatttaagaaaataggcaaaaaaaaagaaagaaaaaagagtggagaagccaaaacatggggaaatgatgacgaatattgcgtaaaacgacacgaacgaatattcttcatttctccatttttgtcctctccatttaccgtttaaaacattttgaaaaatatttgtttttttttgatcgccaatttttttttgccgacaa

SEQ ID NO: 78884 - DNA, 1086 bp, Heterodera glycines
  Genomic contig location: Contig_ID=SeqID_2285; Location=723..1808; Strand=+
  SCN-specific regions: Sequence locations=1-85,190-557,579-1007,1029 -1086
atgaacggagctgctaaaatgtaatttttgcgcaaattaaattttttggtctttaaattccttattaaacaaatttgctgaaaactttattaaaataatattcaaaatttatgtatataaataaaaaccattattattagtatttaaatgaaatgaaataccatatattaaattgttaaataatattttctttttccagtttttgtccttacaatcatttttgggccactgttagccgttgcattagctctgctgtgtggcatcgggatcaaagtcttagtgaaaagaggtacagttagattttaaaccaaaccacattaatagcttataaggggtgggaccggtgagtcgggggtcgttctagcgtcaaaaatacgaaatcgcatacatcatggctaatactagagttgagcgggaccggaatttttggcaaaaccgggaaaacccgggaatttcccggtcccaatcaaaactggtcaaaaccgggacttggtactcagttgtccgtcttcaggtcccggtcccgcttaactctagctaatactatagatggtaggggcccttttaggaagaaaaaattttttttttaaatcgtgaaaacatgtttatgggggttttctgggccggataacccgaacccaacattcattttgactaatttcgaattccggacccgaatttgaacaaaaaatctagaattcaaaattttcaaaattctcacttttgttcctaaattgaccataacaagctaaatttagtctaaacccatcgaaacatcaaaaatggtcattctgtacaggtatgaacataaaagtgaattttgaaaatttgaatgtttatctttttagaaaaaaaataattttcttccgaaaagggggacattgcatctatagtattacgcacatgactgtatgccacaaatcttgtattttttgggatttctggcgtaatgatgacaagttctgcttttgaaagtcaggtttctgcggtcagacgctaactgcatgaacctgtcaaaaatgacaggttttttccggtcggggtcgttttcgcgtgagggccattttcgcgcacccccccccccta

SEQ ID NO: 78885 - DNA, 521 bp, Heterodera glycines
  Genomic contig location: Contig_ID=SeqID_2285; Location=2023..2543; Strand=+
  SCN-specific regions: Sequence locations=1-14,49-83,105-444,466-521
atgacagcatttggagaacaaatgaagaaaatgaacaagcgaactttgaagaaaatgtgagccaaacaatggcattgacaatctttgttttttgggggaatttcgaccaatttccgcattaaatctaaacagggaagtgaattttcgactttttgttcgaattcggtacaggggttcgaaattggtcgaaattaatgccggattcgtgattaataatctccaaaaattatgtaaactcaacactctttcagctggatttgtagcgaggttttgatggacattcttccgttttttgaccgccctcaactcggcctcaaattggcattactttcgccccgtttcaatgcgctggtggacacgcatttcgatgacaaaacgacggaattaacaatttggaaattgataaaaattaatggaccaaagccgcaactatctgttctaattgatggcaaatttgtgggttttccattgcccgaccgtccgctgcccaacaaaattcgatttaatcaacttcggattga

SEQ ID NO: 78886 - DNA, 596 bp, Heterodera glycines
  Genomic contig location: Contig_ID=SeqID_14757; Location=312..907; Strand=+
  SCN-specific regions: Sequence locations=1-155,201-350,372-596
aaattttttgaatattatacaatcgtgctttttgctctctatcaatttattataaaaaaattcacttcccttcgaaattgaaggcagaatgctcatttgaaactacgcaaatataaattaatatttgctataagaactgactatttagtcaacagaaaataaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaatttttgaatattatacaatcgtgctttttgctctctatcaatttattataaaaaaattcacttctcttcgaaattgaaggcagaatgctcatttgaagctacgcaaatataaattaatatttgctataagaatcgactatttagtcaacagaaaacaaataaatcataaaatt

SEQ ID NO: 78887 - DNA, 516 bp, Heterodera glycines
  Genomic contig location: Contig_ID=SeqID_14758; Location=305..820; Strand=-
  SCN-specific regions: Sequence locations=1-160,183-392,414-516
atgacaaattccaacctgggtgagcacacatttcagataagcttcctatcattatttcttagaaacaactaataatctgttgaacagttatttcaaaataaattcgaatatattagcttattatgtatcttcagtgagcattctaaaaaaaatcattttttgttctaattttatgatttatttgttttctgttgactaaatagtcagttcttatagcaaatattaatttatatttgcgtagcttcaaatgagcattctgccttcaatttagaagggaagtgaatttttttataataaattgatagagagcaaaaagcacgattgtataatattcaaaaaatttatctatgcatttgttgaatgttcccaaacccgatcaaattttttaaacctttatatgaaaacatttattgcaggaaatgacaaattccaaccgagcacacatttcagataagcttcctatcattatttcttagaaacaactaataatctgttgaacaattatttcaaaataaa

SEQ ID NO: 78888 - DNA, 592 bp, Heterodera glycines
  Genomic contig location: Contig_ID=SeqID_14758; Location=63..654; Strand=+
  SCN-specific regions: Sequence locations=1-161,184-345,367-592
aaattttttgaatatcatacaatcgtgctttttgctctctatcaatttattataaaaaaattcacttcccttcgaaattgaaggcagaatgctcatttgaagctacgcatatataaattaatatttgctataagaactgactatttagtcaacagaaaacaaataaatcataaaattagaacaaaaaatgatttttttttagaatgcacactgaagatgcataataagctaatatattcgaatttattttgaaataattgttcaacagattattagttgtttctaagaaataatgataggaagcttatctgaaatgtgtgctcggttggaatttgtcatttcctgcaataaatgttttcatataaaggtttaaaaaatttgatcgggtttgggaacattcaacaaatgcatagataaattttttgaatattatacaatcgtgctttttgctctctatcaatttattataaaaaaattcacttcccttctaaattgaaggcagaatgctcatttgaagctacgcaaatataaattaatatttgctataagaactgactatttagtcaacagaaaacaaataaatcataaaatt

SEQ ID NO: 78889 - DNA, 760 bp, Heterodera glycines
  Genomic contig location: Contig_ID=SeqID_14758; Location=1063..1822; Strand=-
  SCN-specific regions: Sequence locations=1-23,207-213,237-252,274 -304,328-410,442-566,588-760
atgggcacaaaggggaatggtaaagggaaggcgcagggcacggcacagggaagacgcagggcacggcacgggaaaggagcagggcacgggaaaggcgcacgggcacggcacggggaaggcgcagggcacggcacgggaaaggcgcacgggcacggcacggggaaggcgcagggcacggcacagggtaggcgcagagcacggcacggggaaggaatggaaacttcggagggaaccaatgagcgatctgaaatcactgaaaacccagccccttttatacggcttttttgaaaccatagtacgctccaatttataatttttaattaaaatctgtttttgttatatccgtttgggttttgcgattttcccattaattgtttgttttccactttttcctttacaattccaattcctttaatatattcaattaattattaataatttgtttagaacgcaatccttaacagaattcgccatttaatattaattaattttcgttcctttcattcctgaggaaatgcacttttccttttcaaacaattttccgttattcatttcaaaaggttttcaagaagtcaggaaaatggagaatgggccgggcttttataccctcacaaatcaatgggggcggggccaggcacgtgaaaaatgtgcacaaacaaatagaaaaaaatccataaaaatatgaggaagagagaagatgactcataattaacgagcgagcgaatgcaaaattgatcgatgaaaaggattaaaaaataaa

SEQ ID NO: 78890 - DNA, 514 bp, Heterodera glycines
  misc_feature (18)..(18): n is a, c, g, or t
  Genomic contig location: Contig_ID=SeqID_14758; Location=2024..2537; Strand=-
  SCN-specific regions: Sequence locations=1-77,117-265,287-378,400-514
attgaaggcagaatgctncatttgaagctaaaattaatatctgttataagaactgactatttagtcaacagaaaacaaataaatcataaaattagaacaaaaaatgattttattttagaatgcagactgaagatgcataataagctaatatattcgaatttatttgaaataactgttcaacagattattagttgtttctaagaaataatgataggaagcttatctgaaatgtgtgctcacccaggttggaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattttcttcccttcgaaattgaaggcagaatgctcatttgaagctacgcaaatataaattaatatttgctataagaaccgactatttagtcaacagaaaacaaataaatcataacgaatt

SEQ ID NO: 78891 - DNA, 665 bp, Heterodera glycines
  Genomic contig location: Contig_ID=SeqID_14759; Location=495..1159; Strand=+
  SCN-specific regions: Sequence locations=1-185,221-329,360-384,406 -528,557-619,656-665
atgttagcaaaaagtcgtggaatcgccgccaatcaaaaggtgggttttatttgaaaagggtgggaaaatcagtttttacactgctgacataaattttcatcgcctttggcaaaattaatcagccgaatttgatgatttagggggcgtaaattttgaaaaattgtggttgtgcgataggggctttgaaaatttgataaattttcaaaatttaaatttttttggggggggggcttgagtttgctttgttttttaccaaaattaaacaaaacatttttttttttgctttagaaacagattctcatcaaaaaattgactgcaaacttcagcggcacacatcaacaacacaacaccaacacaaatggacaaaacgatgatggggacggcactgacaatgagcaaagtttcggcgacggcacatatggacaaagcgatgatggggacggaactgacaatgagcaaaattttggcggcggcggcggcggcacaaatggacaaagcgatgatggggacggcactgacgatgagcaaagttttggcggcggcggcggtgacaacaatgttgagggagagcaggaggggggccagcaacaacaacagtccactgagtttacccgacgtcaaaaaattaaaaaaatatttagaaaattaaaaaaatccttttgaaa

SEQ ID NO: 78892 - DNA, 553 bp, Heterodera glycines
  Genomic contig location: Contig_ID=SeqID_14760; Location=1344..1896; Strand=-
  SCN-specific regions: Sequence locations=1-4,27-553
atggaaagcttcaaaaaagattttttggaggccaaaatgaaggcacttgtggaagagaaggtggccgaggcaaaagaattggcagaatttgccatcgctgatgcggagcgcaaaatggaacaaagtttgaacaacgcaatacacgctgaacgtgaaagaggccaacaacagttacgctctgtagtagaggagcaacatatgcgctgccgacacctcgcactgcaaagctaccgcgccgcaacaatgacaaaaccaacatccgttcgcacctccgatgtgtctcccaaatgggagccacattgcatgttttgtctgatcgacgaaccgatgtttgggagtgaatggtgcgcacatgtgaatgtgtgcgctgaatgctcgatcgtatggtcaggggatgatcagtgcaaatgtttgacttgtcaaactacatgtaataagtttgtctattttgggcctaatccatccccctaaactttcgcattttcctttcattttttagtaatgccatttttaattcataaatgaaaaaatgatttgaagcatttttattaaa

SEQ ID NO: 78893 - DNA, 1284 bp, Heterodera glycines
  Genomic contig location: Contig_ID=SeqID_14760; Location=1488..2771; Strand=-
  SCN-specific regions: Sequence locations=1-51,74-309,338-879,902-1284
atgtcatcatcatcatctcccgaaaaaattttggctcaaccttcgtgcccaaaaaaggcaaaagtggacgagcgagctctgtggaaaattttcaaaggcaaatatatgttggcaatttatctctgcgatgatgactggcggaatctgttcgagaacaaagagaaagttcgccgaatggacaacgaccgtgtggccctaaacttcgaaatgtgcgaaaattgtgctcgtgtgaattgcaacggaacggacatattgactccgtcaaagaaacgaaaactttcaaccgatcaagcctaatgatatcatgatacctttcttttattattattatgtgatttgccctcaactaataaaaaataatttaattcaatttgcgcaatggtggctggggatgggggggggaaggtagccatctgtcggcagctacatcgcatggttgttgttgttgttgtgttgttcggcaaatatcctcacacactctgccctcatccttttccttccttatttttgcattttatctcccaccctcttcacggttaataaaaatgagtgcaaattccgcatcggttgaaagtgaaattgcgtcactgaaacaaattattggcgcacagtccgtaaaattgatgcagatgcgtcatcattttgtgaactaccgcttcagacttgagcaacttgaggcttgggccggggaagtaaggtattcaatgttttttgtgatcacagtttttaacaaggtaaagacaaaaagtttgttcgttcaccaacacgcaacaaacgattttctgtggacgacgagccagcaacatcggccgcaacttccggtaagggtagtgtaatattactgggaacagtgcgctttttcagatgggatggcaatggaaagcttcaaaaaagattttttggaggccaaaatgaaggcacttgtggaagagaaggtggccgaggcaaaagaattggcagaatttgccatcgctgatgcggagcgcaaaatggaacaaagtttgaacaacgcaatacacgctgaacgtgaaagaggccaacaacagttacgctctgtagtagaggagcaacatatgcgctgccgacacctcgcactgcaaagctaccgcgccgcaacaatgacaaaaccaacatccgttcgcacctccgatgtgtctcccaaatgggagccacattgcatgttttgtctgatcgacgaaccgatgtttgggagtgaatggtgcgcacatgtgaatgtgtgcgctgaatgctcgatcgtatggtcaggggatgatcagtgcaaat

SEQ ID NO: 78894 - DNA, 735 bp, Heterodera glycines
  Genomic contig location: Contig_ID=SeqID_14760; Location=2856..3590; Strand=+
  SCN-specific regions: Sequence locations=1-309,332-415,437-455,491-735
atgccgagtttaaacaaattatcattttatgaatctgaaatggtactcgtcaatgtgttttgtgctcagctattagactgtcccgtcaagtcactgcgcgaccgacttaaccaccccgaagattgtgtaaatgcgatgaatggattgatggggaagaaagttcgaacaacctacaaagatcgcaatgggatgcacaaaaccttttttgtcagcggtatcacggagcgcggtgcagctttcgttccggcttatggcaatctacgggcaccatacaacgtaaatgtggccgcttacttttatgcacggcatcccataaagctccatttcccttacgtgccttgcgtaattgaacgcttttccgggagaggtgaggaccgtttctacccaatggagttgctggaaattgtggatgaggaaaacaaagggagattgtttggacgaatgtttatggaaattggtgaagatgatgatgatgataatgacgaggatgtttcaacatcctttgactcaacactacgatttgatatgggacgcgatgagtgttcccaattatggcgatgatcaatatttgcaatattcatcttctattactaaactatgcacttttctacctaaaaatagcattttcacactcttaattatttaatcaatatattagtttttcactctattaattcggcatttttctacccaaaacagacaacttcttttttttcatttattcaaattcacaaa

SEQ ID NO: 78895 - DNA, 1482 bp, Heterodera glycines
  Genomic contig location: Contig_ID=SeqID_14762; Location=551..2032; Strand=+
  SCN-specific regions: Sequence locations=1-233,255-485,507-582,621 -621,644-706,754-999,1021-1059,1082-1294,1336-1437,1464-1482
atgttttgccgatgggctgctgttccgattgtcccttcggccgatcagtccaaaaatgagacgccattgggcgccgaactgttcgtctcctccacaatgttggcaaatttgcatttaaccctgtgctaattttagttcatttaatttacagaatttcgcgcaaattggcactgatcacgcgccgaagacaattcggggctttccatttgtcggatgatcagttggaatatggtaaaagaaaaattggaaaatgatttgaagatatatatcaattgactgattaaaccgccgctgatagggctttttatttgcccaattatcagtcctcgtacagtatttataccgtatcgtatgaccaattagggcatggtaatagacccctaattcgatcgtaatatgactgactatccaattataagtttgggtacggtatttataccgtatgactaattagggtatggtaattgcccctaattcgatcctaatttgttgtttttgttttactgagtctctctggctaatgcccttgctcagatccggccactcctcgtgaccaccttccactcgacgtgcacttcttcttccacccttcctccccttctccgtcttcttctgccgccgttttcctctccaattgtcccaacggcactttgggcgtcgtcacagtgcgctgcgagccaagcgttgtggcaaaaccattggttgctttttttattaattaactttatttaattttaatttaaaatttaattaggcccgcctttcacggcattgccccgatgggacgtgcgacgggtgcctttaccacgtgctggtggagacagtgcacggctgtccgctgtgccgtgctgatgattttcgcgaaattcgcggcgaatgtaacaaaaatggaggggggggggaagggataatggttagagatcgacctggaaacctgaatccaggtctagattttcctgaaaccaggtccaaacatggaatccaggtctaggctttttcaaaatgtcaatctttaataatggataaccgattgatcggcccgaaaatggaaattttaattttaaattgaaattgaaatttccaaatttaatctttgccaggcatcgacgggtcccaaagtgtccattcgctgccctccaaacattgcgctttgtcgggcgcccaaacgcgcgaacggacggagccgtgccgggtgattctgtcccaaaatgtgcgccttcttttggcggttgccattgtgctgatccttttcctcagccttatcatcgcggccatttaccggcgaaacaaagcgtaaaaattaaaaacatttaattaatttatataattttaattgattttagattggaatatcgttatatgcgtttggcggaagggcgagaaactgatcagagcgtgaggacgagctgtgcactgatcgaaagtgatgtggacggatcagaggaagaagaggaggagggcgtaaaacagcaagggcaaaag

SEQ ID NO: 78896 - DNA, 2251 bp, Heterodera glycines
  Genomic contig location: Contig_ID=SeqID_14763; Location=1..2251; Strand=-
  SCN-specific regions: Sequence locations=1-2,25-46,68-69,91-93,135 -159,201-324,376-490,556-597,621-649,671-672,695-745,810-914,936 -1024,1111-1119,1141-1145,1196-1321,1373-1488,1511-1768,1792 -1798,1820-1919,1942-2016,...
  SCN-specific regions: Sequence locations=...2038-2069,2092-2179,2210 -2251
  Gene Ontology: Mol. function=protein binding; Cellular component =cytoplasm; Biological process=response to pathogenic bacteria
cctccaccgcctccgccaccaccagcgtacgagccaccagaagcgccatgcaatgagccacagcagcccccaagctacggagccccggcgccgcctccccctccccctcccccaccgccgcctccaccaccgcagccgccagcgtatgaaaaaccagaaccgccaagctacggagccccgccgcctccgccgccaccagcctatgagcctgccccaccaagttaagaagcaccggaaccgccaagttaccagccgctcccgcagcctccgccaccgcataagcctccagcgaaaagaatcaacagataccaaattcgagaagacattattattttatttgagataaattaacattttgttatatataaaataaatgttttgagtgaaattttcctactaaaaaacgaaaaacaaatcgcagaaatgtgaaaaaatgttaaaaaaggctttatctataataattatgctttaacaaagttgattaacaaacaatttattctttaaatttaaatatgttcaaaaaacttagaaaaaatttttaaattctttttttttgcgccggaagtctgatacttaatacaaaattgatctttatagtttattttatttcatttattaacacaattcttatgagaaatcggtgttgcgtgtgaatttttgaatttgaagcggaaattccatattaattataaatctcaaacgctaaagttttaagatgtagataacacaatttaaatgcattatgaaattatttaatattaaattcatttaaaataatttttttacattttcaaaaattaattttatttgcgctaaattaataaagaataaaactgaaaaagtttactttaaaacaccagacaaaagtgttttatgcaatggaaattaccaacaaaaattccagaaataaaaatatcactgacagaaaatatgagtttttgcccaaaaattatgaaataataattctcgaaatcagtgatgtaagctgataccactcctaatttgcctattttttcggctaccgcttaaattttctaaaataaagccgccgcctccccctccaccgccacctcccccacctccgcctcctccaccaccgccacctccatcgtatgagcaaccagagccgccaagctacggtgccgcaccgccaccaccgcctcctccaccgccaccaccgcctccgccgccaccagcctatgagcctgccccaccaagttaagaagcaccggaaccgccaagttaccagccgctcccgcagcctccgccaccgcataagcctccagcgaaaagaatcaacagataccaaattcgagaagacattattattttatttgagataaattaacattttgttatatataaaataaatgttttgagtgaaattttcctactaaaaaacgaaaaacaaatcgcagaaatgtgaaaaaatgttaaaaaagctaaagctttaacgaagctggtttattctttaaatttaaatatgttcttaaaaatttatacaaatttgctaaaaaattttgcgcctgaagttaagacttaaaactttatggttaaacttttttcttacattttacggaaattggaaacccccaaaaaaaggtttcgtgttcgattttaacctgagacttgtgtttttttaaatctgccacttcactcaacccttcttttcacaaaataatattacaatcctcactaatattatccatagaaagaaataatatttaaattcaagaaaaatataaatcaatacaaatatatagaaagcataatatttttccccaataaattgccaacaaattttcattttcatttcactcatttcaaaaaaatgctcccattatcattaatgactgtaaccactcttgttctgctactggtagccaaaatgaccttcggcgatcccataacattcaaatttaaccaaaactataaacatattatttatttcttaattgtcaacaacgaacaaaatccgctccatgtttataacactaatgaggtagtaattgattcaagtgaattgcttggaaaggaccatgttgcatttattcgctatgctaaccaagaaaaacaagtggtttgttgttattccgtttaaatggagtataaaaaaggggagtgtacgccgcacgataatgggattgcactcgcttcagttattggctaaacggttttcaatttttttttaaatttaaatcttattttaggaccccaccattgtattgtctgttagcaaaataaatgaaaa

SEQ ID NO: 78897 - DNA, 771 bp, Heterodera glycines
  Genomic contig location: Contig_ID=SeqID_14764; Location=76..846; Strand=-
  SCN-specific regions: Sequence locations=1-90,117-153,225-595,633 -727,770-771
  Gene Ontology: Mol. function=small GTPase regulatory/interacting protein activity; Cellular component=actin cytoskeleton; Biological process=regulation of protein activity, epigenetic
tcaaaatgaaactgatttcattggctccattggtcatttgttcattattttttgtggggattcctgtcgtgctcagtgacgggaaaggggcgccaccgcctccaccaccgcctccgtcaagttacggtggacccccaccaagttatggagcggcgccgcctcctccgccaccgccaccgcctccgccaccgcctccgccaccaccgcctccaccaccgcctccgtcaagttacggaggacctccaccaacttacggagccccgccaccaccacctccgcctccgccaccgccaggctacggaggacccactacaggctatggagctccgccgccgcccggaccgggaccgtacccaccatcaccaccacaaaaatgtaaattgtttcttttgattattaaagcagccattaattatattttaggcaaaggagagggactgtcggcgcctaaatattgcgcgtccaacgtttactacgcatgctcaggcggtgtgtccacgaagctgaactgcccgaaagggcttgtgttcgaccaggcaaaccaagtgtgcaactacccaagcgattgcggaaagaaacagccgtaaaaacactcaaaaataaataattattaaaatttatatttattttaaggcctcaaccgcagcctccatctaaaggatacggcaaatacggcagaggaaaacgcgacgcgtctggagcaccgccagcacccgagccagctcctccaccgccacctcctccgccaccaccgcctccgccaccaccagc

SEQ ID NO: 78898 - DNA, 1750 bp, Heterodera glycines
  Genomic contig location: Contig_ID=SeqID_14766; Location=12..1761; Strand=+
  SCN-specific regions: Sequence locations=1-614,638-998,1020-1248,1270- 1303,1328-1517,1540-1750
atgaacattcgtccgtcgctgagcccagcggaattggacgcacgtcgacagctgcagaaagaatgtgcagagaagcgaaaagacggaggtgactgggtgatctatgctgggacggtcggacattcccaatttccgcaaaatcaattgacttatccccaaatcacttttgacaaatacatatttttcaccaaataagaatatcttttccggtcttaagcatgttaagcccaataaaccaatgatgaaaataggggaagttaaggtctgcttagttaatataagatcaatccacaacaaaattgatgaaatcgctttaaatttggtaaattaaaacatagaaatttttctgttaactgaaatatggacaaaggaggaaaaccaaatcctctttagtccatggataatcgaaaactataactttatttttttgtcatagaaaatctcaaaaattaacgcgtgggggtgattgcggtgttttaattaagaaagaaattgagtttttttattaaattttctgaaacaaaatataattgcgaaattttggtttttcaattacaaaaacgtaaatcaatcagatttgtgcttgtttaccgacgacccaagacaacatatagacaaaccaaagaactttttaaatttttagaaacattctatagccataattgtgttgtgttgggtgattttaatttcccgaataaagacctggtatggaaggaagggcagccctattctatgagtaaatttggtgaaattttttgccacttttttagtaagcttccttttttaatcgccacgaatggactcaccagggaaaattcgtggttagacttagttttaccagcgaatgatcaaattgtaaagcaatgtactattgaaggtagtgttttttcctctgatcatttagcgcaaattttcacattgactattccaaaaacactacaaaaaacaaaattcttttacactcgacgcttttctccgtcgaatgtgtccctttttaatattatgatttcttctagaattagcgctttatccaataagcattttactgtaaacgaaaaatacaacgcctttaataatacactgctagaaaccttaaacgagtgtattccaatgaaaagaattaccaaaaaagatatgaccctaaatatccaacgcatttaattgcatcaatcagagagaaagccagactgtataggcaatgtaaaactgatccatcaaaaaaaacactatatgatagcattagtttacacataaaaatacaaacaaataaatttcattctcaaattgaaaaaaggctatttcaaagggaagaaattctatctttaaatatatacaaaaatacgatgttaatccctttgaaataccaaatttagtttttgaaaacaaatgctatcatgtgtttttccacgataacatactataaattttttctttggcatccaaatccaacatttttggtagcattcgtaaagcttaacatgattagaagcttttatacttcgaaattttaaagttttttcttaataaaatttttctaggcttgaaaatcttttcgctttttgtaaagctaatagagcatgtgaagagctttcgaatgataccaacaatgttagatttggatgataaagaaaaaagctatagtggaaaagcatgctggggcccaaccgtgagggccgaactgacgggttccggccaagaaaccttctctcatttacctaaaaattcatgattattttgccgaaccaagtca

SEQ ID NO: 78899 - DNA, 1247 bp, Heterodera glycines
  Genomic contig location: Contig_ID=SeqID_14767; Location=1539..2785; Strand=-
  SCN-specific regions: Sequence locations=1-273,295-1247
atgtacctggatccagccctgtatttttcctggatccagccaggtacaggcacaggccatttttcggcaacctggatttttcctgtacatttattttcctgtacttatgtacagaaaaaataggtacaggccagggatgggccgaggtttcgcttttcgcatttcgcctttcgcattattcgcattttttggcgtttcgcatttcgcttttcgcatttcgctttttggcgcgaaatgcgacttttacacccctaagaattggattaaattcccataaaatttttaaaaattttacctataaattggctaattttcagtgaaaacctgtttataaatgatcaaaatttccatttttttttccccggcggcgcctatcggcaccgccgcgcccccaaaactcctattttttcttagaaaatggcccaaaatcgcaaaattttgtaatttgatgaaaaactgttctcagcggcgccccaaaactcttatttctcattagaaaaatgataaaaaccacaaaatttgatcattagtagtatagagcgtcaaaagcgagcgggttccgagcgggtgtttaccgcacgaacccgtacctatgggaggggtgcagccctttgatgttgccgcccgtggacccaagcctatgggaggggtgcagccctttgaagttgccgcccgtggacccatgcctatgggaggggtgcaaccctttgaaattgccgcccgtggacccatgcctatgggaggggtgcatccctttgaagttgccgcccacccaatccaattcccaaatccgcacgggtgcttttttttgttgcctatccctccccgccgatgcatcgccgcgcaaattaatcgataaaaataatcgataatgacactagcactgtcctccctatcgatgtcgctgccgcgcaagcacccgtgcctatgagaggggtgcatccctttgaagttgccgcccacccaatccaattcccaaatccgcacgggtgctttttttttgcccatccctccccgccgatgcatcgccgcgcaaattaatcgataatgacactagcactgtcctccctatcgatgtcgctgccgcgcaaaaaaaaataatcgataatgagaccgccactctcatcgctctgtcgatgcgccgcgattccgagtcgtgaaaaaaaatcgataagcaccaaaattgtcaatgaaattcgaattaattgtatgatataggaatattaattggacaatagttgaataaa

SEQ ID NO: 78900 - DNA, 288 bp, Heterodera glycines
  Genomic contig location: Contig_ID=SeqID_14767; Location=2367..2654; Strand=+
  SCN-specific regions: Sequence locations=1-125,147-288
attttctaagaaaaaataggagttttgggggcgcggcggtgccgataggcgccgccggggaaaaaaaaatggaaattttgatcatttataaacaggttttcactgaaaattagccaatttataggtaaaatttttaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctg

SEQ ID NO: 78901 - DNA, 1378 bp, Heterodera glycines
  Genomic contig location: Contig_ID=SeqID_14768; Location=1709..3086; Strand=-
  SCN-specific regions: Sequence locations=1-1055,1077-1378
cccagggcaacacaataatcagccaggtttttttttttaattatcaggcctggctcggacgccggaaaaaatttgttggcgagttgtagtgttccggtttccaagaccaatccacaattcacacccaaaacaattttatccctaaagaaccaaggatgagacggaatgcactaaaattttatgaaatttttgcagaggatttgaccggcagtgttcgtctccatctcggcacttgcacatacgacgacggcctttactttgaaggcggcacttttgtgtttgagggcctttgttccccaagtggcgaccgcttggacgtggaacggatggcgttgccgacgatgaccaccttggaatccgctgaatcggttgatggtgccccggggcttgcaacacgtacacaggaaatggcacggcgaacacgcggcgatccgaatgaccgaattgtgctgatgtccgatgtgcatttggacaatgagcgggtttgtgtggtctcaaagtttttgcaattgaatttttcatccacggcgcaggggaggggtggcgaggcttaattaaaagtagtcaattaatgatgatgcctaggcccagaaaaccgatgcacttcaaaatatcgccgtcagcaaaactaatctgctccgctagaaaaacatttttttatttttaaggtattgaaagcactgtaccatcttttacaaggcttttcagccagtccaccgaacattgtaagcattttctgtcatgtctatatttcttaatttaaaccccttccccaaaaaaagttcgtattttgtggcccttttctcggcattcaacgggcgcacagttacatggagcaggcggccaacgcgttcaggcattttgcaaacattttgtccgaattttcgcacgcttaccacgccaccgaattcatttttgtgccaagtgctgacgatgcgcctccgttgcaaatttttcccaggcattacaaaaaaaaacaattagccattttttaccggttttcccccatttttaggcccactttgttgcagttgatacaaaaatgctttaaggaggctaaaaatgtgcattttgccaccaacccatgcaaattggtgttcaaggaccggcacattgtcatctttcgtgacgatgtggtggagaaggtgtgccgttcagcagttttcatgccaaaaaacgcgatggccagccgaataccaaaattggtgcaaaaatgggatttttatcacccaatttttgtatttttttggctctactcttcagttctgtgacacaatttgggcccaacgccatttctcgccgttgccactgttcatcaacccaattcaaccccattttgacccactgtttcaactgttcccgtctcctgatgctcttg

SEQ ID NO: 78902 - DNA, 834 bp, Heterodera glycines
  Genomic contig location: Contig_ID=SeqID_14768; Location=1..834; Strand=-
  SCN-specific regions: Sequence locations=1-321,344-347,369-834
  Gene Ontology: Cellular component=membrane
accggttttcctgtttgcattttgacgccctgcagcaactcacatccttttgaggaacggaggtgtgtttttgctgtttcattttgatgatccgcccgggttgaattggttgctaaattttattttattcgtacagttataataacatcattttttggtcagaattttggtcacacggacggaggaagacgcggtgaaaattggccgatcggtggtccgactgcagccgtcatcgaacaacgcgatttttgactgcaaagtgattggaaatttatttttatcctaaccccaccttggatccaagcctagcctggacctggatttctttttaatttgttttaaaaggcaaacaattgtttgaaaaattaattgaaatatctcgaactatccattaaacaatttttgataactcgaaatgaaacgttggtcagttgaaacaacaaattctaattggtaagatatcatccaggaaatccaggtttttggtgcccaaatctggacctggacccagatttatcggcgtacattcataaattttactgtttaaacaaaaaattttaattaccaaggttttgtcacgaaaccatgccgttctgtgggcgaatggcgccggtcatttcatgatcaaagacacgcgctcatcaaacggcacattcatcaacaacgaacggttgagcgccagcggggaggagaacgagccgcgcgagctgttctccggcgacattcttcaggtgtttatttattacgcctgacatatcagttgagtccaaaaaaaaccgtggcaatttttcataatggcgtctatccctgaattgttcggtttacatccagaaa

SEQ ID NO: 78903 - DNA, 336 bp, Heterodera glycines
  Genomic contig location: Contig_ID=SeqID_14769; Location=454..789; Strand=-
  SCN-specific regions: Sequence locations=1-173,269-336
atgggaacaaagccaccggtgaccagcaattgtcacaacgacggcaacaccgaaattggcaaggcggcacggagggggcgagtgggggctgcaacggcatcggaggagggtgccaaatttgttcgggcgacggggcgatgggcggaggagaagggaaaggagcaactactggcagggggagaggaggcggcggagcaagaggaacagcagcaggatgaggaagaggaggagaaggaggaagaacaatgggaggaagaggaggaggaggggcgtaaattggcgacggaatgggaggagaggccggtagaaaagcagcagcgggagggggagggatga

SEQ ID NO: 78904 - DNA, 4352 bp, Heterodera glycines
  Genomic contig location: Contig_ID=SeqID_14770; Location=1..4352; Strand=-
  SCN-specific regions: Sequence locations=1-44,66-104,126-134,156 -655,681-786,823-844,882-946,973-1126,1148-1333,1357-1387,1419 -1542,1564-1744,1768-1896,1918-2184,2208-2245,2267-2378,2400 -2405,2430-2774,2796-3083,...
  SCN-specific regions: Sequence locations=...3105-3419,3442-4030,4053 -4169,4191-4297,4321-4352
tgattagcaccagcaaccggaagattcggctgattagcaccagcaacaggaagattcggctgattagcaccagcaaccggaagattcggctgattagcaccagcaacaggaagattcggctgattagcaccagcaacaggaagattcggctgattagcaccagcaacaggaagattctgctgttccaaattgggcggtccagctaaatcgaggcattttctgttcgatataatgatatcgttttaaaaataaacctgaaaggcgtgcatatatttgaaaaagaagtgcgtttgtacgctccatccgttcagtgtcggctctcaaacgctcgttggacccgatcagacgataaaccgcataacgcattcctaaattttgatgttttcattaagatattgaaattaatttcttagtcaaccacaacaaaacttttagcctaaattcaaattttaatatgcccgaacatctttagtaagacgaacgcaagaacgaggcgcactcaataaaaccagagcacgctcatcctgggagtccaactctcgaatgtacatcactaattaaaacaaggggttttcccttaaaattgtatttttgtgtagtatcataaattgacacccataattatctattattagagtccggtaaaaaaaaatttccgggagcgggagcgggatcgggagttcaaaattttccgggagcgggatcgggaatcccgtgaaaatcccgctcccgttaaaatcccgcagaaattttacgggagtcccgggcgggagcgggagtaattcgaaaatttaattaaaaactaacaaaaatatttttaatgcacaaatttgaaggaaaatccttttattaaagaaaaaatagataaaaaaatttataaaggagaaatttgaaataaaaaaatcacatttatgggtcgaaaatcagtattttttcaaattgcttcaaataaaattttttaataatttatttgttgactccctttattaattttaacaattttttgcggcttattttttgaaaaaactttttggtgaccagggaggaagagggagccggcggtgccgataggcgccgccgagaaaaaattgatatttgaatacaatacagtgtcagattatgtccaaaaatagccaatttttgaaaatttgaggcattttttaagaaaattaaggattttaagattccggcggtgccgatatctattatattatttgagaatgtctttccgaaaaataatgctttttccgaatgaaaaaatgagttttttttgaaacgaaagtttctttcaaaaaattgttatgaaagaaattcgtgcgatattaaaaacaacaaaaggcattaatttcttcaccactgaaatttgtttatattgcataaatttttcattcattatttttatctttaaacttgcctttattaaaaggcattggccatcaattaaaaccttttagaattgggaaaatatgctttttgattctgcatttaaatgcaaaaattctctcaccaacgtctaaaaagctttatttgtataaaatggtatttattattttggtgttaaaaaattagatgtaaccttttagttttttaattcctttttggcacttttagttttttaattcctttttggcaatcttttatttcggtatatatctttttttgtttgttttttcgcttatttaattaactttttaaacattgtgttttttaagcgtgaaattttctttgtgctaaaatggttcgacataaacagaatttaaaagttgatgattcttcgccaaccacatcatcatacctgaatatagggttcaaagctccgtaaaaaaaagcggtaaagtgatagaaacggttccaagctccgttcaaaagcggattgaatttttacaagaaagtgatgaaaattttatccaaaaacatgcgataaaaagaaaggcatatataaaagaagttattgatttagacaatctccctgatgagttcttatctattaatatgaacaaagaaaaaaatgaaagaaaccgagagtatgatagaaatagaaaaataccgcgcatccaaatgagtgaggaacagagaaatgaactaagagcgatggatgctaaggttgttaaagcacgtagagatagaattaaagaaggtgacttatatttaaaagcagccgaatccgatgttctacatataggtgtttatggtcttggagaattgaatataaagtgtaatcattgtccggccattcattttccagaagaacgaaacaaaccaaagggtttaaacgaattttttgaatgttgcaattatggaaaattaagtaatttggaggatttgctgcaagaatatcctataggtttaagggtattatttcaacctgaaatcgacgaaaataattacacaaaaataaaggatttacacaaaagttttataaaaaatataagaactttaaattcttctttttcatgtgcttcgttgggttgtatgaggtctaaatttcctgataaaaatgttccgatttttaaaatacaaggaaatatttatcattcttataatgcagttgcccagccgaataacgatgagttaccgacaaacgggcaattgtattttattgacacagaccaagcaattgattttcgattaaacatgttgggtgaaaaatcctctgattcaaatgataatataattgaaataattgcatatgttgaaaattatgttcgtgaaaattatgtttactcgcattcatacgaaatgatgaaaaatgtctatgaaaatgcggtagaagagacaaaaaacatgggcacaaatatccccgaaattatgatgttatttgatattcgtgaaggtacagatctaaggcgttataatattccaaggtctaacgaagtatgcgcaattctttggcgagatgcaaatgatgatattccagcggcaaatattgtagtgcatataaaaggaagcaaaaaaattgaaaccattttccctttaagtccattggtggaacctatgtgttatcccctattttatcctaataattaccgagggtggcattataatatgaaagatacaaacaataaaaaaatatcgttgtgcgattttacaaaatataaattatttttctgaaatgaaggaaaatttttgcctcatcattatggtaatagactttttcagcaatggtgtgtcgaccaggctgccagaattgaatggagtagcttaaattacataagattacatcaaaaagaaatctgtaaagagtcgtataatgcaattgataaatttttcaaaggcgtgtttagcacgtggattaactaaagacgatgatgaatggaagcattgcttaaatgaagcaagtcagttcaggtttccagcagcgttaaggagtttgttcacaagtatcttattgtatggtgacccaaaacaaccagaaattttgtgggaacaatttaaaaataatttatcagaagatttcttaattaaaaagcaaccaaacattgcttatgtattggctttgacccgtatcaataaaaatttattacaagaggggaaatctttgaaagattttaaaaatttaccccaagaaacctctttaacagaagaaaacgagaatataaactatgaagaagaaaagaaaatcgcagaaaatttgtataagtctatgaacgctgaccaaaaaattatttacaaaaaaataaaacaaatagcatcaggcaaacttaatcctaaattaatttacattgatggcccgggtggcacaggcaaatcatttacattgaatgcattatatcatttatagttataaaaaacatatgacaaacatggcattttcaggaattgctgctacattattaaaaaatggtagaacaatacataatcgatttaaatttccgcttaatcttaatgctcatattatttctggagttgttcaaggcactaaagctgccgaagaaataataaaaagtgatttttttgttatagacgaagcgccgatgacaccacgatttgcacttgatgctatcgagaaaaaattgcgtgaattaactaactgtaaacaattatttggtggcaaaacaataattcttgcaggtgattttagacaaacgttacctgtaaaaaaatttgcagtaagaagcgaaattattgacctgacaataaaaaagtcaatattttggagtaaatttgagcagatgaaattaacaataaataatcgggctaaagaccaattttcgctgaacagatacttgaaaatggtaatggaacttttggcgagtctattcaattacctaataattggatcataggcaacgattcaatttaatagatgaaatttatgatgatggtttttaagaacggaattttaatgaatt

SEQ ID NO: 78905 - DNA, 762 bp, Heterodera glycines
  Genomic contig location: Contig_ID=SeqID_14770; Location=3987..4748; Strand=+
  SCN-specific regions: Sequence locations=1-211,233-241,263-301,323 -361,383-421,443-481,503-625,647-716,741-762
atgcgttatgcggtttatcgtctgatcgggtccaacgagcgtttgagagccgacactgaacggatggagcgtacaaacgcacttctttttcaaatatatgcacgcctttcaggtttatttttaaaacgatatcattatatcgaacagaaaatgcctcgatttagctggaccgcccaatttggaacagcagaatcttcctgttgctggtgctaatcagccgaatcttcctgttgctggtgctaatcagccgaatcttcctgttgctggtgctaatcagccgaatcttccggttgctggtgctaatcagccgaatcttcctgttgctggtgctaatcagccgaatcttccggttgctggtgctaatcagccgaatcttcctgttgctggtgctaatcaaccgaatcttcctgttgctggtggtaatcagccgaatcttcctgttgctggtgctaatcagccgaatcttccggttgctggtgctaatcagccgaatcttcctgttgctggtggtaatcagccgcagcccgctggtttgtcatttctcttgattttaccaatctccgctcatttcttagcattagcacgttcttattggcaaacaaaaaaaaaatgaattaaaaattggagtttaaaatttcattttattatgatttgtcagtccatccaatttggcgtattttagtccaagatgctggactagtggccgctaaccaatacatgcatcttctttatggtgtatgtttgtacatattgtattattaa

SEQ ID NO: 78906 - DNA, 1312 bp, Heterodera glycines
  Genomic contig location: Contig_ID=SeqID_14771; Location=317..1628; Strand=+
  SCN-specific regions: Sequence locations=1-147,208-350,375-581,603 -1039,1061-1075,1145-1160,1182-1312
  Gene Ontology: Mol. function=structural constituent of cytoskeleton; Cellular component=cytoskeleton; Biological process=regulation of striated muscle contraction
agccaccgatcaaatatgtgttcttgacaccattgccgaacaccatggagatttaccgcaccaaacaaggcgtattgacatgcaaattgaacagtgccagggcaccgttggtttggcaaagggacggaaagccaatcgatgtgtaagaaaattttaattaaatcattttaattgtattaaattatttatttcaaataattaaataatccaatttcagtgatgatccgcgctatcaaattgagaaggatgcggccgggcgcttcacgttgaccatccgtgttgtggaacaaattgaccaaggcatgtggaccgcatttgtcaacaaagacgtgaccaggtgggattttgcgaaatttttaaaatttttatttattgcgcagagcctaattttgtacgaaagtcctaaatttactcctgaggctatcttttttgccttttttttgctattcgcacaactttttttttgcctttttttgcggtcattttttccataagccttatggtgaatatggagtcggcggtgccgataggcggataggcgccgccggggaaattttttttttttggattaatgaatttgttaacagatttcttccaaaaatacctaaattttgcgattttgggctatttttaaatatggcaacaaattttcagcaagtgccaagtgtatgtggaggagccccgtgacacatttgttgtgccgttgaaatcgcagcgtgccaatgaaaaggaaaatgccacgtttgaatgcgatgtgaacgacaaggacatcgatgtggaatggtttcatgacggtgccaagatcaagatggacgggcggcactttaaggtggggaggaggaggcaaatctcttttgctaatcaaagaatacattcatatttttgggttatgaatgatttattttcaaaaaataaggagttatttttttaaatttttgctattcattaaatcctaaaaatccctaattatggatatattccaaaatccaaattaaaaataggtcgaaattcttcaattcaaatgtctatcattgaaataaaaaatataatattagaaaatcacaaataaaacgagtttttattaattttataaaaattttttatttaaatttttttacattatttaaaaatttactttttttttgccaaatttaattctgttttttcctatctctgttttattgcgctgcttcttttacaggaagaacgggctggacgccgtcgtcgtctgctgatcaccaatgtactcattgaagaccacggcgagtacaaatgcaccaccaaagacgacaaaacaatggcccaactcatt

SEQ ID NO: 78907 - DNA, 1118 bp, Heterodera glycines
  Genomic contig location: Contig_ID=SeqID_14772; Location=195..1312; Strand=+
  SCN-specific regions: Sequence locations=1-417,439-643,700-724,750 -987,1046-1118
atgcccggctcaaagtacgagtgccagtcgcgcagcggtgtgcacacaatgaaaatctccaagatcgagatgaacgagggggacaagtacgagattgatgttgccggactgcgcggcgcatgccgcatcaccgtgttggaagcggagcgcaagccggtgatcaagtggaagccgcagaagtttgagtgcgaagcgggcaaggagaagcggatcaaagtgccgtttgaagtgaagggcacgcgccgaggcgacccgaagccgattttgttgcgaaacggaaagccggtggacttgaacaaaatgaaggaccttgttgaggcgagtttaaaaaactctgggcaaaatcgctattttgtaagaaaattggaccatttattttgaaattttaccaaaaaaaaatgtttgttaatttagcgtaaaattttttgaaaatttcggaatgattgacatgttctgagagtgttgataatcgatgccccggtgaaattttgaaaatttataccgtaaaattttgaattatttacaaatctaagagtcttgataagcgctggcgaggaaaattctgaaaatttttacgaaaacccaataattttttctgctatttttgaaatggtgaattattaagagttttattcttttcttgaaattttcttataaaaaaatttttaattttatttttacatttctatttaaaaaattgttacattgcgttatactgcttgaatttgttgtatgtttgttttgttttcaggtgataatcaacggcgatgtggcagagattgtgttcaagaatccgcagaagagtgaggcgggcaaatggtcactgcaattggagaacaccggcggagtgtcggcggcggcaccctttgaattggtggtcaaaggaaagccgaaaacgcccaaggggccgctggacacattggacgtaaagtcggacagttgcgtaagtagtttttgttaaaattttaagttaatttaattatgaacatcgattaatgagttaattaatttgcctaattaattgattgattgaacttgattaatttggatttcagtctactaattgataacttcaattacgtttaattgattgtaaatttgcctttgaatctaatata

SEQ ID NO: 78908 - DNA, 790 bp, Heterodera glycines
  Genomic contig location: Contig_ID=SeqID_14773; Location=487..1276; Strand=+
  SCN-specific regions: Sequence locations=1-140,320-326,499-516,579-790
  Gene Ontology: Mol. function=structural constituent of muscle; Cellular component=sarcomere; Biological process=regulation of striated muscle contraction
cccctccggcgtttaccgctggtggcattcaagaccaacggctccgtgtcggtgagacaatcaaatacgaagttgccatttctggcgagccgttgccggctgtcacatgggaggtcaacggaaagccattaaaggcgtggttttgttgaatttgttaaatttaatgtatattttaattttaattttttaatattttaaattatttaaaaaaatatatatttaattttgaatttatttaattaaaaaagtaaattaacttttttaaataacttcaatttgtttaattcaaaaatgtatatgttttctttaatattttgaactttttataatttaattatgtatatttaattatttttaatttttaaatattattttatttgagaaaatttatttttttcttcaacattttgaatttatttaattttaaaaaagtaaattaaaattttttaaataatttaaattagttaaattaattaaaaatgtattttaaattatttttttaatgttttgaatttcaaattaaaaaatgtatatttttttaatgtttaaaatttatttattattattttttttattaaggccggtggacgtgtgaaaatgaccacggagaagggcaaaactgtgctgaaaattgaagacgctcaacgcggcgattccggcaaattcacgatcaaattgaagaacaaaagtggcgagtgcgcatcaaccgcaaatgtgacggtggtcggacggcccgaaccgcccaagggaccgctggaagtcagcaacatcagcgcagatggagcggtgc

SEQ ID NO: 78909 - DNA, 1394 bp, Heterodera glycines
  Genomic contig location: Contig_ID=SeqID_2286; Location=969..2362; Strand=-
  SCN-specific regions: Sequence locations=1-5,28-275,297-366,395 -486,508-796,818-826,864-884,907-931,953-1045,1067-1394
  Gene Ontology: Mol. function=protein binding; Cellular component =nucleus
atggacaacatgttcagggtggtccaccagcagtttcctaacaaagcctccttccacgaactgcgagccctgtaatattttttaaattttttgaacttttcatttttctcctttttcagttaccccgatttgcagcgccgttttcagcccgagacaattgacaagcagcgcttcaccaacgagcagggcgagttggtggaaaaattcaaaaatgaccgtctgctgaacagctacgaactgctgttgtgccacaaatgtttcagctacgattgcattatgcacaatggtgggaaaaaagggacgcaatatcggtttggggcagacccttctaccttaaataaaaaaccaattttttcaagaatagtcataaatttttaaaaaattataattttttccattttctttttcccgtggcacactttgggatcaccggacataattcaaaatcaaaccaaaaatctcaaagtacttaatatgtcctttttcgtttccaacattctccaaaatgttttagccgcaacatcgaatggttatggcaactcaaaaaagttgcgcacaaaacgccaaagcagcagcggcgtaagccgtcacagcgggggcaaagagaactgctcgaagctgaggcggtcatgctcggccaactgctacctgctgagcaattcgagcggagcagcacaaccggcaatggcggccatgccacgggcggtgggaaaaagggcagcaacaaattgcagcaaaaagttggttttgtctaattatccccgtcgggattaatggcagtttgactacagaaaaatatttcccctttcatttctccgctcccatgaaaaaattatagaaattttaaatttttgaaaaaaaaacttgaaaacccgaaaagtatataaatttactaatttctagaatatttttggtttaacattactaggaatttttctttgttttcaaaaattagaatttctggcgagaggaaacgtagggcggaggggggggggggggtaatttgccggaaatgctgaataaattatcttaaataaatggactttttcagaattcaatagcttctcgtccacagcaacagcagccgagcatcgccatcggtggcacggcaccggcggacagtgccaaatggacaccccacgaagaggccattttcaatgtgttgcgcagcaccggggaggaggagttctgccgaattgccatgtgaggaaaattttttcaagagtttttcatccaacctaattttcttacacaattgtttttttgagaatgctcaacttgagcctgggcgagacggcgcgcaaaaggacctgccaagaagtgtacgaatacgcgtgccgggcggggccacagtcgacaaatggggagtcgtcgtcgcccgtcaaaaatgccaa

SEQ ID NO: 78910 - DNA, 330 bp, Heterodera glycines
  Genomic contig location: Contig_ID=SeqID_2288; Location=1801..2130; Strand=+
  SCN-specific regions: Sequence locations=1-275,298-330
atgccatcaaaaaagtgcacaaaatgtgcgattgccatcaatgacttgaacataaaagagtcgcaggaaatttcgtcttctgtcgattcggtgccgaaattgctaccgtttttctacggcactctgctggcacttttcatgacccaattgggcgcaattttattcaaccattcccatttgggcggactgtcaatgttcgacaccatttttttgctaatcgcacgtgctgacattgcccaagtgcacaaatggatgtttgttgtgagctttttgttgcgctttcttcttcagtcatctggagtgcatttccaaggacaattaattggctaa

SEQ ID NO: 78911 - DNA, 74 bp, Heterodera glycines
  Genomic contig location: Contig_ID=SeqID_2288; Location=2689..2762; Strand=+
  SCN-specific regions: Sequence locations=1-74
attgatcactcttcttgacccgtatttggctgtggggatgtgcatgtcattgtgtttcacagttctaccaattt

SEQ ID NO: 78912 - DNA, 477 bp, Heterodera glycines
  Genomic contig location: Contig_ID=SeqID_14774; Location=142..618; Strand=-
  SCN-specific regions: Sequence locations=1-331,354-477
atggacatagcatcctcatcttcgtcggcattggtcgacaacaaggctcttcttatggagcgaagttggaccgcttgtcggttgatcagatgaaccgagacgtctatgctgtcgaggaccgcctctctgagggctaacggagccttgtccagagcttctccaatttctctctttctctgttcagtccacccgatcaacgccttttgctcaatggcatattggcgattgttgacaaagcaatgtgcgcagttgaccggacgaaaaccgttttttggggggcggtggatcgacagaaggcggaggcacggctgggcgacgaggcgaaacgaacggaggacgatgaggagggagacggagttgactggcgcctggcggaacgaactggcgagggggacagcagacggcgacgggcgagcggccgatttggcggtgacggcgttgacgagcgcatgacgggacagaccggcgctggcgagg

SEQ ID NO: 78913 - DNA, 171 bp, Heterodera glycines
  Genomic contig location: Contig_ID=SeqID_14774; Location=1641..1811; Strand=-
  SCN-specific regions: Sequence locations=1-115,138-171
aaataattatttgcagggttggggaattgaactttagaagaaaaaaaaggatggaagacataaccaccaggccacgacgctcacactggctttacattctttgaaaatgatattgaaaaggcaaaaaggaaaagcttcatatctcggccagaagcttcatttagcaaaaat

SEQ ID NO: 78914 - DNA, 1750 bp, Heterodera glycines
  Genomic contig location: Contig_ID=SeqID_14776; Location=335..2084; Strand=+
  SCN-specific regions: Sequence locations=1-889,1057-1315,1337 -1487,1518-1570,1600-1750
atggacgtgcaaaggctgaaccgactgcttaaagtggtcgaccgcgcgtggactttgcccaaatttggctcctcggagcccatcgggtccaatttccaagtgaatgaatggaagggtcactttggaattccatacgaagcaaatgccttaagtacaagaagacatgtgccagcatttacaaggcgaggtgagtgagaggggggggggggagggacaaacggcatttttgaaacgaaggcacaacgcatgcgagcaggccgggtttggcattatgtgcttcaatttttggtgggttggggggggggcgaagtgtgtactgtttgaaaaagagggccaaattcagttatgagaaaggtgcgttgggaaggcaatgaatggcattcgattgttttttattgtgaaggcgaaaagttggcgttcaaatgcgaagatgcgagtgaaccgaatttttgcaaaaacaacggaaattatgacaatttcctgaacaaatacaaaaaggacgcgtacagagtgagaattcattttggaaaattcaaaaaaagcgaatgatcgaacccaaaaaggcaaagacgtacatccatcaacagctgacgaggtgagcccaatcggaaggaaacggcgaagaaacccaacacgaacagatgctattcatcagcaatttgtgagggcgcacttttgaacagcaaattactgcccaatacaaatgaaaggggacaaaaattgcagagaaaagtgagggattggcagagagaaagagtgagggagacacaacgcaaattcagcaggaaagacgacaaaggatgtttagagagacggcggaagatggcgcggaaatgggcgaagaaacaatcacaaaaagagtccctttctggcagagacttatggtgaggaagagaatggaagataagggacgaagggagaaagagggggacgaagaaagggcagagaaagagagggaagaggagatacggtggatggagaaaagatacggtggaagaagggaaacagaagtgaagagtacggaggaaaagagacagacagagaaagaggaggagatacggtgggcggataaacaatacggtgggagaggggaaacggaagtggaaagaacgagagagagcgctgattgggacgggcaaaggtgggaagggacaacgggcaaagttaatgcgaccacttttgagttcgttggaaagcacagccttctcacgcagtttgactcagttaacgccagaaatgcacgatcacttacaaatgaagcgaccatcgcttaatccccggactacggaacccaacgaagtgttgtggaggaatttccaaccgggaaaatggtttctctccgagtcctcactttcgattaaatattttgttaaggtttcaatccgtacattatatgaccaacacaggctgatcaaacagttcaccgaaagaatatcagaaattacttattccccttacatacgggtggaaacagaagaaccgagcaaaaaagcattaattaaaaatacaagtttatcgacttctgttcgttattattatttttttggaaatcatttttatcacacgcttctaaactaacaaacaaacaaaaagaaatcatcaaaatttagaattattgggggaaggggaaaattgaatttggatgcgattatttgtcagctaacggttgctaaatcccaaaaagtgacttttccgataaccaacaattgggccagaaacatcgaactcgaaataatcactgttatcataa

SEQ ID NO: 78915 - DNA, 661 bp, Heterodera glycines
  Genomic contig location: Contig_ID=SeqID_14776; Location=2252..2912; Strand=-
  SCN-specific regions: Sequence locations=1-8,30-384,406-661
  Gene Ontology: Mol. function=ATP binding; Cellular component =cytoplasm; Biological process=protein amino acid phosphorylation
gttgcaagtggcaagctgaagaaggacaaggatggaaattgggagttcgaatatgacacttcggacgaggaaaattcgtcggaccccgaaaatgcgaccattcagcaaagcgcaagtggggaaagaccaactgtctccagggcatcgagcgaaggcaaaggggaggaacaaatgccgccgcttcaaacactgaacttggtttacaaataggaagcattttgcaaggggccgaccttccgtttcctaaaggttttgcgggttcggaaccagcaaagggaactgaacgacatcaaattcgactactctccgaatgcggacagtgtggacgggtcaatttttaaaaatcaaaccgaataacggaatacgctccccctgacaagccgaatttaaatatttaagccaaatcttccagaattgctcacgaactcgtcaccgccgaactcatagatggccatgatctcgtcgtagtcgcggccaaccttcagaaactgatcgacttggcccagaaaaaggcggaaagaaggacgatcactttcgctctcaagtgaagcaatgcccaacgtctttttccttccaatttcgctttagttccggcgttgcatccaatgaaattcccgacgaacgttctttgaccggttttgctcagctttcactgttagat

SEQ ID NO: 78916 - DNA, 858 bp, Heterodera glycines
  Genomic contig location: Contig_ID=SeqID_14777; Location=1103..1960; Strand=+
  SCN-specific regions: Sequence locations=1-186,208-338,375-412,435-858
atgtcttcgaaaattccgtacgtttttcttacatcgtattggatctctttaatattggccggagttgccaagattaaaatttcccatggaattcataatttaatttgataatttaccccatcgatctacgccactaaaacttcataataaaactgaaattccacatttggctttccttttgcttagccactttctttgcttttccattccattcattcatttcccaaattcattttcattggtactttgtgtctcttctgttggtcggctgtggcaccattctttggttcttttgggacaacgtcaaaaaacgacgacgccccaacaaaaaagaaatgtaaaaaacaaaaattaaattaataaatcttttttttcagcttcatctctgccgactgttggctcgaagtgttcgctttacttccgccttctcagcttggcctcggaatcgctctgatcagtcgccgattttaccgccgcgtggacaaacatttcaaagcacgcaaatggatattggacaccgaattgcgaattcaagagaaagagctatggtttggcaggaagcaaatggaaattgtcaatgccaattggaagcgtttgccaatcccacaaaatctgttgcccaacaaagtcatcggatttaaacacattacgttcatgtaaaattgacaagtttcccattggtttgagataacttttgcttgttttagttacttcgaccacaatattctcacatttgtccgccgttttcaccgctttttcacttcaattacaacatctttgggcattatgagtgaaaatgttcgcatttttgagttcttcctgtccaccatttggccaatttttggtgactccattcaa

SEQ ID NO: 78917 - DNA, 667 bp, Heterodera glycines
  Genomic contig location: Contig_ID=SeqID_14777; Location=2914..3580; Strand=+
  SCN-specific regions: Sequence locations=1-463,485-586,608-667
atggaagaatattttggtcaggcaagttttcgaaagagaatgttggcacaaggccaccgactgcgagaaagtcttgcctgtgaaggcaacaaaaaccggattttggctgaaactgcattcggtttcggcagaaatgaaggaaattgtgaatttggggggccgtcagtgcattccaatttcggtgagaaaaggatcgaaagatccgggtttgaaggccgaacagagcaagagaaaaatttggtagaaaggctgaaagctgaattggtaagagttaaggccgaacgagacgaagccaatgcaaaaattgaaattttgcgagagaaattgtcggacagcgaaaaactctgtgttttcctaaaggctgaccacaaaaaagtgctggcgcaggcagagaaagttcggaccgaatcgaaggcgatagaaattgagctgaatgaggcaaaagaaaatttggaaatggcagaagaggaaaatggccatttttcaattctttctgtccaacagaatttgatggtgcaggagcaaggccgaaaaataatggatttgattgaagaagttgaagaattgaaggccaaaaagaacgccaaaaagaaggagaaactttccaaaagtcccgaacaccaaattactgaacccaaaaaattaatctccaaatcgccaccgaaaa

SEQ ID NO: 78918 - DNA, 157 bp, Heterodera glycines
  Genomic contig location: Contig_ID=SeqID_14778; Location=1768..1924; Strand=+
  SCN-specific regions: Sequence locations=1-157
atgccaagaaagcgcgtgccgcaattggacgagccggacttgtgagtgacgcgcgaggggggggggggggcaatttgtacactaattgattcagtgtctttttttaatttgccgatttttcaggcacgctatgcaaatgcgcggaacaaatgcatga

SEQ ID NO: 78919 - DNA, 601 bp, Heterodera glycines
  Genomic contig location: Contig_ID=SeqID_14778; Location=287..887; Strand=-
  SCN-specific regions: Sequence locations=1-358,380-546,569-601
cgaacgcgtcgcgcgacttccaatactgcttcaactgctgctactgctggccgtggtcgaagccgttcaagaaatacggcgggtcgtcgttccgcgagcaacaggagtagagcggcatcgagcaacagggacagagggacgcgtcgtcgttcgtcacgcgccaggaacgcgtcgcgcagaggccaggacagaagcgggacgcgtcgttcgtcttccaccaggaaagcgtctcgcagaggccagggcagaagagagacgcgtcgttcgccgtccgcgaggaaaccgccgcgcagacgtcagcaggacagaagcggaacgcgtcctccgtcttccaccagcaaagcgtcgcgcagacggcaggacacagggacgcggcgttcgtcatccgccagcaggaatgcgtcgcgcagacgtcaggacagaggcgggacgcgtagttcggcatccgtcaggaaagcgtcgcgtagacatcgtcggcggattgtgccgcgcaaatcgaagccgaagaagcggtccaagtcgaccaagcggcgtggacgtggacgcccgcggaggtcaaggcgtggctacagacgcccaaaagatccgcatacgcccatag

SEQ ID NO: 78920 - DNA, 374 bp, Heterodera glycines
  Genomic contig location: Contig_ID=SeqID_14779; Location=1922..2295; Strand=+
  SCN-specific regions: Sequence locations=1-50,72-313,335-374
cctttttgctgcaactcaccagtgccgagaacacccgccgccgactgctgtttttgtgtgtgccacttttttgcgttgtgttcgttcgctgccgagccgagacgactccgtcctgacgacgtccgcacaaatggcacggaccggcaccagcagggagagggagagcccgagatgtgtgctgatgcgacagtacgaaatgctgctgcaaaactcgaacgacaacagcggattccgtgcctggttcgacaataacaatgtgagagaagcgaccgaccgactgagtccccacccgtccctttcagtcccacaatcatttagtcttttcagctcttcaaatggcgcattctcatcgacggtccgccggaaacgcctta

SEQ ID NO: 78921 - DNA, 517 bp, Heterodera glycines
  Genomic contig location: Contig_ID=SeqID_14780; Location=105..621; Strand=+
  SCN-specific regions: Sequence locations=1-72,94-242,267-318,364 -474,502-517
attttgttccgcaacgacccggcacaatacagggaggaagtgcgacggcgcgtggagagggcatcagcatcgacaccgcgagcgaggtcgtcatcaacaccaccgccggtagcgcaaccgccgggagaacagcagcaggggacgccgccacaaccgccggacggacaggggatgcaaccgccgggagaacagcagcaggggacgccgcaaccgccagcgacaccgccgcaagggcaagaagcgccgcagcagcaacaacaacaaacgggcgaatggtacctttgatgtgacgtgatgccctctgcgtgatgatattattatatacttatgtatgtgtatatgtattgtattgtatgcatgtgtctgtcgtccgaccatttcattaattaatggtctctctctctctctctgtgttcgtttgccctgcttttgttcgctgttgtacatattatgtgtattgtcattatccaccaattattgtatatatatgtgtgtacatatgatggtgtatcgagca

SEQ ID NO: 78922 - DNA, 1489 bp, Heterodera glycines
  misc_feature (1460)..(1460): n is a, c, g, or t
  Genomic contig location: Contig_ID=SeqID_14781; Location=344..1832; Strand=+
  SCN-specific regions: Sequence locations=1-127,149-164,186-752,777 -978,1015-1190,1233-1270,1293-1302,1325-1489
acatcaaaaagaattttggacggcgaaacaaaattggcactaattaatgagtttcacaaaaggaaaagagaatgccaaaaaagggaaaagaaactcaagaaaaattataacaaatacaaagtaaaaattgagggagaaattgcgcgggatttgggaacaaatcgtaaaatgatttacaaatggaagaaggcattgggccaaaaatgtaaggaaatttaaagaaaacagcaagggtaaggggagggggtggggtgatcaggttcgacagttccaaaaatactttgattttatcagggtttttcgagtcatcgaacggcccagaaaatcgctttaatccctgtatatcaactgagtctgaaatctcgatttccagatccaattttcggtctcgagtcaaaagaaatattctgtccgaattagcaataatcagcagttttacacttctttagggaaatttggaaaagatgggttaattcgagagaccggcacgatcgatttttgattcggtctttttcgattttgttcgatctttttttagattttgtatcaaaaaaccaatcgaaagaaaagaaaaaccaaaaaaaccgagcgaaatatttttcgcggccaaagcgagaggggggggggcgtagcggaaaagagggaaattctgaaaaattctgctaattcacttccccggcggcgcctaacgaacggcaccgccggaaattaattcctttacaatgaattcaatttttgacaattaatttgtgtaaatttattatatttttaaatttgtttaggcatcccaaagccacaaaactcaaaaaagcataaactaaagataatcaaaaaatatgaaactgttagaaaggaatttgaagcaaaattcgatttaataatgccgaggaatgtgtcagaaaaagttgcgcataaaatcggcgtgaattataacacaatttacagatggaaaaaggaatttggtctatcgagtaaatgaattttacattttttaaataatttgtaaaattaattcctttttaagggaaaaggcgttttagagattccgaaaaattggaattagtgcgaaaattcgacgaaataaaaaggaaaaaccgaatgcttaacagtgacagagtcgcagaaacattggcagttacgaaagaatcaatacgaaaatggagaacagagtttggcatcgaagcaaagtgtaaaatttttaaaagcattttaaatcaatttaatttaattttgccagatttaaatttagggaattgcaattacaccgaagaggagaaaatgaaattaatatgcaaatttgacaaaataaaagggaaaaacccaaggctgaacagtggacgtattgcagaagaattgggcaccacgcaaaagtcaataagaaaatggagagcaaagttaggcacaaaatcataagtttgaagcgaagaggaggaaaagcaaaaaaaaaaacgcaattttanaggacagtcttttagaaatgaattttaaa

SEQ ID NO: 78923 - DNA, 530 bp, Heterodera glycines
  Genomic contig location: Contig_ID=SeqID_14782; Location=284..813; Strand=+
  SCN-specific regions: Sequence locations=1-307,329-349,391-530
atgcataaattcaacgagttactagagaaagaagagttgtgctttcattattcaaatcctccattatttacattgtattatttttcgatactaaaaaccgaaataacaaagtaaattaattagtttaaatgtgttcgttcagctgctgcctcatcgatgaagtgaatacaaattggatactaatgaattgttgaccgtacttttccgtcggaaatatttgtacgctattttaagcaaaaaataagccaaaatccatctgctgcttatgaaaggcgcaccatttaacccaactttgtctttcggctccatcattcttccatatttttatctaaattatgaaataattgggaaaaacaaataaaattctcagaaatataaaatataatttaacgattaatgaaaagaccttttttaaatttacaacttttacaatgaaaagcttagtgaatgaagcaaacgaatttaatgaggattgtccgtccttcctttctcaaccgtaaggagaaaacacttttttttctttaaaggta

SEQ ID NO: 78924 - DNA, 288 bp, Heterodera glycines
  Genomic contig location: Contig_ID=SeqID_14782; Location=1745..2032; Strand=+
  SCN-specific regions: Sequence locations=1-245,268-288
atggacgccgactcagttctgcagcccgtctttatcttcgcttttgctgccgttgagcttctgatcaatttggtttgtgttcccgtgtcggccatcaacttctttctcgtcgccaaaagttcggtgatccatccgaacctcaaacacattctcatctatcagagcggaagcattctcggggtaaactgtgcagaaaatgaacaaaaagagcgcaaagactgtgctaaactgggcaattaaaaccaaattaattaattaattaattaaatttgtaaagaaattaattaa

SEQ ID NO: 78925 - DNA, 1213 bp, Heterodera glycines
  Genomic contig location: Contig_ID=SeqID_14784; Location=516..1728; Strand=+
  SCN-specific regions: Sequence locations=1-275,297-621,644-694,719 -741,785-919,947-1059,1088-1213
atggtttctattgttgataatccaattgaccacaaaaacattggtggaatgtcggaaaatttactttacgcactcgccgatgggtcgcgtgcagcgtccgatcgaacagttcctggacacgcgggtcggggtgagtgatcggtggcaatttggtcaagtcgaccgtcacattcggcttggcgcttaggtccaactttttcagcaggtcttttagaatctgtggcgacggatggtcattaattaattagtgattaattaattatttaaacggaacaggcaaatgtttccattcaattcaatggttgggaaagttagcaatttttgaaatcagaagccttgatcagccaaagtatttcatcagtttaaatgccaaatatttgcctttcaacgataatttctgatcacaggtcaaagagtgattagtcaatgcttcaccgattttctttttgccaaagtgatcaaaacccaactctgatcaatcgatgttttggcaatttgctcaatccaattgccccttgaaaatcatttcaaaagtttacttgctcctgccggattttcttcacttcagaaaatgtgccgcaagttgcgcactgatgggacgagcaaagaatggcgaggggcgagaaaagaagaaactgaagtgataaaatgggcaatttcaaatgaatgcaaggctttctcttttattgaattgtaattactttttaattttgattttactaaacggccaaaagaatttccaatttttttgaaaaaaataaaaaaataaaatttgtatttatatgtaacagaactgctcaatgaactttttggaatgagaacaatgacaaattttcttcaaaggaaatctactattaattaggtaattaattaattagccataattaaattatattaacagcaccagcactcggagcagaaacatttgttgttgttgtttcggtggttgtaacggtggtggcccgtgtttctttctttccaccggcaactaattacccctaattggtttgtgtttgtttacggcggccaaatgcgcaaagacagcgcattattagcatggaaatgcttcttcttgttcttcttctgtgtacaaattcacttaggtatctctctctctcttttggttcacaaattcctaacatcgttatacagtaccaatcgttcaaattgggcaaaaaacaaaatgccaaatttggaaaggaatgcgccaaaa

SEQ ID NO: 78926 - DNA, 561 bp, Heterodera glycines
  Genomic contig location: Contig_ID=SeqID_14785; Location=83..643; Strand=-
  SCN-specific regions: Sequence locations=1-301,326-334,365-561
  Gene Ontology: Mol. function=protein binding; Cellular component =cytoplasm; Biological process=response to pathogenic bacteria
atgagtggaccaatatcacgacagcataatttctcctcagtttcaaacggctgctctaaaaagcgaaaggatcgcccggctcacaagggctcggcactgcttagtgcagaagaaaattcgcagctatttgaagtgctcggccgtgacagaatttctctggtcgcgggtattgcccaactgctcgacgcgcctgcggagagcccgaatgtttggcgaaagactaacgttgggatagtctatctggtgaaggattatcgcgagaggaattatcagttgtgcatgtacgatattttcaagaaagaattgcagtggagtcagatactgtcagtttaattcttatgagttaatttttaaaatctgaatttagctccatttattgtatttcttatgtacttagttttttcagttacaaggattttgctgtgaattcttactcgaattgtcctcgtctgctcgtgtttgagtgtgacacctgtataaaggctctgaatttcacggattttaacgaggccgaagaatttaaagttgcaatggaaaaaaggagagaatccaatcaaaaaa

SEQ ID NO: 78927 - DNA, 110 bp, Heterodera glycines
  Genomic contig location: Contig_ID=SeqID_14785; Location=82..191; Strand=+
  SCN-specific regions: Sequence locations=1-110
cttttttgattggattctctccttttttccattgcaactttaaattcttcggcctcgttaaaatccgtgaaattcagagcctttatacaggtgtcacactcaaacacgag

SEQ ID NO: 78928 - DNA, 1689 bp, Heterodera glycines
  Genomic contig location: Contig_ID=SeqID_14785; Location=1609..3297; Strand=+
  SCN-specific regions: Sequence locations=1-150,202-362,422-882,904 -953,978-1182,1204-1488,1525-1689
atgacttgcagcacagaagagtcaaatgtcgcttggtggtcgattagtcagaaaagtgatttgttaagttttgcggatggattgatgacacattacacaagcatcgagcattcaaaggagattgacgtggagaggtggtagcagattggtgggggaagaagagagagaaaggaaaggagattggtgtgtgtgtggggagggagggggatgaaagtgggtggatgagtgatgattggaaattggtgagttgcgggaaagttccccactttgatcactatggagtcgggagacagaaaatacggctgttgggccatttctataccaaaaacgcgcaattttctcattatttctattttccacagattaatttattaaaattaaccgttaaataattcaacatttttaaattttttaataaattctttattctcctcacagctgatttgtgattgatcaaagctcccttacaaattagaagtgaaacaatgataatgataatgggatgaggttacgtaactaagaaaattatgtgccttgcgatagagagagagagagagagtcgatcgatttgtgagcccaaaaggatgaatggttgcccattcaataacctaatttttattgaatcatttaggttggtttaactgatatcattacaacaaacgaaaacaatactaatttgaacagcaaaattgcgaattttgaaaacaatatcctctcattaacattttttgtatctaaaacaaaatctgggtttgaatcgctgctgatcagtgatcacgactcgatcttgaattaaaataaaaaagtatacttcctctgctacataaaaatttgtaaatatggtttaaaaatattaggtttccaattacatatgaatgtatcctcccacaacgacaccacccctaaatagaattcatttcatttccctttccttgcctcatacgcttcgtagtcgatttttctttctttcatttctgccgcctttatctgtcccttccgcttcctgcttctcttcctcgcccttgtaattaaattccatcccctgcgctcgttttggccttccctcccacaaatgactgaagtgcctcccaacgcgcgtcgatggacactccattttggtggattggtggaagcggtcaatggcgcacacattgaccccagtggacgcactgatctactcaaagtgttggacagagccaaggcaaaaaaaaaacaaacaaacaacataaattgaccataacttgactaaattctgagcttaaaacaacggacaaaaaacctaaaagtccattggactcctaaagcgcaatagagccctaacaaataagttcagcgagacggcagtttgcaattggatggtggcgaaataacactgttggaatgcgattgcgattcagtgagagtgagttcagcgaaggtggacgaaagcagcaaacctttagcattcattccactccatcagctttcttctgtgaaattttgatgatgttttaatatatttactaaatttaatttatttaatttgaggttggctttgtccatgaaccaccacaaaacattttggcactgaaagttggtgacgtggatgagaacaagcccgatcagtttgatctgataattctttacacttcaactgaggcacgccaaacaaacaaaagatcggacgaattccttacagaacatttttaa

SEQ ID NO: 78929 - DNA, 177 bp, Heterodera glycines
  Genomic contig location: Contig_ID=SeqID_14786; Location=19..195; Strand=-
  SCN-specific regions: Sequence locations=1-89,111-177
atgggcccgaaacggacacaggcagaaagcgacttttgggaaggaatgtgtaaattggctgcgattcaaagcaaagcagaggaagccagtgatggaggaaagaaaaaagcgaaaagcaaggcaattagcagcgaactgcagcaaaaatggccaaaattggacaaaaaaatgccaaaa

SEQ ID NO: 78930 - DNA, 1593 bp, Heterodera glycines
  Genomic contig location: Contig_ID=SeqID_14787; Location=1..1593; Strand=-
  SCN-specific regions: Sequence locations=1-431,458-606,643-842,864 -968,990-1262,1303-1321,1343-1358,1386-1593
  Gene Ontology: Mol. function=voltage-gated calcium channel activity; Cellular component=apical plasma membrane; Biological process =epithelial fluid transport
tttagtggccgatgtgctatctgcggcaatgctctcagcgccattggtcgctccccatcatgaattgctcccacaccaatttctggaaaaacaatgcgctcgggagttggaaaaagctgccgaaatcgaggctcacgattgccggcgcatttgccggagggtggaggaattgtggctcggctctcattggtacgggttgctgcattggttgaactcgaattgcctgaaaaatgcactcgggaattgagaaaaagcaatcgaaagaaagacccaaaattaccggcacatttggtggagggtggacaatttgcggcaggtctctcagcggtatcggttttgcatcgattggaatcgaacaacctgacaaaccaagcgggcagaaatttgagaggacgcagcgagaatcgactctccgtaacattcgcaggggattcagggagggggtggggggggagggttgaggaaattaaaaaaaaatccgaaaaagtaaaacaaaaaatttctaacgaaaaaagtcttacaattagaaactcatttcaagacactctcatctaattagagtgcgacaaacatgataattaaaaatagtgtgtacatttattcttctaaatatttttttataaatttccaaatttaaattttccctaattattttgcctattttacatcttttcttaaagttctattggctggtcattgtgctggtgttcctcaacactttggtgctcacctctgaacaccatggccaggagcagtggttggaccatttccaaactggtgccaatctgttctttgtcgtgctgttcaccatggaaatgctgctcaaaatgtactcgttgggccttcttcaggtggcacttttatgcttttcaattgggcttttggcatttgttcaaaaggaacaaatgccaatcatcggcgcatgatttagccaaaaattgatgagctcatttcatcgacattcacagtcattttaaaagacacaacaactgtgttgactgctagggaccgagactgaaaaactgaaaagtcgagaatggatgattttgaaaaaaaagcactgggaaaaaaaatttggtccaaagagcaaaaaaaggtcttcggattttttctggctaggcttgggccgagactctcgagtagaaatacccaaaatcggatcggcaaataaatgattcttattacaaattgatcgggcttaaaagggtttaaaaaatcggagaattaattaaatctaaaaaccaattgctttttgggtaacttaaaaccattttaaatttgattaaaaatccaaaagataggtaagaactaagacttaatctaattagaaaagagtgcttaaatgcgaaggcatatcccgatgaatgagtgagtgagtgaatgattttgccgtgccgttgtttcagtacatgaacagccaattcaatcggttcgactgtttcattgtgatcagctccatcatcgagtttgtgctcgtctacttcgagttcatgaagccgctgggcatttctgtgctccgttccgcgcgtctgttgcgcattttcaaagtcaccaaagattggacggcactgaggtaaaaaaaaactgttgaag

SEQ ID NO: 78931 - DNA, 1227 bp, Heterodera glycines
  Genomic contig location: Contig_ID=SeqID_14788; Location=62..1288; Strand=+
  SCN-specific regions: Sequence locations=1-162,247-268,322-574,597 -711,821-828,1031-1176,1202-1227
atgccatccctggtgtggtggtctcaccgccgccgcccctccccccgccccactcgccgcgcctaccgtctgcgacttgaccatgcgacggcacccgcggcgacaccggcggttcatccgctgcaacagtcgccactgcgtcagcagcgcggacggtcgctgcgtctcgccgtcgctgtgctcgccgtcctcgtcaccgtcgccggcgcccgactcgccatgttcgtccgcgtgttcgtcgtcgcccaactgctcgatgtcctccgcctgcgtgatccagtccaggtagcccttgaggtcctcctccagctgctgcttctcgcgaaatttctgtatcaaattaagcttattgatcactttagtaacaaattcaatgcattgattgatcaaaatggcatggtttgatcgatcgaagaggatgaccaaaatgatcactttctttccgattgatcattgttcaaatccgactaatcaaaaattagtccataattcatttcgatcaccaaaaattgatcaattccattacaattgctcagaaatttgttttgaaaatgcctgaaaaagtccgcgcgcgttggccttctcccgctccttggagaactctccggacagaacacccaacaccaaattgagcacgaaaaaggagccgaggatgaccaaagtcacgaagtaaatccaaggccattcccggcccaccgcatcattaaccggaaaagggaaatggaaattaaaataataaataaatagaaaaaatagaaaaattaatttaaaaatataaaattatttatttttatttttaaagttcaaatttatttttaatcctctgtcaattattaattaattaaatatatttatttattttaagtataaaaaaataaaattacgtttttataataataataataatatttttttttataattttatttcatttacaaaaatggtttaaaatataaaattgaattattatttgtttttaggcatttttatggaataattaattatttagtattaatattaaattaattaagcctagcctaagattaacataaacctaacataagcctaggctttagcctaagcctaagattaatcgcttcttctctcacccaatacatcacttctgtccacccctccagcgaaacgcattggaacaccgtaagcattgcgaggccaatgttgtcaaagttggtgatgccattgttggggccctgcgcggaaattcaa

SEQ ID NO: 78932 - DNA, 103 bp, Heterodera glycines
  Genomic contig location: Contig_ID=SeqID_14789; Location=316..418; Strand=-
  SCN-specific regions: Sequence locations=1-103
atgttaattgattctcagatcaacaagcatataatgtctgaccagaaacaactgttttattcggccaaactattcccggcaatcagagtggacttcttgaaag

SEQ ID NO: 78933 - DNA, 1456 bp, Heterodera glycines
  Genomic contig location: Contig_ID=SeqID_14790; Location=82..1537; Strand=-
  SCN-specific regions: Sequence locations=1-226,248-763,786-868,890 -1131,1153-1163,1187-1359,1381-1456
atgaacagacggtaaggaaaatttcgaactttcaaatttcaatttagtaattttacacagttttagttggatttgcaatgacattttgatggatttgttcccattctttaaccgtcctcaactcggcctcaaattggcacttctctcacctcgtttcaatttgctggtggacgcgcatttcgatggcaaaagcgaattgacaatttggagacaaatcagaattcacaaaatgggagcaaaaacacagctatccgtgcaagacacgaatagcaatgccgatgctgtgccatttccgttgcctgaccattcgctgcccaacaaaattcgctttaatcgtcttcgaattgagtaaatcaaaggattttcactgatatttatgtaaagcatttgcttttcaggtgtatcgatcattccgtcatcacattcctccgttccaatcagcaaatttttgacggaagaggcaccaatttgagtctgtggctccgtccggacgccaatgattaccagccaatttgggatgctttcgtccgtgaaatttggccgattttcgtgccaaacattcgccgcttgggcattccaaaaggcgatcagctggacaatttgcttcgccgtacttcgcccacaattctcactgatctcaatcagttgaattcaatccatctcgattatttgtttaccaatattggtgatcaaaatgggccaaatgcaactccaactgtttgccaagcattgtttgaatggttgtgcactccgattagcgatggaaagccaaaacaattgacttgctgtggttatccggcaggaaccactgaatggctcaacaatttcaaagaggtaaggccattttttcgaaaaacattttggattgattgcaatttgtttttccatttcaattgtttaggcatttctcggttccaccaattcttcggccagctacataattcggattgaactttacgaaccaacggaaattgggccatttgaattgacgaacaatgggatcggcgaaaagctgacattggagaaagaaggccaattgggaaaccaattgataatcaaacgatgccaaattggggagacgattcagtgggaggacgaaaattcgaacaatttgaacaatgtccacttttggatggacaatgccaagtgcattgggtgagtagcttttgcttttataatcaaatttaaatcacacttaattaaggccaatgtctccaccaaagccgggacaaaacaagaagcgtaagaaaaactgaacgaattattgggaaatgacaaatgattgatcattatatacggaaactgatctgctaattgcccctaacatttattttatttcttctttcgttcgaatacatttcatttgtttgggtttttatgcttttccatatgtatgcccaaaaaatacaacgataagattcatataagcattttttagcctaaaaatcaaaataaa

SEQ ID NO: 78934 - DNA, 81 bp, Heterodera glycines
  Genomic contig location: Contig_ID=SeqID_2289; Location=1140..1220; Strand=+
  SCN-specific regions: Sequence locations=1-81
gtgctttctatgtcgatttggaatgcgaacagaagtcgtatttctgatttggatgggcaggaattgcaggcggatgagtga

SEQ ID NO: 78935 - DNA, 1616 bp, Heterodera glycines
  Genomic contig location: Contig_ID=SeqID_2290; Location=4311..5926; Strand=+
  SCN-specific regions: Sequence locations=1-248,272-397,419-680,702 -956,994-1170,1194-1412,1434-1585,1607-1616
atgtcaaaacaaattgcaatggaatgtgctttcaatttgcttttgaagaaaactaccacattgccattggacgcgcgccaccaaaccgtgccgaccgttgcggtggcggacgacgacgacccggactacgcgagtgtgccggtgggcgagttcggactggcttttttgcgaggctgtggctggaaggacgagaagtcgtgcatcggcaagtcaaatccgcaggtggtaccactgcgcgtcatcgaaccaaggccaaaggtgaaaaaacgggagattatttattgcatttcttaaattagttgtagaataaattctctaaaattggcggttgtattttgagaatataaacattgccaataaatggttactaagttttgcttcatttccttgcttaacctaaatggtattcttcaaaaaacgttttattttacggggcatttccaatgcattttaattatattccgtttgattaagtggttggtcgtttgcttatagaaagttcaatgcctttcgcattttgcaaaattcaagtggtaattgcgtaatggcaggatccagcagtgttggacgcatttcccttgtccaagtacatcctagagttctgccgaaaaagaccagtggatgtttgagaggagagcaccgcaaaattcgttagtgccaatctttaggtttccactcacaaaccaatgaatttttactttttccttagtttttatcttaaattcggttactaatctgttgaattttttagggactcggacttggcgctgtccttccgacaatggcaccgccgacggccaacgcgctaaaggcggcagaaaacggtgacgaagaagcgacaacacttggcaaacactcctacgtcagatgcttatgtatgtggaacattgaacaatttttaaatgcaattgtcattccttggaaagggggtttgggttaacttatgaaaaatagtcaaatttgcccacttagattttcatatttattacctaacaaatatttcagccggtctgaacaaaggctcttatggccaagtgatgtcaatggacgaggagaatgccagcattttcgtcgagttggcatggccccccgccaacgttggcaaaacggtgcgtgtcagccaatgggcggtggaagtggtgagacggaaagagtatcgcgagtgcgtaaagggcggcagcggaggaggaggaacagcggagaacggacggaggctcgaaagggtccgagtctgatggaattggcagcaccaacccgtccaaataccctccataatcggccacaactttcgccatcacacggtcgacacgtcgtacgatttctctgtctcctctcggcacaaattttaatcgttcgatttgttatgctcctggtcaaaaggatattcgatgctgaattttatgttgccattcttttctaaagaaatataaaatcgaatatccttaacgacccaaagtgatcgattcatttcttttttaactgaaaggaggaaattgcacatatttcagcactttgataaagagtacctcctaatttggtccaatttaataataatgctttatcggagtgtatgaaaatctttaataactataaaaataattaaataggaatgtgta

SEQ ID NO: 78936 - DNA, 573 bp, Heterodera glycines
  Genomic contig location: Contig_ID=SeqID_2290; Location=5986..6558; Strand=-
  SCN-specific regions: Sequence locations=1-258,282-573
tgcttttgtgcccacttcttcccaacaaaaagtgccaccatttgtcggccaattggcgtcggaatcagcgcaactgttgcaatggcatttctgtggcccaacaacactttggcactgtacgcgttttggaaaacggttgaggtttgttttgcctgccaataaaaagtattgttctttattcattgtcctatttcagtttgctttttttcggttggccgatgccggcactttgcccgttttgccgtgggccgatgcccttctcttctccgtcctctcctcctatttgctcggccttgcggtgctggaaccacacgctttgaggcaaaattactacaaattcctttgctcagtaactgggaacaggtgaaacggaaatgaacacaattttgcaaaaccggagacccttaaccctcttttaattccagactccaactgcttaatcgaccaatgttcgataaattcctcggcaccagttcaagcgccgtgctttacagtgactaccgaccggagtttctgccttatttgcggaccatcaatccggcacaatatttgccacaaatgcaaatcgtctaa

SEQ ID NO: 78937 - DNA, 960 bp, Heterodera glycines
  Genomic contig location: Contig_ID=SeqID_2291; Location=1648..2607; Strand=-
  SCN-specific regions: Sequence locations=1-748,770-880,902-960
atggctgccaaaaagcgcttcaatccgtccgtgcgaaatgcgaagacatttcagaaaaagaagctaaaggttggccgcacattgcgacatgagaatggcaccgacacgcgcgtaagtgtgaaaaagattggcattttggagcagctgagagaaggcgacgagggcactccggcgaaggaagtcgaaactcggcacccgcaaaagggcatcgacgaattggtggcacagctgggccattacaacgaaaacatttgccgagatgcgatccatggtgagcatggaggggaaacatgcggaataaggtggcaaaatgcacaactttcggaaatttacatccgttttggatcccttgtcaaggtgttcgccttctgttcaaaaactcgcctgatcagttgaggaggcatttgcgcagaataatcccggccatcggttctgtaattattcgcgaggtgagagggaaaaaaaggggacgggtagggtagttcgaatttaaatgacaaacgaattttgaaacgaaaaaaaacattgctaataactcaaaaactatttggaaatttcagctaaaatcgaccgcaactcgcaatcagttgaagctgctgatcgaaatggtctgtgaagtgcccgaggaagtgatcagttcccatttcgtccttttttgtggcttcgttctcaccggtaaatggccatgcttttttctttttacacacaaaatgaataacggaaaacggcacaatttgaaagtgttttagcaaatccaaaattttcagggatttccgatgttcgttcgtctgttcgatcactgtgcttcgacattttatcacttttattgcgcaaatatgtacagttgtgtcggaaaaatcgcgaaatattcgatgcgtttttgcaactgatggaaggtcaacggaagccagaaaatcggtcggttcgttttttgtttggcacatttagaatccaattaaa

SEQ ID NO: 78938 - DNA, 604 bp, Heterodera glycines
  Genomic contig location: Contig_ID=SeqID_2291; Location=2947..3550; Strand=-
  SCN-specific regions: Sequence locations=1-206,228-237,259-604
atgagctttttggacaagctgagcaacggggcgattgtttggctgttggagctgaacaatccctcgtgcaggacgagcggggcggagcacacattggcttgtgccaatttctaccgtgatgtgattgcgtttgtgcccggtggctgtgtttgtgcaattttggtcgtcctatttttcatggacattcgtcggttgggccaacgctctgcacaacaacagcaacaaattggagcaggacgcggaggggaggaggaagaggcaggggacagcggagaagcggcggagaacagcagaagcagcggacgagtcagaattggtcccgagtttggtgggtggaatgctcggactttttacatagaaattgcccggctcattgcaatacgccgtcattttccaaagacaattgaataaaatctaattttcgtgccgagttggacagtgctgataaaacccactcctttccctatcaaaaatttagaatttcacgaaaatacaatgtgaaattttgattttagatttgtcacgcccggccccgcccgttcatacattgacacaaattggtgaggaggagccgcccaacccgaacatcattcacttgccttga

SEQ ID NO: 78939 - DNA, 532 bp, Heterodera glycines
  Genomic contig location: Contig_ID=SeqID_14791; Location=1553..2084; Strand=-
  SCN-specific regions: Sequence locations=1-129,151-532
ggtgtcccaaggaaggccaaggactttggccttcggcttatcaagctgatcctcctgagggatttgtttcatcacctcttttgagttagagatgaattccctcaggttgaagcatccttgttggaggatgtccttggaaaatttgtatttttccaaggcttcctgtaccgtctcgcactcgaggagtacattgtccacataaatggactccgaaatctccctggacagtggggagtcgaactgttgcaagtgtggcggagtgtcgccgccaaaatgaatggcgagctgacgaccccgaacgcaactcggcaaaatcgaaatattgccaagttgtcgggagtcagtccctttgacgtgtcctttagccagaggaacttcgtgacctcccggtcttccggctccaatgaaatttggagaaatgcggcttgaatgtccgcgagaagcggaaaggtcgggcaacggaacagaagaagcatgcctgccaaatctggcagaagcactgggcctcggaagaagcagctgttgaggcttg

SEQ ID NO: 78940 - DNA, 3637 bp, Heterodera glycines
  Genomic contig location: Contig_ID=SeqID_14791; Location=514..4150; Strand=+
  SCN-specific regions: Sequence locations=1-305,327-604,627-1023,1045 -1421,1443-1664,1706-2039,2062-2554,2576-3637
atgtccaccgtggacaccagcaaagggagagccaacaaggttcccaagtgcaaaaagccgcacgcgtatctgatgacgcgacggctgctggctaagtcaagtcgcgacagccggaatataatcaaagttgcagtgctctttgacccgggaagccaaacaacgtacggagcggatccgcttatcgataagctccgcccgcacaaactcacctccgaagagatggaggtccacgggtttggaggaaaacgggagccgttacgcttccattcacccatttactccgtccttctccaaagggcggacggaaaatgggaggaaattgtactcaatcggacggagaaaatctccactcacttcagcatggtcgaatggagcgccgatgaatccgtcacgaatcatcacgaagtctgtgaagcaatgtgcttcacaaaggaggagccaatgatactcctcagcgcaagacacttctggcaattcttccaagggaagagagaagtgtctcccgggctgtttgtgatcaacacaacatttggcccgctggtaaatggcgagtccactattggaccgccaaactcaagtcaaaaggccctttcgatgatggccatccacagcacaaatgtggaacaaatgccaaccatcaatgaggttgagcatttcttcaacctcgaatcactgggaatccaggatgatcctgcccaggatgacgaccaaacagctatggagctgtttaacaaatcaatccgtcaagagacagacggaagttactctgtcaaatggccgtggaaggagtccaatccggacctctcttccaatttcaaaatggcccacagcaggctgtcatcggtgctaaccaagctccgacattctccagaaattctggagaagtacgatgccaccatccgcgatcaactgcaacagggcaccatcgagaaggcccaaagggctcctggacagcttgagcacttccgccctcaccatggagtgctcgccaaaaagctacgcgtcgtttatgacgcgagtgctcacacacgcggaacaccaagcctcaacagctgcttcttccgaggcccagtgcttctgccagatttggcaggcatgcttcttctgttccgttgcccgacctttccgcttctcgcggacattcaagccgcatttctccaaatttcattggagccggaagaccgggaggtcacgaagttcctctggctaaaggacacgtcaaagggactgactcccgacaacttggcaatatttcgattttgccgagttgcgttcggggtcgtcagctcgccattcattttggcggcgacactccgccacacttgcaacagttcgactccccactgtccagggagatttcggagtccatttatgtggacaatgtactcctcgagtgcgagacggtacaggaagccttggaaaaatacaaattttccaaggacatcctccaacaaggatgcttcaacctgagggaattcatctctaactcaaaagaggtgatgaaacaaatccctcaggaggatcagcttgataagccgaaggccaaagtccttggccttccttgggacaccgagaaagacgaaattgtcttcaaattcccaacaactgatccattgaggccagtcacacgaagactggtcctcagccatctagcatcgctcttcgaccctttgggggtccttggaccatgcaccaatggaaggacgaggaaatcagaattcctcgccgcgcaatgctcaatgacacacagtcaattgagctccatgcatttgtggacgcatcggtccacacattcgcgaccgcgatatacgtacgctacgctcaaaggcaattgcgtcgtccaattgccagccttaatctttggggcgtttcgcaaatcgctctatcatgggtaaaacccatgaaactcaaccacaatttgttgagcgaaggctgaaagaaatccgagaatgtctcggatgtactttccactttgtccgtactggggacaacccagcggacctcgcaacacgcggagcaactacttcggagctccgcaaccatcatctctggtggaaagggccaacttggctcacacaagagagccatctttggcccaacgaattctgtttcaaagtaacagagtctgaccaacaaaactcggagaatgttggcccgagtggtgcgtttctcgcatacactcactcaaagcagccaaatgagcaggtcttaattgacccctcacgcttcagctcatggaagcgtctaatgcgaacgacaatgttcgtattacgattcctcgccttaatgttcaaaaggggcgaagaaacaattgcttcactcgagaagcacagaaaggaaattcgccaaatttccaagtctggggaattcaaggcggaagacttcgcactcgcggagcgagtgctcatccgcctggaccagatggatgatgctgaagaattccaacactttaaaacagtgtttgaagacgacggaattctccgtctgaataccagactggagatgagtgagaagccatacagcttctctcatcccattcttcttgccaagcattcagctttggcaaagctgatcattttggatcggcaccaaaaaaggcatcaccttggagtggacaccactctgacagaattcctgagcgaattctggatgccaagcgcgcgtttaaatgttaagcgggctcttcgggattgtcttctctgtcgccgaatgaatgcacaacaatttgcattaccaaccatgccacccttgccgggtgagcgagtacgccgacacgcgccatttcagtcaattggaattgactttctcgggccaacgacaatttcgttggccggagaaaaaataaaggcatggatcctcatcataatatgcctcgcaacgcgcgctgtctaccttgaggcaacattggacctcacatcggaatcattcatcaatgttctccgtcgattcataagtcgacggggaaaacccgacatcatttggagcgacaacgctacgaccttcaaactcgctcagaaaaccctggagcttctcagtgctccggggccggatcaggaagtacaaaacttcctgacccataaccgaatccagtggcgattcattgcccaaataagtccttgagcaggaggcttttacgagcgcctcgtgaagctagtcaaggactgcttcaagcgaactttgggtcgaaggattctttccttcgaccaactcaacacattcgtggccgaagtggaggccatcttcaattacagaccgattaccgcggtctcagacgcagtggatggaccagttccactgcgtcccatcaatctcttacaaccagagattcatagcaattgggaaacaacaacggacccaattgattcagaggaaatgttttcctccacacacgaacgtttagcttcccgaatacaagcactccgggaagccaaagacattttctgggccaaatggcactctgagtatttaacattactcagagaaagagcccagtgggaccacaaaggtccacgactccaaaacttcggtgaaccgaagaaagggatggtggtcctaatctctcaggacctcgttcctcgcaatcaatggccaatgggacgaatcgttgaaacacacggacggcctggagccatccgaa

SEQ ID NO: 78941 - DNA, 75 bp, Heterodera glycines
  Genomic contig location: Contig_ID=SeqID_14792; Location=798..872; Strand=+
  SCN-specific regions: Sequence locations=1-18,41-75
atggcattcgacgatcagttttatgaaaaaacgataaacaaattggccgagacaaaagcgttctatctgatgcta

SEQ ID NO: 78942 - DNA, 902 bp, Heterodera glycines
  Genomic contig location: Contig_ID=SeqID_14794; Location=2326..3227; Strand=-
  SCN-specific regions: Sequence locations=1-111,183-372,399-408,435 -456,479-535,559-723,764-836,858-902
gttgccgcgttgaagtcgcgttgcgaaacgcatctgatcaattgcgttgaaattccgctgatcgaccgtttccttctgattgaacgcttcggactcgacaatttgaaagtgatttaattttcaaatatttaattttttaatattttaaaatagtttttaaatgatttattaaattttattttcccatttttagaattattttttgcatttgaatgttgataaattccgtgcctttttcactgcgaacagtgaacagtttgtgccttttatcagtaaagaatttttgtacgctttgtccgtcagactttgtggatgaatttgttaaattatcggctttgatcatattgatttttttggcattttcattaattgtttatttttcaaacaaattgtttttcctctttttggttaaaattatttattttcaaatgggataatttggcgaatattttggcattttttataacaaacaaagtggtgaaaaaatgtcattttacgtaattttttttaatttggtaggctaattgggactattaattgccatcaaatgactcaaaacttgctaatgaatttgctatttctaataaacaaactattctgttttcaggtgaccgcgttgaagtcgcgttgcgaaacgcatctgatcaattgcgatgaaattccgctgatcgaccgtttccttctgattgatcgctacggactcgacaatttgaaagtgattactaattaatatttaaatttttaaaagattttaattaattttccgcttttagaattcttttttgcatttggatgtcaacaaattgcgtgccttttttgctgtgaaccatgaattgttttttcctgtaatcagcaaagaatttttgtacgctttatctgtacgagcgatggccgggctttga

SEQ ID NO: 78943 - DNA, 2269 bp, Heterodera glycines
  Genomic contig location: Contig_ID=SeqID_14795; Location=605..2873; Strand=-
  SCN-specific regions: Sequence locations=1-194,216-240,321-337,359 -695,718-1443,1490-1595,1621-1664,1718-2066,2093-2269
gatttttatgcgcttgagtctgtcgcaccagtgggaagcggcctaaaatccgatttgaaagccaaagtgcgctatttattgcaatcttcttccgaatcggagcagcaagcttctctgttcaatttcaagcatattcgtccgggaaagtaagttaagagaaatttttgtgtaattttcaaaacctaagcgagcgttaaataaaagcatttttattgcttgtaggaaattttcaactttacgaattttataatttttttaaaaatttagctaataaattcttaaattgataaatttataaccaattaaaaaattttttaaaactaatcattgaaatgatttttggcaatttaaatattaatcttttgattcagttggggcctcttttacatgcacaatgatgcgacgacggatgccgcacatcgccgcttagacaaatcggcactgaacgtcacatattcggacataaacatcgaaatgcatgaccagggcggcatttatgcaatcattgtcagcggaacaatggaaaaggtgaaaatgagcctcagatattcccattttaaattttccttctggtaaaatcgaagaaacaaatttttgtacgaattgcttttgttgtgtccccggatttaaggctttaaaccaatttgaatcaccaatttatgggagaggaatttatttattaaaggaaaagcattaaaaaataaatagcaataaaaatcgggaatgggtttgggtcaatgacaatcacagggcgtattataatatttgggaaagaattgctccgagggggcagtggagaggatttatatacgggtacaattgcgagagaggtactttgggtagggtgaggaatcatgaggactaatcacaaagggaatgttggagaaatgaatgggatatgcaacagaggttaatgggatagaaatggcacaatcattgaaaatgagaggagctggattcgaagctcgcccagccctgcttgggatggaatgaacagacagaaattttttgattggattgtaaaaaaattgaaatttggatgctgcagatacagcagctttttcggcttttctcacggaatttctaataaaaacgtatagaaaagaccgaatggagaaactccatcctcttaaaaattcccaatagaaccctggtccatacatacgggatttgagcacggaacccggtcctacccctttttctaagcattttatgtttctttttttagtcatttagcggtttggattttgaatcattaccatgttaacacatagtctactgttaagcctcgaaaacgcgtttttcgtgccattccgcccaacacagtgagcattctttggcaaatccctcaaattgccatcatcacagcagcagagattctgttctcaatcccaggctacgaattcgcatattcccaagtgaataaatattttgaaatcatgctataaatatttaaaaaaatatttatttaattgatagaattaattttcacgttttatatttccaattttccaacagtccgcaccttcaatgaaaactctgctccaagcttgctggtttttgacggttgccattggcgatatgatcatcatttttgttacatttttccattttggtgacatggctgtccaatttgttgcatatgctggtgaataaaattttggaataaaataatgataattatttaaaagataatatattaaaaaaaatattaattcgaattttattttctcagttgctatgcttgtggtcatcttcatttttgcacttttggcaatgtataatttcttttctcttaaactattatattaaatatttcgccattttttcaaaattttcgactgtaggcttttgacagttatttttcataaaaactcaaaattcttaaaaatcaaataaacgctaaaatgcacactgtcattttgaatttttcatgaatattaaagatatatttgggaagcctccaattattgcaaaaataattgaataaatggctttaataaaaatttaatttcagtttttattacgaataccgcgtcaacacggacgaaagttccaccaatgcagataatgatgatgatgatgaggatgaatttgaagaggcggaagaattgcggaaaattgacgaaaaacggggcccactcgaagcaaaatttgaagacaaagcggcggatgatgagaaaagaaatgagcaaaatattataaaaacaaaagtcaaaacaactaatggaaaccgaaaaaatggagaaataaatgtcataattatgtt

SEQ ID NO: 78944 - DNA, 185 bp, Heterodera glycines
  Genomic contig location: Contig_ID=SeqID_14795; Location=1252..1436; Strand=+
  SCN-specific regions: Sequence locations=1-2,28-133,180-185
atgtcaccaaaatggaaaaatgtaacaaaaatgatgatcatatcgccaatggcaaccgtcaaaaaccagcaagcttggagcagagttttcattgaaggtgcggactgttggaaaattggaaatataaaacgtgaaaattaattctatcaattaaataaatatttttttaaatatttatagcatga

SEQ ID NO: 78945 - DNA, 431 bp, Heterodera glycines
  Genomic contig location: Contig_ID=SeqID_14796; Location=515..945; Strand=+
  SCN-specific regions: Sequence locations=1-328,350-401
atgataagtaaggatgccaaaaatatggatataaaatcgcaaaatatggccataaaatatggaccaaaaatcgcgaaatatggacataaaatggcaaaaatgtcaaaatatggacataaatttttcaaaattgagtgcaaaatttcttcaaatttattggttgaaattgcatatgagatacatttccaaattttttttgactcggtaaggcgctttgacaaagacggctttcgttttggcaattagtcggtcaacattcggaaattggtctcgaattttttcggcaattctgtgcaatcattttagaagaaaaaaaaaacatgaaagctaaaatttattaatttttttagcgcaaaatcaaccacaaaagcgaaattttcgcttttttgcttatttttgacataaatttattaattttttagaaaatttaa

SEQ ID NO: 78946 - DNA, 157 bp, Heterodera glycines
  Genomic contig location: Contig_ID=SeqID_14796; Location=658..814; Strand=-
  SCN-specific regions: Sequence locations=1-157
tgattgcacagaattgccgaaaaaattcgagaccaatttccgaatgttgaccgactaattgccaaaacgaaagccgtctttgtcaaagcgccttaccgagtcaaaaaaaatttggaaatgtatctcatatgcaatttcaaccaataaatttgaagaa

SEQ ID NO: 78947 - DNA, 452 bp, Heterodera glycines
  Genomic contig location: Contig_ID=SeqID_14797; Location=1358..1809; Strand=+
  SCN-specific regions: Sequence locations=1-25,47-172,194-232,273-452
atgctcaacaaaaaatgcgtcacatttgctctgtttctgctgttgtcagctgctgtccttttcgtttcgggagccaaaaaatctgcgagtaagtttcaaatggactaattaattattttaattgcaataaacaatatttactaaggggatattaggtttttttttagaacgctttttatttttaataaattttccaaaattatttttcataccatatttaactatttttgggatttttaattttttaatttaaataaattttgtaaaattttgtcctcagtttgaaatatgtgcgtggtttttattattttctatgcatattttataatacagtatttataaaaacaaagtctgtaaatatgatttctgaaatacaaggtgtgaaaaataagaaactatatagaaaagcttgtattgttgaattcaacttgttaaacggttattttttttaa

SEQ ID NO: 78948 - DNA, 838 bp, Heterodera glycines
  Genomic contig location: Contig_ID=SeqID_14799; Location=567..1404; Strand=-
  SCN-specific regions: Sequence locations=1-85,107-125,172-492,523 -787,809-838
atggtgagtttttcaatttctatgtactttattaagtaaacaataataatcaaacattttttatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggtgaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccacattatacgataagcatttcctcgcacaccgctctatttgctctgttttaaacaacaaaattatcccaagcattcatacctactttcttaattgcactgggatcacatctaaacgactatgctaaaaacggggaactaaactgtattaatatttttaacaaattgcagcccttttcgcctaccctgttaagagaaatcttaatttcactaataatttctcaattttcttctataacagattaactcttctatggtgagtttttcaatttctatgtactttattaagtaaacaataataatcaaacattttttatgattgcaaagcatttaaaaaatcataggcttgtttattttcattatgttttggaaaaggtcaattaaataaa

SEQ ID NO: 78949 - DNA, 759 bp, Heterodera glycines
  Genomic contig location: Contig_ID=SeqID_14801; Location=375..1133; Strand=+
  SCN-specific regions: Sequence locations=1-270,293-299,329-575,597-759
atggtggacgacattccggaccaggtcagctggaccaacctggacccggagcacgtggtcagccaagtgaccgccaccttcgacctgggcaccatgcgcaacttcttcatgcgagtacgtctcggatttttggaaatgtttttttcaaaaaaatgtcggctggtaaaaaatgcaaaaaagaaatgttttttctctttttttgaactttgaaatttaaaattttcctttcataaactgataaaaaaatcattcggacaggttcccctcgagaaaattttttaaaaatttaaaacttctggattaaaaagatttttcttgctttctgaaaaatgcctatagacattatttcattcattttccagtccggcatcggcaaaggctacttggaacggttgtgcatcgacccgcttgacccggcatgtccaccgacggcaccgaatcactacggcggcaccgtgttgtgcgatgcaattcggcattttgagcagcgaattgttggcgtcggacaaatgaccaaccggacaattgaggacattttggcgccgtacaaatccgtcgacggcacaaacaatgccgggaacaaacagaagaagcagaacacatcgccattcgacattttgcaagcattttgtgagtattgtttaagggtttatgtgtaaattcgatggaaaaagggcagagaatggagaagaggatgagagacagtaccataaaaggagcaaagagagagtaagagattgggaaaagagtgcgacaaaa

SEQ ID NO: 78950 - DNA, 378 bp, Heterodera glycines
  Genomic contig location: Contig_ID=SeqID_14802; Location=613..990; Strand=-
  SCN-specific regions: Sequence locations=1-131,153-378
atgtctgaaaagcgaaatggaaccagcatttgggccgaaatctcacaaaatttgccattttcgggacaaaaatggaaaaagattgcaacagtgagagattgtcgaagggtctcgagtctgtggccgttttcaaaaaattttaaaattttttagagaaattttaggacttaacatgcaaaaatctctattaaatctccagtactattaaattgttgtatgcaaattttatgctctaccgctgatgctggtcgacgcgagcggatggaccacacgtgcggactgttcaatgtaagtgtggccggcccgtcggttgaacgcgtggttgtacaacgaatcggtgaacgcacgggcccaggcactgatcacctatcaaataaa

SEQ ID NO: 78951 - DNA, 1296 bp, Heterodera glycines
  Genomic contig location: Contig_ID=SeqID_14802; Location=1..1296; Strand=+
  SCN-specific regions: Sequence locations=1-185,209-291,313-598,620 -838,860-1296
  Gene Ontology: Mol. function=hedgehog receptor activity; Cellular component=integral to plasma membrane; Biological process=regulation of smoothened by patched
gatgaccaacatcaacatcggcatgaccatggcacagcatcaaaatccgctgaggacgaaagtgccgccgatgagaccattcgggcggaggccttacaatccgtcattttggtcgcctcaccgacggaagtgttccgacggtttaaggcaatttttagcatttttttatgcgaagccatgaccgtttttattgtttaaatttcattttcatggcttaggactctgccaaatttgctgctggaaacgaaagcgacaacataacgcgatggtctccgctggtggccaaagaggtaataataataataataaattgggaaaaacaaaatacgacaaaagttaaactaaaccaatttgacggagtgcattatattttcctcccatacggaaaaatttcttttaaatggaaatttttaatacttttccaacatttttagaggtttttttaactgaaaacattttccaaaataaaatttaaaaatcatatttgtcatttttacgttttttaaattaaaaattgtgaattttgctgaaaattagccctccaaccttgtaatttttggtgattttcgattgaaaaagcgcattttccatgtctactcactcatttatttgtttatttgataggtgatcagtgcctgggcccgtgcgttcaccgattcgttgtacaaccacgcgttcaaccgacgggccggccacacttacattgaacagtccgcacgtgtggtccatccgctcgcgtcgaccagcatcagcggtagagcataaaatttgcatacaacaatttaatagtactggagatttaatagagatttttgcatgttaagtcctaaaatttctctaaaaaattttaaaattttttgaaaacggccacagactcgagacccttcgacaatctctcactgttgcaatctttttccatttttgtcccgaaaatggcaaattttgtgagatttcggcccaaatgctggttccatttcgcttttcagacatgttggccgagttctgcgacttcaattacgccatcattttggccggctacttgctgatgttgctgtacgcgctgtactcccagtgccgcttcgatggctgctgctcgctgggcgtcgagtcggctgttggtttggcgttggccggcgtgttcaccgtcaccatggccagcattgcgggccttgggctggccacatggtctcagtttatgccatttttgtatagatttttttaaaatttttaggcttggcatcaatttcaatgcggcgaccacccaaattgtgccattccttgcgcttggcataggta

SEQ ID NO: 78952 - DNA, 765 bp, Heterodera glycines
  Genomic contig location: Contig_ID=SeqID_14803; Location=142..906; Strand=+
  SCN-specific regions: Sequence locations=1-105,132-179,201-404,426 -568,590-618,647-765
atgtttctgctgttgcacaactatccccaagtggtgggcaacgtggcacgcaatgagctgggctttctgatgcgcgagaccggtaggggctgggcaaaatctggcattttaattaaaaaataaaaaatatacatttttcagggatgtccatcctcaccacgtcgttcaacaacattttcgccttctgggctggcaccattctgccaattccggcactgcgctcattctgtggtcaggtgagtgcctttttgattgttttcttgacattttaaaaaaaattgtcatcaaataattgaattttgcactatggaggcccaatttgaaaatggctaatttttcgcgtttttttcccgcgtagccaaaaatttaggcttttctggttacgggcctgattcaatccatttattctgaaatttggaaattaattgctggacagaattttgtctacaaatttatttttgtttttttcaatttctcatttgtcagaccgccattctgttgaccaccaatttgttcggcattttcttcatttacccggcattcattgcgttggatttgaagcggcgcaaggcgggccgacgcgacttggagtttctgtgctattattgcctttgtgtggacgacgacgacgacgacaacgtcgacgcggaaacggcgcacaaaattcggcgttccgacgtaacgggaaaaaagattgggaaattgatggggcatcacccagatgtatctcaatccattaggatccagattgaagtagtacgctga

SEQ ID NO: 78953 - DNA, 1448 bp, Heterodera glycines
  Genomic contig location: Contig_ID=SeqID_14804; Location=68..1515; Strand=+
  SCN-specific regions: Sequence locations=1-75,97-141,164-788,810 -873,896-1081,1104-1349,1373-1448
atggtaaaatggtggtccggtgctgttgtcactcacttttttttttctaaattttcttctccttattttaaattcttcaaaaatttgtatcttctactatagtttgacagaatgccaaatttaaaaaaaaaatgggaaaataaaattatacaataaaaaattcaatttgtcttttcagctcactcatcaattcttgtccactgggctccacgcgttgttcccctcgctcaacggcactcttcccactgcgaatggtgccgaccgtgccgggttggcactgctcgagcgtgacccgctgttgtgccgagcgtccggcggcttccgattgtttgtgcgcaaattcacggaccaacaattgctcaaatgtctgcggacgccggcactgaacacacttggccaatgggcaccgccaaacttgcgctacatccatctgctacgttcggcggtaaaaagggggacgggacgaaatctcgccgccggaatctcaaaaaaaaaaattctaacttagaaatttttgaaggaaaaaactttagaaaattttttttataagaaaattccaaaaaaaaaaaattctaacttagaaatttttgaaggaaaaaattttagaaaatttttttttttgaaatttctgcggcgagatttcggcggcgagattttggggtgcacccgtaaaaagtgccaaaattggccaacagttttaagcattcattaataaaaaaatgatagtggagaaatagcttaatatttattgcatgttttttttatacttcacccccccccccctctccaaaaaaaatttaataaatttactgcaaaaaggtaatcaattgtcggacccaattcttggacatttaatttaattaaacacagtaatttttgaaattttatatttgaacatccaattgaacatttgttaaacaaccgactcatttttaaaacatttttccatttttttaagtggaagaaactgactcaatttgaacgctttgattggcaggaactgtttgaacagtatgccaaggatgggcatgactcgacgctgggtaaagaaaaaaaacattttgccattttttctaatgccaaattaatttaaaaaaatttttgctcaaggcattgtggtggatcagaataaacaactgcttgaggcctcagccaacaaagaggacgagcagcgtttgtgtcagttccaatggctgtccacggtggattctgagcatttgccatgtccattgtgctcatttgggaaccaacgacgatatgccattggacaactcttggtaacgaaaaacggtggcatggatatgaaacacgaaatttgtaacacagaaatttgtaggcattcttttccgaaaaatggaatttatttattgataaaaagtttttgtttttttgtatttttatgccaggggttcgattctacgcataacaactaaaatacgtaaaatgca

SEQ ID NO: 78954 - DNA, 424 bp, Heterodera glycines
  Genomic contig location: Contig_ID=SeqID_14805; Location=331..754; Strand=-
  SCN-specific regions: Sequence locations=1-142,165-424
atggtttatggacaaatgtcttatattcctaacttttgcattttgttagtttaccatgccataaattttcgactcttaaaattgtataaaaaacaaaaatttaatttgaattctttttattctaaccctcctcgacgattgaaaaattacaaataaaactcaaactaacaattccgcaaaaaaaaaaatttctttaggcatactgtatctaccgtaaccctaaaaacgttgagagcctggggcattcattatccaatgaaaattttgattagaaaaaaatttcagaccaaaacagtggggcggtgtagaatttggctggacattcagggcactgcaacatgcattggttgttgatggcccaattccgatgctccatggcacagtgccgttccaattccatcggcgagttccaaccggagcgtaa

SEQ ID NO: 78955 - DNA, 263 bp, Heterodera glycines
  Genomic contig location: Contig_ID=SeqID_14807; Location=114..376; Strand=-
  SCN-specific regions: Sequence locations=1-263
aattgccgaaaaaattcgagaccaatttccgaatgttgaccgactaccgtatatgctctttttatagcccagtctctattaataccgcagtctccaattatcccctgtattctgaggaggttgaaaaataatcccccatgggctataattagagcatatacggtaattgccaaaacgaaagccgtctttgtcaaagcgccttaccgagtcaaaaaatttggaaatatatctcatatgcaatttcaaccaataaatttgaagaa

SEQ ID NO: 78956 - DNA, 104 bp, Heterodera glycines
  Genomic contig location: Contig_ID=SeqID_14808; Location=2407..2510; Strand=-
  SCN-specific regions: Sequence locations=22-104
aaaattttaattattttttccgtttgacgcacatccgaccaaactgatcaattattgtagaagatactagccgcaagaaacaaaaaaaattaaaaagttaagaa

SEQ ID NO: 78957 - DNA, 3864 bp, Heterodera glycines
  Genomic contig location: Contig_ID=SeqID_14809; Location=286..4149; Strand=-
  SCN-specific regions: Sequence locations=1-389,411-632,654-706,728 -1270,1292-1661,1891-1898,1923-2443,2473-3018,3040-3407,3430 -3654,3677-3864
accttccaatgctcccaaatcttaatgcgatttcgccgcatcacgccgtggtacagacattgattaattccacacccgtccgctgcttaatggacacttgcgccagtttgactgtcgcaccgcgatcagttgcagatgaacttaattgtcgcacattttcatccgatttggaggcaatgagtgcctcaggccatgtcattcgcctcaaggaatatgctcaggtgaatttgaacattgcagggtacacagtccggtcaataatttattttgtggatgattctgaatttactgtagcccgggattacagcgtaatttttggttgggatgtctttgaaaaattgcccccaataaaattcgatcatttaaacgggaaattttttgttggggacaactaatccaaattgtgctatcgttcgattcttttactgaacgatttgcgcgtgtcggcagagaaaaacacactcattcaggccgactcccaaatattggtcgatgcttcaatcgaatcatccccaaacccaaaaaattcattttgcattgatcgccctgacataagtcttattaagaagggactgtcagtcattaatagtgtctcgcctgcgggccagaaacaaataaaagtggcagtggtcaacccaaccatggaaccaaaatggatttggaaaggaacacatttggcctttgtcaatgaattgttgtgtgaccgaaatggacttttaagggaaaacagcacaaaagaaattcttacccttatttctgaacgaaaggaaatggaaattgaccccacatttgtagtcgacttttctagggccatggtcaaagacaaagatttggaaaagctgaaggcattaatcgaagaattttctgatgtttttagcaaattcaggtacgatcttggacttttcacagccgctgaacatcacatcacaaccacaactgaggaaccaatagcatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaactcaacgaagttacggtgcccgacaagtaccctctcccacgccttgacagcatcatggaaagggttggaaattgccaattttacagctctcttgacttggccagtggctattttcaaattaaattgagtgaagaaacgtcaaggaaatgtggaattataactgaagacaaagtgtaccaaatgattacgatgccatttgggctgaaaaatgcaactgcagcattttcgagggccatggctatcgttttgtctggattggaggatacttcattggcctacgttgatgatgtgctcattttcacaaaaagtccgaacttttcagagcacttaacggcggtaaggaaagttttggagcgttttcggctttataatctgaaacttagcccgaagaaatgcatttttgcctcaaatgagatgaattttcttggatttgttttaacagctgaaggttttaagccaagcttaagtcgaatcgaaattctcaaagaaatgcctgtgcctttaaatgttaaggaagtaaagatagtgctaggacaggcaggcttttacagacggcacattgagaactttgcaatggtcgtagagccattgctgaagcttacgaggcaaggcaataaattcgaatggggcagggaacagcataacgctttcgacaagataaaagaattacttactcaagccccgagtctaatttttccagattacgacaaagcatttcacattttcactgatgcatcatcgactggacaaggaggagttttaatgcaaaagaatgacgtgactggcacattttctgccatttcctattgcagcaggaccctctctgctgctgagaggaagtggccggcagttcaaattgaaatgagtgccattatttatgctttaagggaattcagaccattcatcttcatgtcggacattgaacttcacacagatcacaaacccctcgcgtttttgctaaaaaaatccgaaaccaatcagcaattggcacggtggctcattgaattgcaaaactaccaagttaagattgtccacgtggcaggaaaagccaacactttggctgatgcactttctcgtgccgctgaggacaagcccttgtcggaaatatacaatgtggatgaactcgaggacattatcgaatttccggtctgtctcgctttggcagcacattccagggtggtcgcggacccatttttgcatactttgaccatccgacacgaggatggaaacacttacgaagttaatttgttgaaagaacaagcagctgatcctgaagccgcggcctacatttcgtttgtcagggatggggaatttccagctgatttggatgagaaagaaaaagaattatttgctgtaggcactgccaattacaaattaatttcgggaattctttattttgaggacaagggactccctccgaggatatatgtcccaatttcgttacgtggactcatttttgaatcatttcactcgtctcttttgggtggtggtcatttgaattacaggaaaacaattgccaagtgcaaaaaatatttttggcccaaaatgtactctgacgtttaacttgggtcaaattgtgtgtcacctgccaattgagacacaatccaacacccgcgtaccgggaagagatgctcatggtgccagccaacacactttttgccaaagttgggctggacttggccggcccctttccagtcacccaaaaagggaacaaacacattttaaatatcgtttgttggttcaccaaatacgtgatttctgtcccggtccccgacacaaaagcacaaacaattgcccacgcctttctcactaattgttacttaaaatacggcggttgtgttgaattgatcaccgataatgcctctgccttcacctccgaatttttcagagaattttgctccatgctttacattgacaaaaagtatgcctgtcctcattggagtcaaggcaatgcgtcaattgaacgcacttttcggacatttcacaacatcttggccaaatacatttcgaagactcagcccgacttcgatgaatttttggatgctgccaatttttgctacaacacgtcagtgcatgcttcaacgggtgagactccattttttcttatgtttgggcgtgacccaattttctgtgttgatcagatcattgatccgaaagttcgtgatccgatagccatttcggaccgtaatgaatttaaacagaagctggtcgttgccataagacacgcgtggcacgctgcagctgatgaatatgcaaaagcccagcgaaaaatgaaggaacaatatgacagaaaggcaaggccacaacaaatcacaattggtgatcgagtgctgatcagaaactacgacggacgggtcggcacatccaaaaaattccaattaccgtggcgaggaatttttcgggtcatcaaaattgagggcatttatgttactttgatcagttgcacttcgccaaattcgatcccaaaaagacttcacttaaatcaaatcaaaaagtgcttcgaaattttgggccccccgtgcactacgccaatgcaaccaattgaagagcaaaagtgccttgaaaatacaccaagcgtggaggaagtcagttcggaaaggtctgaaattaggaatgaaatggaccccgagtcccgaaaagatgagaacttagaccaaatccaagcccgagggccggaaaaaagaccagaaattgaagccgaggcggagaaaatcaataaaaaaacggatatggaaccaagaaa

SEQ ID NO: 78958 - DNA, 872 bp, Heterodera glycines
  misc_feature (527)..(527): n is a, c, g, or t
  misc_feature (571)..(571): n is a, c, g, or t
  Genomic contig location: Contig_ID=SeqID_14810; Location=2158..3029; Strand=+
  SCN-specific regions: Sequence locations=1-364,390-499,521-872
atgccgcgcctgttttgtcggctggcgatgaatccaacggaaagtcaatcgaaagggtaagcgaattggaaactcaaatgaaaacaatgccataaataatactaaacctgttcagcacatctcagcgccatcctccggccaacagcaaatcgtattggacaacccaaaggcaaattcaagaaaagtgcgggaatcgattggcactaacactgcggggaatgcaacggcagaagtgggtagtctcgtaaatgggacggcggacgaagcgatgagcacgacaaccgattcgtaaggggggcagtcccgtggcatgaatgtgcggttacctttgaggttaagttggtttcactgcctatgtcgtattaaagaaattgtaaaataaaaaattcaacgcccaatgacagcatttcaaccgaagccctcggttgtttctggcttattctcctcatcttcttcatagtccttgacttacactgcaaggcaaaagcaacactacaacaaaaaattaagaaaacaaaatgagggtntatatgtaaaatttacagaattcgtgcacaaaaaaaacaaattncttagggtcagattttcgtagttgcacacgcataaaactttagttctaggtttcgcaagaatactaaacagcggaaatacgaggtgcggaccatcttgtccacgacaacatacaggaaggatggacaattgcgacggatcttctatgtgcattggctgggtaaattaatttgtttacaattttacacattttttctaattaaatttattcaggctagagccggaagaaattgctgaaaaactcagaacgaaccttgagtatatttcttgtaagtttttatggggaaattagttatataata

SEQ ID NO: 78959 - DNA, 236 bp, Heterodera glycines; identical to SEQ ID NO: 56319
  Genomic contig location: Contig_ID=SeqID_14810; Location=1278..1513; Strand=-
  SCN-specific regions: Sequence locations=1-18,40-236

SEQ ID NO: 78960 - DNA, 1706 bp, Heterodera glycines
  Genomic contig location: Contig_ID=SeqID_14811; Location=1..1706; Strand=+
  SCN-specific regions: Sequence locations=1-139,173-315,351-443,468 -985,1007-1034,1151-1371,1447-1450,1473-1536,1559-1654,1676-1706
cttgcaacaaaatatttttttccaattgtaaacacaaatttttttttaggattttcaagtgacattcactggtcattcattgggtggtgcgttggcctcactcgcagcaatgcgaacagtgcttgaaggaatgcggaggtaaaaaaataaattttaaattttaaaattttttcacttttatttttaggagtgatcaaatcaaattgtacacatttggtcagcccagggtgggcaatgtcgaatttgcattcaaacatgatgaactcatccccgagaggtgtggttttttgtgttcaatttcaccaattagcttcataaattttccataaatttgtattattttttgaaatggtttttttagtactaaaatatggtgccgtaaaacagtatttatatgaacattgaaacaaaacttctttacagagtgctgaaaaaatttacggaatttttgtattttgggtttttgtattcgattttcaattaaaaactcgatgatttaatggatcacttacgaatgaccagagaaaccaaaaaaaaacacagcgaaaaatggaccattggggtcactttttcaattggttaaaagatttttcaaaaattacttttaaaaccaaataaaaaattatcaaccggtttataatggtcagaaatgttcattgaaaagactggtgaagtaaaatcagcgaaaaattttgaaaattaatattcccaaaatataaaaattctgtgtctttttccgcaccattagttgccaaaaatttgtcaataaaattattggttcattatttgggtttttgtcagtttccgtgttgttttccgcatggacattgtggcacatatgcctccatgtgccaaaaatcagcattacgagggtgtggacgaaaaagatgacagcaaaccgtgtgatccatctgcttctaatggcattgcatatcatcatggaacagaaatttggtaataccaaaataccgccaaattgtaattaattatttgttatttgctattgaccggatatatattaatttaaggtatcgaataattttttaaattcaattatgatttaataaattgatgtttttatattcctttaattttaagaaaacaaattaattcgtttgtttatattcgaaattttaaaaaatttaaataacactgtaaaacatcataacttactgtaaggtacccgtacggaatggaccctggcgatccgtattttgaatgtgttggctcaccacgggacgaagacttccactgcagcgattcgatgtcctttgaaatgtccaaatactccatttacatttcggaccatcgtcattattttggacacaaagtgtgtatatgcagatttaaaaattaaaagcatttaaaagctttttataattaaaatatttatctttttttagacttttaaatgtcacaaaaattattttaactttatattaaaaaccaattttattgattcggtttttatgaaatatttatgaattagacaaataatttaaaatctgttgggatgcgctaaatgtctaaatatccatattttattatttattttttaggttcctgcctggggcaaacttggatgcccgtcaaactcgcgcgggttggaagcattgcacagtgagccaacagatgaagccaacagtgccgagggcgggggcatttttcaaaaattgtctcaaaagttcagatcgatcggcagaata

SEQ ID NO: 78961 - DNA, 893 bp, Heterodera glycines
  Genomic contig location: Contig_ID=SeqID_14811; Location=2524..3416; Strand=+
  SCN-specific regions: Sequence locations=1-226,248-710,733-893
atgttccaatttttcattttttccacccttttttgccttgtttgtgtggcttatgccgtcccagctgaaaatgtaggttcaattgtttggaagagcaattaaatatttaattatgtggttaatttgcttcaaggaggagcgtttctgccactcgatggcagacaattcggtctacaaatgtgtccactgcaatgatcctaaacaagagaaaatttgtaagtttggctaattttaccaattaaaaatttaatcggagaaaaaataattctgaaaaattctcctaattataacgattttatgccaaataatctttaatatctgaaccaaaaagggatttttatgactttagtaggacactgataaaaattgtggtcacaaaatttagcatgattatcactaatttaaatgattatttggcacattaagctgctatatgtgagcgatgacacaggctgcgtgttctaattaatatttcattttaaaataattcaaattctctaagaaaaaaattttaggcgtcaatctgcgcacgcttttcgaaacggtttcggtgagtgccaaatcagagacgcgtctgactttgacgacggaaagtgacaaaacggagactctgccgccatgcatcgaatttgttcaaactgaaaccaatgcccaattgaatcatcgctctacgattaaggcaaagacggaggccaacaaagtcgacggtgcagatggtgaacatgtgcaaattgctgtaatcgtaagtttgagattattagttaaatgatcatattcgggttactgtatttccttccctaatacagtaattaaataaacagaaggaaaccagcaaagtcgacaacaattccgctgctgctaataatgacaaacagctgccagttgctgtggtg

SEQ ID NO: 78962 - DNA, 960 bp, Heterodera glycines
  Genomic contig location: Contig_ID=SeqID_14812; Location=167..1126; Strand=-
  SCN-specific regions: Sequence locations=1-63,85-472,495-797,819-960
atgccaactgttcgcgaaatacttaagagtctgcaaaagcgagtaaaaaaagcctcgcattgctacaaatgaagacagcgtactgaatgttgagaggacagacgcagaacaacaaattgaaggcacttcaaccaggaacaatttggacgtcgcttcgagtgatgacgaagaaaattgtgagcccgttcaattcaaacgtggagaaacaatcctgggagctctttgtctttggtatcaaggtgttaatagtttttttttatttgtatttctttattttcaggctttcgatttatcaaaaacagaaaagatggtagctggttcaggtgcgaacagcgcaattgtccagcgacagccaaattagaagacaacgatttgatgacaggcattttgggcgcaaaaggacatcaccatggttgcgcaccatcgcgttatgatgcagagacgaaacgaaatcagatgaagcgcctgatcaaggaggagccaaaaacgaaaccatgtcaaattcggactgacatcgacgatgaagtcttcgaattgctcggcagcaatgaagcgctcgaccaaatggcgaacaggtagacaaaattcagagaaaataatgacgcaatatttagaacaaagaacaaattcgttggtggtgtcaaccgtgccgatccactgaacatacaaattccgcctggtcttttgataaagaatgatgagtccgtcctcatttatgacagccgtgaagtgaggactggacaatctgatgttgtcctgattttcagtcatagcaaggcaagcctacctatacttatgtccttttttaaacaaaacatccaggtgtcctttattaattcaaagtgttttttatttttacaaatcagatcagttctttctttggcactcattccgccagtttacgttcggcacgctttttcaattattgtcaacgcggcaccccttggagttcaaggatga

SEQ ID NO: 78963 - DNA, 2269 bp, Heterodera glycines
  Genomic contig location: Contig_ID=SeqID_14812; Location=1494..3762; Strand=+
  SCN-specific regions: Sequence locations=1-572,594-716,740-1085,1107 -1148,1177-1372,1395-1466,1488-1850,1872-1950,1972-1990,2020 -2215,2251-2269
atgtcatgtagccgtcctgaaagcatccaacaaaacgaatatgtaatagaaactgagcaattttcgagccaattttcacacatgggaatgatatccaataaaaaagacactggaaaaattagtcgaaatcaaatgacagaggaacaacgacaaattatcatggcaaaaaacgcaatcgccgcaaaaacatatagaaaaaaagtaaaaaacgtagattttttgcttttgcaagcgtctgaacaaaacacttataatgttgaattgtatgaacttagtgaatttaaagtaaagtgtaagcattgtccggctatacatttttcagaagaagaaagtaagacaagcggtgccaatgaattttttgattgttgcaattatggcaaactatgtattttagaagaactaatccaggagtatccaatagaactaagaatattatttcagcctgagcttgacaaaaataattatacaaagattggagaaatgcaccaagattttctaaaaaatataaggatgttgaattcttctttttgctgcgcttctttaggttgtatgaaatttaaattcccggataaaaatattccaatttttaaaatacaaggcggtatatatcactcatataacacatttgctcaaccagataataacgagttaccaatgaatggtcagttatattttatagatactgatcaagcaatggattatcgaataaatgcgttaaataaaaaagtggtaggagatgataaaattattgcattaatagcatatattgaatcttatctacgccaaaattatgtttattcacaagcatacgaaatgatgaaggatgtatatgaaaatgtattaaaagaagccaaaaatgatgctattcctgaacttacgatggtgtttgatgttagaaaagatgttgatttgagacgttataacattccaaggtcaaatgaagtttgtgctattatttggcgtgatgcaaatgacgatataccagcagctaatgttgtagtgcatacaaaaggcaataaaaaactagaaacaatctttcctttaagtccattggttgagccaatgtgttacccaatcttttacccaaataattaccaaggatggaatcatactttaaaaaactctgaaaacaaaaaaatatcgttgtgttattttactaaatataaattattttttcgtgaaaatgggaagtttttgcctcatcattatagtggtaaattatttcaacaatggattgtcgaccaagcagcaagggttgaatgggataggttaaattatattaagcaacatcaaaaagaaatatgcaaagaaacatataacgcaatagataaatttttatttgcaaaagcaactgaagatggtgttcatgttaaaaagaaaattattctgccttcgtcgtttactggtggaccaagaaatatgtatgagagtttcagatcggatattgttgcaagagtgttttatttaaaaataacccaatttttaaaagaaataattgatggtcaaatatttggaagagtttcggggttttgttattcaattgagtttcaaaagaggggtcttccacaccttcatatgttattaactttagatggtttaaataaatggaaagaaacagatgacattgataaatttatatctgctgaaattccagacaaatgccatgatgaaattttatatgagttggttacaacattaatgacccatggtccgtgtgggcaagattttcctaatgctgtttgctggtgtcagaaaaaaaataaatgtaataaaaaattccctaaaaattatcgtgaaaaaactgaaataaatgaaaatggttatcctttgtataaacgaccaaacaatggaaaaacattcttaaaaaaggattggaaaacagggaaaagtatgtctatgacgaatcgtgatatagttccctataaccggtatttacttaaaagattccaagcacatataaatgtagaaaaagtggccgacattaaagctgtaaaatatatttacaaatatatttttaaaggttatgacgcagcaaccgtacgttgtgtaacgagtgggaacgaaaatgtaaaagaattagtttatgatgaagctggctcttttcttgatgcacgttatctgagcccagtcgaagcctgctggaaaatttttaaatttcctttgcaagggaaatctcattcggttcaaagattacctgtgcacttagaaaacgaacaaattatattttttgatgaaaatgatgaggaggaaactattatagagaaaagtg

SEQ ID NO: 78964 - DNA, 844 bp, Heterodera glycines
  Genomic contig location: Contig_ID=SeqID_14813; Location=162..1005; Strand=-
  SCN-specific regions: Sequence locations=1-90,112-844
atgagtcggctattggacaatgcaaaatctggcgccgtttttgtatcgttcggatcattcacaaatgcccaattaatgccctccaaaatgaaaatggcctttctaaacgcaatggaacagttctctgaggtcgaattcatttggaaattcgaattaacagaagaggacacaaaagtgtttgccaaatatcgaaatgttcacacaatgaaatggaccgaccaaaaagcaattttatgtcagtgcattaatgattaattagttgtaaatatttttacattactttttttaaaagtgcatccaaatacgcgtgccttcgtcacccattgcgggctgaacagtgtgacggagtctgtgcgtgccggggtgccggttttggccattcctttattcggggaccaacttcacaacgcaattttggccgagcaaaagggcgtcggcataaaattggacgtaaacgctttgaggggggaggcggcggacgaagtgttcttcgcctcacttgacaaggtcaattcggaacccttaaatgttttcagcaggtaaatttcagattctccgtaatccgtccttccgtcggaatgcgcaaattttaaagcgcaaattccaactgacgccctttgagcccaaagacaaattggtccgatgggtcgaatttgccgcccaatttggggaattgaacgagctgaacttgccctgggatgaccagctcggcctcctcgccttttactccgtcgatgttcctctcttcgctgtttcattcgtattttttgcttggattgcgtttaaaatgacaactcttttggtcaaatgtttgttgtcaaaaagaaaagaaaaaaatacataa

SEQ ID NO: 78965 - DNA, 1411 bp, Heterodera glycines
  Genomic contig location: Contig_ID=SeqID_14814; Location=39..1449; Strand=-
  SCN-specific regions: Sequence locations=1-4,42-244,302-390,413 -567,589-717,739-1411
atggtatttattaaattttaaatatatatttaaatataaatgattaccaatggtgccgctggaagaaggctgcgaagatgagcgtttggcattcggtccattggcattggcggtttgaaattggcaaaatgtatcattgtcagaatttgactgacaaaaaagttccgcggtttctgatattccaacagaattgtcgctgctgatcagcatttgattcctcttgataatttagttttgctaaaggttttttttttaatttaaattaaattttctttttccatttcaaaattatattatttttgctttactttaaatttgccattttgcctccactgtttctacgaattagcaaatataggggaaaaaggcgttcgaatgaacagagaacacgtggaaaaggagaggggagggatcattatgattttgagttttttaaaagtgattgattgctgacaaaacaaacaatgatgaatgatattggataaaccaaccatcattctctttttggcttggcttttcccacttgtccgtccgtccgttccgtttcgatccgttcgttcgttcgttaattaattggttgctgccttaggcgatgtttggtggcaaccaaaggaaggcggaagtaaaagattcgtattttcttgtaaatattgccctgtccacggggaaaggtgcaaatgaaatgccaatgcccaccgcctcccacttttttttcttcttgaatttgcatttttgtatcaatcagaaaacttcgacgattgaatttacaaaatttgccatatttagcattaatcattaattaaatcatttgattgtctctttggctttgtaattttctgctgatgcgcaaatagtccttattatttcttttgttaatctaattttttaattcgcaattgtcgctttttcaatgtgaataagaaggttcagcagaataaattcaaaattataaattaattcgaaattccttaattaattaaaagacaaaaacaaactccgaacaaaaaaaaaagaaaaataaacgaacatgaaaagataagaagaaattaagtgaatgacggacgaaaaaaaagtgaaatcgaagagccgattaacaatcaaacagaacaatcatcactcggatgggtttgacattatcacaaaaattgtacgctgttcaatgttagttaataattttttaattttgaatcatctcttaataaaaaaatggtaaattaatccgctttagctgattattacatctcatccgatggatttcttttcattgctaatattaaaattggcatttctttcacttttcggcgcattcgctgaagtgccaaaaaaacggctgaaaagtgttggtgtattcgccgactttgacatggagtcacatgcaattcatgggcacaattgcggacactttggctga

SEQ ID NO: 78966 - DNA, 258 bp, Heterodera glycines
  Genomic contig location: Contig_ID=SeqID_14815; Location=1416..1673; Strand=+
  SCN-specific regions: Sequence locations=1-3,120-258
atgcttctcttctgtaagccttttctttcctcgtctgtctctgtactgtctcgtccctctctttttctcagcctctcttctcctcgtgctcctttccgctcttctctcacttctctgctgtgtccaattgtgccgtcgctcaaaatcctccacccattgcaccgatgtgcacgaacttatggctatcgcagcggaggcgggagggccggtggtgtcggatggacgcggcggacattgcggtggcaatcggatcagcgg

SEQ ID NO: 78967 - DNA, 101 bp, Heterodera glycines
  Genomic contig location: Contig_ID=SeqID_14816; Location=305..405; Strand=+
  SCN-specific regions: Sequence locations=1-101
aaattctatccgtcaaatcggcttttggaattttaatgagtaaatcaggaaccgtaaatgacattctatgcttctcttgttggatacacgggaagaaataa

SEQ ID NO: 78968 - DNA, 1335 bp, Heterodera glycines
  Genomic contig location: Contig_ID=SeqID_14816; Location=618..1952; Strand=+
  SCN-specific regions: Sequence locations=1-57,79-569,591-742,771 -1228,1256-1335
atgacattctatgcttctcttgttggatacacgggaagaaataatagttagtccttttgttgaatttttagaaattttatccgtcaaatcggcttctggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaatttttatgagtaaatcagtaaccgtaaatgacattctatgcttctcttgttggatacacgggaagaaataatagttagtccttttgttgaattttttgaaattcaatccgtcatatcggcttttggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcagtagcgggtacgtgaaccgtcggctatttagctggtaaaaagcgcttcgcgctttgggagcttcgctacctaggctgtgaagcgattcaaattgatcgaattggttggagagattttttgaatttttaaaaaaattattagaggtttttagtccacattgaggctcaagacgggcgcttcgcgcccgttttttaaatttgttgaactcatacgggcgtttcgcgcccgttttttagcttgttaggcgcttcgcgcccgtttttcaatttttgttggccttggacaggcgcttcgcgcccgttttttaaatctgttgaacttatacgggcgcttagcgcccgttttttagctggccttggacgggcgcttcgcgcccgtttttcaaattttgttggccttggacgggcgcttcgcgcccgtttttaaactttgttgggctttgacggccgcttcgcggccgttattaaattttagaacagatacaaaagtgattagaagaggtacaacattggtcagaagaggtacaacggtgattagaagaggtacaactgtgatcagaagaggtacaacagtgatcagaagaggcaaaacaaatgtgttaataattttttaaaaattaaaaaatggtagttattaattaaaaacaacgttggaaatttattcatttaatttgaaattaaatgaatttttttacaaattcaaaaa

SEQ ID NO: 78969 - DNA, 1001 bp, Heterodera glycines
  Genomic contig location: Contig_ID=SeqID_14817; Location=310..1310; Strand=+
  SCN-specific regions: Sequence locations=1-323,345-662,685-729,751 -800,822-1001
atggaagaatttgtcggcatttaccaattcaattctcatccgaatctcagcggtgtgcccgggctttatccattgaaatttccaagccacgcgcggatttccgattggaacaagccgaatgtgaacagagggacattggcgatggaaattaagaaattgtcagaatttgctcgagagaaagaggggactagccgattcagtgatgctgtgccaataaaaggatttcagtggaaaatatgggcacagataaggacgaaaaaggacagcactgagaaatggctgggctttattcttaagtgcgatgcttcaaaagaaggtgggatcaaaataaaatttacagatcccattgcgaggtatttcacatagaagttgtgtttttctgattaaatcgtattttctatacaaaagcaggcacagaacaaacaatacagggccgaatgcaagaatacgacaaaatttagtaatatattttttggaattcagatgaaaattggaattgcatttgttcggcaacatttcgaattgtttcgcaaatgcgaggcactgaagatttaattggaaagtgcaatgaccacttttttaacattaaaataggcatctgcggtttccacggtttcatcacttttgaagtgagcggcaaatttggaatgccttttaaatggtttttgttaattaagcaattaatggacccaagcagaggattgtatgacaaaaatgaggacaaagtgacattgaccattgatattgctgtggaagatcaaaaatcgaagaaattcgattcggacccaaacaaaccaaacggaaaaattgtaatggaaattggaaaattgtcggaatttgcgcgagagatttttctcagcgaacggagcagcgaacccgtgataattaagggtttaccatggaaaatattgacattgataaatatgaagaaagacagcacagaaaaaagtttgggctttttccttcgatgcactgccccaagggaagggtgggataattaa

SEQ ID NO: 78970 - DNA, 1120 bp, Heterodera glycines
  misc_feature (15)..(15): n is a, c, g, or t
  Genomic contig location: Contig_ID=SeqID_14818; Location=72..1191; Strand=+
  SCN-specific regions: Sequence locations=1-122,147-157,182-423,446 -816,838-1120
atgcagcgatttctntgggctgtatgggcaagtctaaatacggcggaaggcaccactgaaaaatgtttggtcttttgccttttgtgcggtgctcaaacaaaaggtgggcataaaataccatgaaaatagaaaacctttaaatattttgcaaaatctgaattttaatttttttaaaattattgttgaaaaattaagtgccctcggggtttaatttagaaataccataatctaattgttattaagatgaaaatgggagctgcaaagttacggcaacccttcgaatagtctcaaaaaaaggcgaagcggaggatttcaccggcaaattaaatgatcaaatttttgacaataaattggtcattttttctatcggtcatattactttgacggtgagtgaaataattaactgtttttaattgtttaacataaaataattaagcaattaatggaccaaaacagaggattttatgacaaagacgaggacaaggtgactgtgaccgtggaaatcactgtggaagaggagaaaaaagggacgaagcgtaaattgccggatgagtaaaagcatcaaaatcaatttatttgtttaataaggcatttttcttgcaattattcctccttttgtatttaattacttttcaaaaaccgcttgtttttgtaattttaattggtactttccttccccttacgatattcatctcaaaaattggctttttctagaacaatttgtttgtttaacttcataaattcaccacccaagcaaatgataaggccatggacaaaaaaatgttattttaaaagacaaaaaaatgagacatttgaattaataatttttctcagtttcctaggccataactttttttttcttaatttggcattacatatattcttggtatcaaaccaaagcttaatgtctcaataatttacaatgagaaaacacaaattcaactttttatctattgccttgagatcagaatttaattatacaaaactctatagaatttaatcttccgattgatacccaataatgagaaattgacgaagaaaaaaagctatggcctaagaaactgagaacggttcactgatcggacgcataaactaaagtagagcccaatttttgccagta

SEQ ID NO: 78971 - DNA, 592 bp, Heterodera glycines
  Genomic contig location: Contig_ID=SeqID_14818; Location=1372..1963; Strand=-
  SCN-specific regions: Sequence locations=1-426,448-592
atgcggcggcgtgcgcaaaaaagagaagtaattagcattaggacgacggcactcggaagagaacgttggcataaaagaaagctacgaagaggaaaatgtgataaaggctcatttggattagcaaaacatttttggaatttggctaaaattggtgtgaaaatgactgatttttgaaaaagggattaaaggcataaaaatgcacaaaagcgatggtggcatggcactaaaattactggaataaaactgatcaatgcatttagcaactttaaattgaggatagcagccgcattttttaggaattttgagataatccggtcaaaaaattaaatgtaaaagtggcaaattcgattacacaaacaaaacaattattttcctaataataattgttaaggtttcgaggaagagatttaaatattccgtgtaatttaataaaaattgcacatttaacagaagaatgtccaactccgaaatgtcctcctaaccgaactctgccgattggaacactgagaaagtacacattatgtattaattataccttataaaaggatttcccccattatacagtgcaaccagtaattttgcaaacaataaa

SEQ ID NO: 78972 - DNA, 624 bp, Heterodera glycines
  Genomic contig location: Contig_ID=SeqID_14819; Location=1220..1843; Strand=-
  SCN-specific regions: Sequence locations=1-128,151-152,175-385,414 -414,445-624
atgcagaatttttttctctatcgatatgtaaaatttggtgtggatttaacaagtaggaaaaaagttaaacaggatgaagtaaatgttgttctttacattattaagaatgaagagatagtacgtaaaagtgagagaaataaagataaaaagtaaatgtgacagaacgccaattttttcccataattatccataaaaaagatttattgccgcttttttttcttttttaccgtccatgtgcggctttaactcgacgagaaatgtacgaaaaacacattttttgttcgaaaattttgtgttttaacgcacttattcgaacttagaaatgcttattttgtatatttaattatttgcaactgtatgtagtcaataaataaaattgttttccttaatttaaattattttcatataaaaaacagcaatttaaaaaattatacccctaaatttggaattttttcgagcttattttcgcacttatttcgcgatttttcgcacttatttaaggccttattttggactttttcgcgcttaaaaatccgttccctactaatcataatctcttatatccttttcagttttttttattgacaaaaacttaacgaataaaacgctaatctaaaaaataaa

SEQ ID NO: 78973 - DNA, 1035 bp, Heterodera glycines
  Genomic contig location: Contig_ID=SeqID_2294; Location=100..1134; Strand=+
  SCN-specific regions: Sequence locations=1-133,204-329,351-458,481 -529,560-639,661-972,1019-1035
atgggtaattattggaagaatctattaataaatctggcaaaatttgatgtccctgtcccaattttggtctctcacaaatcatttccaaaaaaatcttttcgaattaattttgttccattcttttcctggataatttttgttcctttttgctttattttttttttcttccgcattttctttattccttttcttcccatttttctccagaaatttcatcaaatgccttttaaatttcatcaaatgccttttaaatttcatcaaatgcctttttttgtagttctttcatttctgatttaattcgactaattagagcatttaatattaaaattaaacagaataaaagtaataaattcatttttcaaagtattctcgaaatgtatttttttaataatatcgaaaacgattaaattttacttatccaaatctataataaattcttaattcttttttaattgtgaataaatggaaaatgaaattgaatttttttaacaaataaaacaaatttacttggttttctgctttaagaatctttaaattattctttttttaaaatttatttcgaaattgcagatggaaagccaaatttggagaccgaattttatttaaaaaacaattggattttctcatgaaaacattgcttgcaaatttccagaaaatttcatttagtgacaaattttacttgaattactttgttgtaattagcgtacaattttttgtttcttctaaatttttaatcaatttaaaaataggaattaaattttatgaaaattaggttaaaaaatgagctttatctcttaaaattcacattgtttatctttaaaaaaatgattagttttaacaaaagccacacgtcacgggacattgaatctgcatacgattcgagtacaatgtgcaataatttttttcatgtttttctgcgcagctcatcgaaccggagtatgaaatccaatctttgcaacctgtaaaagaaagaattaaattatttttataattacttttcgatattttataatttaatcgctataagcccaaaca

SEQ ID NO: 78974 - DNA, 580 bp, Heterodera glycines
  Genomic contig location: Contig_ID=SeqID_2295; Location=226..805; Strand=-
  SCN-specific regions: Sequence locations=1-96,132-179,202-253,287 -299,335-517
atgggaaaaatttcgttaaaattatttttggtcaatttttttgcagttatttacgtggctgttgaagcaatgtattattgtactcgtaagtctaagaaattttaatttaattattgaaatattcaaaatatggacaaattgaccagattttacggtgaaaaaaaaattcagtccaaattaccaatgttttaaaacaataaatttgtcaaaacttcaaaaaattcaaaggtggaaaaaatgaaaaattgctggatttcttttccagtaattttccaccaaaaatgcaacaacattaagccattaatatatttaaaaatattatatatgttttttagactttgtctatgagtcgagacagaatctttgccctccgacggatccgccgctcacttattacgcttcggtgcacttgtgctgcaaggaggactcggaatttggcatggcattaatttacaggacgttcgcaacggaaccgccaacaacttttccgcaggggtgccggggtaagaaatttgaaaaattaaatcaaattaaaaaaattataaatttaaattaattttaagaaaattaaaaaaataaa

SEQ ID NO: 78975 - DNA, 570 bp, Heterodera glycines
  Genomic contig location: Contig_ID=SeqID_2295; Location=1829..2398; Strand=-
  SCN-specific regions: Sequence locations=1-82,105-235,257-324,368 -379,404-453,475-490,519-570
atggcacttgtggaaacgcacgaaaaacatgttgttttttttgtggttgttaaggtatttttcaagtcattagtagggaataagtttttgcttattttttctgcggctttaactcgatgagaaatgcacgaaaaacacatttttagctcggaaattcttgttttaacgcacttattcgaccttaggcttattttggcgtttcgtgcttaaaaatgcatattttagaggttcgcccttaaaataagtttttgcacttatttagcgttttatgcttattttcgttcttatttcgcaatttttaaaaatttttcctgtaaaattctcaaattttttaacaaaaatacaatgaaaaataaaaaatttttttgacgcgatcacattttttggcgacttggttaaaaattttcaaaaattcttccactaaatttgtttttttttatctcggcaaaaatttttgtaatttattttctttcttgaccaaatactgggttttcaaattttattaattttagaaaaatgtattcaaaatttcgaatatttaattatttgcaattgtaatcaattaataaa

SEQ ID NO: 78976 - DNA, 449 bp, Heterodera glycines
  Genomic contig location: Contig_ID=SeqID_2297; Location=260..708; Strand=-
  SCN-specific regions: Sequence locations=1-141,163-206,386-449
atgcactcgcttctgctgcttgtcaatgtcacggtttacatgataattttacttcatttcatgcccaatgaaaatgggttggccaatgccattccggtataatttttaatccgattttaaattcattaaaatacataactgtattgtgaataaaaaataaggcgactttgaacggaggcgacgcgttgctgttgagaaagaagcgcgaagacgaagatggagcaggtgaaggtgaagaggggggtggagatgatgccgagggtgcccaagaagacgccgaaggtggtgaggatgaagaaaaagcagacgaggatggagccgaagatgaagcaaaagagaacgaagacggagatgataaggaggacaaagatgaagacggcaaagacggcgaggaaggtgaggagtgccaaatcggggacaattggaccggagagcacagcactgactag

SEQ ID NO: 78977 - DNA, 722 bp, Heterodera glycines
  Genomic contig location: Contig_ID=SeqID_2297; Location=1962..2683; Strand=-
  SCN-specific regions: Sequence locations=1-1,23-139,209-296,318-722
aattgtaatagtcaaaccaaaattaaatttattcatgttcttcgtgaaccttgctgcaatcttaattttcctgcaattttatttggtgaaaattttagtttaatttgttttaaacataatttttgcaccttcgataatctattttttttaattttgaaaaatcaaacatttaaacaaaaataagaataaaaaatgatttttatttaaagaaagaaaaatatggcattcttgacatagccctaaaattctctgttagcctgcaaataaaagatttttgtcaagtatcacaaaacaataattttctatattaaatcaaacgcaattttttactttgcaggctaataagaacattcagggctaaaatgccaaaaatgcattttttttctttacccacaaaaaagtgatgtgacaatttctgcccaaaaaaagaattttgtgacaataaaaaaagaactataatttctttcgatgatttgtcacccactttataggatttgaccgaagcgggcatcgaatgccaaccaaacggagtctgtagagacgtttctggctcaactcctgcgagtaccgtatgctcaaaaaaatgctacagttgcacttacaaaaactgttgcaacaaagtgtacacgagccagtacgccaaatgctcaattaaggggtggcgtaaaaaaggatacattggcaatgtgccagtcgaaattggtgcaacgaagaaacaaacg

SEQ ID NO: 78978 - DNA, 632 bp, Heterodera glycines
  Genomic contig location: Contig_ID=SeqID_14822; Location=567..1198; Strand=+
  SCN-specific regions: Sequence locations=1-86,108-115,137-197,219 -268,291-362,385-449,471-632
atggataagccgcgacagcggctggcggaggcgaacaccaccgcaactgacgacgcggcccattgctccgccaactgcgacgaacggcatgacgaccacccgctgctgctgtcattcggggaggatgaggaggagggcacagcgaccagcgccgcagcggacaacggcagggacaacatgaacaaccacaacggtggcgagcaggtcggcggcactgccgcgaatggcgtcggtggcaacgagtgtggcgattcactgggcgtttccgccggcggcagcggcggcgggggtgccgatgacgccaactttttcttgtgctcgccgctcatctactcggagccggcactgcccagcgcattcgccaatggcggcgccggcgccggtgggccaacaattggcgcctcgtgggcctactcggaaatcgcactacctcaggtcttacaatttagtttagtttgggtgatgatttagtaattacccaactaattagccccccgttaattagctaaaaattagccgttttttgatccgtaaaatacattctattttgtacacttgtaaatttttcaaaatgtgaaaaaatcctgttaaattattatagattttgcccttaaatagccaattccaaggaa

SEQ ID NO: 78979 - DNA, 1449 bp, Heterodera glycines
  Genomic contig location: Contig_ID=SeqID_14825; Location=69..1517; Strand=-
  SCN-specific regions: Sequence locations=1-178,200-843,867-908,930 -941,963-980,1002-1118,1140-1449
atggactcggcatcagatgctattcgtcagttacaacgagcaatgcgcgaacagcagcagatgatctttttgctgagaagccagatcatcgatcagagagcagtgttgcttcagaatatgacgcggattgaatcaacggaggggtacttagccaacgtaagtttaattttcaaacaaagtattttaaaataattaatttcgtttattttgataaaatagtgatttgattatttcagtctcgcgggaaccagagattcagcccgagatactctcccatggcgggagtggagctttcgctgctcggccgtcgacttgaggaacgagaacgccgacaacagtctcgtttgggtaggcgatatttttaaattaagataataaatggtttaaagtgcaagtggagaataataatggtgcgggtccaagtgatggcagtgttcgtgccagaccgaatgaaaatcttaaaccctgaattttatttaattaaatttcgattttttttttgcagagcagctgactccgctaagttcacgttcgggaagcaatgggactctgcaaaaccgtactaatggtgtgctaattttgaaaaaaaatgaaaaagaaaaaaaaatttttttagtgagcaatgtggctgggccaagtacggcgagtgatggtgacgatgaacgtgaaaacggtgagatgaacccttaataattttacccaaataaatgcattttgacaggccccgttctaagcgctgtcatcgaaggccacatgaaccgttcgcggatgcgtctcattcgcgacgagatggttcatcgtgctgttcagcagcaacttgaacaccagcaccatctgttgcttcagcaagcgcagcagcagcagcaacgataagagcgagaaagacagcaacactttgatcagcaaatggaggaagcagagcttcttcacgaacaactgcaggcagcagagcaggaaaacgacgagaacatcgaaccacagccccctcagcagcagccgcaacctcaaccgctgattcgtcatcagcagctgcagttcgaacgtaatgttcgactgcagctgcgtgagtcgcaacgatttgaaaggggaggtgcctcgtcagtgctcgtcccgccagcccagctctattgggagaccgaatgcatcatctgcaccagcaaccgcgcacacttctacagccgtaattgcggacacatctacctgtgctcgacatgtgcggtgaacgcggtgatccacaaggtcgcgacttgtatgctctgtcgtgcgcgaattgaggggatttatccatttgtccgctgatggatgtatttgataattcttggacccctttgtcattgtccatcctatcattaccatattatcacaatttttgtaaacgattcattgattgccacttggccttagcaattctcaatcattatttaaactcagccaaaaaaaatcaataaa

SEQ ID NO: 78980 - DNA, 1569 bp, Heterodera glycines
  Genomic contig location: Contig_ID=SeqID_14828; Location=172..1740; Strand=+
  SCN-specific regions: Sequence locations=1-142,164-167,189-1569
atccgtctcccgtccatcccttgccaaattttgttcgttttttctgcgtttatggcgcgacttcgctgtcagttcagtccccagtcttaccccgacccgaggttcgtctcctgcggttttggctggcccattgagtggcaattcagaattgaccctttgtcatgccgtcttctgctgccttcccaagtctgtgacccttccgaaattttaacgcccgacgagcggcgcattctcaacgaaaagattgtcagggtacgccgggctttgggaccaatcgttttttgggagggaatgccaacgaatgtttagctgcaacagataacggcaaacatcaaaaacacttctcctgcctgtgccgacacaaccaaaagcaccaatctgttcattatggtcgcgttggtcgaccgtttgagcaatgcgttgccttttgagtgggtgcccttcggcgctttctttgcttattaacattagcatgtgaaattttgaattttaaaacagtggcagcagcgaccattcggcgaacattgagaaattcaccaaccaactccgctcaaaataccaacattttcaggtcagtgatgtcataaagtaaatcaaaaaattgtccaccacaattctcccgcctcacagcacaggacatttccctgtgcgatccgttggtgctcattgtgaacgcccacggggaccgacaagtgttcactgtggccggtccgtccataattatgatttaacacaccattttaaattgaacaaaaggcccagggatgagaggccttattttgaagggcgggatttcattggacatttcccgagagaatttcaggccgagatgccaaactgagcagagaagtgcttcaggcggcattccaacgaaatgtcggccatttccgtggcggaaattacgcattgggcctggagggcatggcggaatacactgtgtcggcctacggagccgcacacattgtgcaggtgccgagttttccgggcgagccgaagtgagcgtgggaaccacaaaaactagccaagcgattaattaattgcccatcaaagcacgaagaaagggacgaaaaacaacgaaagtttctccaatggtccgtcgaccgtttcttacggaatgggacaatttgttgcgcacggagtgcggcagcagcaaaggccaacaacagagaagaaatttcacatcgaaagcattcccgaggaggacagactctggacacgcattttggcaaaggcaatggcacagtgcggcggagaggagcagggcaaaatggtcaaatacgcacagacagtggtggaaggtggacaaagacgaattggacaagcggaaaatgccatcctttagatgccatggatatttccctgaaactgatcagtgacccgcactataacagaattgaggaggattctcaaagcatggaaaatggtctaaatgcccgggaaaaggcgtggcaaagcataaaaggacatttggagcaaatctatgcgaaatacggcggccaaatgcaacaaatgaacgcagccgaacaatgccccggcccgaagagaggcgaaaagacgctgaagatctta

SEQ ID NO: 78981 - DNA, 405 bp, Heterodera glycines
  Genomic contig location: Contig_ID=SeqID_14828; Location=2309..2713; Strand=-
  SCN-specific regions: Sequence locations=1-20,53-405
atggcgacgggtcttctgttgaagcggcggcagctgctgcagcggctgcaggttttgttttgtggtatattccccattcccaaggtgctctcacccaagactagcaataagtcccgggactgtctccgtttatcttttcgttgttttctcatatttccctcgctccgttcagctgcagccgctgctgcgaattcgcagcaaaattcgtacagcaccaaaaaggatggacaagtgatcggaccccaattggacgcactgctcagccaacagcagactaacgaagtgaactcagctgaaccatcgaatcagcagaaacaaaatgctacggggaatgaagagggaggcgggacgaggaaacgcaaccgcgaggaggcggggttggagcaggacggtagcgaaaactga

SEQ ID NO: 78982 - DNA, 741 bp, Heterodera glycines
  Genomic contig location: Contig_ID=SeqID_14829; Location=105..845; Strand=-
  SCN-specific regions: Sequence locations=1-533,555-741
atggcattggcacaaaacgcgcaaatcacaacagaggaaaattgcgaaaagttgcacggcaaaaacggcgtcggggaaacggcaacggaagaggagacgatggacgaatgcgcatttgtgacggagccgttgattgaggccggtcaagaccttgccaccagcgtacagtgcacccgggacggaagtccgctgagttcgcggtcgatggatgccgtcgtaagtcgaaggaaagaaaccgcggacattacattcatttataaacaccagcagaatggcgaagaatggccctcggtgcgttcgacctctttcaactctcaacggtccagcggcgccggttcgcccgcgagtccgtccgatttgcccgactcgccgtcccaatgcgtcgcccacaaacccttccaattggaagcgatggcggtgacggattattacggaattgcattctatccaaactcttcttttcttcagttgctgatcaaaaaagcattggaagaagaggacgaggccaaagatgggaaggatgacagtgggacggaagaagaacaaatttgggggaaagggtcacaaattgacaccgacgaaaacggaggaaagggcggacggagtgacattgagcaaagtcaaaagcgagcgaaaatgggaagcgaaagcaatgggcaaatcaaagaagaagacaaatcggagaaatcagcgagcgaaggcactttggctgaggaaaaggcaaatgctaacggaaggtag

SEQ ID NO: 78983 - DNA, 639 bp, Heterodera glycines
  Genomic contig location: Contig_ID=SeqID_14830; Location=1363..2001; Strand=+
  SCN-specific regions: Sequence locations=1-340,362-542,564-639
gttgttttgtttgatcagtggcacagcagcagcgaattggccgaacaacaggtcgattctctgagaaatgcggtggctaaactggagacttgtgacgctgatgctgttgcccgattgtctgcctcggtcgcgcgtttcgaaactggaaactttgcaaaattgaaggagtcaggtcagaggatcattcgtccactgagtcttgaacggaagcgaaagattgaagtgaaggtaagcggaaattgatagcgttatgtgaggagtatgtgttttgttgcataaattgacgttcctcagtttagctgcatttaggaaaatcgtaaatctgttttcaacctgggttttccattttagcaaagagcattaagtcttaatttaagactgtatttaaaaaaaagaaatttcaatcatatgaaccgctgtgagtctcaggtggccgcgatcgaacgagagctgggctttaacaaatcctcaattcaacatcactccaaaaactctttgcaaatcattgacaaagaagttcttggggtgagggaatggatcgaagaaagagacaaagatgcagatctcgttggcactttgttgaaacacggtgagaagaagcatattgacgagattgacgcactcatggcgcgttccaag

SEQ ID NO: 78984 - DNA, 1401 bp, Heterodera glycines
  Genomic contig location: Contig_ID=SeqID_14831; Location=1..1401; Strand=-
  SCN-specific regions: Sequence locations=1-351,373-551,574-1318,1340 -1401
aacccggccaattccaccagaggaattaagaatgcgaaaattgtggtgggagggaccgaattggctatcccaaatacctgaaaattggcccgacgaacagacggtcattttacctcctgcagaaagtgtcgcacccgaaccaattgtgtgtgctgccgtcattccaccccctattgtttttgaatttgatcgcttcggctcatgggagaagcttattagaacggcctcttttgttgtaaaattcctgtccaaattagggaaaaagagacaactgttcaccaaaatagagggagaaggaatttttgagtacgtaaaccaaaaatttatcaaaaattggctgtttaaaataatccaaaggggaatgaaccccccgacccaaacttatcttgacaaaaatggagtgatcaggttgaactctcgattatccaacattgacgacaaagattttgcccatccgattgtgatccccacaaattcgcctgtactcagcctattgatccgccattctcatattatgttaaaacatgctggtgtagatgctactttaacagatttcctttgaaaattttggtgcaaaaaagcaagacgaactgtccgtaaagttattactgagtgcaatacttgtaagaaggatcgggcagtaaaattcggtcttcctccgatgccaccccttccaaaatcacgcactcatccctctcttgcttttgaaaatgttgggattgactttttaggcccaactctttataaagcggtcaattcggggccaaataaagcatggattcttttaatcacatgtttggcatgccgagccgtacatttagaattggttaattccctatctgccgaccactttttattggcatttagacgttttgttgcccgtagaggactgcctaaaggtatcttatccgataatgggtctcaattcgtgctttctaaaaatgtccttgacaaatgcacagaattctgcattaaatggacactcattccagcgtttagcccatggtcagggggcgtttatgaacgcctcaatgcattgatcaaaaattgcttccggcgtattttgggacgcagaattttgaattgggaggaaattgttaccttcctgaccgaagtggaagcctcactaaattcgagacctatcacctttgtgtctgatgaaattgatggtcccatccctttacggccaatcgattttttatcccctaaagtaaacctgagttttgaagaacctgagatttcggaagaaatttatcggccatctcaggcagaaaaattagccgctcgttggtgggccacagcaaaatcaattcggcaattctggaaaaaatggtcccaagaatatttgcttatgctcggacagcgaaatcaaacgaatcataagggggccacggatcactg

SEQ ID NO: 78985 - DNA, 504 bp, Heterodera glycines
  misc_feature (490)..(490): n is a, c, g, or t
  misc_feature (497)..(497): n is a, c, g, or t
  misc_feature (504)..(504): n is a, c, g, or t
  Genomic contig location: Contig_ID=SeqID_14833; Location=59..562; Strand=-
  SCN-specific regions: Sequence locations=1-51,84-173,254-358,412-504
atgagcaactttatatttgtcgcctttttaactgcagcgttttttagctcaggtaaaattcaaaaataaaaatcagaatttttgtaaattttaggcctcgctctaccggctccttatgatgctgaatcggtggtatcttctgaattaaatgttccactactttcagctgacggtaaataattgttaaagaaaaataaataattttataaataaagtttttaaaattaaaacaataatttaatttaattattttgtatagcaaatgttcaagcagcaattacaattgaaaatgttgagatacaaattccatcaattccagcaccaattgaacaacaaactgctgctcgtaataagatggaaaataattatttattttttattcaaataaaattattttttatttaatttatagacattactcatccgactgaaactggcaatgagccttctattggtgcgcaacatatacctttttctataatgaaccganaatttanaaattan

SEQ ID NO: 78986 - DNA, 585 bp, Heterodera glycines
  Genomic contig location: Contig_ID=SeqID_14836; Location=15..599; Strand=-
  SCN-specific regions: Sequence locations=1-585
atggacgcggaccaactgaagcaaattctcgatgcagttttggcaaaatccgaaaagcggattcaacaaatgatgaatgcgcagcaaaatgttggaccttctgagagcctaagccatgcaaatttggcgagctcaatcgatggacgaatttcaaaatttcattacgactctgagtcgggaaataccttcgagcaatggttcaaaaggtttggaattctgatagaagaggacggaaaggatttgccggagctagcgaaagttaggcttttgcttggaaaactctctgacgaagagtacaacaagtacagggacagcattagcccaacgcaaccggacacagtcaattggaaagagtccattgacaaattgaagggtttgttttccgaaacccggtcattatttgtccgccggtatgaatgtttccggattcgtcagcagccaaatcaagacgtgtcgacgctaattgctcatatcaatgcatcatgcgagaatgctaatatgtcattgacaaaggagcagctaaaatgcatgattttggtgatcgcattgagcgatgatcaacatgacatgagacaaaaatgttga

SEQ ID NO: 78987 - DNA, 622 bp, Heterodera glycines
  Genomic contig location: Contig_ID=SeqID_14836; Location=1348..1969; Strand=+
  SCN-specific regions: Sequence locations=1-622
atgtttctgtggcgcccttctcaaaacaaccaacgctacgccttcacgcctttgttggacaattcggaagacgaaaatgaagacgaagttgaagaggacgaactgttcacgaaaagcggaggacaaaggccggcgatattcgacgcagtgcaaaaaaggggggcgggggaagcgaaaaatgaaggcgaaaaagcgacggcggaaggagcgaacggagccgtgggggacgacagattggcagtgagaaggggggggggacacatccgggggtactaattttaagttaaccgccgcgtcgtttcccgccttcccaaattgaaattttttttttttttaggaaaaagttaaaaaaaatctttggagaaaatttctctcaagaaatcttgaaaaaacctctgagaaggttagaaacccaaaaaaatttcggagtgcggcgaaattaaattacggcctgaaaatccgagggggttggggattcgcgaaggcatctcaaatccattcttctcgtcaggaggatctgaaatggatcgaaacgaatattcccacgtctttggctgaggcattgattgacgacgaagaggaaaaggaacagagggaattggaaatgtccaaaatgttgtga

SEQ ID NO: 78988 - DNA, 447 bp, Heterodera glycines
  Genomic contig location: Contig_ID=SeqID_2299; Location=2278..2724; Strand=+
  SCN-specific regions: Sequence locations=1-368,392-447
atgtttcgggtagctctatttccgttgacctgcactttaactcaacatgtgggatgccagggcttaatcattgacaaaatgggatatttaagatcgaagccttggcatttttgcggatgctctaacacaacaaaaactgcgataaagatggttgtattaacgaatttagctacatatgaaaaggaaaacaatttccgtgaatataactagtaattctgagaaaatattcaaaattttttaaaattctagcaaatcttggtgtgatacaattcgaagtattgattggacgcataaaagtcgattggacgcacaaactgtacttgagccaaaaaagtacttaatcatcgaaataattgaaggatatcgacaaaaataataaatttaaaattttgaaaattggaaatctatcgaaattttgaaaatttcttttaattttctttaatcgga

SEQ ID NO: 78989 - DNA, 127 bp, Heterodera glycines
  Genomic contig location: Contig_ID=SeqID_2299; Location=4220..4346; Strand=-
  SCN-specific regions: Sequence locations=1-127
gacccacgggttggcaccgtgttgcgcgcacatgaaaaagcgggtgccattgttgcggcaatttgtgccgctcccattgcatttgtggcacaccaaattggcgttgggggcgtactcacttcatacc

SEQ ID NO: 78990 - DNA, 136 bp, Heterodera glycines
  Genomic contig location: Contig_ID=SeqID_2299; Location=2825..2960; Strand=-
  SCN-specific regions: Sequence locations=1-43,68-74,96-111,133-136
atgtgttttttcgtgaaaaaaggttaaaacctaaaaatccgggctctttttattatgtatattttaccatttcaaaatgatttgtttatttacagggcaaaaattttatacaaatgtccaaaaatggaaattctga

SEQ ID NO: 78991 - DNA, 1210 bp, Heterodera glycines
  Genomic contig location: Contig_ID=SeqID_2301; Location=392..1601; Strand=+
  SCN-specific regions: Sequence locations=1-246,270-320,344-358,380 -1173,1198-1210
ggcaaattgctggcccaaaaaggacgacaaaatgctgctgccgcagaaattgaaacaataccagcaaggagttgttgttgttcaacctctgctgctgctggtggcgccaaaattcaaaattccgctgaaccgaagctgcccccgccggcggctaaattgttcgaattggcacactttgagcaagaaataaggcaaattgcgacaaaatggaatttgaactttagcgaaaaacggtaattaatagagaaaaaaaaattaattaattaattgggaggtaatgttctaactgtctgtcctctgccttttccacactctttcgctgtctctctcactttctctcttcattttatggagaaaccaccattctctcattggtcctctaactgtctatttttttttatttttctaactcatttctctctctacacttgcggtcggccaaattatactctcgtcgattctctatgtcctcttattttccacattctttcgctgtctctcttatgctctcgtcaattacactaactgtctgtccttttctttttcacactctcttgtcgtctctccttttttactctcttcatttgtcaccctctcattaatatgacagtatcggtattcctaccatatttagtggttcctatttgtttcttccaccgaaggacaccaaggcgttcaaggacggcgttctgttgtcgctcactgaccgtggcgatcacattcgtgtgagttttcttatttttccaaattttaagaaattttcaaaaattcgcccattttttaaattgagagggaatgcttggttttgccagaaatttcatttttttgattgaaatttccataatttttcatacagatggatgagttccactctgcacgttcacaggtggataaaattcagcgttggccaaaagagcgtggccatgcgactgtcatgcgtctggccagtgatcagtgtgccaagatgtttgccaactcttcctgatcgtgtgccatggattattattgttgatgaaatgattaagcgacgaaattttgatcaaaatccaaataacattttagtgttacttttttccttgtttttgattttttttttcctttacgtatcacttttttttttaataattgaacctttttttgtcgttgataaacatttggcaataatactgttctttttctcccccacccccatttttcgaaaaaaaaacaa

SEQ ID NO: 78992 - DNA, 1383 bp, Heterodera glycines
  Genomic contig location: Contig_ID=SeqID_14837; Location=446..1828; Strand=-
  SCN-specific regions: Sequence locations=1-55,80-326,348-441,474 -725,762-910,932-941,963-1335,1357-1361
atgttaatgttaaacggccgcgcatcattcgtttcggcatttatatttcaacagttggtcatttttgttgttgttggtgccgatccatttttcgttgtgtctacagatgacagctcagagcaggacgatatggcaaaggcattggcattaagcaaccgcttcttttggcgtaatatgatggcaaagtggggctgccaatacggcatcaaaatccaaccaaaccaaatccgagcaaaatccgttgacgaattgaaacggatttgtgaaagttggaaaatcaaagcgttggcagccgacgcatatgtcaaaagttgggaatgtatggtgaaaaagcaacaacagcaacatgtcaggaatggaggagcatcaagttcaacgagttcagcaccagcaacaatttctacagcaatcattcatgaccaaatgagagaggagggttggttaattggatttaaaatggttaagatattaaattattagaatacataacatagatccaattgttcaaatctgtttgatcactgagagaaataaatacagaaaacagtgctccgtttatcgacatccagttctcgatttctagggatttttgggtgtagaagttttcgattttcaatgattagaggcttgagatggcttcaatatttttctgggctcacgtttcggtcgccaaaattaaaatccggcgcgctagttcaaaaatagtgcaaaatttcacaaaaggcaatatttaaaaaattttgtaatatattcattattttgattacagaaaaaatctattcggcagacaaaaagacatttaaatgaaaaatttcaactagtgcgtaaattctgagtcctttgtttttaatatttctgctgaaaattttaacatcaaccttttaaagatgtcgaattctttcgctttgactgtttgtgtgtaaagccacgcttccaagtgcagctgggcgagctgcagctgagttcagcaatggaactggtcaaagcagcttatcgtattttgttcggatggagtgaagctgagggaccaattgttggggttagagaatctccgataaaaaaatgaatatcaactagggccatccccgaagtcctctatggcaaatttcttggcactttcggcctcatcccggaacccgattctcgtcattatcaccccgaactccctgctatttggtatgactccagaccctgatccctgacatttccataccgaaaacagaatttttgacataaaaataatttttccgattttgaatatttaatcaattttgtgcaaaatctgtatagtaaatcaacttctccgattttaattatcatttcctttaaaactttcaaatttccagaaaatacaccaaaaaccttgttttcagccaaaataaa

SEQ ID NO: 78993 - DNA, 407 bp, Heterodera glycines
  Genomic contig location: Contig_ID=SeqID_14837; Location=2224..2630; Strand=-
  SCN-specific regions: Sequence locations=1-31,53-367,404-407
atggatttgcgcactgtcgctcaaattagaaagctgaaaagtattttcaaaattgccaaaaattacgtatcttcatcgaatttcagtaatcggaattctgacgagcctaaaaatgtcgacaatcgaaaatcggaatcacgagcccagaaatgacagaaaccggctttccaaaataggcaatccaaatcaacattccgtctattccctgctggtctacagtttgatgaatagggatccaatttttaggctctaaacccaccaaaataggtaggctttaggctctaaaagcagcctcaaatttgggggtgtaaaatgataaaatttattcaaaaaagtaaaaaaattctaccaaaatcagtattgagataaataatttttaaaaccaaaacccatgtcaagaaaataaa

SEQ ID NO: 78994 - DNA, 1531 bp, Heterodera glycines
  Genomic contig location: Contig_ID=SeqID_14838; Location=68..1598; Strand=+
  SCN-specific regions: Sequence locations=1-36,58-205,228-369,411 -962,986-1077,1099-1433,1455-1531
  Gene Ontology: Mol. function=protein heterodimerization activity; Cellular component=nuclear matrix; Biological process=embryogenesis and morphogenesis
atgggcaaatacgacacgatgggactgaaacagctggacaagaagctgacggaatgcatgaacgagttgaagaagtacgaaaacgtcaacaaaaaggcgctggaccaattcatgtgggttttgttttttatattttctttgcgagttaattcgcaaaatgtccaatttaggcgtgcttccactcaaaaagaggagctcaccaaacgagtggaggagctgcaaaacaatgaaaaggtgtgaaggcattcgtttaaggggggcgggactcattttgtatgaagcactgaaattctactaccattttttgaaacattattaatcaaatttttcggttgttcaccgtttccttcccgttagtcccccacccggaatttttttttattaaaaatctaaaataaatattttttaaactaggatttataaacttttgcaagtaaattattaagtatttagaaaactaaaaaaacatttttgatataggacttattttgatgtgagcattatttgaacatgacttttagacgatccaagacttactttccgtactggaaaaccgacgttttgaaacccttcaattgacttttaaacaagtggcaaagaatttcgaggacgtcttcaaaaaattgattccgcaagggacggccaatttggtgatgcaaaaggtggacccgtccatggtttgtcgagcaactctttcattccctctgattttgattgagttcaggacacttcttcccaatccgacgcttcgagtcaaccaagaaaatcacagcccaaacacgtattggagacatttgtcgggactagcattaaggttaataggaaaaattattgaatttgaatctatcgttactatttttattgtctgtccgtaggtttctttcacgggaacgcaagaagtgcgtgagatttccgcgttgtcgggtggtcagaagacactcgttgccttggcgcttattttcgccattcaaaaatgtgacccggcccctttctatttgttcgatgagatcgatgcggcattagaccaagagcaccgacgtgccgtcgccggtaaatttatgggataaaattcaattgttcttcattttaaaagtagttcaattgaatttttgactgattgtgagataaatattgtgtatccaattagtcaacaataccagtttgttttggctataatcttttaatgggtctagtagtaagtcgcactgtttcaatgtaaatttattagtcgaaaggactcatgaaatgaaatctgctaaaataatgttttagaaatgatccacgaactgtccgaaattgctcaattcatcacaactaccttccgtgccgaactgttggaacatgccgagaaattttacggtgtccgttttagggacaaaatgtcgtacattgatgacataagtcaacaacaagcgcaagactttgtgcaggatgatcagacacactcctgagaattatgacaccttttacattatgtcttaacaagttgatcgatctcactttttacattttatctcgcgcatataaaata

SEQ ID NO: 78995 - DNA, 408 bp, Heterodera glycines
  Genomic contig location: Contig_ID=SeqID_14839; Location=155..562; Strand=+
  SCN-specific regions: Sequence locations=1-336,368-408
atgaaaggacataaagaaacactgattagtgaatattcaaaccaaaaatacgaagcacatcttggcattatgcattatatgagaaagaattggcaatgcgacaaaatagcagatgaatttgaagaatatgaacggacagaatgccaaaacttccgaaattattgggacattttatatgaatatttgagcagagaatacgtcggaattccaacaatgatgccaaaatttgtatttaaaatgcaaattgaaattgaaggaccaataacttatgcgctgaattgtttggccagaatttggcatttttattttacattatggagtaaaatttatgaatataaatttaacaaacttttcaatcattggtttgaaccaaaatgattgaatgagaagcgattgaattatggaaga

SEQ ID NO: 78996 - DNA, 795 bp, Heterodera glycines
  Genomic contig location: Contig_ID=SeqID_14841; Location=267..1061; Strand=-
  SCN-specific regions: Sequence locations=1-85,107-556,578-619,655 -731,753-795
atgaagccaaaaattgtgctcccaaatgaattgctttttgaggcaatttgcttcgtcccattccacaaaaaatggtccaccattcgtgtgtgtgttgtatttgatcactttctgcttaagcgaatggcacagttcctgatcagttacaaaaacacggtaaggattgatcgaaataaatttatagtgccaatgttatgtggtcaattagcgcggcattcccataaaaacatgaaaaaaaacaaatcaaaatgtatcaaaataaaatactttaaaaaattttctttgactatagtaatacgaaaaatggaaagtcgcccgctgggactcgaacacacgggccttcaaaaccgtggatatactcgaactgactgagacacgggaaaactaatctaaatattcgcccatatctttatccccaagcttataggcttaaccctataatttttattgcttttttaaggctttgaattgtctggatgaaatactggtgatatgtaaattgctaatgcagttggacggcactttcttcatccgccacccgaaaagcattgacacaaaaactcctataaaatttctagaaaccagaagagaaatttttggtgaagaaaaaacaattaactattattataattgaaaattaatgtaaaataaaatgctttttcaatggaatattaaaatattttaggattactttgtgccgttgatcgtctcaaatctccgccaaatattcgagcgattgttggtcttgcgccaccttcgaatgttggcaatgtgccattattcgacggttttacg

SEQ ID NO: 78997 - DNA, 56 bp, Heterodera glycines
  Genomic contig location: Contig_ID=SeqID_14842; Location=1527..1582; Strand=-
  SCN-specific regions: Sequence locations=1-56
tcagatactcggcatctgtgcacatgtgatgaatggttttggtggtggtgctgcgg

SEQ ID NO: 78998 - DNA, 859 bp, Heterodera glycines
  Genomic contig location: Contig_ID=SeqID_14843; Location=220..1078; Strand=+
  SCN-specific regions: Sequence locations=1-123,145-262,319-322,345 -350,395-455,477-859
cctaccaccacctccggcattgactggcctcctaacggtgaacaaaccgaaggtgttagaaaaattgttggagggacaagttcttgggcctgaatcggctgtcatcgaaaatggtaaaattaggagaaaataaaatgtgtcagggtcgtatgagtcccaaaacatagttagtcccaaaacatagtctcagccgtgtcatttgggaaaaagtcaattaacttttttttttaaacatgagtctttaaggaaaatgaaaactgtcaaattaaaaaaaaaagaattcaattaattaatatttattctatttttctaaaattagggaaaaactgaaaaatgttggttttttacagaaaaaaaataaatttctcaaaatattttgtttttttaaattattggcacttttccaaatggtgccccccccccccaaaaaaaagaagcaaaggaaggctttttttgcaaaattttttatcataaaagtcgttaaaatttcttcaagaggttttctgggtgctgattacgaatctgacatcaattttaaccaatccccaactcgaacaaaagtcgaaaaattcttataaatttcgttgttaatcaaattattatgtcagatttgtcaacagctagttcgggaccgggaccaaaacacgtacaactgagtacctaagtcccggttttgaccagttttgacagggaccgggaaattcccggtttttcccggttttcccagccaaaaagtcccggtttttcaactcgaaaagtcccggtcccggttttgcccaaaattcccggtcccgacctaccctaccgaaaactcctaagaacaagctttctcgaattttgcaagcccacattgttttta

SEQ ID NO: 78999 - DNA, 787 bp, Heterodera glycines
  Genomic contig location: Contig_ID=SeqID_14845; Location=575..1361; Strand=+
  SCN-specific regions: Sequence locations=1-22,44-117,139-220,242 -712,734-787
atgatcattattaatttctctgttattttatttgttttaatttcacccattttgccatcggcatttatttcaatatgcgtacgaccgaacactttgagttatgtgggacgactgatgtgtaaaagcaataacattatgcacgagattaacaaaaaaacggctgaaaaagaagatgcagtaactggtagatattcatgcatttccttatgggtggattttcgaaaatgtgatcagaatgaaacgaacgcaatgatcaaaatcaccaaaactgacaccaatgaaacggttggtactgcaaatggatgtgatttatgtaatttatcaatcaaggtcgggttgggataatccatcttgatttggaattttttgaatatccaggatttaactgtatgagcaaccaaaatttttgtgtatatcaatgcatttttagaaaatattcgaggtccaaaaaacggatctttctttttccgacttaccgattgtgctccccttcggcgatcaaccttcaaccgacaaaacattcaattttaaaagtaaaattccatggatcaacgaaggagatactcttggtattaaaattggatgcgatgttggtcttgaagattatgaacactatgcaattggaagcgcaatttatccggagaagatcaatggacagcttgccagtattcatatcaccgtcaaactgtacggtgatatgattaaggttgtgcatttatgtggcatgtttggagatatcaataacaaaattgaaatcgctattattcaaaatgggaaatggaggtaa

SEQ ID NO: 79000 - DNA, 1022 bp, Heterodera glycines
  Genomic contig location: Contig_ID=SeqID_14847; Location=29..1050; Strand=-
  SCN-specific regions: Sequence locations=1-139,161-438,463-709,731 -900,926-1022
  Gene Ontology: Mol. function=protein carrier activity; Cellular component=cytoplasm; Biological process=ribosomal large subunit nucleus export
gtcgtcacccttatgaaccgttcgactggcgaagcacagaaagcagcttctgacattttggcccgcttcaaagaaagcgcagattcttggacaaaagttgacacaattttggaattcaggttaattttcttatttttattataccattcattattataatggtttggtctccattaatacttttagttcccaccaacaaaattattacaaaaagcttcaaatcgttcattttgataaaagcaagctgtaaatacttcgttaaacaaaggaaaatctaaaccttttagtatatttaaagcggatttttgcatttaaagtaaagaaaagagttcgaactcgtttagaaatttactcttttgtccgtactgtcatttttaatttttgtgccattaagccctaacttttattttgtttttttttcagtgacttgctcgagacgaaatactttggtttgcaaattttggagcatctgatccaaacacgatggaaggctttgccaagggatcaatgcgaagggatcaaaggttacattgtcaacatgattttggacatcagtgcggaccccgaaaaaagtgaacgaatgaaactgttgcttcagaaacttaacctcgtcttggtgcaggtcgttattttgcgctttttcgcagttcggcactaatttccttcagatcgtgaaacatgagtggccacgtctttggccaactttcatcagtgacattgttgggtccagtcgaaatggacagtctctgtgcatgaacaacatggccattcttcgtctgctcagcgaagaagtctttgactttgggaccggccttacctcgtcgagggctatacagttgaagcagcaattttgtgggcagtttgaagaagtgtaccgactttgttatgagattttggtgcgcctttttcacacccttaattttgtcttaatttttgtttaggagaattctgacaatgctcagctcgtatatgctactctgtacacattgcatggttttttggattggatccctgttggatat

SEQ ID NO: 79001 - DNA, 711 bp, Heterodera glycines
  Genomic contig location: Contig_ID=SeqID_14850; Location=249..959; Strand=-
  SCN-specific regions: Sequence locations=1-256,346-630,697-711
atgccatttttgcagagcaaaatactcagagaacattatcggaccgaccccgacccgagcccggtcgtgaagcagcggttggcgcaagagaggtgtcttacggagaagcagggtaatcagttaatggatggtaatcagtgccgggtaattagataattaataaattcgtggtaatttagatagttaaccaatgcggggtaattcgttaattaacgagtacggggtaattaattactaacgcaggagcgctcgctattttctctctatctctcccccccccgctctcctctttttctctctagcgcaggggctctcactatttttctctctccactttttctctcttcaacaaatcatcgtttgaatcaaatttaaaaaaaattagttaacaagtggttcaaaaagcgacggttgatggacaaattgcaacaacaacaaatgtctgagttgtcgccgctttgtccggtcacgaacagcagcagtggcggattgtctcgccccgatgatcatccggtagacaatcgactgactaattgtttagaaattattaattaactaaatttaagtgctcttccgccaaagtgccacctgactgttgaatttgagaaaaaggacgaacttttgggaccgaaagaaaagaaatggaaagaaaaggacgaacggagcaaagaaaaggaggcgaagagaagagaaaggctcggaacaatttga

SEQ ID NO: 79002 - DNA, 1524 bp, Heterodera glycines
  Genomic contig location: Contig_ID=SeqID_14852; Location=252..1775; Strand=+
  SCN-specific regions: Sequence locations=1-15,37-486,508-636,658 -789,858-948,971-1145,1176-1337,1373-1524
atgaatttgtggatgttaattttaatgtttggccctattcattcagttcgaattcgaaaacattgggtaaaagggcaactaaatgatgaagtaaacagaaaagactttgaacataatgtaaccgatcattcttgcgcaaatgccaatcattctgctgatcagattgcgaattttgtcctttctgatcaatcaaaaaattgtggtaaagacagaaatgtttttgatcaatcacaacaaagtgatgaacccaatgatagagatgaaaaagccaatcactctgttgatagtttggagagtgatcaatgtcttagcaataaatccaaaagtgagaggaaatgtaaatttgctgatcaccaaaaactcagaattaccaatcaatacaatcattttatcagtgcctatttgcgaaaaggaaatcattcgaaaaatgaatggggaaactttttgaagaaattggccaatgttcttggcgtaaaagggcgtacaataataaaatggaaaaaacaattgggcattgatgtggagaagaagcacacggacgaggagagaatggcaaaattggaaatatattacaaaataaagaggcaaaatccgaaaatggcacttatggacgttgcggaggaattgggcatttccatgggcacattaattaattggaaaagcgaatttaaagacattggccaaagtgtcaatcaaagcgaagaaagcataaaacagcaacggaagagcagcaaaaaagggtaattatgtttaattaattgagttaggtatgttcaaatattttggtgcaaaaattcataaatatttaatctctataaattttgttaaaaatttatttataaaacattaatatttaacagaaatgcttttttgagcttctttcgcgaaatcattcaatttataaccctaggtaattaaagcttaatacaaggacatttctgactaacgttttttgttaaaattcccaaattttttagtcaggcttcgatttcaccgactaaatcgttctcctctaacgatgctttttgggcgtggaaaaagtcggcaaagaaaagaaccgttagaattgtattgtgaataggatggaaaaagtcggaagaccgagtgacgattcaccgactgtaattagttgccgcaatcagttctattgtatttcccagtttgtttccctagcgtttttcaatgtaaagtataaaaaagaacaatgccttgaaattcgggaatgaaattaaaagtcatttggtgtcatgcgctgcaaatcggaccttcttaggggtgtatttttcgtttttattgcatttttcataacaaattttggcaaaacgccaaaatagttgaaattattatttttttttaaattttgtaaaaaaaactagaaaatagttgctaataactcgaaaagtagcttaacaacagccgaaaaaacatgtttttcgtgcgtgcattccaagctatgggaagctcaggaaaaaaatagtgaaaaaactataaattggagccctagttattattgataggaattga

SEQ ID NO: 79003 - DNA, 721 bp, Heterodera glycines
  misc_feature (105)..(105): n is a, c, g, or t
  Genomic contig location: Contig_ID=SeqID_14853; Location=597..1317; Strand=+
  SCN-specific regions: Sequence locations=1-13,35-100,126-478,501 -604,626-648,670-721
atggcaccactttttatttttctgttcgttttgttggcagtcgaaaaaagcatcggcccattatcaccaaattgcagtaattcatttactaattaatacctattntaatataattaattatttttcatcagttcatttgccgcccatttcttccgttggaagtgccaatgtttcacacaaaatgtttctgttccacaaggcccaaagctaaaaatatcagcaggacaccaattattagcaaatggccaatttagtaaaatcgattaataatttgtttttatttcaccgatttttgctttttttagaattgccaaaaacggaaagccaacggaaagtttctgtaaattctgcgcagcaaattgtttctgacgagcgaaaagtttcttcttctgagctcgaaaaagtgccgggggcttttctcgaattttctttgcccgttgaaaagcaccaaaattcgcttggccaatatttggcggaactttcaaattattatcattctgcgcgactccacgttccgccgagtacaattgcgagggttttgctacggatgaaaaatgaaatgaattttcattgtatcaaaacttcggccactgaactaccgtacccccaaccttggaaaactttcgtgtcgaaaaagaatcgaacgattccaacggaatgggcggaaacattcgcatcactttcattgacgagtgccaaatttgtagtcaaagtgaattga

SEQ ID NO: 79004 - DNA, 99 bp, Heterodera glycines
  Genomic contig location: Contig_ID=SeqID_2303; Location=1452..1550; Strand=+
  SCN-specific regions: Sequence locations=1-99
atgactactaatacaactgacagcaactggaattcttcatttgttctaatgaagatggacgacaacgaccaatccgagcgcgattgcgttgagattaaa

SEQ ID NO: 79005 - DNA, 400 bp, Heterodera glycines
  Genomic contig location: Contig_ID=SeqID_2304; Location=259..658; Strand=+
  SCN-specific regions: Sequence locations=1-175,199-400
ggtgtaagcctttgcttctccacgttgactctaagcgcaatctcaattgaccgttttcggcttattgtgacgccacttcgacaatcaattcagaagcgttgtgcatgccgtattgtggcacttaacactgccatttcactgatcatatcgtatgataattaaaaaaaaagtacggtatttttaatttatttattttttcttagacttccgatgctgttcacacaaaaattggacacctatcatcgtttttgtggccaattttgcagcgaatattggggcagcgaactcggcgcaatggcccgaagtgcatacggtaatatattcggcggatttttgtacttaccgtaactcagcagacaaaacattaaaatctttactattaatttcaaatgtcgctaaa

SEQ ID NO: 79006 - DNA, 572 bp, Heterodera glycines
  Genomic contig location: Contig_ID=SeqID_2305; Location=1092..1663; Strand=-
  SCN-specific regions: Sequence locations=1-58,80-333,355-572
ggaactacgttaaaacttcgtggtttgctcacaaagcaaacatctcaaaatcaagacgtttcttttgtctttacaaatgagtcacggattggttttgttgaaaaaaagaaaccggaaaaactggcattgaaattgagtgatttcactcgcagattatgtgaatgtaactagataaaatagaaatttagtattaaaaatgtttttataggcaatttgcgactcagtgtttcaagaaaacaggctccaatcaatttgtcaaaaaaacaagacggaacaatggtcattgaccaagaaaataaagctcaactcatttttccgaacagtgtcaaactcaaaattggacaggaaattgctttgaaaatgacaaacgttgaagtaaacgaaggtaaattttaaatagtgaaatttttgggtgaaaatagctacctaatttcataaatacatagatttttaatttttaagttggtgtagtcacactcattgtttatgatgaaaataccattgaagtgcacgaagaaaagacaattaacagtcatttgaataaccttgaatacccaacaattggaaaataa

SEQ ID NO: 79007 - DNA, 1290 bp, Heterodera glycines
  Genomic contig location: Contig_ID=SeqID_2307; Location=1399..2688; Strand=+
  SCN-specific regions: Sequence locations=1-20,42-108,138-245,282 -296,598-709,758-899,929-973,995-1077,1099-1109,1131-1290
atgagtacacgtgaagaaattcaagcagtttgtgtgcagtccttaaaacagttgaaaatcggtgtgggtgaagaggagttgcagaatgggaaggacttttacaaattgtaaaaattaaattttcaaaaaaattttttgaaactttgaaattttagttttttcaccaactatccaaccccttcgcgtgtattttaagggagcagaaaaatacgaagcggaggatgtgcaaaagtcggaacgttttgaaagtaaaaaataagttaaataaagaaataatattcatttgttaaaattgcataattaatttactattaatttttcaaatttaataattaaaattaaaaaattgaaattattttaaaaattgcggaatctaaaaatattaacaaatcttaatatataaattaattatatttaaatatttcaaaattacataatctaaacaatattaaataaaaaatattttataaaaatatttgcagaatctaaaaatattaactaataatatttatcttaataatagtaaatttaattatatttaattatttcaaaattacataatctaaacaatattaataaaatatttacatttataatgtttaacaaaaatattgtacttctattttgcagaacaaggacaacgtattcttgttgccatgcatttgattgccaatgtctacagcaatgaggcaattaatttattcttgacataataataaatttttccatttttataaattaattatttcatttttttggttcggctctattagtgtgagcgccctcaaattttacgtttcacaattttacagatgcttttcaatgcgtatgtgcgcgagaccgtgaatcgtcatcgccagttcaaaatggagccatcattatggaaggcaagttggcccaaaaatttgtaattattaatttattaaatgacataattatggtttcattcctatcactttaatatgacaattagtgaaaaaactgggggcaatttgtgaaaaaagccattaactttaattatttttgtctcacagatatgagtcccttaatatgctcttattgtctttgtttaaagaatatcaaagtcaattaatttgtttttctagtcacaccctaattttaaattaaattttgccaaaaattttttaggcattttggacagtttggaccggctttctggaaacaaaagttgatctgacggaacaggccaagtcggcctggatgtcattgggtgaggattttgccaaggaagcgcttgcacatttgaaacgccttggcatcccgcattga

SEQ ID NO: 79008 - DNA, 323 bp, Heterodera glycines
  Genomic contig location: Contig_ID=SeqID_2307; Location=4088..4410; Strand=+
  SCN-specific regions: Sequence locations=1-156,179-323
atggcaacaaatttgaccgttactggcaccgttattgtcgatttgatcagcaccgggctgatcaatgccggcttcaagcagtttaccttcgtttgcaagctgatcaccgcccttctgatcacgcgtctgttgctgctcgcccgcttccgtcccgccgttctacgcgtgccggaactgtcccgcgcattgcgcacctttttgtgctttcacttggccggtgccattgtcacaatgccgtacaatgcttatgtgccaattgcgtattatacgtcattagagaatgaagatgtttgaatttttttcagaaaaattcttgattttca

SEQ ID NO: 79009 - DNA, 52 bp, Heterodera glycines
  Genomic contig location: Contig_ID=SeqID_14856; Location=1186..1237; Strand=+
  SCN-specific regions: Sequence locations=1-52
gtcccggtcccggtcaaaaaagttggtcccggtcccgacttttctggtcccg

SEQ ID NO: 79010 - DNA, 259 bp, Heterodera glycines
  Genomic contig location: Contig_ID=SeqID_14857; Location=1199..1457; Strand=+
  SCN-specific regions: Sequence locations=1-15,37-88,161-196,241-259
atgctgcgtgctagcgggaccgaacccgcatttgataatgtgatctgtggctgcgctgcgactgcgctatttgcatgccgccaggaactattataaatgttataaaacatatattatatttaaatcatttttataaaaaaaaaatcaaatcaatttttaagaacaaaatctcaagggaaaccagcagaaaaaatgcatattaatataaaaaataataatttaatttttaataataattttgcaaatacttaaaaagcaa

SEQ ID NO: 79011 - DNA, 524 bp, Heterodera glycines
  Genomic contig location: Contig_ID=SeqID_14860; Location=805..1328; Strand=-
  SCN-specific regions: Sequence locations=1-3,28-41,63-457,479-524
atggattcttcttccaacacccaatcaccggccgttgctctgaccgacacaaacaccgccggtgccatcgccgtcgaaatggtctccgatgaatacgctgcaatgcctgttagtccgtgattcgtacacaacacaacaccaaacttatttctgttttttttcaaatcaaaccaaaatttcattcttggtatctttcgtttaccttcttcatatatatggttcttctctctgttatacatcaaacaaaattcataaaaaatttgtttgattgctgcttacaagggctggttccatattccggttccatatttcgaccatttagcacaaaattccggaactttacattttcataattttggcttaaaagttgaaaatgccaaattttcaaaatatcaaaaacacactaaattcataattccagcggtgttttaacggctccgccggaccttccacagttcaaaaaatttggaaaaaccccagcaaataaacacgaaatcttgacacctaaaagtttgcaaaataaa

SEQ ID NO: 79012 - DNA, 404 bp, Heterodera glycines
  Genomic contig location: Contig_ID=SeqID_14861; Location=298..701; Strand=-
  SCN-specific regions: Sequence locations=1-301,323-404
atggctctgttagcactttatccgtttcttcattgcgccgcttttgacagcggagagacgagcgcagaaatggcggaggaaatgaaccgaatgagcgcgggaaaagccgaattcggtgggggggggcaacagagaagaagcaaaagggccaaatagcggcgatcaaattgttcaatgcttcgaatttcggttcagttagcttcgaggaagtgatcgccttggagcgtccagcagcaggtgacaacggtttcggcacttctgcttcggttcctccgtctttggcttcgaccattcatagcggtttcatcgtcctttgttttcgcctattggacggtcaaaccgatagcaattcgcaattggagaacacttggcttagttggactggagcaaatgaaatatacaaa

SEQ ID NO: 79013 - DNA, 1387 bp, Heterodera glycines
  Genomic contig location: Contig_ID=SeqID_14862; Location=44..1430; Strand=+
  SCN-specific regions: Sequence locations=1-167,219-800,822-1387
atggatgggaaagtaaagaacaaacgagaagcgtcaaaacggcagaacaaaggagaagcgtcaaaacggcacccaacggatgatcccaataagccaaaagatccattttttggacaaacattgaaaaggcactccttccgtgtcccaaataaaacaactcatattccttttattttcttcaaattaatttttgatagtttatttctttccaattttaagttaattaaagttacatttaccaaatactttttgtaagtacttgtcacagatataagacaatatgaccgaattccaatgcaaatttaaaattaccgatatgatataatagtgaccgggaattaatgggaatgaaagacagtcaaattgtacaataatgagctgggttttgagtgagtgacaacgtaaggcgtacatatgaacaaatacaataaatcctcacaattatatggtcaagtaactggtcaacgaaattaagagagttgaacattcagaagaggagggatagtcgggcttcatttaatgtgagttttcccaaaatttttatgttattaaattgtgccttaaattttttggagtttttaagaccagtgaattggaccagtaagaagcgcctaacaagaactatcagaatcaaagtgttaatttctcaagaattcttcactgggacgaaatctctacgcttcagaattatttcgctctctgaccaaatagcttaaattgtggttcaatttctccagaatttcgtcttcatggcgcaaatactcacattctttcaactgaaaatcttttttttttttttagaaaatgaaggctttaaattttctctcccctccataaccaataaatagggaacgggacattcccatcggaatctatggaattgtttgtatcaacttgccagtctttgctcaatatcaaagaggtgttcatcccacgctttcgggaccattctccgttgacagtcggccaatcgcaaagcgtactccaaattgcttccgcttggtcctctgcttcgaataatctaaaagccaagggaatgaaaggccaataagcagggatgggaaggatggtacttgtttgacaatttcgtcgatgctcgtgggaactgagtgataaatgttgtcgcccgcttccgagatgtacacgcacagttcaaaggggtcagacccattgtccgggtaaaactggacacattttagctgaatttaaggtaatactggagaatctgggctccacccaaaaaaaaaatttttcttgtaaaaaaatgaacccggggttttcggtgcttctgatcacgaatatgatatcaaaatttgcaaaataattgactttatcatttattttgaaaatcatagattttagaaattttgaccaacatggcagggta

SEQ ID NO: 79014 - DNA, 510 bp, Heterodera glycines
  Genomic contig location: Contig_ID=SeqID_14862; Location=718..1227; Strand=-
  SCN-specific regions: Sequence locations=1-363,385-510
ttttacccggacaatgggtctgacccctttgaactgtgcgtgtacatctcggaagcgggcgacaacatttatcactcagttcccacgagcatcgacgaaattgtcaaacaagtaccatccttcccatccctgcttattggcctttcattcccttggcttttagattattcgaagcagaggaccaagcggaagcaatttggagtacgctttgcgattggccgactgtcaacggagaatggtcccgaaagcgtgggatgaacacctctttgatattgagcaaagactggcaagttgatacaaacaattccatagattccgatgggaatgtcccgttccctatttattggttatggaggggagagaaaatttaaagccttcattttctaaaaaaaaaaaaaagattttcagttgaaagaatgtgagtatttgcgccatgaagacgaaattctggagaaattgaaccacaatttaagctatttggtcagagagcgaaataattctgaagcgtag

SEQ ID NO: 79015 - DNA, 531 bp, Heterodera glycines
  Genomic contig location: Contig_ID=SeqID_14863; Location=45..575; Strand=-
  SCN-specific regions: Sequence locations=1-89,113-383,412-531
atgaaaggcaccatcagttatcccttggttcttctgtgtctggtgtttttggcattatttgccttcagttgcaacactaccaatgatggaaaagacaaacagaaggacaaggagaagagtaaaacgaacgatgagcgaagaatgttggttgaacaattaatgcaaatcgaagcttacctacaattcccggcacaacagcaatggacggtatttaatttggcaaggaaatacggcatcatggacaaagaagcattaattaacctagtggaagaacaatggaaaaattacaaattagaatgggatgtagaaagaaacaatttaattcaacaacaactgatacaatcgtttggtccaccaaagccagcagaagaaggttttaagacaaatatttataataaattagttttaaatgttaaaggtatgccaatcagcagtgcattgcaacaatggcaaagtcaaactggacaacaaaactcattaaatcaactcacaccgacaaccggtaaatttgtcaattttggtgtgatttaa

SEQ ID NO: 79016 - DNA, 1199 bp, Heterodera glycines
  Genomic contig location: Contig_ID=SeqID_14866; Location=50..1248; Strand=+
  SCN-specific regions: Sequence locations=1-9,32-510,533-850,886 -1160,1183-1199
atggatcccggaactggcttctgtgttatctatgaaaagcacaaactgccaaattgcgtgtgccccgttttgcgtcgtcgctttgattttgtcacattccgaaggatttgcattttggcgggttgtgactacttgcagggcggccttcaaggcgttggattgaagacagccgaagaagtgttcacaaaggcatccagtcatgccactctaccgagtgtttgtcgttcatttcggtttcatttccttaatatttgcttttcaggtcctcgttcgtctgcaattgtacacaaataaacgactcaaagtaaaagtggacgctgattttgtggacgcctttgttcgcgcggagaacacctttttataccaaattgtcttcgatcctttgtatgttatcccttttccattatatttagaattctttttaattcgtagaaagcgagaacagagaccattgaatgcctatcctgagacaggggaagaaaaggttttttgtctattttattggtaatgtaaaaaattattattattaattcattcaattgcttttttcaataataaataaatttaggaaaatttgttggacaatgaaaagaagtatcattatgcgggagaagtaaggtgatttggtcagttaaattcgtcgtttttcggtcgtttctccacggaatgcccttcgccttgccttgggaaatgacgacctttccaagtcgtcgcttgaggatgaatttgttttgcccagtgaaattcccgtgtcgtcaatttggaacagcaattacaaaaaagtgttggaaacggaaaaggaccaactagaaaaagagttggacaacaaattcggggcttttcgggtacgattttaattatttaaatttttacaaaaaatttttagccaaaaaaatcactcgtgaaaagatcggctgacaatgagtcaatctctactcattgtcatgacgaacgcaaaagaacgaacaaaggggaaattgatacgatttttacgaaaagacgtcgtttctctgagattcaaatcgtaagtgatcgtttttagtaagagttgaatacctttacatgagatttggtttttaagggaagtgcagcaccgcggaatggagcatatacaaattggacagcaagggattggatgcgaatttatggccaacttacgcaaaaggaaggggaagaagaggaaaacagctcctccagaa

SEQ ID NO: 79017 - DNA, 684 bp, Heterodera glycines
  Genomic contig location: Contig_ID=SeqID_14867; Location=283..966; Strand=+
  SCN-specific regions: Sequence locations=1-364,386-684
atgggacaaaacggtggtcagaacgacaatggagaagcgatgcctcacaatcagcaaaacactgtcgagcagtttgaagcgctgctccgtcgtgttgacaagcagtacgtttgggcaaaaatggcgaatttgacgggtatttacgaacttattgttagttcattaaaaaatctttaggtcacaaaaaggaagggtttttcttaatttttgatattttcggcttttcacacgaggaaatttttttatttaagacttgctgatgtgcagaacaatttggacgaatggaatttggagagaggcgaaacgggggactcgggccgagattggtccataattgaagacgaagagcagcaaaaggaatgcgaggaggagagagaaagaaatgactgtccgcgctaatcgaatgacagcgaaacaccactgacaattgacccatcactttcacttttcacccataataaatccgaaattgtgatgatttaataagccttgctggataacgatctacttcacttttaccctgtcagtgcaaaacctgaaaattttcagatttaatttcctaaaaatttttgcgcgctgacatttttaatacttaaatccatctaatcataatttaagccagcttgtaatttgctttctattcagattgaattttataaatttgtacacgcttttgtattgaca

SEQ ID NO: 79018 - DNA, 491 bp, Heterodera glycines
  Genomic contig location: Contig_ID=SeqID_14867; Location=1093..1583; Strand=+
  SCN-specific regions: Sequence locations=1-273,295-315,337-425,447-491
atgccacgcgaagagaataaggacattgaggaggaaaggttggggtttttttggtatttccaaattcatttgacgtcatttttcaggcgcgcgaaaacggcctacgatttgatgcgcatcagactgaagagactggagaagaacattgtccgttgctttgctgcgcaatggccttagttttttctgtttcaggacaaacccgtgccgataccgaccaggcgagaagagcccaagccgaggcctccgccggaatttgtgcggaatgtcgtcgggtcatcagcagcagcaggcagtgccgagttccacatttgtgcgtgtttaaacaaatttataattgatattcaattaatctaatttcaatgtgcagttcgcaacaacaaacgacgggaattggaacggttggaatacatcgaaaaaatggcagtaaaagatgaaaaggacaaagaatttgaggagaggagaaaggcacggagagatgaggaggagaaaaa

SEQ ID NO: 79019 - DNA, 1197 bp, Heterodera glycines
  Genomic contig location: Contig_ID=SeqID_14871; Location=4..1200; Strand=+
  SCN-specific regions: Sequence locations=1-1197
atgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcatttcgaaaaattaaggaaattttggcatcagatttgctgctaacacattatgatccaaaaatggagatcattgttgcagctgacgcttccgaattgggcatcggagcggtcatttatcacaaatttcaggacggaaacatcaaagcaattgcccacgcatcaaaatcactcgcccctgcagaaaaaaattattcacagatcgaaaaagagggcttggcattgatttttgccgtacaaaaattccataaaatgatttatggacggcatttcacattgcagactgaccataagccccttgtcagcatttttggcagcaaaaagggaattaggcagtgcagtgccaatcgtcttcttcgctggtcattaatccttttggcctacgattttaccatcgaatacataaacaccaaggattttggccaggcagatgcgctctcgcgcctcatcgccaaaggaaatgagcccgaagacgagaaaatcatcgccatgatcaatgcggaaacagattttgagacgaatttcgacaacacaatttcaaaattgccattaaaattttcggacctaatcgctgcttctgagcgcgatgaaaacatttttcaagtccaaaaatttgtcaaaaatggctggccaaatgaaaaggccatggacaaagaaaatcaaattgtccgtgatttatgtcgaagaaaggaagaactttcaaccgaaaagggatgccttatgtatggagaaagagtggtgatcccgaaagtcttccagtcaaagattctgaaattgctgcacaaaggacatcccggcatgaaaaggatgaagcagctggcacgccaatacgttttctggccaaaaatcgatcaggacattgaagattttgtccatgaatgtgtgccatgtcaggctgctgcaaaagcgccgattaagacaaatttacaatcatggccaaaaacaacaggcccttggcaacgcgtgcatatggattttgccggtccgtttttcgggaagcatttcctaattgttgtcgactctttttcgaaataccccgag

SEQ ID NO: 79020 - DNA, 810 bp, Heterodera glycines
  Genomic contig location: Contig_ID=SeqID_14872; Location=647..1456; Strand=-
  SCN-specific regions: Sequence locations=1-250,273-307,329-528,550 -564,609-624,648-810
atgatgttcaatcaaacaataaaagaggttgacaatttggacatcttaaacacggaaaaagatgtgttcgactccgcagatcaaaatgatgccgacgatggacagtttccaccggtcgaagaatggtaaaaacaaattaagcaattgaaaatatttttttcggtctgatgattaattaagagcaattaaaaattgacagttatccgacccttaatgaattgcattgtgttgaataataatacatcgattcaatttttaatatatttttattacacgttaaaaaatactttaaaggctgaacttatgtagttgatgaaaacaaaagattgtggggtttctcgtgatttttcctttgtaaatttcatgtgatggaaaatccacaagatttaaattgtccataacttctttttttagtgatgatgatgatcccgatttgtttgccgtccgtgccgtccccgacatcgatgacccgcccagtcccccggacagcgacgaaatttcggccggcattcgaacggcgccgattcgtcaagctggagaaaggcgaataaaacaattaacaatcaaatataataataataagaaaaaagagaaactattagcttttatttactgattttgccaaatttagaattgacacttctgccgaacaaacagaaaattacggaccgaatttttggagaacggaggcggcacaacgcgttgttgctgaacaagaaaaaatacacaagcaaattcagcaaaaacgtcgcgcactagcttcaaatccaagtactaaaaaacgtgaaaatcattaagagagcaattaaa

SEQ ID NO: 79021 - DNA, 1344 bp, Heterodera glycines
  misc_feature (160)..(160): n is a, c, g, or t
  Genomic contig location: Contig_ID=SeqID_14874; Location=783..2126; Strand=+
  SCN-specific regions: Sequence locations=1-16,38-488,510-935,991 -1159,1205-1344
atggcaagcaaagtcattgacgaagaaaccaatgaagagaaatatgttctaaagcaggtaagctaaagcgaatgattaaaatcaatcaattagtcaatgccaatcaaaaaaatgcaattagccgacactaaaatatcctttttcaattttgcaaagcatntaattattgccaggttgaacaaatcacggcgctatgggcggccacggcacttctccgcgtattacggcactccaccggcgaatgctgtccattgccggcgtcgactcgtcactgtcggtggtgccggagaatcaaactggcaaaatgtttgcgacggcattgtacaaagcatggtaagagcatgagaaaaagaggccaaaccgtacaaaaacatttggaagactcggataacaagaaaaaaaaacgaatgaatatcatactgtaagttatttaggctcactaaatgggtaatatatgaactaaaatgtgccaataaatgggtaaatgcaatttatttaatttattttttccttcatcgaggatttgaaaaatccccctccacatatgaatatttttattttttagtaagtcctatccccgattttttctgacgaatgatgttggaacaaatacacattaaaaaatttaaatcaatcctttagtcttataattaaatttctgtcgttcgtgtgccatttatagtcattaaattcatcgcaccctttggcacttttttgatcatcgaaattctattgtataattttgcccattttcagggaggcattcggcaacactgaggcggtgattcttttcctgcacaatccgtaccgcgactatttgctgatcgaagcgcgcgaggtgcagcacgatttggagaagattgcagacggaaaagtccaatgctttttcctcacattgaagcaggccaaagagcggtcggtttgtttaaatgaatttaattaattgaaattattaaattaatttaattaattaatttaattacataattactaaaatgattgcatttattcaaattaagattgactttccccgacgactcagactcagcaattctggacaacaaatacgttgtggctgttgcgctgagtcgatacactgcttacgccacatccgatgaaatagtcaccgcgcgtgcgcttcgccgttcaaatgccattgtaaaaaagaaaaatatttttatttaataattattttaaatataaagggatcataatccgatcgatgcctaaaaaaatttcccaaattctgtcctcttcatttttttctctgatattttccaaattattagagtattggaagatttggtgattccgagagactccgccggggggggggggtaatta

SEQ ID NO: 79022 - DNA, 362 bp, Heterodera glycines
  Genomic contig location: Contig_ID=SeqID_14875; Location=759..1120; Strand=+
  SCN-specific regions: Sequence locations=1-253,280-282,305-362
atgcttttcctctcctctgaaggtccccttccgccatgcgacgtgcttttcacgctgcacaagggcactctgttcgcactgctcgacggcaccgtgtcgccgctgtgcgcctatttggagggccgtgtccaaattgaggggccagtggcggacgcggcactgctcaaacacttggcatacgcaattggaggagtatcagcaacacaaccaccacaagcagcagaggaaggaatgatggggatggaacatgcgcaagaaggagaaaaggggggaggaggacagattttggatatttaatttgtatatatggaatgacggatgtggacataaaatgccaaatttggtaaagcgaattagaagaa

SEQ ID NO: 79023 - DNA, 195 bp, Heterodera glycines
  Genomic contig location: Contig_ID=SeqID_14876; Location=457..651; Strand=+
  SCN-specific regions: Sequence locations=1-195
atgcttccaataactctcccaaacagatcaacgtgtcgccgattgggcgcagctgttcccagtcggaacgtgatcaattcgtgcagtttgaacgcacgacgcccattcgcgcccaatttgtcgaggcattgcgccaacgattcccaattgaacagtacggactggtcttctcaatcggaggacagatcagcattg

SEQ ID NO: 79024 - DNA, 1319 bp, Heterodera glycines
  Genomic contig location: Contig_ID=SeqID_14877; Location=1..1319; Strand=+
  SCN-specific regions: Sequence locations=1-194,232-363,401-525,552 -861,894-992,1021-1150,1173-1265,1312-1319
atcggttcggggggactgcaccgaaaacaaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaaacccaaaaaaaaattttttggataaaaattatttaaataaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttggataaaaattatttaaaaaaactgactagataatatttaaaataggttatttctcttcctttcagtatccctgcaaagtttggggcgcttctgataagtttctgaaaaaaaagttaagcctaaactttttgccctgtttaaaaaggaattaaaaatttttaaaaattttattcatctccctttttgatagaaaaagcatcagagtgcctaaactaacatgtaaataaaatttggtgcgtttcagaaccctttctgtaaaaatacttatgaattaattttgcaaaaaaataaataattaatgaaaaactcagaatttctaaaaattttgaaaaccaattatgggccagattttttcaggttaagttagtccttttacagaggagtacgcctgtaaaatttggtgagtttatattgattttagagtgcgctagattcaatgaaactttttaaaatttaagcctaaactttttggcatgcttaaaaaggaattaaaaatttttaaagtatttattcatctccctttttgataatataagagtcagagtgccttattcaacttgtaaataaattttggtgcgtttctgagcagtttctgaaaaaaagatatgaattaattttgcaaaaataaataaataatgaaccctcctccttaataattttcctgcgcccaaggtactcactcggccgcttcgcggcctcgtggggggccttcgccccgcacgcatgattccaattttccaagcaccccaccgaaagtagaacgaaataaccaaaatataaggaaaatatttttaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagt

SEQ ID NO: 79025 - DNA, 7338 bp, Heterodera glycines
  Genomic contig location: Contig_ID=SeqID_234; Location=797..8134; Strand=+
  SCN-specific regions: Sequence locations=1-30,52-1231,1253-1382,1404 -2561,2583-3241,3263-3404,3426-4227,4249-4942,4964-5164,5188 -5204,5226-6079,6101-7162,7184-7338
atgaaagccgacgaacaactcaaatcagtggtcaatgaagccaaatcaatcttcaaagcagccggcatgataatccgagaattttacggcaccgacattgaagggctcaaacaattgccagccgaagacttggccaaagaattggaagagacaaaagttcttggaatcgcttggaagccgaaacacaatcgtatcgcattcaaattgccaattttcgagggaacaatcaccaagcgcacaattctatcacacattgccaaagtgtacgacccgcttggattgatgtcaccagcattgttgtcagccaaacttttccttcaagaagtgcaaaatgccaatagcaaatgggacgaaacattgtcgagccatctcgtcaaaacgtggctcaaaatcgtagaaacttggtcgcacagtggcacaccaatcaatgtcgaatttccgcgattcattccgtccacaacgaaggacgaatttcattgcttttgcgacgctagcaactatggcttgggaattgccatttatcagaaagcagacacgacatacgcaaaatccgaatgcaacttgatcttcgccaagagcctggtcaagccgctaaaattggtcgcccacgattcaacaattcccaaactggaactgcaagcactcacgctcggagttaaagcagtcaacttcattcaacagcaactcaatttcgatgacaagcaagtcattctttggaccgacagccaatgttcggtcgaacgcctcaaagacggcagaaaatccgatcgattcgtgaccaatcgactcaacaaaataagggctgcaaattttcaagttcgacacgtcagaacagactcaaacccggcagacttagcctcaagagggatcgaccctcgcagcattcaagcatcgcttctttggagatttggaccgatttggttgtccaaatctgatcaatggcctgagtcaaatgtcatttatcaacccggcgaagaaatcaaagcttacgaagaagtgccgatcgttgaaatcagctgcgcagttcaagaaaagcagaaattcaagccaacaattcaatttgaacgattttcgaattggaaccgactcagagccacagcagcatacgctaatcgattcatcctgcgactgctgagagcaaaaagaaggaacaaacagcttcctcaaaacattcaaatcaatggaccattgaaagcacacgaactgcaacttgccgaagaatggatattgacagaaactcaatcaacttatccgccaaccgaagatcaaattcgagatcttcggctcttcaaagttggaagactgtggagatgcggaggaagacttgacaacgcagaaagtctcagtttcgacaacaagcaccccattttcctgccacccgacggctggatcaccaaactgatcattcgacattatgatcaacaacacaagcattgcggcccgagaattcttctgtctcaaattcgagagaaattctggattccgcgcggcagaaagacaattcaacaagttctgaattcgccacgtcatggatgtctcaaatgtcgaaaagaaagagcaaaaccatactcatacccagaggcacctgatctaccagctcaacgcgtcaatcaagcccgaccattcaactcaacgggcatcgattatttcggacctttgaaagtcaaaaggggtgccgaagtcgtcaaaatttacgtcgcgctcttcacttgcttagtgatcagagcaattcatttggaaattgcggaagactactccgccgaagcattcatcaggacgttccgacgatttgtctcgagacgtggaacgccaacactcatcatgactgatcaaggatcaaatttcgtcgctggatcaaaaatcatcaaagagcattggaccgacacgcttcttcccgaacatgtgcaaactcgactcgcgcatcaaggaatcacatggaagttcaacacagctcatgctccgtggaaaggaggcacttgggaacgacttgtcggcattacgaagaattcacttcgtcgaacaattggccgaaatcttttgggatttgacgaaatgcaaactttgatctgtgaaatcgaagcaatcgtcaacaaccgacctctcacgtttgaatcggatcaagaaccgtatcaatcgcttcgtccgatcaactttctcattccatacgaacaaatcgtgatcaactttccgctcttggatgaaaacttcaacgatccggacttcgaaccgcgcacaagcaaccgtaatcaactcgtcacgatgctccgaaaaaccagcacgctgctggaccgattctggcacacatggaaaacagactacctgttttcgctccgtgaaacagacagaagcaacgcaacaaaccgatttcttcaccccaaagaaggggatgtagtcattgttggagacgatgaccaaccgcggtcattgtggagtttggcacgagtcattcagctccacaaagggcgagataaccaaatccgctctgccttactgtccattaatggacaacatcgatcccgggctataaatcagctttattgcctggaaattcccgacagttcagaaacagaagcaccagcacacaccgaagtgatcgctccaatcatggcatcggaatcgatcgaagtcatctcattggcgagcagtgacgaccaaatgtccgacgactatcacattccgaagaagaaaaatgtgatcaaacgaaaacaacgctttattactggtcacaacgtcggcttacgagaagtcgagcaacgacccacggacaacgatcccgtcgaaggattgttgtactccaagcgaccggacaacaaaaccaaattcttcaaggacggaaacttgaagatgcttttggaatcaatcactctgttcaagcgcatcgaaggcaaaaagatggcagaaaaactgttggaactttacggaaaagttccgatgatcgaatgggacaaacgcttggccaaatacgaagcaaaactgaggaaaatggatgaagcaagggacaaaaaggataaagagagagaaaaccaaagaagagaaaaacgaaaattggatgaagaagaggaaccggaaaaacggaagaaaatttcagtcgaaactgacccattggaagaaactgacccgaaaaaggaacggcaacttcaagatgaaaatagaatccgctggtctgcgcaaaggaaagcagcagtggatgaactccgtcaacgcatcaaattgaggaagaaacaatggtcaagggaagaaattgagaaggaaatgaaggaaagcgaaaaagaggatcaaacacaactgcgcgaactggccaaaaacggaagcaaagaagcaacacaattattggaaacagccccatcactccgccaacagtcaaatgttcaagtgactgcgacaattcaacgaaaagctgaggattatccacaaaatggagaaaaagttttgaagttctgccagcggatgtaccaagacaatttgatgtcagcgtggagaagaaaccgagttcaaaaggaattgactcaacttttggaagatggccgcttcaaactccgtcatgtgaacggacaacaagcaattctgcatcgaattacagaaggcaaaaaggacctttgcggtgaatttctcatcggaagaatttgttcatggcattatttggacgaaatcgaattcgaagacacaaaagagccaccgccggctcaacgagactcaactccggaaatcacggtcgtcgaaaccaaaaacgaccaggacaggcagcaagacgaaccgcaattcgttaccattcgagccggacgtacgccgccaccattatttatccctcaacgttcaaaatcgccatcgcctcaattcatagtacaccgtgccgctcacacaccgccgccagcacatcgcgattcaacacaaacacaactcgtggaagagtaccatttggccaaaagcaaacccaacacgtttgtggatttcaacatcttcactgaatgcgatgaaactcatctcacctgcgcaaaaaatgcgacttatggtcaaatcgcggacaaacacaatcgagagaaaatcgaagaatttgtcaattgccgtgcacgcactttgtttgaagcaataatgctccattggcttaattgcaacatcaatcggccaaataacgaagtttgggccatgcacgaactgcacactcaacaattcgacactttggaagaatcggcaaaatttttccatcaacaacaaatcgtcatgcgtaaaagagacatcggcaaagacaaacacttcaaagaagcgatcgaaatttggcgcaactcatgcgacctgttcaatgaaaactttcaacatgtgaacaagcaactcaaattcagcccaacacattcgcctgaaatgcaaaaaacggattatgccaaatggatcgaacggatcaaccaacgtacaaacgaaataagctcaaaagagagatcaagaatgcaatttcccgacttcatctacttcaacgttcgaacaattttgattggagacaacaccgcagaagctctccaatctcatttcccaaaatcccgctggtacactcattttgccgatcaaccgcttcgacttacactaggcccacaagtcaagcacgccatctttgcgtatcaatcaactgatgaggacatgatccgacaaatcactccgttgctttatcagcacaagaacactgacatcgaaacaacgctgatcctacgaaaggacaacaacaacgattggctctacaacaaaaaggaattcattggcttgactaaacgacttgaggccggattcttcgttttcaatgcacgaatcggcgaagctaaagaattggccgatcggatgaaagagacaatggaggagtcaatgcaactcaacaccgagcctacaacttcaaatttagccgggaacaaaaagccataccgaaaaggattcacagttgggcaacgaatgctcaactcgctcatgctcttcagcctttttatgctcatcgcattacaaggagcaagcgcacaaccaatccgtcaaaaacgatttggcggagttggagtttggcatggaagccacgcaatcagccaactttggggcaataacgccaccagggaacgattttcgacattttctccctcagtgcaacgctacataagtcgtgtgttcgctctcaacgcaacagcaactcttccaacagtcccaacctcatcaaccgcacacacaactccaatttcaacaactccgcccccattcacaaccacaaaaccacccgcaataactatcaaaccccccatttccacaaccacacgccaatggaaaacgaccaagcttcgaacaactcaaacattgcccccaacaagcaccgaaactccgatcacccgaaccaatcgccccaaaatccaacccccattattcttcgctcaacgacaatcccaatggaagggagacccgatcaacgccaaaggaatggacatcttctggtgtacggatcgtggcagcacaatttgtgaactgaagggacctgaaaactcacccttttgtcgcccaccgccagtgttgaccgccaaatggaccgcacttaccatcacgctgtacacaaaaatccatcgacccgaaaccgtacaatcaggatggaattgtgcagtgagacgaatcagtgaggtgtattacaccaacctgataggagataagttcgtggacgtcaacaaaacatttctgcccgtgtccaaaacaatgtgccgacaaatggcacttcatcaaatttgccctatggcaaaaacagaaatgacacaaaccagcaaaaacacatggacaaccaacgacgaactcagtgtcaactttcctggtccaatcgaaggactcttcaaaggaagtcaaaccagcgaaacgacaaactgttttgtccaaccagcaacattgttcgtcaaacgccacaatttgcaacttttgtcgccagttcatcatgtagaacattgcgactactcatcaggattttgccaattgcccgacaacaccacaatcatgtggaaaccagattgccccgccgaaggatgctacacctgcgacttcgagaaagccgaacaaatccgaggcgaatttaccaaaactcgaggacaaacctcagcaatttggatatcggaagatcgtcaaaaagctttgaccttcaccgactcaacggcaataatggcatgcgatggcaaatcgattgttctttcggagcagaattttggaattcgaaaggaacaatacgacgcattgatggacaacgatcattcaagaacaaagcgcttcgtagaaccggaacaactcgcctctcagttgtcagcagctcaaattgcaaccaacatggcactttcgcaactctacatgaaagaatgccaacgcaacttccgtgttgcgaatccgacattgcaggcccgaaaactgctcaaccgcgagaatttgcaagctcgatggatcggagaaacaaccatcgaagttttcccatgcgtcaacatcactctgaccgacatcagctaccgagcaacaaaaagttgctacaaattcattccggtcaccgttcatctgccaaatgccacaatggatgcatttctcgaccccgaaatgcgcatcctttcgctcgtcactcacatagcaagctgcacgcatttccgctaccaccatctgcaacttaaaaagaaccctagcatttggctgcggatcgacgtcaatttcggcatcgccaaacgactacctcagtctgctgtccatgagctctacgaatcgattcaaaatcaaactaacaacgatttcgaactcaatccattgatcttccatcaatggcaactcagcaacgacaccgacaacgccattttcccgcacatcgacgaattcgcggatttgacggatttcaaatcaaaactcgagcagcatcaaactgcgagagccgaagcattgggcgcaattcccggaggactggaaggatggacaattcggaaggtcaaggagtggctcaacgaactcatcaattggtggatgcgactcgcatgcgcatacgctacatttctccttctacgggatgtgatactcccgtgcatcttcgcctatctgatcaaccccgtccgtgtcacattcatgagcctcgtaggattccgaccacgccggcaaccacttccgcaacggcgatgcttcgacgaagtcgtaccaatgcgccaactgccccgggcacccaaacggccatcaattcgtctacgtgccgaccgcccatcctcgccgatcgctttggacttcgactcaagatcggcaacttaccgatcacgcgcatcaagcttgacaatcgacacgccattcgggaagtcgcaaccgttcaaattggcagacgatgattga

SEQ ID NO: 79026 - DNA, 3717 bp, Heterodera glycines
  Genomic contig location: Contig_ID=SeqID_234; Location=10515..14231; Strand=+
  SCN-specific regions: Sequence locations=1-166,188-477,499-870,893 -965,987-1225,1248-3093,3115-3717
atggcctctccaatccaacaaaaattgggagccgcactcaaagtgatcagccatgtccgaaccgctgctgcactgacaatcgcaactgatccaaccgcaagcaactttgaaaatgcactcaatttcgaagcgcaacttgagaaagttcaaaaagaagcaaaaacattggaaatctttttggatgacattcgcgaatcgctttcttcgtggactgatcttctccgcaaattgccagcaacagaacgagaaacaggcgaaaccgaattcaacgcctacaacaaaaaggagaagatcacagacaaagtcgatgatgcatcaagcaaactccgggatcttcgtgatttgaatggcacgttgtcaattcatgcaaaactcttccgcaacaaatacgacatggaagaacgagcaactcaagctgcacaagcacaagcagcacccgcaactcaaggcagaacgattccgccatcacgcccatcatcatttttccaaattcaacccgtgcaactcgagagattcagcggcagcaaacggcaatggccggaattttacgaatcattcaaatctgcaaccggatcacattcattgagcaaggccgaaaagttcaacatcttacgcaatttgttgactggcgaagcacgtgaactcgtcgctggctttcgtcttgaagacgcaaactatgatgtggtactccaattactgaaagacacctatggagcgcatgacgaacacatcagatcgctgcatttcgaattggccaacctccgaacatgcaaaacattgcgcgacacaaaagagtttttgctgcaactcgaacgacttacgcgggaattgctcaacgcaggagcagacatcgaaggaccgccaacatatctcatgcttgaaaagaagctgacgccgccatttctgcgcacaatcctcaacaaaaagggagaagatcccgatcattggaacacatcgaagttccgcaacattctcaacgaagcagtccgcaaagagactcaaattcaagaagtcatgaccgaatatggtcaccatcagcagcaacgaccaacaaaaccatttattgccggaccgagattccgggatcgcgcaccgttcaatcaatttcgagaacgatcattcattgcgtccgccgtggacgaaaatcaaaggcgattcagcaataaacaattggcgcccaaaatcgcacacaatggaccaaaaccaactcaattcgcacaacgcacgcaacacaacccggccaaacccaatcaattcaacaggccgtcacaaccgcaaacaagtggcaacagtcaatcaaatgcaaatccaccaaggccatgtgtattttgcaacggcaaccattggaattccgattgccgaaaattcagcacaattcaacaacgagttgaaattgtcaaatcaaaaggcttatgcttcaaatgccttttcgcacatcgtacatttgactgtccaaaaccgagaaaatgtttcaaatgcggacaacttcatccaacagcactttgccgcaacattaatgcgcagaaccaaatcgcagcggcaacaatcatgccacatttgtcaataccaagcccgcaaccaatcgaaaatgctgcaatccaaacccaaccaatgtgcaacgccgtcaatgcaactgacactcgcgccttactcatgacaacgacggcaaccattttcaatccggcacaaccgcacctcagcatgatcgcctcaattttcatcgaccctggcagtcatcgatcatttgtgtccaatcatacggcacaacggcttgatcttccgatcgtcaacaccgaagaatgccttttgaccagctttggtgagcgcatgccaaagaaatacatcagtgacatggtcaaattgggatttctgtgcatcaatggagaaagactcatcttcaacctcaatgcacttcaattcttggtgaatgaaatgccaatgatccaattgtccgaattggatcgcgatcaactcaagcaacgaaagcttacgccaccacacgagatgaagcagcccgacattttgcttggcatcgatgtctggcacgaattgcaagtccaattcatcgaacgattgccgagcggatttacactttgccgatcaaaaatgggcaaaatactaagcggaacgggacgaatggaaatggggcaagcatcaaatgtcacattcgtcctcgcagtccaagacaaccaaatggcccaagcatcgacaactcaatcaatcgaaatcgaagacaacatcttcacatccgaggatgatctgaaacgagacgatcaactcaacagcttttttggtctccatttgattggaatggatgactcctcaacgccgatcgatcgagatgaagttatggtcaacttcaaaaagaatctcacgttcatcaacaatcgttaccaaattgctctgccttggaacgacaaagtcggaactcttcctaccaattatcatcaagcaaaagcccgactgatcggactgatcaacaaacttcgttcactcaatctgatcaacgaatatcaggccattctcgacgatcaactccaaaaatccgtcatcgaactcgtcgaaatgcccgatcaatcaattggcccggttcattacctaccacaccgagccgtcattcgagccgacaaagcaacaacaaagttgcgaattgttatggatgcttccgccaaaccaaaaagcaatccatccgccccatcgctcaacgaatgcctctacactggtccgctactactcaaggacctgactggcatccttttacgcttccgccgaatggaacgcgtgcttttggccgatatcgaaaaagccttcttgcaacttggcgtccgcgagcaggaccgagacacaactcggttcctttggctgtcaaatccgaaagaggccgaattaaaccctctaaaacgagaagacattttggtctttcgttatagtcgtgtaagcttcggattgaccgtttcgccttttctgcttaatgccacgatccgtgaacacctttcacttttcgacaacgacttggcaaaacgcattgacgagaatctttacgtcgataatattctaatcgaaatgaaagccgacgaacaactcaaatcagtggtcaatgaagccaaatcaatcttcaaagcagccggcatgataatccgagaattttacggcaccgacattgaagggctcaaacaattgccagccgaagacttggccaaagaattggaagagacaaaagttcttggaatcgcttggaagccgaaacacaatcgtatcgcattcaaattgccaattttcgagggaacaatcaccaagcgcacaattctatcacacattgccaaagtgtacgacccgcttggattgatgtcaccagcattgttgtcagccaaacttttccttcaagaagtgcaaaatgccaatagcaaatgggacgaaccattgtcgagccatctcgtcaaaacgtggctcaaaatcgtagaaacttggtcgcacagtggcacaccaatcaatgtcgaatttccgcgattcattccgtccacaacgaaggacgaatttcattgcttttgcgacgctagcaactatggcttgggaattgccatttatcagaaagcagacacgacatacgcaaaatccgaatgcaacttgatcttcgccaagagcctggtcaagccgctaaaattggtcgcccacgattcaacaattcccaaactggaactgcaagcactcacgctatga

SEQ ID NO: 79027 - DNA, 507 bp, Heterodera glycines
  Genomic contig location: Contig_ID=SeqID_234; Location=739..1245; Strand=-
  SCN-specific regions: Sequence locations=1-398,420-507
atgaatcgcggaaattcgacattgattggtgtgccactgtgcgaccaagtttctacgattttgagccacgttttgacgagatggctcgacaatgtttcgtcccatttgctattggcattttgcacttcttgaaggaaaagtttggctgacaacaatgctggtgacatcaatccaagcgggtcgtacactttggcaatgtgtgatagaattgtgcgcttggtgattgttccctcgaaaattggcaatttgaatgcgatacgattgtgtttcggcttccaagcgattccaagaacttttgtctcttccaattctttggccaagtcttcggctggcaattgtttgagcccttcaatgtcggtgccgtaaaattctcggattatcatgccggctgctttgaagattgatttggcttcattgaccactgatttgagttgttcgtcggctttcatttcgattagaatattatcgacgtaaagattctcgtcaatgcgttttgccaagtcgttg

SEQ ID NO: 79028 - DNA, 93 bp, Heterodera glycines
  Genomic contig location: Contig_ID=SeqID_234; Location=8726..8818; Strand=+
  SCN-specific regions: Sequence locations=1-93
gtttttattcgcttttgaatttgggcacattttgcctatcgaccactcgccgaccccgaccccacaaacaaactttggactagcgtgttcgaa

SEQ ID NO: 79029 - DNA, 831 bp, Heterodera glycines
  Genomic contig location: Contig_ID=SeqID_234; Location=8858..9688; Strand=-
  SCN-specific regions: Sequence locations=1-57,80-296,318-473,495 -710,732-831
cctcatgaaactcggaattggttatgttttgtcgaaaatatccttacataatactcataaaaaatacaaataaatcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaaaccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattgacagtatcgtttctaatagggaaatattgacaggatattcggctaaaaacgggtttgatcatttttagcgcatttttaggtatacatttgagacaattgggcaggacaagaaaagaatgaagttgatgcct

SEQ ID NO: 79030 - DNA, 653 bp, Heterodera glycines
  Genomic contig location: Contig_ID=SeqID_234; Location=11853..12505; Strand=-
  SCN-specific regions: Sequence locations=1-653
gtaagctttcgttgcttgagttgatcgcgatccaattcggacaattggatcattggcatttcattcaccaagaattgaagtgcattgaggttgaagatgagtctttctccattgatgcacagaaatcccaatttgaccatgtcactgatgtatttctttggcatgcgctcaccaaagctggtcaaaaggcattcttcggtgttgacgatcggaagatcaagccgttgtgccgtatgattggacacaaatgatcgatgactgccagggtcgatgaaaattgaggcgatcatgctgaggtgcggttgtgccggattgaaaatggttgccgtcgttgtcatgagtaaggcgcgagtgtcagttgcattgacggcgttgcacattggttgggtttggattgcagcattttcgattggttgcgggcttggtattgacaaatgtggcatgattgttgccgctgcgatttggttctgcgcattaatgttgcggcaaagtgctgttggatgaagttgtccgcatttgaaacattttctcggttttggacagtcaaatgtacgatgtgcgaaaaggcatttgaagcataagccttttgatttgacaatttcaactcgttgttgaattgtgctgaattttcggcaatcggaattccaatggtt

SEQ ID NO: 79031 - DNA, 638 bp, Heterodera glycines
  Genomic contig location: Contig_ID=SeqID_234; Location=13389..14026; Strand=-
  SCN-specific regions: Sequence locations=1-398,420-638
atgaatcgcggaaattcgacattgattggtgtgccactgtgcgaccaagtttctacgattttgagccacgttttgacgagatggctcgacaatggttcgtcccatttgctattggcattttgcacttcttgaaggaaaagtttggctgacaacaatgctggtgacatcaatccaagcgggtcgtacactttggcaatgtgtgatagaattgtgcgcttggtgattgttccctcgaaaattggcaatttgaatgcgatacgattgtgtttcggcttccaagcgattccaagaacttttgtctcttccaattctttggccaagtcttcggctggcaattgtttgagcccttcaatgtcggtgccgtaaaattctcggattatcatgccggctgctttgaagattgatttggcttcattgaccactgatttgagttgttcgtcggctttcatttcgattagaatattatcgacgtaaagattctcgtcaatgcgttttgccaagtcgttgtcgaaaagtgaaaggtgttcacggatcgtggcattaagcagaaaaggcgaaacggtcaatccgaagcttacacgactataacgaaagaccaaaatgtcttctcgttttagagggtttaattcggcctcttt

SEQ ID NO: 79032 - DNA, 920 bp, Heterodera glycines
  Genomic contig location: Contig_ID=SeqID_2309; Location=3471..4390; Strand=-
  SCN-specific regions: Sequence locations=1-19,61-71,93-150,193 -212,237-276,300-663,686-851,897-920
atggcggcggcttctggttgtactgctgctgcttctgctgctggtagtagtggtagaggaaatgattgtgctgataatgatggtgatgatgctgaggaaaagcccgtgaaaagctggtgataattgttggcaaaatttggatcttcacatgacgaggaggaggaggaagaggaatcggaagaggaagaaaagttggggcagtaaagagtcaactcatcatcatcattaaaatcatcattaacaaagtccattggcggatggattgagagggatgaagcagcaaaatgtagaacaaaagcaggcaataagcaaaaatttaaatttcttaatttgattttttgctgtgtaaattttggggagtaaatttttgaaaattgaaattttggtcccatttttttaatttttgaatgacgtattttcctattttatagcgaatggttttcataattttattggttcgctacaaaatatattcggaggaaatttttaatttttgaaattttgtccaatttttctatttttccccatttcccctattttcaaatgtttcttttttgttgtgattttggggagtaaaattaattaaatttgacatttgtttaggctgattttttttccatttatagcgacaattttcaaattttgtggcgaaggaaaaaatggagaagtgggagaaggtcacctcggcgattgatcagggttactgtatttgataggtcacgagcgcctgcacagatcgagcaggtgagaggtggtggagggtggacaccaatcaaaaaaaaaaaatatgaaacccgaaatattaatccgaaatacggaaattgtagcgaaaaatcaggatattaacacccaaaaaaatgttatttctttaaatattttttgattaaaaaattattcaaatatgattagtagggaataaa

SEQ ID NO: 79033 - DNA, 598 bp, Heterodera glycines
  Genomic contig location: Contig_ID=SeqID_2310; Location=928..1525; Strand=-
  SCN-specific regions: Sequence locations=1-23,50-95,123-356,395 -509,538-576
atgccagaaaaagctgccccgattgaaccaccaccaccatcaccacagcttgcctgcgctgctcatgcaacagtgccggaggcgagctttgctgctgcatttgatgctgttgctgctgttgcatcacaaattgttggcattgtgcgtcgcgggcggaggatggcattacgcatgtttcggcacaaccgccgccggcaccgccactgccgctgctgctaatgctctcgttgctcgtgttgttgttgctaattggtgttgttgtggagcaggacaacagagaggacgactggaactgcagttgttgctgttggtgttgctcaataacaccttcctgaaaatgatgggggccaatttagttaattaattttattttttacgatttttaatatattaagaaatcaattagtgaaaaaacgtaattgggagcaaattgccactctctcctcgctcatttgccgaaattttttttaatttttcaaaaaacataaagaaaaaaagaccaagaaaagtataaaaatttaaaatgatttttaatttctacgaatcttttaattttttttaacttgaatttcttagaatttttccaaaaaatattaaa

SEQ ID NO: 79034 - DNA, 959 bp, Heterodera glycines
  Genomic contig location: Contig_ID=SeqID_2311; Location=158..1116; Strand=-
  SCN-specific regions: Sequence locations=1-288,312-481,524-591,613 -646,670-726,748-773,828-959
atggaagtcgccaagtcgaagcagttcggtgtactaccaccaccaacgccgccaatggcactgcccactgagccgggcgtgtgcacggcaccgcccgtggcaccggatgatgccacactgctgaccggtgttgtggtgggcgtcaactgttgctgatcaatggccaagtgatgattctattggttgtaattggagtgataatataggtggaatttgccaaaaaaaatgtgccaaaaaaagacaaaatcggaaccgcccaaatttggtgccaacgtttcggcacagaaagattttaattgttttattattaattgatgccatgcgctaataagggatggcttcgcgtctttgaagaatgttccagtgggcaaaatgtgccgcatttttacacggtgggaaaaatgtgccatttttacacggtggggaagatagtgccatttttactcaccgctgggacaaaataatgccattgccattttaaatggcacatttttactcgccagtggtgccaaatttttgccatttccccccatcgttatatgtaccatttcttactgtactctctctctctacctgttgatgatgctgatgttggttgttgtggcggttgtgctggtgctccctggcaattccgccaccgtttgggtgctgctgctgttgttggcacttaatgcgggcatttttgcgccgtttcagctgctcatcactcagaatccactcctttttcatgccgacttcaaagcatttgcggagacgacatttttgacaaaaactttaaaaatttatttttttaaattaattttttaaatatagaaaaaacaaaaaaacacaccgccggctgagcgcggtgatctcgcactcatttgagtacgggcatttgaactcctttgggcgcaacgcgttccggcggaagaatgccttgcacgactcgcagctataaaaaaatattggaaattaaa

SEQ ID NO: 79035 - DNA, 360 bp, Heterodera glycines
  Genomic contig location: Contig_ID=SeqID_2312; Location=476..835; Strand=+
  SCN-specific regions: Sequence locations=1-91,113-234,256-360
atgtcccggtcaccgcccgccgactcgtcgccgtcttcgcgcagtacgcccaccagcggtggtggcacaatgccattgccatcgttcaccccggctgctgtcatcaatgaccatcactatccagccacggctaacagtaccactgcatttggcaatcacacagccggcacgggcggctccgttgtgcaaacctcgtccattgcttcatccccagagcaacccggtgccacaaccgccgccacaaccccaaccaccgtaaatgccgtgccgtccatagtgttcaaggacttgcgcgctttccaactcaattcgttggagctccgtgacgtggaaacagtgaaagcggctttttcattgtaa

SEQ ID NO: 79036 - DNA, 82 bp, Heterodera glycines
  Genomic contig location: Contig_ID=SeqID_2312; Location=894..975; Strand=+
  SCN-specific regions: Sequence locations=1-82
atggaggaagaattgcgcaagagtgctgccaacaacatggcgggaccttgcaagaacatcgcggaactgatgctgctccttg

SEQ ID NO: 79037 - DNA, 375 bp, Heterodera glycines
  Genomic contig location: Contig_ID=SeqID_14878; Location=635..1009; Strand=+
  SCN-specific regions: Sequence locations=1-13,101-137,208-221,243-375
atgaaaaatgaggaagaaaagaaaaaacatgaattgaaacacaattcggctgaaacaaaaacaaagcaaaaaacaaaaatggaaaagaacagaaaagaaattgagaaaatgggagcaaaattgaacaatttacagagtaattaataataaataaataattttaaataaatgcattattttaaatatatttcattttaattttttttaggacatgcaattcaactaaaaatattggaatttctattgacaagcgatgaattgttccgaataaatcatcgttttgatgaaagggtgacaaagcgaaatactttacaacattcataatagcttatgacattttggaattatgggcaaaaagttaatttaaaactttta

SEQ ID NO: 79038 - DNA, 908 bp, Heterodera glycines
  Genomic contig location: Contig_ID=SeqID_14880; Location=23..930; Strand=-
  SCN-specific regions: Sequence locations=1-287,309-389,412-527,556 -731,761-908
atgtacccacgcggtttgatcgaccccgaatacaaatgcaaacattttgaggactctgaaaggggtgggtttagtaacttttaattaagcaaatatttttcttgataggattttcgacaactgtgacgcacattgagctggaggccgccctccgctctgggtacaaggtgatgcacgtgtgccgtgcctacatttggcggcttgtgtgcgattggagcaatgggctgttccactcgtacctgctcaaatttctcaaaatgaaatttgaaggtaaattttgaaatagtaataaattaattaatcaacaaaattttaagcaagcgggtacccagccaagtgcaccgaggcgggcatcagcgaggaggagtcggcacggagaaagcaggaacacatcgacaaggccaaagaaaaggcccaagtccaccttgaggcggaccggatcaagcacaaccccgggctccgctacctgtccaagctgtgtttgaattcgctgtggggccggttcgcacttcggtaaaactttttagaaaaatatataaaaaattttaaaaaaatcaatagaaatcggctcaccaaaaccgaaatcgtcgagtgccatgcggagctggccaaactgctgaacgactcgaagattgaggtcagcagcatcgataagctgacggaaaagttttggatggtctgctacaaggccaaggatgagcattggtggaacacagcacgagcaacgtaagaaaaaattttaaatttttaaaatttatttgccgttctcaggtggccattgccctatggaccacctctgctgcgcgaatccatctgctggaatcgttgaaaaaggtgtatggccctgctccgggtgttgagcggtacgacacacgcattctctacatggtaaaaaatttggaaataaa

SEQ ID NO: 79039 - DNA, 2030 bp, Heterodera glycines
  misc_feature (1967)..(1967): n is a, c, g, or t
  Genomic contig location: Contig_ID=SeqID_14881; Location=4..2033; Strand=-
  SCN-specific regions: Sequence locations=1-356,381-893,927-1031,1078 -1243,1265-1372,1409-1582,1669-2030
atgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcatttcaaagaatttttttgtttagacatttaaaagtcgtgattgctatgaacaccatgccaaatgcacaaactgccgggtcaaacgtgacaacgaagaggaaattgtgggaaaatcaatctgcatgagctcgaaaaaaatgtgttgactgtggtgtgatttaccgaatggcggtaggccttgtattttaagattcgtaaaataaaataataaatatcacaggatcaagacaagaaaaaggggcatgtttgcggtcaaaaattctgcaaaatttgtctcggcttccatgacccgcgagactgctacataccataccggcctaaagtcaagaaggagaagcgcttcgtcttctttgactttgagtgcactacggatttcaagcccgacccgcaactcatgcggtttaagcaccaggtattttgttttttcaactttagcaaattatgaaaaattcaaaggtcaacttctgctttgcccatgtcacatgcacccgctgcattgagaagggcgtttgggatcaggaattggaaaaggcctgcgcgctttgtggccgattccgaacttatgcctggtccccgttcgaattctggcacacggacgtggaatgccgcaaggtcgtcgaagacccactggcagccttcaccaagtggttgctgaacttcgaaacggaagtcctcggcatggagcccggagcaaagaagcgcagaaagaggaaaaacattgacaacaccgacggggaggccatggaagcagatgaggaagaggatgccgtggatgaggacgccgagaataattggatgttgggttatgaggaagcgggggaaaagccggagtcggtgacgacttacgcatatgcacatgccggtaaattcaattatttaaaaaaaatttttgaaatataaaataaacaaaattaaaggctctcggtatgatcacgtgctgatatacggggaaatgctgcgcatgggtgtccgccctgaactcatccgccaaggcaaccatctcctggaaatgaaggcgcgcaaaacaggagtctacacacccaccgtgtttcgggacaggtaaaaattcaaactgaataatttttattttgtcctttcagctacaagctgatcccgatcaaattggcaaattttgtcaagacgtttggcctggaaattgagggcgtggaaaacaagaaatattttccacacaaattcaataaggtaagaggaatttataaaaaaaaaaaaataaataaaaattaatacaatcttaggcggaaaattatggcactgtgctggacaccctgccaccaattgagaactattacccaggtggactcttcccggcagagcgcgcaaagtttgagcagtggtacgacgagaaccgggaaactggttttgagctgagtgaggtcatcgcggattactgcaagacgggtaaaaaaaaaattataaaaaaaaaaaaaaaaaaaagaaagaaagaaaatttttaataataataattttgaagatgttcaaatcctggcacatggtatggtaaaaatgcggcagctgttcttgtccgagacacggcatgacatcacggattcggttaccatcccatccggctgcatgaagtattgggtacagctggcgcaccactacaaagagagcgtcgccattatcccacacttgggatacgagaagcgcggcaagcagagcacaattgcccggaaatatttgaaggtgcctaaaaatgattataaatttacattttgccatttctcagtggcgtgccgaagaagagttgcgagagaatggccgagtcctgcgccatgtcgaaangccctggaggggagttcaaagtcggcaactacagctttggacggggatgatggagcgccctga

SEQ ID NO: 79040 - DNA, 1365 bp, Heterodera glycines
  Genomic contig location: Contig_ID=SeqID_14882; Location=335..1699; Strand=-
  SCN-specific regions: Sequence locations=1-29,51-379,401-555,577 -667,689-1365
gagaagtggaagcgagcgcaaggcaaaacggacaacatcagaacagacaccaccacagacacagccatcaccagcagaagaagttgagccgaaggcacagcaaagaattgctgcagcaggagcggtgttcgtcctcgtcaagtgtgatcagcaccagcacaaacagttccgttgtttcgtttgaaccgaaaggcaacgacgaccggcgggagcactttctcccggccgacaaattcgctctctgttttcaggtggcacttttgacaaaaatcttattttttgtttttatgttatccaaactgattaataatgctaacactttcagaaagcactgctcgtcggcagaaaattggacgacaaaatccgttcctcaagcaattccatggacaaaaagtcggagaatggcgccatggaacagacgttggagttccgtccgcagcacaacagcagcgtaagggcggcaaattggatgaatattcattggcttaacgggggactgtcatttcctgcagaattgtgacggcggcggaagggcactttctgccggcacggcaaagggcggagagggcggggggccgaggagcaaatcgccggggggacacctcatcaacaaaatatcgaactttgcacggggcaagtacaggaacagtctgagcgaacggcagagcaacgcggtgggggcggaggagaaagtgcgcaaagtgagtgagccgagggaataattggcaaagccatggaaaaacaaacgaatcgaatgagggagaagtgttgcaggacatcggcagggagctgatgaggtgcaaggagatgggcgagactcggttggacctcaattcatccgaagttcgttcggattcgatttggtcccttcgatttggcccattctttgccctttcagttggccaccattccctcgtccatccaaactttgactcaactgaccgaactcttcgtttacaaagtcttttccttctctccctttttttaaatttatttttacgtggattttagaacaaattgactaatttaccctccgaattgggccatttggtcaatttgcgtatcctcggcctaagcgaagttcgattgctttttttttattttgccattttccctttttttgccagaataatctgtccacccttcccgaaagcctttcttcgttgaaaaaactcgaaactttggaccttcggcacaacaaaatcagcgaggcatttccatttgcgtcacttttattttattttccatttttaggaaattcctcccgtcgtttttcagatggaatctcttgaaacgtaaaagctttgttcccttttccttttctattttttgtcccttttcagcttatggctgcggtacaataaa

SEQ ID NO: 79041 - DNA, 928 bp, Heterodera glycines
  Genomic contig location: Contig_ID=SeqID_14883; Location=103..1030; Strand=-
  SCN-specific regions: Sequence locations=1-76,98-595,617-776,808 -856,880-890,917-928
  Gene Ontology: Mol. function=ATP binding; Cellular component=cytosol; Biological process=cell-matrix adhesion
tcctctcatcctctaactttctaaatttctctcccaatttcaaacgtaaaaattattgtaataaattcactaattgtaccaaacattattttggtaatcaaattaaaccagtaataatgttagtttgtcgtctacgaacctcaatttttcatttggtcaaattttcccctccctcccccccctgactcaggtgcctatcattttggttggaaacaagaaagacttgcgcaatgaccagcagaccattcgcgacctttcacggaacaaacaggaaccggtgaagtcggagcagggaaaggcaattgcagaacaaattggttggtaattgcttttacatataaacaaatgtttttaaaaacgttattttttaatttctgagctcgaattcaacagtaatcggtggtttcaatggtgtacgaatttggccttagtttttgtcggttccgaaccacagaataaacagttcaaattttcgagattcgttttcatgggacagaaaaatttgaagtatgtgaaaactaaaagcatgtataacagcatcaaatggctgttttctacagatttccattttttgtgcgggaagtgagtgaaatgggtgacggatttgtgttccgcggtctcgagactcaataaaacttatgatcttttgtgacaaaattttgaaataaaaaagttggattctatcgcatttttttaccatttcccaaatcgctaatcataagtttgttattttaaggtgcatatgcttatttggagtgcagtgcgaagaccaaggaggtgtgtttgtttttctgtttgttggtcttcgtcggattaccaaaacaaaaaataattcggctgattttagggaatccgagaagtatttgagaaggcaactcaggcagcacttcagcagaagaaaaagaagaagaagggctgcaacgtgctt

SEQ ID NO: 79042 - DNA, 351 bp, Heterodera glycines
  Genomic contig location: Contig_ID=SeqID_14884; Location=54..404; Strand=+
  SCN-specific regions: Sequence locations=1-12,34-110,204-209,231-351
atggcaaagaatgggggaaagggagaggaaaagcagccaaacgacaagctaatcgctcaaaaacacattcttgaattgtaagttttaagtttaattataattcagagcggaaataaattttaaaattaaaaatgattttaaaattctaaatatcctttcatttttgagaatttcaataaattaattacttttaattatattatgttaaatgcaattgaaaatgggaaattaccaaacaatggaattaatgggcaaagaatgcgtcgctttttgatgtcatcagcaatcattcgtccctttatatggtaaataatccataaaaacaaagctccttttctcaaatttgctgca

SEQ ID NO: 79043 - DNA, 685 bp, Heterodera glycines
  Genomic contig location: Contig_ID=SeqID_14885; Location=131..815; Strand=-
  SCN-specific regions: Sequence locations=1-95,117-343,365-406,428 -545,582-685
atgcgattgtcgcaggtcggcacaaagcccaaaacggagttcggtcttgaaatccgtagtgtttttcatattgttccatgtcacaaagtcggacgaaggattgtttttggggaaatagggctaagtaaagagaaacggggagccgattatcaatacgatgaaaagcatcatccccaaattaaggcgctgagtggcgccgattgccggaatctgagaaagccaaatgggcacagaagtcggaggaggacaaagaacgcttcgcacacggcaaaaaaagggggggggaagaaaatgaaagaatggcatttttgacatttgcagagaaagccgagaaaagccaatcgcagcagaaggaagaggaggaatgagaagaataaaggaaaagtggggaaaaggatgaagcagcataaaagtgaaaagaaaaagctaatgaaggacgggtggattgatcacatttgatcattttggattaatcacacaaattgccattattgcttttgttgaagcaaaacataattagctcgtaaagttggattaataaatcgttatttattagttttaattaattttgattatattttcatatacagcgctgatcattatggacgagatcattatcaaactcctaataatgaaaaatggtaaaaatgccgaaacaatggcaaaaagaatggcgaaaaattga

SEQ ID NO: 79044 - DNA, 317 bp, Heterodera glycines
  Genomic contig location: Contig_ID=SeqID_14886; Location=153..469; Strand=+
  SCN-specific regions: Sequence locations=1-317
atgcgaaagaaatatgccacgaaaaaagtgatcagagctgacataatgccaaaaatgatcggagagcctctaaagtttatgcactttgatcaacgacgccgtccaaacagacttaagagactccaaaagtcgccactgccaatggagagcaaatcggtgccaccgccagcgcctcgggcgccgaccagccattggcgacgatgccgcaccaacgcactctcgactgcagaaggcaatgtcgagaagttgagggaaagcatggcgaatgtaagcagcaaaagtgtggcacagaatggacgacaaaaagcattttaaaa

SEQ ID NO: 79045 - DNA, 1490 bp, Heterodera glycines
  Genomic contig location: Contig_ID=SeqID_14886; Location=1250..2739; Strand=-
  SCN-specific regions: Sequence locations=1-294,317-334,356-371,404 -496,518-667,700-839,908-1189,1219-1286,1310-1490
atgtgccgtccttcgttcccttcaatgtttgcttttctgctgctcgttgctgctgccattgctctgatcattttgccttccgcttcttgtgcccctctcgacaatgcccaaggcgtcgttcccgacgctgcccccggcatcggttctgccagtgccgtcggcatcgctccgcgacatcggaggcaatggctgtcggccgcccgcggtgccggcggagactccggcagtttttggagtctgttcggcaaaagatgaaaagccgtgaaagtgccgtgccaatcgagacaaaaaactggtctttcaatgcccagaaacaacgagattaatacaaaatcattctctttttgtatattttacgggataactaaatttccaaaaaatgtctaaaaatctctgcttttcagtttaattggaattttaaatttattacaactttttcaacatttttgtcatattgacaaatattcagaataaattttacaaaatgtgctttacattttttataatcagtttttataaccataaatattagttttggttgatcaaaacaaaaattctttctttttcatctgaattcattttcacttcattacgcagcattaatgagcaaatgcacagtcataatcacttaaatgaataattattatcatcatcagatttcaattagtaatttaatgatatttaaaattataaattattcgtaccgaaaatggctgaaatagcgaaggcgaagtcgcacattttcacagtttcagtagagtccggcacagaattagggtcaggggactaaaaagaaaatatttataattagaaaaacggatgggtttgtatttaatctcaatttaatgaaaaaaattttaaataaaattttcaaaaattatttagttcaaatttagtaaaaaattttgcattattttgccagtgttaaaaagaaattctagtttcaatgccactaaatacggcgttcttttttgtgccgtcgtatgaaacggcaacagtttcggcactggtaatgacacgggattcggtctcggcacttagagtggttgtcgcttcaggtgacttataagggaaatttaagtttactaatgcctccgtaaagaaccaaaatttgagaatttgctaaatgtataaagagcatctacaaaataatgaatggtgctatttgatagcccataaaaaacgctacaaaattacaaaataaaattttttaattcactttcaattttgattggttttcaacattttaaattgtatatagtgagtgcccgtacactatgaccatgactgtatatggattttattttttagagaataataaacactgactgattcaataattatgtattataattaccaacaaaaataattcgctttaacagtacataataactgttattttggtcaatttccaaaaaaaagacccaagtaaaaaaaaacaatttgcagaatttgtagtaaaagtggataagaaattaattgctatatga

SEQ ID NO: 79046 - DNA, 435 bp, Heterodera glycines
  misc_feature (8)..(8): n is a, c, g, or t
  Genomic contig location: Contig_ID=SeqID_14886; Location=4513..4947; Strand=-
  SCN-specific regions: Sequence locations=1-331,354-390,420-435
gggcaggnccaccaaaccccaaaacgtttgggggacattgactggatgacagtaaaatgaataacaaataaatacaaccaaaaaaatcctattaggcctctattagaggaaaaggcgaaaattaattattaattgaacgcttttgaacagagtcctgctgaagcaacgccagtgcgagaacaaattccactcagaggtaataatataagaatgggattttttaagtcaaaacaattttcaaaaattaaacgcctaaaaaacatcttccattaaaaaaaggtaaacttaatgctcaatggcctccgcccgaaaaagaataccgcgtcgaagtgttgttgccggagggggtcaaacagtgatccgctgctaaaagtgatcggaaaatagcacagatttataaaaaataaaatatggaataaacactcgaaactttga

SEQ ID NO: 79047 - DNA, 506 bp, Heterodera glycines
  Genomic contig location: Contig_ID=SeqID_14886; Location=2576..3081; Strand=+
  SCN-specific regions: Sequence locations=1-187,213-259,296-506
atgccgacggcactggcagaaccgatgccgggggcagcgtcgggaacgacgccttgggcattgtcgagaggggcacaagaagcggaaggcaaaatgatcagagcaatggcagcagcaacgagcagcagaaaagcaaacattgaagggaacgaaggacggcacattttgttgattgggagaagagatatattattatggatatttgatgctaaaattctaataaaataatcattaaaatggacaacatttaattggtttactaatgagcaaaaccaaacaaaattgccaatttgttagcatttgcaaataatcaatttaaattatttaagcttaatggtaaaaagaaaatggcaaattgctgttattagttggacaagacaattgactaattatttaaatgttgcgaaaactgttgctgattgaggcaattcactttgcttaaatacaaacagagtttggtcactggttgttatgcaacctttacgccatgaagtaaacaaggggca

SEQ ID NO: 79048 - DNA, 179 bp, Heterodera glycines
  Genomic contig location: Contig_ID=SeqID_14887; Location=1257..1435; Strand=-
  SCN-specific regions: Sequence locations=1-150,172-179
ttcggctcgccatatccgatcaaatagccccttttgccacaatgggcatcgctctcgtccatgcatttgtacgccttgcaaccggaacagtcctcgtcaccacgcgtggcaatggaactgttattgttaaccaaaattggactgtccgagatggaaaagggaagaaattggaggagtaa

SEQ ID NO: 79049 - DNA, 724 bp, Heterodera glycines
  Genomic contig location: Contig_ID=SeqID_14888; Location=775..1498; Strand=-
  SCN-specific regions: Sequence locations=1-340,362-724
  Gene Ontology: Mol. function=ubiquitin conjugating enzyme activity; Cellular component=proteasome complex (sensu Eukarya); Biological process=mitosis
atggagaagaacccactgcctgagggatgcactgcacggccacttgatcaacggaccatgaccacctggacggttaccatccgaggccgggccggcacaccgtacgaaaacggcaacttccaactgagcatgtcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaaggtggcgtggatttggtggatggatttgatcaccttttaaatggattgatcactttaatgctcttaacttttttcaggggcattaagatccgctatttttgtgtttgattagcaaattcaaaagatttcattgcgtttcatcagagttagcgaaaaagcgaatttttggaatttatggtcttaatcgggcatgaatttgatggcgttggttttgtgtggtatttgtgcagtttgagtgatcaattttttcacatacaatttttggctgcagaaatcgttaatttgtttctctgtctttacagttgtgatctccatcatcgttctgctgaatgacccgaacccggacaactcgcctctcaatgcggaagctgccaatttgtaccggaatgaccgtgcggagttcaacagacgcgcccgtgagatgacgctcgcctatgcacggatgagatga

SEQ ID NO: 79050 - DNA, 175 bp, Heterodera glycines
  Genomic contig location: Contig_ID=SeqID_14889; Location=2208..2382; Strand=-
  SCN-specific regions: Sequence locations=1-175
aaggttcgatggtgcctttttctcttcgacttttgcatgccgaagcgtcctcattttcaccattgccttactcgtcgatggttcgtgtacacaaacttattgagaataccgtaaaagctatcgaaattgctcgtcggaattttgcggccactgattctgaacttggcatttggca

SEQ ID NO: 79051 - DNA, 1452 bp, Heterodera glycines
  Genomic contig location: Contig_ID=SeqID_14890; Location=283..1734; Strand=-
  SCN-specific regions: Sequence locations=1-182,204-1452
atggacgaaattttgcaaggaattgaaggagtggcagtgtatctcgacgatatactgatcacagcaccaacacaggcagaacatctttgccgaattacgcaggtgcttgagcggctcaaggcaaatggattgagagttaaacgggacaaatgcgaatttatgcgtgaaagcatagaatatttgggacaccgagtggacaaaaacggagtccatgcttcagaggaaaagctggaagcaattcgcaaaatgccaccgccccaaaatttaaaggagcttcaatcctttttgggtatggttaattattatggcaaattcgtgcccgctatggctaccgtttccgagccattaaaccaattgcggagaatggaagaaaagtggcattggggaagtgagcagcagaaagcatttcaaaggattaaagaaattttgtcatcaaccgaagtgctcgttcattatgatcccagccagccattatacttggcaacggatgcgtctgattatggcgttggtgccgttcttttccataaaagtcaacaaaatggaaaggaaggcgtcatcgcctatgcatcacggacattgaatgcggcggagcgaaactattcgcaaattgaaaaagaaggccgcggaattatttttggagtcgaaaagtttaaacaatttttgtatggccgaaaattcgtgttacagacggatcacgaaccgttgaaaaagatttttgggccaaaaagtgaaatacccgtggtggcggcgagaaggctgcaccggtggtcactcattttaatgaacttcgactttgacatcgaatattgtccaacaaaagaatttggaaatgccgatggtctatcgcgacttccatgtccggagatagcaaaaattgatttggacagtgcagaagtgagagccgtacaattggaaaacatcgactcgctgcctgtcaccgcaaaatcgattgccagtgaaacagcaaaagaccaaattttgaagaaggtcaaagaactcattgaaagaggatggccgaaaaaggtcgaaagtgatcagctgaagccattcgagccgaacaaaaacagtttggaattggtaaatggatgcatcatgttgggaaaccgaacagttattccgagaaaatttcacggaaaaatgttagaacttttgcatgccacccattctggaattgttcggatgaaagcgttggctcgacagaaaatttggtggccaggaattgacaaggacatcgaaatggaacgaaagaggtgcaaaaattgccaatctgatgcacccgaggagaggaaggttccattgcatccgtgggaaacgcctgacagagtttggcagcgacttcacatggatttttgtggtcctttcatgggacacatgtggctgatcatcgtcgacgccaaatcaaaatggcctgaagtgatcaaaatgaagaacatcacggccaatgcaacatag

SEQ ID NO: 79052 - DNA, 1130 bp, Heterodera glycines
  Genomic contig location: Contig_ID=SeqID_14892; Location=2314..3443; Strand=-
  SCN-specific regions: Sequence locations=1-33,55-71,139-343,392 -410,432-451,474-698,720-793,815-959,982-1104,1127-1130
atggacgaagcgattaatgagttggcatacaattacataaaagtatgttttgaattcagttgggttaaatcaaaaattatattttaaataaaaccaaaaaaatatttattaaaaaatgtaattgaatcgttttaataagagattagtgtattttagggccaggaacaggacaaggacctgttaggatttccaatattctggtcctacttcaagtttcctcgctctagtctatttgtaacttaaataattgaagaaatttttgtatctttttatgtttctgttcccgtgacgagtatttgtgctccaattggaagctttttgggctcacatttccacagacaggtaaaaaaacaataataaataaatatttagcctattattttttattaaacaattaagtataagtctaaatttaaatgtctatttcatttagacacttgctgctttggtctacatcatggagattattgcatacattggctttctttttacggctacccgacatttgaggacttgacatttgaggacccgacatttgaggacccgacttttgaggacccgacatttgaggatttgacatttgaggacccgacttttgcggatattcccgacatttgaggacccgatttttgaggacccgacatttgaggatatacacaatttcaaaaaaaaatgaatgaaaatcattataaaaaagagaaaaacctttcccaagggccaacgggtgcaatgtatcaaaaagcattaaggacaaccgaataatttaaatatttgacagcacaaataatgatttcaaatttaattttggagattaacagcctttttctttcttaatgatttacaagtcatcctaatattcaatttgctcagactaacagcaattgaacacgatataaattataccagctgggaagctcctgtcaatctttgatcattttggatcgcatttaacacaaaaagtttgtaaattaaaatgtatttaaagatatatgaacttttttgcctttccccacaaaaaaatgccattcattagtgatgtgaaaatctttcactccaaaagggtgaaagcgaaatcaaaccctgctggaaactggaagtctttataaattgaaaatttttgaaaaaataaa

SEQ ID NO: 79053 - DNA, 1154 bp, Heterodera glycines
  Genomic contig location: Contig_ID=SeqID_14893; Location=1975..3128; Strand=+
  SCN-specific regions: Sequence locations=1-160,194-418,459-765,787 -926,950-1043,1066-1154
atgggagagcaaaaattccattttttgaaaatgcttttcgcatttggcgcattgctaagtgccgaaattgagcaacaatcgtccatcagggaaagaagcttcccacgcatatttttgaaggcatacgaatgcgtagcggacaaaaaattcgtcggaaatgaaaaaaagtaaataattttaatatttttaattagagtgccacgggaccgggacctggtagcggacaactgagtacaactgagtaccaaggtcccggttttgaccgggactagtcccggttttttcccggttttcccagccaaaaattcccgggttttcaacccgaaaaggtcccggtcccgggtttgcccaaaattcccggtcccgtggcactctatttttaatctcccaaatgttgccttttcttaaataagtcgactaaaaaaataattttgaatattttttatgtatttatttaagttttctaccttttgcaattgtatcaaaaatggaggggcaaactgagcaattgaatattgagaaggttttgttggtaattcaaaatgaagaagatttgacggatcgtagtcttcaaatcggctgtaaatttttgaaatgtttgtaatgaaaacgatagaaaaccaaaaaataatgactaggaaattgcatataaacgatataccattggataaagcagggtcgacttctattgtgaatttttaattttagcggtgcattttgcctgcttcaaaagttacagggcctcaaaaatcgaaattttgtgcttgagggctcattttcaactttcgtgtatattttttgcagccctgtttattaatgtaagattcgaatctattgaccaaaaatattgtcaataagtaaaataatgaaaatttttcaattctactatacattaaaaaagttaaactaagttaattcaatatttgtaattaattaattaactaattaacagctcgattatatgggctatgaagactattgaaaaaatgacaaaagtttatgatacacaatttagaaaaaagaagactacacgaaatttaaatggggatttgttatataaatattttaatggcattttacctgaaaaattctggccctgattcaatatttggaattattgtagattccaatcaaggcattttgccttaatgcta

SEQ ID NO: 79054 - DNA, 1556 bp, Heterodera glycines
  Genomic contig location: Contig_ID=SeqID_2313; Location=432..1987; Strand=-
  SCN-specific regions: Sequence locations=1-164,236-432,455-489,511 -713,735-933,961-1326,1349-1357,1380-1556
atgcctgagtgtctgatgatccaatttccttgtacaaatcggctgactagcgacgccattgtgccgacgagtgccgctgatgccaatgccgatcatgggattgctgttggatgggaagggagggggggaggtcccttctgccctctcaaaaaatgcttctgatgtaaatttataaaataattattaatttaattaattaaattaagatatacagtatataatattttttaattttcagggcacttttgacgcaatttcacttaccgaaaatcgacaaaaattcatggaaaactattgtcttaatattggcaaaatgtttttcgttcaaaaaggtgtcagaaattttttgaatattttatcgctttattttagaagcatctcagctgctgcattatttccttatcatttcttgcaattttacgatgtgaattcatttttattaatatttaaatttgctaaggagttaaaaaaaattttttaatacgttttaaatagagaaacaaacaaatcatagcccaagtgtttttataggcctacaaaattcaaagaatttcgtaaagttcaaaaaagtaatgacagaagaactcaaaacaagggcttcgaacattattgatgataactttttcgaaccttaaagaaattttttgtgaataggcaaatataaaaaacttaggattatcaaatgatgtcaagaattaaaaatttggttgcttttatgaaaaattataggcaaatttttttgttttgctggtttttgagtaacatcgtaacaccactgtttctaagacattttgttttaaaagaatttctgttctattttttatccagatttgctcccctgcatttttaaatttttccagccatccccgatattttatctgggaatttcctcaacgacttttctctcccagagagcgggtgaccaaacgtagaataacaaaataacacaaattaaaaaatgttttgtcctgacccatacgaattcactggttcggtctctagtaaaattaatttcagtgatgagttaattgcacattttgtcaaaatgccatcagaagaagcatccggtgagggaacctttcaatttgtttctccgttgcctaacgcgccagaagcattcaaatttggcggtagcattggcaccacgacaaatggggcggtcttcagatggatccggaatgatcaatgatcgcttcaatttgcatcatttatcctatttgttattattccacagttgggcacatttcttaccataaattatctttatttgtgtttcgatgacgaaattttagtgggaaactatgaaaaattgaaattgtagtcaataattttttcacataattaaggaagtattgaatttatttttgtgttaaccttaatgtgaaagccttgttttggagacgctttcacagtttttggcaggcttaactgaagttgggccttaaaaatatttgcttggatttgtgaatttgggacaaattctatgctcgatttaaaactcttgcaaaaaataatgaatagcaagcagcttaatcaaaagataattgtaaaataaa

SEQ ID NO: 79055 - DNA, 1303 bp, Heterodera glycines
  Genomic contig location: Contig_ID=SeqID_2313; Location=2480..3782; Strand=+
  SCN-specific regions: Sequence locations=1-261,283-477,500-773,797 -961,991-1145,1173-1187,1209-1303
atggcaccactttttattttgctgttcgttttgctggcagttgaagaaagcgtcggcccattgtcaccaaattgcagtaatttgattgcttttaaactatttaaatataattaattgcttttcatcagtgcatttgccgcccatttattccgttggaagtgccaatgtttcgcaacaaaatgtttctgttccacaaagcccgaagctaaaaatatcagcagggcaccaattattagcaaatggccaatttggtaaaatccattaattattatttttatttcaccgattttgctttttttagcattgccaaaaaaatcggaaagccaacggaaagtttctgttatttctgcgcagcaaattgtttctgacgagcaaaacgtttcatcttctgaggtcgacaaagtgccgggggattttctcgaattttctctgcccattgaaaagcaccaaaattcgcttggccaatatttggcggaactttcaaattattatcattctgcgcaactccatgttccgccgagtacaattgcgagggttttgttacggatgcaaaatgaaatgaattttcatcgtctcaaaacttcggccacccaactaccgtaccccctaaccctggaaaactttcgttccgaaaaagaagcggattccaacggaatgggcggagacattcgcatcactttcattgatcagtgccaaatttgcagccaaaacgaattgacaatgagcaaattgatcacaatgagcccacagcaaatttcggtgccaaagatttcaattttatttttaaaaattatttcaaaggaaatgagactaaactccgaccaatcggacatcgcttggtttttgggaagtgtcattcatttgttggctttccaaacgtatccgcttgaggaatggcacattcgggacaaaatattggccaaccaatgccaattgggtggcactttcaaaatgccgcaggttttattttatgttttattttattattttgaatattcatttcagacttctgaatcgttttgcatgtttctgctccaaaacagcgtcaacaaaatgctattttctgctgaaaagctccaaattcgcactgattttcctcgtggtttcgagaaacagtacgccattcttggccaaataatgagggtattaatttattaattaattaattaattcaaaaactaaaattcttccggttttcatttatttttagaatgctctccacgtcgattccgaaaagagaacttttgacggaaatggacaattgctgaaattggctgccaacttaatctcccattaattaaca

SEQ ID NO: 79056 - DNA, 1801 bp, Heterodera glycines
  Genomic contig location: Contig_ID=SeqID_2313; Location=5676..7476; Strand=-
  SCN-specific regions: Sequence locations=1-151,173-187,211-558,597 -650,679-941,963-1007,1029-1141,1163-1171,1210-1243,1267-1315,1337 -1533,1557-1590,1612-1801
atggtaagaaatttctggacataataaaattatggcccaggaaattttatgccgctgtaaattgcctggacctgggggtcgtcagtggacaatccgtccgcattcaatcgtcattaaactgatttattcatcacttttataaaatttcacaaattattagtttgcttttttaaaatttaaattcattttcacattatttacaaaattttgtgttatgaaaataaatttttctgacggattgtccactgacagattgtccgggagtcgacctgggatccgctcaggtaaatcccgaatatttaaacccggaaatttcaatttcttgacttaccttggaaattttagcgctctcgtggcttcatttctcttgtcggtctcgactattcaacaaatgcaattgaattggccaagaagcaggcttcctcatgcaatgaccatcagtcaatgcccatcgaatttggggttggtctcaacaaaattcaaaatcaagtctttctatttttggcattttatatagggagcttggttggtcgattcctaaaaagtgcaaaaatgggcattcttaaaaaagtgcaaaaatcaatcatttgattttttatgtgatttataaacaattaactgctaaattaattaaaatttacatcactgagaaaaattttctaattaaatattaaatttgaggtaggattatttttaattcatatttagcaaatcaaaaaagaaaaattccaaaattaacgattaataaaatgacaactgataaagcgataatttagcttaagggcaaataaaaattaaaaaagaatacaagaaagttacgaaaaattataaaaacaactaattttgcgtatacttgaaaaaaggcacattatttaaaagccaagtcatttcgtatcagcaaaaaaaagaagtaatttgacttaaattcacagccctactggtaaaaaatgaaggattcctaatgatttccattctaatatattaatttaacttatatttgttagggttgatatataattaataaaaaatcatacaaaaagatcaaaagtttggttttagtttttttaggaaacgacatagcaccttgggaagtagcatagaccgaaaaaagaaaaaaatgaaatttaaactttaaaattcgaaactttccaaataaaagaaaataaagttgttaaaaatatttgaatattattttttgattttatttttcctccaaaggttgttgatttggcttctgatcagttggacaataaattttgccataaattcgacattctcatcgataaagtctcatttttatttgcataatttacagtatataatattttttaattttcagggcacttttgacgcaatttcacttaccgaaaatcgacaaaaattcatggaaaactattgtcttaatattggcaaaatgtttttcgttcaaaaaggtgtcagaaattttttgaatattttatcgctttattttagaagcatctcagctgctgcattatttccttatcatttcttgcaattttacgatgtgaattcattttttattaatatttaaatttgctaaggagttaaaaaaaaattttaatacgttttaaatagagaaacaaacaaatcatagcccaagtgtttttataggcctacaaaattcaaagaatttcgtaaagttcaaaaaagtaatgacagaagaactcaaaacaagggcttcgaacattattgatgataactttttcgaaccttaaagaaattttttgtgaataggcaaatataaaaaacttaggattatcaaatgatgtcaagaattaaa

SEQ ID NO: 79057 - DNA, 500 bp, Heterodera glycines
  Genomic contig location: Contig_ID=SeqID_14894; Location=581..1080; Strand=+
  SCN-specific regions: Sequence locations=1-430,452-459,481-500
atgataaatttcgccatttttttaatctatccatttatccgtctgaatttgtttgctcaagttttggcatgcacatcggaattgcgaccaagaaaatgccgttgcacagctgtgtgggatgccatgagggcagttatgcatacgatgacaatggcaaattcttgggcagcggtgcattgttggatggcacgagcggacggattggatgtaattaaggcgaattatgggcataattaaacactaattgttgttggtctaattaacgaatgttatatcgagttaactgaaactcgcacaatatcgtttttaaaatgtttttttttaccaaaaattttcttccataaaatctagttttttcccataaaaatcgactcaaaattcctcgaaaatttatctcttggccaaaattaaaattgcacaatagccacactggcttaaaatccagcaaaaacctggcacgaatttccaaaaccgagcaaatgctggattttccacgcaaa

SEQ ID NO: 79058 - DNA, 939 bp, Heterodera glycines
  Genomic contig location: Contig_ID=SeqID_14895; Location=958..1896; Strand=-
  SCN-specific regions: Sequence locations=1-212,244-337,359-411,445 -523,601-902,932-939
atggataaaagaaatgatgtagaaaatattaaaataattcattttagtgaaggcaaacgtattggaaagaatttctacatttggcagtgttcttgttgtggacaacattttccttatgttgcgtgccgcatttgtcatgaagtgaaggtaattgcaaccgtagtttgaaattttcaaaatgcttaactttattttttgtaaaatatgtgatgaaatattaaaataataataattaatatatttcaccacatttagacactgaaaatcccaacaatcggccagaattcgcaaacgagacggtaagacttaaaatggataataaaatgtacttagtatctaaataaataaatgaaaaaagagaaccatcaggaaaacccatagattagaatagatatcaatgaaagtgaacccaaaaataaaaaataaataaatatttttttatttccctgctttagaaagataattaaattttcaatgagattttttaaagtttcagaaaaacaaaacaatgaattaaaatgacaaaattaaataaattgttgttaaatataaataaattgttgttaaatattgtttcttactttaataattaaataaaaagcaacaaaaaaaagattgcctaaaatcgtttaatttattaattttttgcagaagaagctcagcgaggatgagtgcaaaattttggcaaaaaaaaaagacttgcccgtgcggtcgtatcaaatgcgtccaaatgccaaagaacaaggtagggatgatatttgagactggaattttgcagaaaaatttatggattcaccggattggattagcgacattcaaaccccagtttctagccttgaatgccgatattggtcgaatggtcctgatccagagtggcattttagagtcgggaacccacccatgatttgggttttttaagaaatttaaagttcaaataaa

SEQ ID NO: 79059 - DNA, 645 bp, Heterodera glycines
  Genomic contig location: Contig_ID=SeqID_14896; Location=58..702; Strand=-
  SCN-specific regions: Sequence locations=1-51,75-645
atgtctttatttaggaaccgaaatttaatttttttaatggcaccgcccgccgagaaaaagaaaaagcattcctccgcctaccaccgccaaatttcttcaccagcaattggtgaacatgaacaacaatcgatgggttcacttatcacatcacttggaaaacggcgaagtgttcgagtgacaaataaaatgaataaacgaattttgaagaaaatgtgagaatttcttgggttataaattagtgaattctcaatcgctctatattccgcattttagctggatttgtactgacgtttggatggacattcttccattttttggtcgtcctgaacttggcctcaaattggcacttctctcaccacgtttcaatgttttagtgaacaaacatttcgacggcaaaagcgaattggcaattttgagacgaatcgaaattcgcaagggcggtggactaaagccgaaactatccgtatttatcagctatgacaaatctatgcgatttccattgcccgaccgtccgctgcccaacaaaattcgctttaatcgtcttctgatttcgtaatttgattcaaagcattgttaacagataaaatcatcccattttaaggtactttgaattattccgtcctcaaattcctccgctcaaataaa

SEQ ID NO: 79060 - DNA, 1469 bp, Heterodera glycines
  Genomic contig location: Contig_ID=SeqID_14897; Location=547..2015; Strand=-
  SCN-specific regions: Sequence locations=1-137,159-315,337-771,793 -896,918-1004,1027-1205,1227-1469
atgggaaaaagaaaattattacctaaaatccacggcaaaaagggagtgaaagagcgtgagaagaagcgggaggagagaaaagcgcagacggccaaggcgatacaagcccgcctggccaaaaaaagtgagtttttcaccaattttaactcaaaaaagcattttttttaatttcagccgcttcacagtcgaatcccaatgccgaaatgccacagcaggacgaagcagggccgtcaacatctgctgcatccgccgaagaagcgatggaaccgcctccatcgactccaggaccagtgccaacgccagaaatggacgaggaaattttggaatttggcttttcactgccgtcgacatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctgcgcgagcaggtccgtaaccgagaagcgctgatcagtgatctgcgtcgccagctggacgaacacatggcaccaccgatggcaccaccaacgaccagcaaaagtgagtgaaattcctttttcattttcataaaattgatcttttttcaattttagcgcctccaaacagaggaagaccgaagaaaaggctggaagaactgcagcgcagcgccaggcgcgacatcgtcgacgcaattgtgggcgtcatcgatcgtgatcgctcgcgttccgcgagccgcgcatcgctggatcggatccatcgggatatccggcacaaattcgcgcactacacgccaaagaagggccaggagcggaaggagtggatggaagctgaggatgggctcctgctgcttgcccagcttgggacacagatggcttacaaacggatgaaggcgactctgaggctgatcaacaggcgctttgacaccttcccaccattgataaaggtacagtttttcagaattttttcatccgacctattttttttgggtgatcaaaatcaaacgaagaatttgctcagctttaaaatatgatgtcatttcaacgccaggcgggcctggatatgtttgctctgacattgccggggcactgcgtttcagattgtccacggcaaaggacaatctgatcagcctgatccctgcccgtggtctgccactgaaggtcagtggcgatcacgggcagggattcacaaaaattaccatttcattggcccatgcattgcgcccaaattccccttccaacaattttgttgcggctgtttttcccgcaaaagattcacgaacgaatttgaagaatttctgcagatcgttttgggaacaaattgagcacctcaatgaaattgacgggcgcaaagtgaaatggtgaaaataaattttgttttttgattttttgaaaattttccaggtttcttggcggtga

SEQ ID NO: 79061 - DNA, 877 bp, Heterodera glycines
  Genomic contig location: Contig_ID=SeqID_14898; Location=144..1020; Strand=-
  SCN-specific regions: Sequence locations=1-71,93-141,163-383,405-877
atggcttttccaagtgctaatcgtcgagagggtggtggaccctttccgcaacttcatggacctgtgctcggtggccaacatcagtgtgctggcaatgacaaatccgctggtgagtgagtgacaccgtccaacaattgacagagttggccaaaaatttcattagaattttgttccaaaaacagaagaattatgcgcctgatgatttcgccactttaatcactgtccttttcgttaagcgcggcttttacatccacggtcgttctgtgcatggctttgccgacactgacatgctccagatgaatgtctttcttcaacgagaaagggtgagaaagcggaggaggaagggaatggcactggaatgaaaatcccttggcatggcattggaatagaaatcccttttcttcttttgccaggacaatttgtgtgccatgcgcggcttggagatgggctccgaccttcaaacattcgtcgttaatgtgccgcgttcatttcgcgaacgaattgaccaaattatggcgaccgctgtcgcaaatggcaaaatttgtgagtcaattagaaatctgattaatattttgatggacattccaaagaattttcatgccatcaaaatgcccaatgttcagctgctgctgtccgacaaggcgccgatgcgatggacaaaacgactgtgcgcatgcagcaggtcgcaacggcttacagcgagctaaacgagtgcctgaaggactttgtgaatcgggtgtacccgcagtgcgactatgtggtcaccagcccacggctgatcgaggctttgctcggcttggaactcagcgacacaagcacagttggcactttccggaggtaaactgtgaaagttttcgacccgaaatctcggaataaa

SEQ ID NO: 79062 - DNA, 597 bp, Heterodera glycines
  Genomic contig location: Contig_ID=SeqID_14898; Location=752..1348; Strand=+
  SCN-specific regions: Sequence locations=1-107,129-177,199-597
atgcacagaacgaccgtggatgtaaaagccgcgcttaacgaaaaggacagtgattaaagtggcgaaatcatcaggcgcataattcttctgtttttggaacaaaattctaatgaaatttttggccaactctgtcaattgttggacggtgtcactcactcaccagcggatttgtcattgccagcacactgatgttggccaccgagcacaggtccatgaagttgcggaaagggtccaccaccctctcgacgattagcacttggaaaagccattggcccatcgcaatggcaacgtaaaaggaaaagtcaaccgcgaaacgactcatcctcgtctccacgatttcgggcggttggtcaactgcaagcggaaatttaacggcgccggaaaatgcgtcagtgtaaaatgcttcagtgaaaattttattgtcataaaacaagtttcttggttttcgagtttcaaaaatcagattttggggtcgaaaaccagaacattttgcgaaactgcttcaaaacagttgtttttacattctatttaatcaaaaacgtattaaatattatattttcagctcccattatggatttgaatagtattgaggagtaa

SEQ ID NO: 79063 - DNA, 442 bp, Heterodera glycines
  Genomic contig location: Contig_ID=SeqID_14899; Location=226..667; Strand=-
  SCN-specific regions: Sequence locations=1-442
atggctcttgttcgatttgaagaagcgaaatccaaccgtggcaaaattctcctttctcgtcttgggttcgaatatgcttatgagagcgactctcgaatcgagcaaggctgggaatactggaaatgcccaaaacgtcccccttactgtcctgggcgagattgtgttcaaatggcgtggcacgtcgatgcaaatggaagtcgttacaagatgggtcgcatgtcagccgaccacaaccatgccgcagtttttggccaactcaatgtaagccaaaaaagcaaaccatctatttttggtatagataagacaggcaaatgagcaaattcgccaagaggctcgaagtgattttccgacaaccagtcgaaacattgtccgaaatgttcgggctgaacttccggtcgatgtgcgtgtaaacgcaccaagcgccgtaaacatgcgaaataaa

SEQ ID NO: 79064 - DNA, 156 bp, Heterodera glycines
  Genomic contig location: Contig_ID=SeqID_14900; Location=78..233; Strand=+
  SCN-specific regions: Sequence locations=1-156
gctggtttggcaattctttctggcattgttggcatcggtggtacaattaagactggcgagaaggcttgggcttttggcgctgctttaatgttggccaatattccatacacttttctatgcatttttccagtcaacaaacgtttgctggctaccaac

SEQ ID NO: 79065 - DNA, 290 bp, Heterodera glycines
  Genomic contig location: Contig_ID=SeqID_14902; Location=543..832; Strand=-
  SCN-specific regions: Sequence locations=1-290
atggcactgagagaaggcgggtcttgttcttcagcagcggcaatgggtttcttagcgcttgggagggatcggctcgtgcaagactcgaagtgctttactggcacagtgaaatcagacggccgaattgtgaaaattgatgaattaaaaacaaaagtcgaagcggccattgctgctggtaaagcaatgatagtccttcccgctggaaacgtcagtgattttttggcactcgaacctgaaatcagagacggaataacgagacggagtgtcaatgaagtccgagatttgttgcg

SEQ ID NO: 79066 - DNA, 937 bp, Heterodera glycines
  Genomic contig location: Contig_ID=SeqID_14904; Location=389..1325; Strand=+
  SCN-specific regions: Sequence locations=1-83,113-178,246-554,681 -811,849-937
atgccattaaaaattgacaatgccaaaagaatgcagcaaattgttcctaaagtcaaatcatcagagaatgtgacaggatatttggaaaacaaaaatgaagaaaaacagcaaagaatttcattcaaaaattattttaatgaaatcaacgcttattttaactattatggtaaaaaagcggataattaaaaaaaataaaaattataattttcagggtaattaataaatttaatatttaaattaatttagtgcctaaacatataattggactaattgctcttaaactgatcaatgcaattcaatggcacttggaactgaacaatggtcaattgacacatgtgttgacacctgatcatttggtggctatccgtgttggtgatcaatttagcaagtcggaactgctcggaaatgttcaccttgaaatcgatgccgaaattcaacgcgtggaagacccacggcagagggcacttcccagcgctgatcaaaccaaaatcatttggctaaaagacttttcttatatgagtccacagcaaataaaggtgattcattctaatcacttttttaatattatagctttagaatttttatcatttattaatcaattaattagcaatttttaaaatttaaaatttgtctatttttatattgaaaagctattaatatagtttatcatattatatttagagataaatgtttaaaatgtttatttagcacaatattattacgtcgggagaaagtgatattatttggtcatttggaatcactttatatgaaatgatcagtggtgaaacgcccatatggcatacaaataagcaatatttttattgaataattttattaaaattaaaaatgcatcttaaacatttttcacaatttttgtagtgccatcaaaccaaaacaacaatggcattggattccgttgaatgacgaaaaaggcgaa

SEQ ID NO: 79067 - DNA, 690 bp, Heterodera glycines
  Genomic contig location: Contig_ID=SeqID_14907; Location=1060..1749; Strand=+
  SCN-specific regions: Sequence locations=1-191,216-339,361-365,387 -461,483-560,589-690
atgggattgcacgttcgccgatcaaaaatgtctcttccgaaaattgcggtaatttttagtatttcataataagttagcaaattactatttattaaattcggttgcaggaaatcgatcaaatgaaagaagcgtgcgatcgtctgttaatgcgccgagaagaatttcacgtaaatttgcttaaatcttaataatatcaaaataatcatattttaatagactgcataacatttaggtgagcgacatcggtcattgagacgaaatgcgcggtcgcccactaaaaggacgagctttaatggattttccggtatttgatttcctcttacaaaattaacactatttcatttattattcattttaaatctcaaaatttccatttttcagaggataaacgataccaaaaagtgaaacaattgggcgatcaccgagtcgtgtcccggatggcgattctcgtatgattaattttattattggtatattaataaaaatagagaaatatttacgtaacatccaattagtttttcatataccaaaatttctgaaaaatacaatccactgaaaacaaaaaaaacaattttatatttaattattgtcactttgaccattttatatttacagataaaagatcaaagggtcgccgacaaaatgatgtgtatccgtccagaggcgtgtttgaccattatcgtaataaag

SEQ ID NO: 79068 - DNA, 1036 bp, Heterodera glycines
  Genomic contig location: Contig_ID=SeqID_14908; Location=200..1235; Strand=+
  SCN-specific regions: Sequence locations=1-27,49-92,128-164,187 -345,369-401,436-681,703-726,748-1036
atggtaaggcataaaattaatacttagataaatttgatttaaggaaaattgataactcatctcccacccatagaagattattatcccgactcattaaaaaaaaatgaatttattaagtttaaaaaatggtatgacgaaaattataatacgtcttttttgttaggtaaaaaatttaaaaaaaattttcgtcattaaaatttttagaggaccaattagaaatatactgtggccaagacaccgaaattttaatgaatgcggttttaagtatgagaagaatttttttagaaatcacaaaagatgctgatacacctcaaggatatgacgttataaaggtattaaaaatggtttatttaaaaaaaaattttttaggaggcatcgactctagcgggcgtagcgatgcgaatatttagggcaaaatttttaaaagaaaaacatttagcaataataccggaaggaggttttgaaaaaacagacacacaaagttcaatcgcgattaaatattttgagtggtttatgtacaaaaatggggttaaaggccgacacgccggaaatggcggtgaaataaagattggaggtaaaaaagcatgaaaattcagaattaaatatgttttaggttttaaattagattttatatgtggaaaaaagaaagtcattatcgaatttcaggtccctagaaaaaagtttttttttattttttaaattcttacagggttgtgcatttcacggtttgtttttaattattaaaaaggtgattataaatttaggctgcccaaaatgttataagtcaaatcatttatgtcctaatgaaaattatgcagaacaaaattttttgaagactcagagtagaatgaataaactaaaacatgtggcaaaaaaatatggattaaatgttgaagaaatatgggtatgttaaatttttatcatataaatcctattattttaaaggaatgtgatttaaaatcaatgttaaatcgaaaaaatgacacaaattataatagcgaaatgaaaaacttttttgatgaattatacgacaaag

SEQ ID NO: 79069 - DNA, 522 bp, Heterodera glycines
  Genomic contig location: Contig_ID=SeqID_14909; Location=1062..1583; Strand=+
  SCN-specific regions: Sequence locations=1-19,41-94,133-446,468-522
atggatctttcatttaattccgagaaaactcctccaaagcgtgccaaacgttcaccaattcaacgattaaaagctggagaaacgatgatgtgcgtataaaaatataattaattaataaaataaaaataatatggttaagtgatataaaattggttttgattatggccgattctgtgcggattgttggagaaaaaagcaaagtttggacgattattggtagcgatggagatgattacatcaacggtggaacgtctaatcccgtcgttgctgccaaaactgattcgaaaaactcttttgaagtatgctgatctgcgtgctttctcttcggcagttgtggcggtggcggtggagggggcaagtggtacactggtgtcggggtctgcgtacaagcattggagcgaaaaccatggtcaacgttaaaaacacggcctttgtttcgaatcttacaattttaaaatttgtttcttgaattttaaaagcccaaaaaaatgatgatgatgcaggtcagaaggaaatgggtaa

SEQ ID NO: 79070 - DNA, 328 bp, Heterodera glycines
  Genomic contig location: Contig_ID=SeqID_14909; Location=1656..1983; Strand=+
  SCN-specific regions: Sequence locations=1-163,185-204,242-328
atggctcgccgcggacctcttctaccgatttacaagcggcgtaacgttcgccgacaaattcaaattaatcaggtataataaagttttaacgaaatttaatcatgtttatttttttaagattttcgttttgggcggacaccaaaacagctattgcctatggggttgcgccctcgcttctcctttcatggctcctttggtaacgaattgttttaatttttaaaatttgaaaatgaaactatttcagagttaaatctcgagagaatcgatggacgatgggcaaggagagagagcaattaaccgagaagaggcgtaagacaaataatttaaa

SEQ ID NO: 79071 - DNA, 728 bp, Heterodera glycines
  misc_feature (39)..(39): n is a, c, g, or t
  Genomic contig location: Contig_ID=SeqID_14909; Location=2212..2939; Strand=-
  SCN-specific regions: Sequence locations=1-115,158-166,188-307,329 -476,498-593,615-728
atgacggatctgctgcttcagatcaacaacaacaatacnaatgacaaaggcagcgtgagcgggctgatcgttgtcttcttcctcttcattctgatcactcaggtgaaactttttgtttattaatttttaaattttattaaaataaatttcattttttgtaaatcagttttgtattttctgtctcctcttcgtccgtggccaggcccgcactcgtcatcctcatcggcgtcagcgcacccaccaggaattgccgccggagggtgccggccgtcctctcaccgtgttctgcccggtgcctcgggtaatccccccacccctccctcacttcctccacttatttgttaataataaacaaattttcagagccccgctgtgccacatggggacgagtgcgcagcgcgccgctcgcgccgcgtcggattggagaaggtaaaaaacgggagaggagggaaggaagcaaattctccacttatttgttaataatattaaaaaattttcagagccccactttgccacatggggacgagtgcgcaatgcgccgctcgcaacgcgtcggattggaaaaggtaaaaaatgggagaggagtgaaggaaaaattatgcatttatctctcaaaataggtctcgacttcgggccagctggagaccatcgacgaggcggttgaagtggtgagagtgaataggaatgtttcattcatttcaaatttttacaaatttcagaccgaatga

SEQ ID NO: 79072 - DNA, 924 bp, Heterodera glycines
  Genomic contig location: Contig_ID=SeqID_14910; Location=1934..2857; Strand=-
  SCN-specific regions: Sequence locations=1-5,27-137,160-641,667 -712,734-924
atggtaattgattttcaagattcaaagtttgtgcaaattaaacgttgcattaattactagtaattttgggtttttaatttcaggattcggagtcggaagagaaacagtttttgaaacagataaaggaattcgtgactacgaaaaataagaaagattcatccaataatgccaaagccgaccaaatgagcgattgttcaaagaatgccgtcaaattggagctcaaagaatggaagcgcgggtttctgctgggtaaaccgagtgaaaatgcttaattagttgttaatgatgcaatttcttctgccagtccctccatcgtcagccaatgaaattggcacagattcaatcgaatgcctacggaaagagcgaaaaccgactgaaaatttgaccatttgtgaggtcaaagaacgaaatggcaaagtcggaaagggaaatgctttagtgggagaagtaatcgaaaggaaggcattggaaaatgtgaaagagcggctgagggggcagagggacacgaagaagccgaaagtggtggaggcaccgcgaatcaacccggagcaagtccgacagacattttgatgaaccaatccgggaatgaaacactcaattgcctaatgacatattcgaattgtcgttcttttttttgcgagataaattattaatttataattaaaagctgataaactacaagggggaattagcaatctcgggcatcttttcaccaccccactttatatcagtgtacaaccagcttttatgcagaaaagcttgacaaaataaggccacttaagaagtgaagcttatttcgaaaggcaaattgacataatttcagcggtcggaaatccaaatctattaatgtactaaaattgaaaattaagtacatctataaatggtatatttttagatgtatttttctctttattaaacaataaa

SEQ ID NO: 79073 - DNA, 1767 bp, Heterodera glycines
  Genomic contig location: Contig_ID=SeqID_14910; Location=1..1767; Strand=+
  SCN-specific regions: Sequence locations=1-495,517-1260,1284 -1419,1441-1767
  Gene Ontology: Mol. function=transporter activity; Cellular component= integral to membrane; Biological process=transport
ttttggtcggcgctttgttcggctcattgctccgtcggctttcgttccaatcgcagtcccaaagtgcgctcgccgccggagtgtccggcgaagctttacaaaacattcgaacggtcaaagtgttcgccatggaagaggcagaaacggagtcagtcgaacgaatgaatgcaaaatgcagatcaaaggaatattttgcgctttctttatcagactctatcgtaaagaggtgcaaacggcgtgttccctcggcgaacggctcggcgttggcatcggtctcttccaggctttgagcaatttcttcctcaatggtccgtctaatcaccgatatgtccgttgttaaatagttttttccattgttgaggaattgtattgggtgttttatatggcgggggacaactcgtggctgatcagcaactctccgcgggcgatttgatgtcctttatggccactgctcagataatccaacgttcggtgtcccaattttcgttaattttcggaaatggaataaaggtgatgccatttgtttggtctttctttgtttgtgactccttccttccatctctctgttaggcttggacttcttgcgcccgaattctccaattcttgcgcattgacccgaattgccataatcacttgaacggtaatgaacaaatcccaaggcattcgctgatcggtgacattcatctgcacaacatttgtttttcttacccaactcgtcctgaaaaggccgtgctcaacggaatcgatttgcatttcgccggtggacagacaacggccatttgtggcccgtcgggtgcaggtgggcgccgtctgatcgaatttaaacgcaattaaatactattcccacaaattaaattcacattaagggaaaagtacaattgccgcattggtcgagcgtttatatgagccacagaatggcaaagtctgaaaggatggtaattggtgttgccgaatttcgctgctttggtttaggttactttggacggtcgggacatccgctcgttggaccccctttggttacgccaaaaagcgatcggagtgatctctcaagagcccattctcttttcgacgtccattagagagaacattcgttacggaagaccaaacgcaaccgaagaagaagtgaaagggacggactactaaaggaaaaacaaatgcatttaaagattcgatctgccgccgaattggcaaatgccgccgaatttatcgaaaactttgccaatggttacgacactttggtgggcgagaggggcgcgactttgagtgggggacagaagcaaaggtgcttgaaataaatgcaaaaagaattgccccgaaacacgaaaaggatcgcaattgctcgtgctctgatcaaagaccctccgattttgattttggacgaggcaacctcagcattggacgccgaaagcgaaagcgccgttcgttgtgccctttgggtgcacttttcgcttctccattcgcttaaggttcaactcgcattgggccgcgtaatgcgcgaccgaacggtgattatcatcgcacaccgactgagcaccattcgaaacgccgaccaaatttacgtcctgaaaaatggacaaatggttgaggtcggtcaaacgccgccggagagaatttgcaaatcgtttggttggagtgagcaaaaagcattccaattttaagaaaggcacgcatgaccaattggtgaggaacagacgcggtgtttaccattccttagtcggcgaacaacggcaaaaatctccgggagaagatgaaccgacaaaggcagga

SEQ ID NO: 79074 - DNA, 1005 bp, Heterodera glycines
  Genomic contig location: Contig_ID=SeqID_2314; Location=536..1540; Strand=+
  SCN-specific regions: Sequence locations=1-96,140-669,691-855,893-1005
  Gene Ontology: Cellular component=nucleus; Biological process=protein- nucleus import
atgcagtcaatgtttctcggtggcgacggtgaattggtcgttaatccaaactttgcttcattgaacattgttggcacttgtactgacattggttggttttattgaattttttaaaataaaattaaataataatttatttgttttgttttttttcagagaaatctttcttccgtctcacagctgcgcctgatccgagtcagattaggccacaagatgtgctgaaggtggcgctggagaatgtcaaggagaagtacaaacaaaacaacggttatcgttatgtgagtgatttcatagtttgatgatcccgcatatgtttacaaaaaaaattcaagaaaacgaggcacaaaatgaaaaaacactgcattcctgtttttctgcccggcgcagaaaatttgcaaataacactgccccccccccaccccttcccgaaatttttcttgctacagcggcctgtagttagctgaaaattttttcttttattttcaggcttctgatcagctgaaaagcattcgtcaagatctgatgatacagaacatacgcaacaatttcactgtttcggtgtacgagacgaatgcacgggttgcgctcgaaaaccgagaccgcgagtgagtaaatttaattgcatctattttttagggaaaaaaaacggatgcggggctggaatcccgattttaaaaacttggggcctcgaaacgtcatccattccaacaaatcctcttttttcagagagttcaatcaatgccagaatcagctgaaacagttgtacaaacaggtgtcttccgggtgcccaaatcggtgggagttcaccagctaccgactactctattacatttacatgcgagaaacacttggttgatattttatatttattttgtttttaaattgaaattttgtctgttttaagatgttgcatatttgctggacgaacttgtgcccgaggcaattgccgacgaatgtatgggttttgcactgatggtaattaatatctggatttaacattgaaaa

SEQ ID NO: 79075 - DNA, 1205 bp, Heterodera glycines
  Genomic contig location: Contig_ID=SeqID_2316; Location=4185..5389; Strand=+
  SCN-specific regions: Sequence locations=1-785,807-1205
atgcggacgatcgtctacttcaaactgttgcaaattgtgctcagtttggccttcgtgtggcaacttctttcacttcaccaattctgcggcacatttgtctgtccgaaggtgtgctgctgctttttgttgtttttgccaattttcattttcaatttttttgtttaacgctgtttccatgcttttcaggccttcctccatgacatctctgttggccactgcaaacgctttacgctgatcggaaaggactcaaagacgggcgaattcggcgctgtgttggacgagcggaaatggcacaaccaactgttcatgagcagcaccaacggtctcccaatcaaagaacagcagcagcaattcatggacgaattggccgccaaattgccgtgccctggacgccactgtattccgattacgacggtgagcaaaatgccatcagaaatatcgaaataaaatgccattttgttttttcagccttcgttttttttctggactgagaagaacagaaatctcctcgacactgttgtggactccttttccggccaactgttgctcgcattgtgctcgcttctcaccattggcattggcttcgcccggatgttacgccctgcggcagaatatgaagtgagttcaatgcgtgaacacagacagcacatcagcccgacaaaaacgcgaacaaattgcttttcagttgaaatccggtggaattttgaccaaattgtgatcagttttgcttttgtcgggttacgagttgcaaaaatttgcttgttttccattgagtcggttactaattttgtttttcatttttaagtgcttcgactattgcatggccctctattctgtcttttgctggtgttgctctgcttgggcctcatcgtgtttgctgctctattggacaccttattggtcttgcatgaacttccgtgcggatgacacaaatgtgccgttggtcacttttgtgagttttgccgcccatttgattctgcattttccaattctggatttttcaggtgttcgacatcgtcatggtgtgttcgttcgtcttcgagatgttcttcaacaattcgctggtgaaaaaacggcccgagaatgcttcagtcgctgccgctaatcgcaaattgcgcaacgatgtcgccacggaatgtgccaatgtcgccattcatcgccagcagcagcagaagaacggaagtgccatcatcatgcaaacttaa

SEQ ID NO: 79076 - DNA, 873 bp, Heterodera glycines
  Genomic contig location: Contig_ID=SeqID_14911; Location=52..924; Strand=-
  SCN-specific regions: Sequence locations=1-405,454-523,545-873
atgcgatgtacacaaacaaaaaatgaccaagctgatgaagcaattcaaaaaaggagcaaagtgccaaaaggtaatttatggtgccacggaattttctaaattttaattttttcaattgtaatgtttttaaaacatatttttgtgaattttgaatttttacccactttgtcttaactgttataaaaatgacagaaaaattgaaaacgattccaaacacagcagtaattccaagcatagcatctccatgacattgaattatatattataattacagaacggaaaaaaggcagcaaaaaaaccctcaaatatgcatgaaaaaaaaccccaaaataattaactaaatagtgacaaaaaatggcaaaatagtggcaaaatagtggcgaaaaagttctaaatttaggggtgtaattttttaaatagctattttttaatttgaaaataatttaaaattaaggcaaacaattttattcactgattgcagttacaaaacattttcttaaatattgagcaagaaaaaaatttgggggaagaatttttgagaaaattttccaattcttagggggcgtatttttgaaaatttttaggtcgattcttaggggtgtattttttgaattttttaggtcgatttttggggtatattttccatttttattgcattttttgggaaattttccaaaaatgccaaaatagtggcaaaataagtgaagaagcgccaaaatagtggcaaaaaactattttagtggccaacttccgaaatagtttttttagtggcaaagctccaaaaatagtgattcatagtgatgaatagtggcgttaaaacgaagaatttccgagctaaaaatgtgtttttcgtgcatttctcgtctaaataaa

SEQ ID NO: 79077 - DNA, 2193 bp, Heterodera glycines
  Genomic contig location: Contig_ID=SeqID_14913; Location=271..2463; Strand=+
  SCN-specific regions: Sequence locations=1-761,783-1193,1215 -1700,1723-1965,1988-2070,2092-2193
atggacagtggtcataataatcagcgacattacaacttccgccaccgtgtgacagtgaattatatggagcaggagtcaggttcatcacaatggtctcaaaatatgggaaatataagaaattatggacaataattaaatgaaaacactcatctgattgtgcaaccaaacaatgcgcacggaaatttttcccagcccctcgaaaatcagcctttctcggcccccgcacaaaatcagtcaattcctcaaaactcgaaccatggacagcagctcgcaatccctctgaaccctgtcataaattttttcgatggaaacgagcaaaacattggaaacccccgtttggagtcaactgcagtttcacctcatatttcatatcaagaaaggggcaactattttgtgaactttcccgagggtatgcaaaatcgggatcttgttaagaaccgattcaataataaccgccaaaatcccgctcaaaattttcaaaatcctcccgtgtttgtgaattcgcagctgaaccggaacaatgaacggccaaatcggtttcaaaatccaaacgagtttccggttcgggactcaaatcgccgatccatccacaattcgccaattaccaaaacgagcaatactcggctcgagatgctcggatgtatcggcaagagacaaattcgaattttgtgaccccattaaacctgcaattctccgaaaatgaaaaccgacacaattatacccaatttcaaaatccaagaaatttccaacaaaatcccgaaatggtttatgcacagataaatccccccgtttaccaaactcaagcatttccagcccaaaccattcccatcccggacattattatggaattacacaaagtcacactttccaaccaatacgcaaacacaatgagagaaatccctacccttaatggaacggaagggagtgacaaagtccaggatttttttttaactgttgaaatgtgtgttggagagtggcgccacgaaaagaagttggaaatgttgaaaactaagctgaaaggaaaagctctgagggcacttaacatggcactgagtaaatttggaaataccgcgccattcgagacgataaaaacggaaataatgtcgacattgagggagacggattacaaggaagcaagtgcttttcaggaacttacacagacggggaaacgaaaggagggcgaaagtgttatgaaatttggtgaaagaattcaaaggctggtaaattgtgcccatgttggtttaagtgaggcacaaagagacgaaatttccaaaaaaattttcgttcttaatatcaatgacacgaacatggcaaaatttttggagtgtcagtcaaaaccgtcccaaacatacgacgaacttttaatggtcgctaatcgtcttagtttggttgaagagaagactgaggaacgttcggttcaaatccgaaattcacaaaatccattccacttgccaaacgcgaaccaaatctcataccaaaacgaacaaagtcgttattttggtcaaagaaatttccaaaattcttaccagcctcagccaaaatattttggaagaaccgggcggccaccgagtcattcttacggaaacaattttggaggacgaaattttccagtgaatcagaattttaaccggtaccctaacaatcagcaaaacagaaattttggtagcgaaagggcacagagtaacaaaccgagacaagaagtaaattttcaaggccaagggtctcaaaattccataatacctgcaagtaatgcaaatgccgtcccgttaaacgcccaaaaacaaaattttcgtcccggatatggttcgaacgcaattattgttacagaaaatactgaggacaattcgccagtgatttctgtcggtcattttggacaaaaagagccaaccgattatgaaaaattctttaacgctctttccactcattcttccgaatttccgccaaaaaacccggctcttgttaaaacgtcaaaatgtttggatatcacactgagtgttgtggacaaaaaggccaaaggcttaatggatttgggtgctgagactgatatagtaaaccctgaatttttgtaccgaatttcagtggaaaaaggaattaatctcgcagattggggtttctgtcccaattctggccttaccaaattacctttttccgtcgcatcatttactggtggaaaaattgcatttattggagtga

SEQ ID NO: 79078 - DNA, 2221 bp, Heterodera glycines
  misc_feature (1654)..(1654): n is a, c, g, or t
  misc_feature (1750)..(1750): n is a, c, g, or t
  Genomic contig location: Contig_ID=SeqID_14914; Location=1432..3652; Strand=+
  SCN-specific regions: Sequence locations=1-186,208-352,376-446,479 -700,743-803,826-850,872-1315,1342-1787,1870-1979,2003-2184,2207-2221
atgtgcaattatcaatggtccaaggccaagggcgagatgcttggaccacttgagaatgcaccttttattggccctgcttttgattttgtagtcagcgttggactaccacaaatcccacacagtgataatccggatgataaagacaaagttgccgggtcaatgtgcaaaatagactatggctgtgattggggaaaatgccatccaagcgctggcaaaacggcaagcacttgctgtgcagatggctttgtgttcatctgctgcaaggatgtaagtggagataaataaggacacgagtggataaaagcacctcaaaaattcttcataatttttgtctttagactgtaagcaatcaaaatattattttcaaaattatttcatgtaaattcataaattaggacgacgacatcacagagaattgtcaaagaatattttcatggattttgaaagtaataaaaattttaatgtgttcattcaaaaatttagcctccggaggtatgtgcaaaaaatggagttggtttggtgggtgaaacttaatataacaatgccaatgttgtcagccggaaccggcacaacttacacaaatggaggagtgcaaaaaagcagccaaagctaagtgtagctgtggatggttcgcttgtgtgcgcaaacgagggaatggtgcaaccccatgctgtgcagaaaacacggaattcacgtgttgtaaaaatgtaaaataaaaaataattaataataataataatatgagagattttcaacataaaagggaaattataaaatccataaattcagaattcttttttgaattttgttaattgtaattttttagatcactattgaatcattggtttggattattttatttaaaatttttctgcgatttttgcaaatatagccgcaaatcgtgcacgacaacgagtgcaatatggcaaacaaaagttgcaaaccatgcggttggggcgagtgcgtcccggcgcaaggccgttcgccaagcccatgttgcgcccagcactacgcttttaaatgttgcgaaaaagtaaagtggatcttgaatctgtacttttcttgtgcccgggccctcataaaatgttatggccctttctccagcaatcaattagatttttcaagagtaattttgcggtgctataaagaaatgccattggagattaaaaggctgagattttgtctatgatttttatcatattcgaaaaagatttcttttaaatctaagagccataggaaatggttaagcaaaattacctaagcagtgtttggccaaaatgttaatcagctgtcaatttgaaatttagtctttcaatttctcatctacttatatatttgtcaattgtgcaaagaaagtttcgtaaaaattatttttttagcctccaccggtacgtcgacagtatgacacatttggcatatatgtactgtaatcacatttaataaaggtgaaaccagcgcaactcatccaaatcgatgactgcgaaaaagccgcgaaaagttgcgactgtggctggtacagctgcatcccgcacccgggccaaccgtcaacgccatgttgtgctgagcactacaatttcacgtgctgcgtgaaggtaaggcgacagtctttggcatttgtatagtgtttcagctgaacaatggtcactcagaaagnacacttaaaattggaattggacaagggcatttgattatagactcagacagttggccacattaatcgctacaatttttcaacacaaaaaatgaatgnaaggagtttagattaattaatccatcagcatttgtggattaattaaacaatattttaaatatccatttaaaatttatttttccattttaaattattaacatttttaaatttatttaattgaatttgtactacggtaacatagataagatgaggaagaccacgtacctatgagagtagtaatttgctataagctttaggttgtgaacctgacgagttttggtgttatttgtttttaaattttaattatttttaggctccaccggtatgtcgacagtttcacagtgtgccaattactgtaatcgcacttttgtcggtttattgaagatcaaacccccacaaattattcaaatggatgagtgcgaaaaggcagcgaaaaattgtagctgtggttggtacaattgcatcccgaaaccaggccaatcgtcaactccatgctgtgctgagcattatcagtttagctgctgtaccgat

SEQ ID NO: 79079 - DNA, 592 bp, Heterodera glycines
  Genomic contig location: Contig_ID=SeqID_14915; Location=754..1345; Strand=-
  SCN-specific regions: Sequence locations=1-405,427-571
atggcaaaattggcgctttatttgcccaagttcaaggatttgggctggcaatggctacgcttccgaatggaaggtctgtcatcacttttggtcgactgtctgtggaggccgtgcccggtcatttttagagctttctatgtttaaattcgaatagcaattccattgaaaacgccaattaatcgaaaatcgtttactgtctgtccgggcataattaattataaggggaacggatgaagcagacatttgggatcatttgtcaattttcagccacgcctcaacttgatgaaagaggacaacgagcgacagaagaagagaaggcattttgcacacacacattagcctccttccgtgatctcctcctcaacaatgttaatgataaaagcggagcgaaggatagaaaatgaatttaaaattatttacatttttatgaaaagatcattctgctgaaggagtgatctgctgatcatcttggtgtaattgtcttatttgataagccaacacttaggacccagtagttattagttagagtttcttaccctatattgaacataataagatttggaatgggaaaggtgaaaaataatttattaaa

SEQ ID NO: 79080 - DNA, 559 bp, Heterodera glycines
  Genomic contig location: Contig_ID=SeqID_14916; Location=190..748; Strand=+
  SCN-specific regions: Sequence locations=1-348,451-559
atggcaataaaattggaaggattccaaggggtaaagcacacgaagggctatggtgagtggggtgggcatatccaaaaagccgaacagcttgtaaatccttgattgagcattttgtgaatcggccaaattctaatgctgctgctcatccccaattgttaaatgcacttttccattttgccataaatggaaacaaaaaaatggacaaaaaatgtgaattgatccttttagtaaatcattgacatttcaatgcttgtaaatataataattttttctaatgcgatagataatatttatatttacatattttagtcgtagagctctgattttatggcgaaaaaacggagtctctaaaaaagttttttgaaaattaattgttatattaaaaagaagattttttaattttttaaaacttattaataagttttctcaatttttaattttaaaaattatcttatgtgtggaataatactaagttcaaatgaattaaaaaacacattaagacgccataaaaacacgagaaaacgagacgagatgagacagaatttctaggattttttca

SEQ ID NO: 79081 - DNA, 906 bp, Heterodera glycines
  Genomic contig location: Contig_ID=SeqID_14918; Location=231..1136; Strand=+
  SCN-specific regions: Sequence locations=1-906
atgctaaacaacacggtgattgaggtcatcaaccgagtgtgcaaagagatggcaatctatcagcacaaagacctcctcttcgggggtaaaacggtcatattcagtggcgactttaaacagtcgctgccggttgtgcctcatgagggtttaactgcgcaagttacttcttgcttccaaacgtccccgttgtttggtcagttcacaaatatgatattgacaatcaaccagagattgggacaaggacaacaagattatttggaaatgtgccgccaaatcggcctcggaaaaaccggagaattcttctggattcctccgcaattcctcgtcaagagcagggaagagctaatagactttgtctatccaaacttccaacaacttctcggtaatgacaaggagctgctcaaccgattgatcctcgcgccgcacatcgacacgtgcgacgagataaacgctattatgatggcgaatgtgccaggtcaagaacgcgaatatttgtctacggacaaacctcttgacgagcgccctctggatatcgatgaaatcgagtctgaagtggctgcgctgaacagacgcaccgactcgggaatgcccccgcacagtctccaacttaaagttggaagcgtagttgttctccttatcaacaaaagtgatagggaaggactgataaatggcactcgcatcgttattgaagagcttggtgacgatcgcttggtcggtcgcgtgatcaacagcaacgctgttggaagccaagtaaggttattccttgaacgaacccgtaatgtttacgaggacaaaacgccaggcggcgtgaaatacgagcgtttgcagtttccaataaagcctgcattcgccatgaccattctaaaaggtcaagcaaacaatcagcacggttggaatagatcttga

SEQ ID NO: 79082 - DNA, 1136 bp, Heterodera glycines
  Genomic contig location: Contig_ID=SeqID_14919; Location=1140..2275; Strand=-
  SCN-specific regions: Sequence locations=1-158,180-366,388-397,433 -678,708-827,878-950,972-1024,1049-1136
atggccaacaatttggtgatcctgatcatgatgttcaaccatcacattaacactgatctgagcgcggaggacaaatcggctgcggtcaaacatcacgccacctacacggaactgctcaaaaggtgggagagagatcgataactgtgtgcataatgtgtgagcagagagaaaaacaaaaatgccggatgaacgagagagtgtgtagggaagacgttagacacaaagagagggtgttagagtggatgtcttagaattttttgtaataatacttatacaggtatttggagtccatctacgggccggaggaggcacgccaaatctacgaaactgtcccaaaagcatttgttatgctgaacattgtgagtttgagaggggggaaaaacagggtggcacaattttaagttttctaaaatatttttttaaaagaaatctctcaaaaaaaaccgaactatgaaatagaatgaaattttctcaaatcaaactgcatttagaaatatgacgtggaaaattgctgattttcaagcattttcttgaaaattagaacaacccaagcttcagagacttttataaaattcaattacaaagccgaaattttcgcgacaaatttttcgcttcaaaaacattataaaaattcaaaaattttgtccataaatttttagaaaaatcaaattttcgatctttaaaataaaattttttttcaaaattatctcttctacaggtcaccgagaaggcgaaggagctgttccgcgcccgggtgcccaccgaggacgagaaaatgcttaagcacattaagctggccgccgaaatatttccgaccgcggcggacgagaagaaggaaaaggaggaaaagcagcagcagaatcaacaacaaatgaagttggaggagggcaaagacggcggcgacgcagatcaaagggaagtggcggcggaggacggcgccattggcacagtaaaagggccaagaagcagcgaaaaagatcaaaaagccatgccgccggcgacggcaacagtggtctcgctcaagcaggagcagcatgaggatgaggaaatggatcaacaacaaacgctgtaacttcaactgcagagcagcgcggcggaggcgacggcccctgtggggccgacacggggaaattaaa

SEQ ID NO: 79083 - DNA, 887 bp, Heterodera glycines
  Genomic contig location: Contig_ID=SeqID_14919; Location=2809..3695; Strand=-
  SCN-specific regions: Sequence locations=1-597,619-887
atgctgcgccgtatggtcaaggtggtcaagaagttgcccgccttcaatgaactaagccagagcggccgttttgcactaatgaaagacgctatcattgacatgctcaccgtcagagggtgagtgacgcgggtcattattattttagtttggcgcccatttttgggcgccgatccgtctggacgcgccaaggattttggtcgccgagttcttttgcgcgcctaccaattttgggcgccaatacttttgtccttagggcttggacgccgtcccgtttgggacgccaattacttggcgcgccttaactcattttcgcgccaaccagtttgggcgccgtaaaatttggggcgccacagttaggttggcaccgatcagtttggacgctgtcaaatttggggcgccaaccgtttcggcgcacccaaacttatttggacgccattttattttggagcgttctaaatcatttgggcgccaattagtttgggcgccatccaattggagcgccaatcagtttggtcgccgttccgttcggggcgccaaccatttgggcgccaatcaattttggcgcgccctataattcgtttgggtgtcattagtttcttacacataaagcttttaaaattttattagatttttgcccatttttcagcgccgtgagcgttgacgtggaaaacgaatgttggaaacgaccgttgatcagcaactgcgaaattcggctcaacttcaacattcttgaccagatgctgaacggcagcatgcaaacccggcgcgtgaccggcttctacaaacagttgcatcaaacactgatgaaggaccaggtcagtcagcaatcgatgatcttgatcagcagtaatcagactatttagagcacactattttggcaaaataaa

SEQ ID NO: 79084 - DNA, 227 bp, Heterodera glycines
  Genomic contig location: Contig_ID=SeqID_14920; Location=25..251; Strand=+
  SCN-specific regions: Sequence locations=1-227
atgcgagcgaatggagaatgcggcgtttatgttgtggaatatgcaagagcaattttggatgtaaatatttttaaatgtgaaaaaaattttatggttctcattttaaggcactatctcggaattggaacgctgaatttgattttagtcatataaactctgataacattagctcaataagacggcattggatgaaaatcattcgggaacgaactgcacttgagaaatga

SEQ ID NO: 79085 - DNA, 797 bp, Heterodera glycines
  Genomic contig location: Contig_ID=SeqID_14921; Location=1..797; Strand=+
  SCN-specific regions: Sequence locations=1-797
  Gene Ontology: Mol. function=plus-end-directed kinesin ATPase activity; Cellular component=plus-end kinesin complex; Biological process=organelle organization and biogenesis
actttgcgctttcgaatgatacccaaaagataggatttgttcgaacatgaacaaagttattgtgtaaaaacccgggattgtcaatcgattggactcataaaagtcaaattggactcataaaagtcgattggactcatataagtcgaatggactcataaagtgcattagagccaaaatatttcccagcctaatgggtttgaaccataaccacaaaaacacaaatttaaccaacgggaccacttttcgctttaacattggaaactgactggcaatggggagggggcagagaagtggcgatagagtgtaggaaaaaaggagaacagattgttagaggaccgacgacagagatcgtttgcctccctccgttaatgggtcggtccaatgccaaattattttaaaaccgatttttttttccataattccgtcttccccgccttagggcacaccggacggatgaacgagcagagcagtcgttcccatgccattttcacggtgaccgtcgaatgtgcggagacagtaaaagccgctgacggacgccaactgctcacttagggaaaattgcacttggcggttggtgattggaatttacaattattgctgtaacttttatggaaattccaaaaatttcagcgacattttcaaattggtttcattcccttagggtagtgaacgccaatccaaaataaatgccactggcgaccgactaaaggaggcgtcgaagatcaatttgtccctctcgacgcttggcaatgtgatcagtgcgttggcggacgcgaaagtccgcacattccgtaccg

SEQ ID NO: 79086 - DNA, 1458 bp, Heterodera glycines
  Genomic contig location: Contig_ID=SeqID_14922; Location=1220..2677; Strand=+
  SCN-specific regions: Sequence locations=1-120,142-236,312-550,603 -1257,1279-1350,1372-1458
atgcgagcagaagccgaacggaagcacacgattggtgcagcagaagcagtgaagggaggaaaagtgatcagtgatgggagagacgaagcaaagcattgattggcagaggaaaagccatcacagcaaatcaaagactgttccacacactttttaataccctgttaattactcactaattaatgtccattttgaccctggaaaaattagtaaatgcattggttgcttcagtaacttggttaattatttttttagcaatttaattaactataaaatttttggattaatttaatactaataattacttaataattgggttgcgtgataaacttgatatcagataatttattctccgttctcaggagtgagacatgacaatctgaatttaataattaattccgttttgtctcaatttgattcaaactacaaattcactaattagctgaaccgattagaggatcaactttttgggaagagaaacggacggagaaagggaggcgaaaatcgaaattatttattgacagtccgtcgatggattcgttgggtgggcggcttcttcttttttttctttgtttttctatttgggcttttcttttttttcgtttgcccttttggccttccaatcggctcttcttttgatcagtgtgaccaaatcaaaagcaaataaatggaaggaaacagtggaaccgaatcggcgccagggctaatttattgcgcgacacatttgggatgacgcgacttagggtggtggtggatcgcccattaactaataattggcgaggcctataaataaaaggacaattccattccgccgtgttcattatccattaaaaacattcaattaattcttttttgccatttctttagtacatattaattcgattcgttcctaacttattttaaattccgtttgattccgtttttaattcccttccctccggcagttctttctgttgcaatttgtccaaaatgagccctcttccgctgctgctgcttctcatttccccgcttttcttctgtccttccgttttttctgatgacattctccgctttgaccccgcggcaccgccggccaaaatgccctcaaaatcgtcactaattaacttgtctaaaaaggaccaagttacacttgacgaaatactcattagtctcagacaaaaatcgccaattgagcaaacgcacgacatgaaagcattcgcacaactgtcgaaggcggacttatgaaagtgagcggtgatgggaaaaaggctaaacgaaacgcaaggcaattaatttcagttgaaaatcgacgccattttggaggagtatgccaaggcggtggagaagttcaagttggaaatggcacccaaattggaggccatgagtttgaaggaggcgcggtcgtgcggtgatcatgtggtgctgatcatcaccgacccgaaactgagcccagcggagaaagtggcgagagtgaacgacgcg

SEQ ID NO: 79087 - DNA, 1828 bp, Heterodera glycines
  Genomic contig location: Contig_ID=SeqID_14923; Location=335..2162; Strand=+
  SCN-specific regions: Sequence locations=1-60,83-1068,1093-1372,1409 -1413,1435-1714,1736-1773,1807-1828
atgaccgacgagcacttccgcgggtcccggcagtactaccagcgcgagtacgccaactgcatgaccatctgcagagaagttggaaagccggaccttttgatcactctgacgatggatcccgaatgtgatgaactggaagagatgctgccaactgacccagatggccaccgccagcagtggtacgaccgtccggatgtgatttgtcgtctctttgtcgacaaattcaaagagctgcgtcatgaccttaccgtcaaggaggtcatggggcccgtccgtggctggttctactcattggagcatcagaaacggtaaactgagtcctttggttttgaatatttatgagtcatttttagtggcctcccgcatgtccatttcgcactgattttggactgggacagaatccgaagtggcggcaccatcaacacgccagaagactatatcgagcagtacatctctgcagaaatcccggacaacccctcgggccgctcatccgaagtgttgctcaagcgagagctttacaaaacactgaggatgaagcacatccacacgtgctcagctcgaagatgtttggttgacggaaagtgcctcaaacgttttccggttagtcaatattttacttcacttttatggttgtcaagcatatcaatttagaagccattctcgtacgacaatgtctacaacgaacacgcttacccgcggttacaagaaccttgtccaaaattgtgcaaggactggcgaggttcgctgtcgcaaagaagactgcaagccatcgaatgcgctgccggatggacttcttcattctgaacgcatcatcgatggtcttcatccagaggtcttcgtcagtgaggagaccacgtgctcccgcagcttcaacaaaggtagggaacacgttgccgttgacggtgcgcaatgactcccatccctttgggtcaagcacaaccaacagaagcagtcgaattgcctgtaatagaaaaaatgatcaaattggtaatgtgcttggcgttctaccccccccccccgaaaactgggctttttggaaaaaaaatatttttttgaaacctccccggcataattttttttttatttaaataacgcgtaagggaacataaaataatgccaccaattccatttaaaaaaaacccgaaaattcccccctaagaattggctttttgagttggccccccccccccccccgaaacgaaggtcctggctacgcccttgtttcacaagccatttttgatgttaagctttttttgccttaatgcgaggaaaaagtgaattgaaaatgcacgaagaagtcgccgatcaatggaggaaagaactttcgaacatcggatttgacgaatctaagcagaaaattactgcggaggacttccaactgtaacccttaaagattttgatttcaaactctatttttcaaaagcccactgatcaaaaattggtgggggagtggatagtaaccgtcaaatgttctattaatagcggttttagcaatgcttatataggaaaggttcaaaatgcctttgtcttgtgaaactcttattcatatggtctgtttttaggttcgtctgttctgctctgaaccctgtttgctcaattgtcggaagtgtcgttgcgcaagaggcaatcaaggtaaagaggataattcgttttgtctcatcaattccgtcattttcagtctttgtcgcagaacgacgaaccgttgaaaaatgcgttcttttattcagcacttgaaagttgcggaacagttgttgacatggccgtgtgatgtccgtgaaaattttgtttaaaaaattgtttttgtttgctttactaccaccagcaagga

SEQ ID NO: 79088 - DNA, 1406 bp, Heterodera glycines
  Genomic contig location: Contig_ID=SeqID_2318; Location=92..1497; Strand=+
  SCN-specific regions: Sequence locations=1-44,66-172,194-872,894 -1075,1097-1124,1149-1365,1387-1406
atgtgttgggtcattgacattgcactgagtctccaggttggcccaactttttggctttattttcaattattgtttgcctttgtcaaaggacgagtcaatgcccatccacgaattgtacacgcaaatcagaaatcgcataaccgtggcttcgggaatggaggatttggaccggaatggacaggagtttgagccactttttcgtaaaatgtgtgcctcccgcactgaccaggcccgtttcccccatggtcaaatcacgaaaaccataatattcgttagttgttcagctcctggtcgcgcatgtgaaggcgtttgcgccttgcacctccaatttggacccgtacttgcgcaaaacgattcgcgagcagcgcggcggtgaaccgatcattgacctttccgtgtcgcaggaggacgacgacgtagcacagcagcaggatccatttggaccactgaaagagaccatcggcccagaggcggaatttgtgtttcaggacccgatggtgtgggcatcggtgcggaaagctttggccaaaatgtccgtcgctgaaattgtggcactcatacgacacttgggcattgttaaggtcggcacattagcaacgtttcgcttaattattcattcgaaaattccttttaatgcaaattgtttaacaaattaaggagagggaggcgcagctcgtcaatgctttttatgagaacaatttgaatgggctcgtccttcacatttgcgatctcaacgaactgaagcaaatattgaaagtgattgatttctaaatatgccaatttgttttgttcattcgttgtccattttgaggtgccattgggcgattggactctcgtcaaattgttgattgaatctctccgcaaatggaaacccttctccacacagtccctttgctctccgcccgacaccaacagcaactcggtcgccgaccccgtcgttgttgtccaacctcaacaacaaaaacaccttgtacaacaccatgacaatggtgaatttggtcaacagaatgaacaacgcatggcactgttgcggcgcattgaagaggagggaaatgggcagacgatgatgaacaatggcgagacggaggaggagaagcggagaaagtcgacaaaaagtggcgaaaaggaagagaaagagcgaagagaaacggaggaggagatgaacagcgtggcatctgtggcgggctcttctgagcagcgatcgcttctgaggtcgtccacatccccaccgaaggactaatcacagacgaatggaaaacgaaacgaaatgatcatcaatcacaccactttttcattctttctagtcatacaacatatcagggattgtcgcaatctatgcttcatttaaattaaatctcaagcgcatttttgcatttcattaaaaaattggtaaatttgtgtaaaaa

SEQ ID NO: 79089 - DNA, 693 bp, Heterodera glycines
  Genomic contig location: Contig_ID=SeqID_2318; Location=7616..8308; Strand=+
  SCN-specific regions: Sequence locations=1-150,172-361,395-613,635-693
atgggcaacaaagaaagtcagtttggcacaagatacgcagttgatggccgagacagccaaactctcgacccgagtctgatcagatcattcacagagattcgggacagtgacactgactttgcattggacaaattccaagtatttttttcttatgtgtatgtatatattaaagtatattcaagcaaaattcagattgtcaggatactttccaatcttcgccaatatcgccttctgtcgggtctctacgaaaaagcaattcgtctaaatggaaatgacaagttcgcttggcttcagttttcgctttcactttccgccgatcgacacttccttcgcgtctcaaagattttgcaacaatttatttctatggaagaggaagaagaaacgaatcaaaaaggaggtgctgacgaagacgcaatcgttgcttacatgcatttggcacgcattcaactcgaacattttggcgactgtaatttgggtacgtttgttgagttaagcattaagcagcattggagaaaatgtgtttatggcggttcaccaaaaaaataaattgttttcgctatatggaaagtggccgattttggattttatcaaaaagtaaaaacaaaagggggggtactagttgggtttgtatcctagttttggatcaaattttttcaaaatttttttttttatcgcaattgctttaaataacaa

SEQ ID NO: 79090 - DNA, 1768 bp, Heterodera glycines
  Genomic contig location: Contig_ID=SeqID_14924; Location=28..1795; Strand=-
  SCN-specific regions: Sequence locations=1-154,177-219,241-782,846 -1135,1157-1445,1467-1555,1578-1768
atgccgtccaaatttgaacaaatcgctcaaacaattcttcgaaaacttttgcgccagttcatggaagaacaaaactggtttttggcggagatttcaatttgtcaagaaatgccaaacattgttcgaattgtggatttgcttgtcccattgtcaattcctccaactcctccaattccggacaatttggtccgcgtgaaaagcgtggatgttgagtaagtgataaaataccttaaaatttatccgactttctttcttgcctaatttagcagcctcagtgacaacgtgttgacacttcttcaacactttcgcctcctcttttccacgtcgcccatcaatctgtacattgaagcaataaaaaagaaagtgcttcgcgattttgcccaaaaaatttggccatcaatccgtgaccatatttatgccctcattttgccggatggattgaagcgaatttgtcattttttgcctacttttctcgtcaatcgctgtccatcaaattatgtcgtgtcgattggcgccgcttttcctgatttttcggccgacggttccacaagtgcgtcggcggatggcatcgttctggcccaatggcttttatcaagcgatagagagtgcccgaaggtgctcaaatacgacgccaaacaagttgaagtggcaaaaatatacacgaaaattatgcgattggtcgaggtgtggtgattatggtggtgcaactgtaggggagaaatttggacaccaaatttcctaaacaattcgtaatttctgcaaaaactattattcggatttggtttttaatttttaatcaaaaatttggattttaattcttttttaaattttttttttaatttttaggcatttttggaatcagatgtttgctcaaacttcataatctccatttatcatttcgcgtccaatgaagaagtgtctccatatcgtttcgacaaccatgcgaccggagaacgactgtcgttttcgatggaacttcatgtgaagggtgcgcgaattctaattgtccgttccccaatcaaacgcaatgaacaaaaatgggcacactacgaagcggaggcaaagaattggcacttcgaccaccaatggaatttattttcctgtattttaagcgatgtgatggacgatgaaaggtgatcaagtcacattaatttatataagaggaaggaacaattggtgatggatggaccaaaagttaaaaaaatcaacttgtttgcttccttgctatcattgatagccgtgaaattggggggggggggatagatatttggggttaggtgctaatgaaatcaatggcttgtcagaactttgtcttcggggcgtgggggaggggtggggtctacctctctctcaccccggttcggagtcacgtcggccggaccatttcggtgccgccaatttgaaataccgtaacttatagtatatttaattatttctcgccgatatttttacaaaaatttttgtgtggtatgtgtaagatggtgtcatttggtccatcctgaaaaaattaagttttaacgaactccccgtaattaatttttttttacaaaattcagtgatgatgaggaagatggtgacgaattggaagaggaggagcaggaaggaggtgacaaatcggaagggtccgacatggacatcgatgaattgtccgagggaatggaaatgtaattttctcaatttgcaattatttgatcctgttttttgaagatgaagacgtatattgtggaacaaccttttcatgtaacattgtcaacaaatttttattaaa

SEQ ID NO: 79091 - DNA, 1859 bp, Heterodera glycines
  Genomic contig location: Contig_ID=SeqID_14927; Location=53..1911; Strand=-
  SCN-specific regions: Sequence locations=1-490,522-524,627-658,680 -1086,1114-1747,1776-1859
  Gene Ontology: Mol. function=structural constituent of cytoskeleton; Cellular component=neurofilament; Biological process=N-linked glycosylation
tcagatcactgacccaacgccgctgaatgaacgtgctgagattatggtggtccaagagttggccgacgagacggacgtgttcatggagtttggccacctgagccaggcgacccgtcgcaaaattgaggaattccgtcgacgacgcaaagaggcggaggagtacaacgaacagtcaccgatcaaaccaccgaaggcacgccgagcgtcgaaggcggaggaggaaatgagcacagatgaaaaaatgctgagggaaaaagcacccgcaaaggaggcaaaatcattgaatgctggaaaatattagaaaaagccatttttaattaggtaattaaaatgtttaagccagctaaactgacggaggcggagacggagaaaaacgcattccatgacccattggaacggctgaaacagctcgaaaaccgactgcaaagcggcggcaaaaggacgagcccaatgccaacagaagtagggaaaagcccgaaaataaaattggaaataataaaaaaaataatttaaatttaaatgcaaaggacaaaaaggcggaggaaaagcaaaaggaaggcgcagaaaaagaagaagcaaacaaagcggagaaggaaaataatgaaaagcagcagcaaaaggagaagccggccaaacggaagacatcgctgaaaaggcaagagacaacggagaaaagagagaaggaacagcagagaccagcagagaaaaggtcgggggcggaagaggaaaagcatggagaaaaagcaatttcaattgtacatttagcgtcaaaatagacacaacaccaacggcacaaaaggaacaaaaaagcgcagtgccaaaaccacaaacggtgacaatggctgctgctgttgccgcgggatcgacgacggtgccgacgagcgcagcaacagcagctccgaccccggcaactacgattattggcccagcgatggacccgcagcgatactggcgactggagacggactcgctgaacgcgttgatgaaccaggcgagtgcgaggcaaccgattgttggaagagatattagcatttcatccatgacattagtaatagagcataagcggactaaaaatgtgtgaaaatcgggaaattgggattgggttttttcaaaaatattagcagcggatcaattctcatgctaaacccgatcagaacggtcggagattagccatcgttcaggtgcttgagcaaatggagcgtggtccggtgagcatcaatctgatcgctcgcataaaggcccacccgttctatgacgagcggcccgaggtcaaagagctgttggagtcgatcatcgcagcacagccggacgaagtgcagaagcaaacgtcgaagctgatccagcaacaatcgaaggtcaaagagcgatcaatcaatcaattagtaattaatacattaatcactgctaatgaattaatgtcaataaaaatgcctgaggattgaaaataattgggggggggggagactggatgaatttgatcaatttattcaatctttcagcaaatgtgtaacaaagcattgaccgaaacgccgacccgaaaaatgtctcagcgcgaatttcccgttgtggactcaaaaaaacggcagggcgaaaaggtggagcgggccgcaaccagcaaagcaaccgtagccgggaacagcagcaataccgtaattgtgccaccattggaaacagtgccgccaaaagtaacaccggcggagcagagaaaggcacagttcagaagacgcaaggaggaacggagatggcacagcgttgaggcaaagagcttacaattaggacattgggataattatcgagagttttgagagcggcaacaaagatttttcaaaattcataaattaccaatgaaagttaattaa

SEQ ID NO: 79092 - DNA, 683 bp, Heterodera glycines
  Genomic contig location: Contig_ID=SeqID_14929; Location=148..830; Strand=+
  SCN-specific regions: Sequence locations=1-281,323-492,515-683
atgacagagcgggatatgcccgagccaaattcgccacttcctcgcaaaagagtcggcttcaaagagccgcacacggggcttgtgaaaaatgatttcttcgggtattggtacttacaatattggtgagtctaaattgtcaaactcaaatctaccgattttctttaagccttgtgaccggtctttacatgttggagccgtgggagaggaaaatgttcaatgttttcgtcacgggtttcattgccgttttatgcagtgccttttatgccttgtggaatgcgttgattaattaatttaattttttaaaaacgtaaatttatttatactgccaattttatttatttaataaagagtcaaaagcaattttatttggttactttacaagttctcttcaacccctttaaattgaaatagtctgtgttagaatggtcaaattgttttcattctgaaatggaatttacggtcccatattgaatagtgatttaggtattctgattatttatttccaaaatgtttctgaaactttttcacaatgggatattgtagttcagtagtaaaagtcatggaaatctttcaaaatgctcttggacaaacagcacgcgaaacaaattccgatgatttgcagggcgccaagaagggcgctggcacagccaaccaccgtcgcattggtcacaatccaatgctga

SEQ ID NO: 79093 - DNA, 851 bp, Heterodera glycines
  Genomic contig location: Contig_ID=SeqID_14929; Location=695..1545; Strand=-
  SCN-specific regions: Sequence locations=1-851
  Gene Ontology: Mol. function=signal transducer activity; Cellular component=integral to plasma membrane; Biological process=protein complex assembly
atggtcgagggcggaatcactttggtcaaatacctcctcttcttcgccaacttcgtcctttgggtgattaatccgaccgaattcgtttattcgctttctctacagactctcggcttggcctttctaatcgccggtgtcgtacttcaactcaagtacacgggccttttggacattcttggcgatgaacggctcgccacccccgtgcttctgttggccatcggctgtctgtgcactttgctcggttttgtcggctattgcggcgccatccgcgagaattactgcttaacggtcagcttcgctgttctgctcgcacttctgctgctggccgagactgccattgccattctcgtctatgctcttcacgagccactcaatgaagcacttataagccaattgacccaagtaaatggggccacggtttgaccattggcaatggatgacaaacaaacatttcacgtctttgttttagggaatggaacgctataaccgctcaaagggagtttctgtggcttggaaccaagtccaagtagggaaaccaaccgactgattcaataaccaattgaaaaatcattcagcgacaattgcactgctgtggcgtaaataatgccaccgattggaaaatctacgcacccgactcgtgctgcgtgcattttcatgacggatgtgccaaaatggcccaaccgctgctttatggggtgggctgtgtgcaggcagttcagcattggattgtgaccaatgcgacggtggttggctgtgccagcgcccttcttggcgccctgcaaatcatcggaatttgtttcgcgtgctgtttgtccaagagcattttgaaagatttccatgacttttactac

SEQ ID NO: 79094 - DNA, 414 bp, Heterodera glycines
  Genomic contig location: Contig_ID=SeqID_14930; Location=96..509; Strand=+
  SCN-specific regions: Sequence locations=1-28,98-246,268-283,305 -370,392-414
atggcagtgctaatagattcaatgatggataatttaaaaaataaaggtaaattttacaaaaaatatattaaaaaatgtaaaatcataaattaaaaaacagaaaacgctgatttggtcgccccgttgtttccaatcacttttgtcatcttgggtggggaattgcttgttgaacgtgaaaacttagagatcgactacattttcaactttttgagcggctcagtgacagacgacatctaaaagaaatttgttttgagggcactgatggagaaatgaaaagcatccatagagaagagaaaaatttatcattattattgatgtatgccctagtcaaagaaaaaaaattagaagtttatctttgtgattaagtaacgatcattggttctttattttggcgattttccaaatttagcgtaa

SEQ ID NO: 79095 - DNA, 895 bp, Heterodera glycines
  Genomic contig location: Contig_ID=SeqID_14930; Location=989..1883; Strand=-
  SCN-specific regions: Sequence locations=1-107,181-215,237-529,551 -736,758-873
atgtatggctgcatgaaaaatgacaagccatgccaaaagaatgtaaatgtgatgaagaaggttggttataagttgtgtgcacaaaaaatcccttttcgattaatggctaaaattaattcatatttaaaataaacaaaaaaaaattttcataaaaaattcaaatataaataaaaaaataatgctaaaagtttatattgaagagaaaaatgcttatgcaaattttaaaaagcaccaaagattcttagaaaaaaaaactacagcaaaattaatagaaaaaagaatttaaaaactaaaaaggaaacacctttaatcctaaagtattacattaatactattaattgaaggaaaacatttgcaaaagaaaaataaatcaaaccctactgtagaaatgtgaaaatgaatggtgctgagtagttatataaaaaccatcaaatggaaattttcaaaaaaattgcccataacttttgtcaaaatcaaccaaattagacattcttggtatcattggatagccccaacatttctctacaagttatcaaaattcaaaaaatttggtcaagtttgagcaaagttatgggcaaaagtacgcaatgtaccaagtttgcacacatttttggccataaatttttttaaactcaataaaattttttgaaattttgtaggctaatagaggacacgtagggctatccaataatagcaagcttattaattttgttggttctgagaaagttttgatcagaattttttatgatcaaaatatccgcaatccgtaattgagcccagccctggcgctagcgctttctcagcaattccaaagagggcgctagcgctctcagcaaattcaatttggaaaatacattcaaatataatcgaatcaaatttaatttattttaataaa

SEQ ID NO: 79096 - DNA, 3214 bp, Heterodera glycines
  misc_feature (561)..(561): n is a, c, g, or t
  misc_feature (568)..(568): n is a, c, g, or t
  Genomic contig location: Contig_ID=SeqID_14932; Location=344..3557; Strand=+
  SCN-specific regions: Sequence locations=1-306,328-374,408-2430,2452 -2686,2715-3135,3166-3214
  Gene Ontology: Cellular component=plasma membrane; Biological process= neuronal cell recognition
atgtttttctttggtctattttttctccttttcgtttctccgttttcggaagcaaatctttggacagaaacagcgcgaatgagcgatttgcagcaggtcattttgtgccagtttcggtcagccttgaaaagcatttggatggcatttgttcagtggcggttgctctgctcgcgttaccaagttgcgcaggcgtacatggaggacgtaaatgcacgcgttactgtgttcgccccggtcaacgacgtgtttctgtataaccctgacctgcgagcaatggaccaaaaagaagtgctttcacatatcggtaaaaaatcaaaacaaacatttggaaaggccaggccgactgcctttgctagtgagcaaagtggtcagcccaccttttcatacactgatcaatgccaaatccatcaatcttggcgaatgccccctttcagtggacacccaagtggtggagatcagttctggtcggaagtgggagaagcaaacgctgatccgaagcacgatcaacagcgggtacatctacgtcacccagttcgagaatggcccggccaattttgttgngcattgngcgggccgtcccttatcgacggttcatctccattttaagtcgtatttcgcaaacgctggcgcaatttgcaaccacgtgaccaaccaagtggggcatcatcaccggcgagcagtacttgtacaaaacgtgcactccgatgggccatcgtccataccccggcacggcactttcttttgttcgcgacgacgaaaatgccttttttgttgaccgacactatgacaacagggatttgacgtcagccatgcccagaaagcactcatccccggaaacattttagggaattgcgtgacattttggacagagtgccggacatcgccttggtcatttacggaagctccgcttggaatggcttccacacatattttctgcccaacaacaaagcattcgcaaaggtcgccgtgcatattgataaactgttggcatttttattttacatcggttaaatcattgcttaggtgatcgatcgaaatcgggttgaccgtgaggttttgttggcccatgtcagcggaatgaacagagtatcaacccaaggcattccttttgttaatcccccgttttcaggtgcttttcacttacccttggctttacgacggcggtgtccacttttacccttcaattcggtgccttttgtcatttcgttgtccctttttatcgcttcgcttttgtctctgctgtttcagtttctcctcgaatatcatagaagataattacaagttgaagctgtgcttgcgcaacatcaccgaccatcggacgggcaaatgggatttgtacgccgtgtccaccgtatacgaagtgagcggggagagagagagagggaaatggcaaaatgccaatgaacgtttttttgaatggattgagtgccatcttttcttatggtattgcttttgagcgttatggccaatttcggcggggcgctgtttgggccaaattgctggtgcccaatattccggtgcagaacggggtggtccatgtggtggacaacgtgctgggcattgtgaccaacacaattgaccaagtccgtccgtttcgttcgattcttccgatcactcgtcttttctgactgatcattttgtgatcagatgctaatggacaattaccgctgcaccactttgatgcgttatatgaacacaatcggacaagtgactccttcccttcccattctctccccatccgctgccaattgacagattgtgcgcaattatttctccgccaccggcggtttggtcacttttttcgccccgtggaacgaagcgtttgagcgaattcccgagccaatcgaacggcgccttttgcgcgacagaatttggctggaacaggcgagtcggactgatcaaccaatgaatgaatgaatgcactcatcacagatcattctgtttattcaaaagcacagattctcaaacttcacattgtcccggcgaaggaattgacaactgaagaaataaccaatgaaacggttgtggccacggtggacaacatgcgccatttgtattttgtgaggggcgaatggccaaaaaacaacgtcacttattacgtgatcggcggaggggtcagaacggcaattcaaatggtcggcacttggcagtttgctatgttttgtcggttcattcgcatttatttgtctgtttccatccgtaccttaggaggacgtgacagccgttaatggaattgtccattacatcgaccgcgtgttgggcgtgccgtatcaggtggacggagcacgggcggaatgccatgatgcccaaattattacagaggattaatcactcccctttttagtcactttgggaaattttgcgtaacgaaagtcgagcgcagcgatcatttgaaatgttgggcaatttgcaagtgattaaacagcaaaaaatgaaatcagaaatcaaacatgaccaaattgcagcttaaatacagcttggacccgtggcaagtgctgacgcccgaacaaaacttcactttctttgtgcccatcgatgaagcgtgggacaaggcattgccaagcgaaggcaaatgagcgaagaaccaaaacgaggacattttgacaggtcgcaccatcgctaaagaacagaatgatggacggaaaccattggcaagcgttgcaatacgtttacaaagtgagtgggaggatggcaaaagcaaaacaaaacgactgacggttcagcgccacgtgctgcaaggacaggcgctgatgtacacggaccttcgggagcggacttatgttatgatgaacgacgagaaagtgatcatccgaaggcggggacgatgtgagttgatcaggaaaaggaaagaaaagtgaagggccatcgaccgaatgaatgcctttcgcattcattggcatccactcgcagacttcgagttgtactggccccggggcaatcgcgtcgcgcgtgtgctggagggcggagagctcgccggcatcaacgggttcatgcacctcgtggacggggttagccccttttgcctttgccgttggcttttgctgactttcgccgtccgtttttctcaggtgctcatttatgagcctgatttgcgtgccgccgctttggtcggcgcttcgatcactgacaacaaccacactttgcttctttgcattgctttttccctatggacgcatcgctggaggcgaaggtaaaactgacaacagcgaaacgc

SEQ ID NO: 79097 - DNA, 150 bp, Heterodera glycines
  Genomic contig location: Contig_ID=SeqID_14933; Location=2207..2356; Strand=-
  SCN-specific regions: Sequence locations=1-45,67-150
ccttaattttaacttattacatagagaaaacggcaattttaataaatttcacctctacatttgaaactttttcgcccctatttcgcgaattttttgcccctatttaggtccctaaattggaatttttcgcccctaaaaatccccacccta

SEQ ID NO: 79098 - DNA, 1469 bp, Heterodera glycines
  Genomic contig location: Contig_ID=SeqID_14934; Location=210..1678; Strand=+
  SCN-specific regions: Sequence locations=1-10,39-97,133-193,217 -291,317-409,436-714,736-798,822-1469
atgatttatgtaatttttaaaaaaataataaaaatttacgaaaaattgtgaccaaaaaagctcgaaaaatttagactaacaattttaccctaacttttttgaaattcattaaaagtttttaaaaatttaactgaataataaagaaatctctgggctatcttttcatatcctgtgcagtttgattaattgaatgtttaaacaatttttatgtttaaacgaccttacattttttggatgaccataaaaatatataacctattaattccttcataacttttttcagaaacatccaattttaatttaatttatataattagatagcccaaagattaatggattttaaaaagttagggtcaaaattgttgagtctaaatttttgattaagctaagttatgctttattattaagcaaataaaaataataaattaaatattacaaacattgaacatacttttgtcacttcgtcctagcaccaagtcaattgacggaaaaactggcctaataataaagttgatttttttttgtaaaatttttaggttattgaacgattaaacgaaatcgtcaaagatcctcataacttcgcagaattgaccgaaaatgaccttttggtgaatgcgctagtcacttttagttttcccaaattgcgtcacattttcaaaaaatacgaagaaaaatatggggaaaaaattgaagagcaggtggacaacgcttacatcaaagaattcaaacatttatcaaaaaaccgaataaagaatctacttaaactggaccttcatgtcgagcaacatttttgggtaattattttttgtgttaaattttttgatagatgcattatgtatttgtttagcaatttttcaaaattttattcctttcgctttttagctttttctcaaaaacttttttgtttgttctgaattcggaaaaattttcacattgcaaaaaatccttgagtctgagccggacgaaataattaaatttagcaaacattgaacgcaatcttaacggatattcaatatggtcgcccatatttttttgcacaattattgaaagaaaagcttgacaaattgcgaggaaacgaaaagtgggcctcagcggacgcgctgaaagacgtgacgcgaattttgctcactcgcgcacccatcgatttggccgacattgaccaggaatttcagggattgagtggcagcttgaccataagaatttcgatttcggcttacatcgagcaaattctcggattcgaaaaagagaaaaagcaaaaaaagggaaatgtttttcgaagcttttccatacgttcaaaatcgcacgaagacattggcaccgccgttagtagcgaatccaatacggcagcagcaaaaggaaagccatcgcagaaaattgaaactttgaaggcattcaaagaaattgtcgattgggcaacggagcagcgaaggctgagtttggcgagaaatggcaacagcggggtactgtga

SEQ ID NO: 79099 - DNA, 669 bp, Heterodera glycines
  Genomic contig location: Contig_ID=SeqID_14935; Location=1259..1927; Strand=+
  SCN-specific regions: Sequence locations=1-566,590-669
atggccgggaccgggatcgggacttggaaaatgaaccgggacgggatcccgggaccgggactcccgtttttccgggactcccggtcccggtggtttgtccaaaaaagccgggaccgggagtcccggcaaaatcccggtcccgtccgggctctaattatcatatttaaaattgtaatttaatgcatattttttttgctgtatgttaaattttagatttttcatcaatgaaaaattactaattcttataattatttatgcgtttttcattttatagtgttttttaaggaaaacctcactgtttccgtttctaatctgtaacgagccaaaattgtaagtcggataactaagttctatatagcttatcagtaacagtaaataacaattttcgtgggattttttaataagttaagtattatgcactttagtaattttttcatttttagttcagtgcaagggatcatttctcgcttgcgtgtctatgtttttcgtgttcttgtgctgacaaatgagcatgtatgaaaaaataacctctttattttttgcaaaactttttaatttcatacttcattttataattataattatttttggtttggcctttatatgcaacaagattttaacgatatggttgcatattacactgcagcaattatttgtttgagcttttga

SEQ ID NO: 79100 - DNA, 664 bp, Heterodera glycines
  Genomic contig location: Contig_ID=SeqID_14938; Location=7..670; Strand=+
  SCN-specific regions: Sequence locations=1-318,382-635,657-664
caccgaaaagtttttggaattttgctgtcgcttttttgggcggttactcggcatttcgactagccaattccctctggtattactcgcaatcgtactcgacggatcaccaccaattttacgacagtctcccgtgcgctctctcttacaaagtaccaaattattattaataattcgttttttgattgtttgacttttccccccaggtgcctttctattgtgcccttctgttcgagctgttcggctcctttttcctccgttttctcctccaccgtttccccctctcttcccggcatttcttcgctccgccgacaatcgccgctttcctttccttcggtgcctttccttctcttttttcctccctttttattcattttccttttcagcactcactttcatcggtgttcctggccttaatcccgtggtcacttcctcgaggcttcaaggtttagtaaacaaaaaacgtttcattaaattgtcgtcatttttgcacattttgtcaggttgtcccggcttggacttgcaatggttcattgtgcgttctttccgtcctcaacgcttttgacgtttcattttgcattttcagatgacttattggtgttgtccggtggtcggttggcttttggcctcaaaattggacaaaacgccgacaaaacagaagaaaaaa

SEQ ID NO: 79101 - DNA, 1242 bp, Heterodera glycines
  Genomic contig location: Contig_ID=SeqID_14938; Location=991..2232; Strand=+
  SCN-specific regions: Sequence locations=1-547,569-801,823-894,916 -1036,1094-1242
tcaactgaggaggaaagaattgcaaatgtccattttgaccttgaagtggtcaattcggattttattcgaccgatgcgaatgaactttcgccggagggggcgcgacttatactggtgcgaaaaacggcttagatcatgcgtttttagagggagaagtttttaaatgaatgaagtgcttgcccatttctagggacatggcgcttgggcacgacagtgtcggtaagccgttcgtcccattagtgtttcttccgttcgtttctgttttcattgccttttgtcccaattagccgcactcattttccacaccgaaaggaagcagttgctgttcgtcaagcagttcagaccacgtaaatttaattgctagatgccctcttttgacctttccccttattactttagctgttttcgttaacgtcgtccggtcactgcccgaaaacaaaaacaaatctctcgccgaagtccgctgggagaattatccgattgaaaatggatgcaccgtcgaattgtgcgccggacttatggacgaaccgggcaaaacgccgttagagcatatgaaaaaggaaatactggaagaatgcggttatcgagtggacgagtcgaacatccgcccgattcggcgttatgtgacgggcatttcgctgtcgggcgcaattcaacatttgttttacgttgagttggacgagtcgatgtgggaaccgaaggctggcggagggaatgagcacgagggcgaattcatccaaaatgttttcatggacatcggagaagccgaagcacttttggagaaggaaaatttggtgggaagtttttcaataaaaatatttatgagccaacaaaacacattttattatttgaatggattaaggtttcaccgtcttcgttccttttcgccatcagttggtgggtgctcaatgagaaggaacgtttgctcaaaaatgtgaaatgaaaagcgagcgaccaattccttttgtttttgcgggccatttttgtgcgatatttccaattaccttttttcgtcaaattatccaaccaaacggttcattatttatttaaaaatttgttttcaataaactcaaaaattaaaaagtaattttaaagtttgaaaggccttaactttcttttcaaatcttcagaattttatatgaaaaaatcgggtaaaaaataggattttggaaaaacaaaacaaagtgattaatccgctggagagggtgagtcatccatccgttttgtctctctttctctctct

SEQ ID NO: 79102 - DNA, 831 bp, Heterodera glycines
  Genomic contig location: Contig_ID=SeqID_2319; Location=1316..2146; Strand=+
  SCN-specific regions: Sequence locations=1-192,214-302,343-484,523 -580,602-808,830-831
atgaattaccctactgatttttcttggcttcccgtcaacaattgtgtttgtcctgtgaaggacaatttatgttatcactttcccggctacaaaaagccggttatttgtgcccataaactggtgcaaaacattaccgcattcctttcaactccccctcacattcctaatggtattttttctgtttgtttatgatttaatttttcaaacaattttccagaatcggcacctgcgtctctttcctcgggctccgtgttgatgctgcttactgtgctccaaattttcatcattttgcttacggtgagtaaaaattgtttatcattaaatttaaaaatattttaatttctttaaggtggctttatgctgctgtttgatcgtttttgccgcgcgaggccgaacttatgcggtgaatggtcgccgccgttccattcgacgccgcgctgccgctgcgactttgagcgccttccaggcgcgcacttcgggtgggaattttaaaattgttataataaaaatattcattatattcggggaagggatgaatttcaaattaaaaaaaaattcttccattttcagcgcttggtcttggcaccgctggtccattggcgattccaaaccgccccgcagggtgcacttctcatcgtgtgccgggtagtgtggcatttcacatttattttttttgttttaattttcattcattatttaggctgaatggtgtcagctggtcaacgaaagaatgatgtgtgaagaaaaggcggataaaatttaaaaaaaaggaagatcgaataatatttttcttttttttattctcttcattttttccaaataacaatttaa

SEQ ID NO: 79103 - DNA, 5440 bp, Heterodera glycines
  Genomic contig location: Contig_ID=SeqID_2319; Location=3531..8970; Strand=+
  SCN-specific regions: Sequence locations=1-14,37-59,102-169,192 -317,340-409,432-656,678-936,959-1082,1105-1413,1435-1720,1780 -1989,2011-2190,2215-2318,2348-2438,2460-2474,2496-2637,2683 -3650,3673-3976,3998-4660,...
  SCN-specific regions: Sequence locations=...4687-4842,4864-4885,4908 -4961,4984-5033,5056-5074,5096-5440
  Gene Ontology: Mol. function=structural constituent of muscle; Cellular component=sarcomere; Biological process=cell proliferation
tctcggaaccgatgggggaaaaccaaaagaagacatctcaaacaccagccgttgaaaagcagcaacaaccaccaccacaacaacaacaacaagaccaacaatcatcccctgtacaagagaagcccgtcacggcacccgctgtggaacagaacactgttgaagtgaagacggaagaagaaaagaaagatgatcttggtgacattgacaaaacactcgacgatttttttgcgagccttaaagccgcaaccaccagtatgtaaacgaaaacatatttaaatccttggaatttatttgagcaccatttcacttgatcacaataaaaaatgttaaattcacaagcgttttcaaataaagatatttgttttaaattgccctttgggttaattatttcggggccctcatcctctggtaaaacccaatttctactaaaatttattgccgagtcctccgagttaatctcacccagcccggtctccattctttattgctttggtgaaatgaactcagcggtgcccgtacttcaaaaagcgggggttgacgtttatgcgggagtcccgtcagaagaattgatcaaacgtttgcccaagcctcttttgttgatactgaatgacctcatgctctccatggacgagcgatacctgtcagatttgttcaccaaaaaatcccaccaccatcaatttgcggtagtttttgtcactcaaaatttgtttgagaaaaagctcaaagtggcgcgcctatcctcccagtacctggtactgatgcgagcacccaactctctgttgtccatcagaaatattggagtccaacttttcccgcgccagctcgacttctttctggatgcgtatcgccaagcgaccgaccgtccctacggctatttgctgatcgacatgcatgcatcgtcggacccatcgttgcgtctgcgcacaaacatatttaaggaagagcaggaggaagacgaaggcattgttgtgttcattcccaaaaatggaggaccttagtcaacaacagcaacagataaaaataggacagctaataaaagacaactcggactggctgtgtgctttggcgaggaccaaatcctctaaaaagtgtaggaagattttacgtcacgcgaacagcgatcagctattagcgctagtggaaatttgtctgaatctcgtcgcttcacgtttccgattgactacacgacagaaaaaaagattgatgccctatgttgagactgtgcgaaggatgagcagagcgagaagtgaacgcggcgcgagacgtgtgcttgttcagaaaggatcgggatttggggggttgtttgctgccctcctaacacccgtgttaattgaagtagcgaaatcgtttgtgaccaaaaacgcataaataccccacaatttgttgttcacgctcacatttttgcaaaatggctaataaatttttgcttgttccacaagaaatttaccgagggctaacctcagcgtcggatacgggagtcattaatttggatgcggtaaggcatgacctggagcgtgccaggcgtgaacggactaatccgacaacaaaaaatgtccggtacaatcaacagcttaggcgttatctgcaaatgagaagggagcttgccgatagacctaccaaagttgagttaaccaagggcttgagtgttttgctcaagcgagatgggggtgttgatgatgacgacggcgaagtcgtcaacactcagccacggcctcccgctccaccaccaccaccaccaccaccaccatctcctccacctcatcaataccaccgtcaccatcccagccctcccgatcagcaatcttcctcgtctgacgatagtcatccgcctcgcccccctcgtccaccacgtcctcagagaacaaagaaaaaccatcaatcttctataaaacatggtcggttgaaccaatggaagcaaaggcgtcgtgacttgcaacaacaaccggtagtacgtgatctactcgctgaggcagcagctgctcctttacctgaaagtgacgatgacgatgaacaaatgctggaaggtgggtatctgctgccaacaccatcacaaaattatggagacatgccaatattgcctgactatgcagatgaaattgaggaaatggacaccgcccaacaaagacttgcaagcagaagaaagattaaaggagaggagggaatagataaaaacaaaaaatacaaaatttactattctcctccaccatctcccacactaccacccgtgtacaaacgaccagaccatccccctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcaatgtctccaaaagggaaccgaaaattgaactagctcctcctcctcctcctcctcgtcacttcgccaaaaaggaaccaaaatttgaagttgacccacgaccatccacatcgaagcaagccgggtacttcccgcccccgaaaatcaaaaccgagccaaaacatgagttacaacctacaaagaggccagtgccataccgtatcccgaagaaagagccaaaaattgaagaaaagccattacagcagcagcaacaacaacctcctcctcctccagctgttgtcgtcgaagaaatgccctatattcctccgcctaggagggggaccaaacgcacctacccccagaatgatgatgatgaggtgcacataagaaaacgagtgaggcaaccgagaagggtaagagtacagtactcgcccgagccagggccatcaacatctgcacaaagtgaagaagaacgacaacaacaacgtcaactgtttgctattccgtcaaatcaactgaccatgacacagagaatagaacgattatatctcaaatgtaaccattatgccgatcgtatgggtgttcgggtgaatacaattaacaccgccaacggcaagccgttggcgcatagcaatttacgaatggccatcaagtatataatagaccgaagagcgggccgtcccaccattaaaccaccgggagcagacctattggagcagcggcttaggcgggatccaattttgtattcatggacggctccaccaaagagaccatcacagagcaaaaccacccggacggcacgggcaatcaagaaggagtttcgcccgaaaaaatggagctgatcaacaccactcttgacaaaatgtacaatgacccatcctccccagcggcgtttgcaggtgttacagcactgtggaaagaagcgcggaaaaagattaagcatttacgaaaagaagaagtgcagagatatttggagggacatcgcacctatacattgatgcgcccccgcagggtgcggtttccaagagcaaaaactatagctgctggattcatgaccgatgtccaggtggatttggctgattttcaagccctttctcgtcataatggaggccaccggtatctgctcgtggcggttgatgtcctgtcaaaacgtttgtttgtcgtcccactgaaaaataagagagccgaggagatgctggaggcattcaaggagcttattgagcaaatgcccatggccccccatcgaatattctccgacaaaggcactgaattcaaaaacaaactggtcaaagaattctttgaggagcacgagattgcgaagcacgagcccgtgcattcatcagtgaaagcctcagttgctgagcgagccatcagaaatgttaagcagcgactatacagatattttgcagaaaagcagactctcaactgggtggatactgtacagcaaattgttgatggaattaacagtgcaccgtctcgtgttcacgggatgcgaccaattgatgtcaattttcggaatgctcaaaaggtgtggaaacgaatgtatggacaacaattacttaaaatttcacaaaggcgagcaccacgtttccgtaaaaatgaatttgtgcgcatgagcagagagaaggggcagttcgagaaggggtacctgcccaattacggcgatgaaattcttgaggttgaccaagtgttgaaggcagtgcgtccaattcggtacaaacttcgtgatgatcgcggcgaaaagttcaggggcactttttatgagcaggagttggcacgcgtacgtaaggatgatgagacaagctaccgaatagagaaggtcttcaggaagagaagaaaacccgatggttcagttgagatacttgtaaaattcataggctatcccgagagggaatggatcgatgaatctcagcttgtataaaagcattcagtttgttcattattttttacatttggataaatctttttctaatgacatcaaatagcttctttgtgtttttgccaagtaatgtatcggattaccccgacaatcaaccgaacaaatatagggtacgtcttccaaaacctctacattttagtgggtcgtgggtttgtgggttgcatagcatcagctatccctactcatggcactctacaattggtaccttggatgaccaatggattgacattcatttcaccaatctccattccgttgatgaggaccgacagcgtgtcatcagagtacctgtcccacaggcgtcgcacaaaaaagttgagcaactcagggattttttacaagcaacattgaagagtcaagaaaaagtcagacttaagccgcttgcgcatgaagaagggtacttcgataaaccggtagtgctcggctcgcctccacacgccaagcgcctcaagagatcaacaattgatgatctctcttcactgccctctccccccgagatatgatgagacagatgagcaacaatcacagcagcagcagcctcagtctccccccagattcgatgagacagagaaagaggataaaaaagtcaaagaaacaacccctccttctgccgctaagcaaccgataccgccggctccaacacttgctcctccttcacatcctccaactgaagcgccaaaggcaccaaaacaggcagctccaaaatctgctacagtacctccccaaaagccaagtgtgacacctgctacaaccaaaacttccccggctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccacctctggcagctaaaccaaaggagccaaatgtcgcaaagaagtccactgtaccaactaccgtatctacaacatctatttctaaattaacttctcagatcgaatcatcaccaacaacaccgaaaccaccgccgcctcctattaagcctattcctacttcaattccggcaccatcaccgcccccaaaga

SEQ ID NO: 79104 - DNA, 448 bp, Heterodera glycines
  Genomic contig location: Contig_ID=SeqID_2319; Location=2376..2823; Strand=-
  SCN-specific regions: Sequence locations=1-251,277-448
atgtcctccccaagcaaattctctccgacaaaaagctcccccgtcaaaaaggagaacaatgttggaaaagctgaatttgttgttccttccttgaaagcgcccacccgtaagcagccgtcaaaaaatgtgggaatgaatggtggtgaggagcagcagccgtcaatgaaaaagcgaaaagtcgaggaccgagacctgtggaaactcgccaaaggaaaatacatgctgggcttctacctctgcgttggtgaataactatttattttttgttgttaaatatttataaatctcagatgattggaacaaattgtacaacaacaagcagagggtgttgcgcaaggatgatggccgtttcgctgtcaattttgaactgtgcgaagaatgcgctctggccaatgttcgcgcaaccgacattttggcgccgccgaaagcaaagaagcgcatcgaataa

SEQ ID NO: 79105 - DNA, 1058 bp, Heterodera glycines
  Genomic contig location: Contig_ID=SeqID_14940; Location=847..1904; Strand=+
  SCN-specific regions: Sequence locations=1-486,544-1058
  Gene Ontology: Mol. function=3'-5' exodeoxyribonuclease activity; Cellular component=replication fork; Biological process=DNA dependent DNA replication
atgatctcctacatgatcaacgaggccggctttctgattgtcaaccgcgagattgtcgctgcggacattgacgacttcgagttcacgcctcggcccgaattccggggcgaattccgcgtgttcaacgagcccaacgagtgcgcgctgctcacccgcttctttgaccatttgctgcgcgtgcggccgcacattatggccacgtacaacggcgacttctttgactggtgagcgtttgtggtggattcattcatcatccccatggggggggggggggtgtttttttcattcgctccctaatttttcaattagaaaaaaaacaattattggatccatgtttcattgtgatgcaccactgcgtttccctcatccaccacgaaaattattattttttccttttcaaatagaaattttaaaaattttcaaagaagaaacttttgcaaaaaaaatttggtaatttgtcgtgtcgtaaaattttaaaaatagcagaattaaaaaaatatatttcatataaaaaattattttatttttttaaatttataaattgtgttgtggagcggcttcgaacctacacccattattgtttttaaaaatctaagtttggtgtcacattttcttgaattggaaaactttttatcggttttggatttggcgccggtgtcgcattttcagggagccccattcagcagagagctcccaattgtttttttttcgaaattccaaatttttggacagatagagagtataataaaacagttcctatttgggcgtttattgaaaaacgaaaatcccaacaaattttcaaatgtaaaaaaatatgaaaatccctgcaaattttcaaggccctttgtggagacgcgtgccgccgccgtgctgccgcccgcctcgcagcggatgagcgcccacctgggctttggccgggacgcgcaggacgagtacaaacaccccaactgcgtgcacatggacgtgttccgctgggtgcaacgggacagttatttgccgatgggctcccagtcgttgaaggctgcaacgcgggagaagttgcgatacgagccggtgga

SEQ ID NO: 79106 - DNA, 856 bp, Heterodera glycines
  Genomic contig location: Contig_ID=SeqID_14942; Location=498..1353; Strand=-
  SCN-specific regions: Sequence locations=1-295,318-320,494-706,728-856
  Gene Ontology: Mol. function=structural constituent of cytoskeleton
acatttcttcttcttcttcttcaccacactccaaccaacgaaccgcttcagtgcgcaacgcaacgcaatggccacttacctattcatcgctgctgctgccttcggagcaggaattgtaatgctgcgctttcttcattttttcaatttgcatttcataacatttttgtccttttcagtactgttggaaggcgtacctcggcccgatgctcgaccaaccgaagagcgacgacgaggagaagcccaagccggaaggaggcgaagaagcgacgaccgccggcgacaaggaggagaagaaggctggcagcaagggcgacaagcacaagaagaaggacaagaagggcgaaggcgcagcagcagcagcaccagcggcggacaaaaaggaggagaagcgcaaagacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcttaaatgttccccttgtgaacagtgatccttccttatgtggcctgaatatgtatatattgtatacccattaatatattgtgcttcgcttgttcgatatttgtgaaatctcattcatattcatcgtcattgtatttatatgcacatttgatatattaataaa

SEQ ID NO: 79107 - DNA, 1689 bp, Heterodera glycines
  Genomic contig location: Contig_ID=SeqID_14943; Location=8..1696; Strand=+
  SCN-specific regions: Sequence locations=1-874,903-1212,1236 -1407,1429-1546,1575-1656,1679-1689
  Gene Ontology: Mol. function=ubiquitin-like conjugating enzyme activity; Cellular component=cytosol; Biological process=protein ubiquitination
atgcctgctgaaacagccaattctaattcgaacgttaattcttctgaaacagcaaataataacgcaatttcaactcatatgcttcgcgagaaaaacagcgacgaggcaatggtaagggaaattgtctaattggacaaatgctattctcccacccctcttctgatttaaaggaagttgaccagcaaatcgtgactgatactgccgacattttgcagtctgtgctcgaattcgcttttggcgtttcaatcgacgacaacaatggcattgcacaggaattctcctcatctcccgaattgcttttacaactgcaggattctgtgcgcacaattcttccgtctttaaattccgacgactctttggctttgtaatgaatgatccattcgtttatctgctttcatttggtgttttgtttcagtggtcaaaatgaattccaaccggactttgaccgcttcttcgccttccctgaggcttatttggaagttgccgtcgagtttctcactttgctcgtcaggtatttgcttggattttattttcgactttttactttttccatttagcaagtccaaaatgagtcggattttcctaaagaacttgtccgactttccgaagcaagttcttcatttgcttctcaacttggagagcataaagaaccctttcattggttcaaaggtaaaacccccgcttcccttttctgaacattttgctctgttcctctgattttttcaggtcgtcgatttgcttttcatgctgtgccctttggttaaccatgatgcatccgtcttttaccgtcaaattgtcagtgattctcttgctgttgaaggactgttcccatccctcgtcaaattttattcggccgttgaaacaactggtccgattttcttttttcttctcctttatgctcccaaaaccttaggttcacacactgaatttttcgacaagtttaacatcagaaggaacattcaagtcattttcaaatgcatgtggagtgatttgtcgcatcgcgacagaatggtccaatacgccgggtgttttttctgttttgtttatttttttaaatttcccattcagtgaattttctccgaattttgttcgtttcatcaacatggtgctcaacgacacaacttttctcctcgacgaatcgcttgacaaattgaaaatgatccaagacattgaatccgttatgagcaatgagaccgaatgggacaaactcagtcaggaggagcagcagctgaagacggaccaactcagagactcgaagggacaagtcaaaatgtggatccaactcggcactgacaccatggaactattcgttacgctgaccagcgacgcgccgcaaatatttcgcaacgaagcgcttggggaaagagttgcggcgatgctcaaccacaacctcgtccaggtgggcttgagggggagggaagggaaaagccaaaaaaaaagaaagaaagcccaaacaatgcacggcttttatagttgtgtggaccgaaatgtgcgcaactgaaagtgcacgacgcaataaatcgcttcgaatgggacccgcgcacattgacacagcaaattgtgaaggtctacatcaatttgggctcggaaatgttcgccaagcaaattgcgcaggatgaggtgacctatttcagacttatttatttgccgggacgcaatcccccaaaaaaggaaaagatgaatttttaa

SEQ ID NO: 79108 - DNA, 880 bp, Heterodera glycines
  Genomic contig location: Contig_ID=SeqID_14944; Location=1883..2762; Strand=-
  SCN-specific regions: Sequence locations=1-87,293-623,645-705,730-854
atggcgctcttcctttatgtctctctctttctctcttcgctggatttcgcgcttcgtttactcttcctttatctctcgggctccggttctctcgctcgtctctttcctatctctctgtctgggtctctctctctcggctcactctctcctctctttcctatgtctctttttctctggtctctccatttctctcttcctttatctctctctctttctctcttctctgtctgactttatctctcttccctctctccttctctctaaaaatattttctttaaaattttaaaatttcagttcttgtctgccaaatcaattatgggctccttttactttcctatcggacgaactttcccaatggacctgagcagtcatttttacattacccatcctttgtctatcttccatattcagtatacagaaaaaccccagtcttatggacatcctgaaaacccgaaatttacccaaaaaatgggaaaattcagacaaaattccacgaacctaaaactttcagaaaaaaagatagactcctacattcgcaattttacagaattcttgcaattttcgggttttcagggtcacaatgaaggagtgatcggaccaaattgggtttacaatttttgtatgactttttaatcttatccatttactgagtgtactgtatggcttttcatcatactgtaaattggattatcattctgggtttaaaataatcaattaacaattaattactagggctcgaaattgtatgattaacataattttttgcgcatatgctatgaagaaaggggctcaaaaatggcatttctgcgttaaaattttttgatttcgtgaaggtttttagtccataaaaatccatttttgggggtttttgggaataaa

SEQ ID NO: 79109 - DNA, 1509 bp, Heterodera glycines
  Genomic contig location: Contig_ID=SeqID_14945; Location=329..1837; Strand=-
  SCN-specific regions: Sequence locations=1-251,273-309,342-481,503 -619,670-979,1001-1324,1351-1509
atgctagaactcaaaactattgttaaagcatataaaaacgatgagaaaaaaaaggatgccgtccgtcgcatttacactggtaaaaaaaaaacaaaaaattcattttttttttgggtttttctgagcccatatccaggacttaaaaacctcacaaaaaaaaaaaattattttcagttattgtaaattatggcgaacatttgtcatccgtgccaccaggggcccgtcaatttgaagagctcaatgccaatattgaggacgaaaattttgtaagttgaaagaagaatgcttgaataatatcagatcattttcaaaaataataaaaagtatttaaaaaattaattggattaatcaattaattttatgttctttgagcgagccatttttcaaatttgtcgtcagggaggggcaatgaatgctttaataatcattgagagtaaaatcttaaaggaattccattgattttaaagcaatttttttttgacaaataaaaattgaaaaattattgacttataaggggacctaaagataacttctgcaaatttttgaaaacaacaatctatcgggcggctaatttaatgttatacagtaattggaatttttggcattaaaaaattggatgaaatttttaacatttttttaaattatcattattttaatttattattatttgaggtcgagactgtgctttttgagtgccaagcactcgtcagtcgttactctgattgtggtttcgcggatgaggatgatgcggatttgaatagcttactgcattgtaagtcaccactattattctcaagtttttttttttaattttcaattttttgaccaggtcttacaacgttggtctattatcatgacagggactgaatgtttacttgtatgatggatggctcgaattcatgttcctatgacattaagccagggctcgcaaatgtcctttttctaagatttgtcctttttggaggggccggatcttggcctttttctattttcttattttcaggcttcccctaacaaaaaatcgcgccgcaaaaaaaaacacttttattgaatttttatttggaataattttcctaaatgctaatttttgacaccaaataatgatttttttttaattggccaaatgccgcttttgaaaaatttcagttggtagccatgtttttaattgtatctacaatgtaaaaagccgtttttaaaaaaatcttattttggggtcaaaatcatagttttaacctcgtttgtccttattttgaagaaaaaaaaacttgcgagccctgcattaagcagatgcattcatgtctttatgtaaaagataagacaaatgttttttatttaaaaaaattttttaatccgataaattcttttttatttttctttgaaaaacttgaatttttttttaattgcgattttcaattagttacatatttttacaaaacttgatactctttttttcaataatgatcagaaccgcacaaaaattgatttggaaattccacgtcaaagaataaa

SEQ ID NO: 79110 - DNA, 226 bp, Heterodera glycines
  Genomic contig location: Contig_ID=SeqID_14947; Location=413..638; Strand=-
  SCN-specific regions: Sequence locations=1-226
ttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtccctgg

SEQ ID NO: 79111 - DNA, 1085 bp, Heterodera glycines
  Genomic contig location: Contig_ID=SeqID_14948; Location=325..1409; Strand=+
  SCN-specific regions: Sequence locations=1-33,56-189,211-212,235 -265,287-299,342-377,401-408,430-590,615-821,867-1085
atgtcggaggccgggtaccccgatcgggtaagattaaaattttattttaacgaaaagaatctcaaggcatcccagccagggctgcacgcaattggatttgcagttacggaaatccgtaagtacggcgattttctcagttactgaaattcgtaatccgtaattacgggggtccaaaaaccccgtaatttcccgtaatccgtaatccgtaattttcaaaagtcaatttttgtcagaattttagaaaattttttcaaagtaaattaataaaaatccaaaacaaattttcgggatgcattttctttattttatatttcaattttacaaagaaattataattttatgtctgaaaaaattcattctttttgaatttttagggttcattttggaaaagtttttgaaagtctgataatataattgtatttatgtataaagttatttcaacattgataagaaccactagccagaaaaaatttcaggggggagagaacccaaagaatttttttggcctaaatttttttgtgttatttaaaaaatttcagagccggagagcaaaaacaggaattgtagccgtttttagccaaaaaggctaattaattttttcaaaagtgacaatttttcctggtaaaatttataatttttgatttccccgttcggcttctcactgcgctattttttatataaggtagcaattatgttaaaatttcaactcgatcgtttcacggtaaagaaaaagttacgaaaaaggagcaaaaaaagaagtaaatcaaaagaaaatatttttccttttttaaattttcctggtttatctcttgatgttttagatttttttaagttatttttttgttatttttattaattaatttatacactagcctagatagtgaaggtgctgctgtccaacccaaactaatggtcgagagaacgaggaaaagagggaaatagaattggggaaaggatgaaagagccaaagacccgggcccagggtggttggcctccccaaaatcagtcccaggaatgcgcattcgattggtgactcaatgagtggaggaaaagacaagagggagcagtactttattggccatgaa

SEQ ID NO: 79112 - DNA, 1106 bp, Heterodera glycines
  Genomic contig location: Contig_ID=SeqID_14951; Location=971..2076; Strand=+
  SCN-specific regions: Sequence locations=1-524,546-1106
atgctaatcgcaccgcctcctgtaaaaatactctattgttattccgagatgaacgattctgtgatcgggttaatgaaacaaggaattgagacacataatggggtaccgacccaaacgttggttcaaagtatgcccaaacccttacttttaatcctggacgacctgatgttgagtgtaaataacgattttttggatttattgttcacccgaggcttccataactgggatgtaagtgtgatttttgtaaaacaaagtctctacggacgcaatattcgtaccgcaagagccaacagccattatttggttttaacccggaatccttctggtcaacttcaggtcagaacggtgggttctcaattgtttccgaagaggctaaactattttatggaggcatacaacgatgcaaccagcgaaccattcagctatttggttatatatgcatcctaatgcgcccgagtctgaacgtttaacaactaaaatcttcccggatgaacagcgtgaggtgtaactaccaattgaataaagaaagggtataaaaggttgagaaaatctgtaattttcactacaaatgtatgaattcagtccatatataagtgaaaacgcagaattttaaaaaaaaatcgcctccacgaaatcggaaaaaaagaaaaacatccttctgcgagacacaacagccgaacaaatattaggacttgttgaaatttgtgcaaacatattaaaattcaatttcagcctaagcagaagccaaaggaaacgcttggccgaatacgcggactattatcgtgcaattgcacgctcgcgtagcgaaaagactgcgagaaaaatgctacaacagggaagtggtatagcattaggggcaatattagtgcctattcttggcgcactagctcaacacctggtcgaaaaaattacagcctaaaaggcgggagctaccaatgaaatatacaaaaaagatggtaccagagagcgagtatttggccctcattaatctacttaaagggagcagcggcgtatttcctcctctaaccgacgcgttacagggcgagaaaacgttgcttgatgtacagattcaaaagaatttggctgatccaaaaaataacgctgaa

SEQ ID NO: 79113 - DNA, 1213 bp, Heterodera glycines
  misc_feature (1121)..(1121): n is a, c, g, or t
  misc_feature (1203)..(1203): n is a, c, g, or t
  Genomic contig location: Contig_ID=SeqID_14952; Location=26..1238; Strand=-
  SCN-specific regions: Sequence locations=1-94,116-874,899-1005,1027 -1048,1072-1213
atgaaacgtcgtcgcagtgatccgttgcattcgcttggccggacgagggaattgtcgccacttccgttggacgaattttgtcgacgtccgcgcgaattcgaacggaaaaaggcgaattcaaagacaccaatgctcgggcggaaaattatgagcggacaattgcttaacggagcagcggaaaggcgggcgcggacgaaggacaaagggtcggtcggtcatttgcgttcgtttccgttgcgacggcacttttccccgccggcgtctgtcagcgttttctgttcggcttttgcagtgcgcatctctttcgtcaaacggatgaatcgcatttggctgatgctctgtgcggctccgagacgcccctccgcgtccacgtctacgacccgtactgtccggtgcacggctcgcggaggcgaatgccgcgacatggcgaacgcgtgccgaagcgattggtggacatgcactcatttttggcctcagtggacacgacggatgaagacgtggacgaaaagttgaacccgtacctgggcaggtgctttttgccaaactcattctggctgatttcacaatttcagtcaagcaattttggcgaaacaatttcggaaagagcgcagggccatcctccgcgagacggaggggcccaaactgaaggcgatgaagtggaggatccgcactgatctgttggtctgaaatagcacaccttcttatgcgcctttaatcgctcattttatgtcctctctttggcatttctcttccttttcaccggcttcaacggcctgcaaactcttcagacggccgtcaacggcgacatgggtgccgactcactttggtcagtccgccgtgcctcggcggcactttctgttccgctttcagtgtgctttacctctctttggccgtttcctctctatttgtgccgccgtttgtgctcaatcggctcggctgcaagcgtactttggtgctgagcattggcattcacgtgctttacttcgctgccaatttcatcccccggtcttcgccttcccatttatcttccatttggtcaaaatgtcctcccttcccctttcagttattactcgttgatccccacttccatcatcgctggaatggctgcaagttgcatttgngcatcaaaatgtgtgtacatcaccgaaagtgccataaaatacgccaagctgaacgtggagtccaccggagtggtcatcccanggcattttcc

SEQ ID NO: 79114 - DNA, 535 bp, Heterodera glycines
  Genomic contig location: Contig_ID=SeqID_2321; Location=82..616; Strand=+
  SCN-specific regions: Sequence locations=1-535
atgcgcgccttttggcgtttagcattggtgcagaaacggctgtccgattatttcaatgcgatttgcgaattcaacgggaaaaagtaagttttggatgggaatgatgcgtttcaaaggccgtgaggaatgtcaaagcaaaatgaacgaacaaagatcactttctttgattttagccacaataaaccatccgccaaagacaaacatttgtaaaaccttaatttattctcaaatgacatttattgcttgaataattagggaccattaaattttgggcatttcggtccggtatggagaattggagaagttgtctgatcaattctgctttactctgaacaaattccgcatttttagccctttttacgaacattgggccttcatgcgctgcgacagttgttgtgcttttttggccggctctcttttggctttgaatgctttcgatttcgatttgtccattgaaaatgaccatttggaagtataatctttctttttccgtctcaattactgctaatgacactttttttcatttgaggagcaa

SEQ ID NO: 79115 - DNA, 1580 bp, Heterodera glycines
  Genomic contig location: Contig_ID=SeqID_2321; Location=1156..2735; Strand=+
  SCN-specific regions: Sequence locations=1-355,378-762,785-1091,1113 -1195,1226-1415,1438-1580
atgaaaaagttcacggaggatctctacgagaaattgaaaacagctgagagtcgggtgagacggcttaaaagcgacatttgtcagctcaacgaattacacgaaaaggtggtcaaacttgttctggctcataataaagattatcatttggcacaattcctatcattttttatttattttgtttaaactttttgggtacaaatcctttggacaatttaatggactgaagagggcatttttacccacttttagtgctaatacaaacatcaaaaatgggaattggaaaattattgatcataaccaccagagccaaaaacaacaaaaccaattttatagattttcttaggtgctctaaaccgataaaataaaaataaaagtgcgcaaagcgtttaattaatttttgctccgttttcgcgtgctcctttttgagtacagtctgttaataaattatagcgccaagatttttttttgctactccacctacttcccatggaccaatcggtctgaaatttttaccacacataccctcccataaatattaagaacacacaaaaaatctaaaagtgtaaaaaaaaatttatgaattttttccgaaatttgccccaaaatttgctgttaataaattatagcgccaaaacttcgaagacatataaattttttattagggtaagaaaaaatctgaaaaaattcatttccatataactttttgtgctgatcaaaaaattcaattgtaccaacgtgatcagatcactccttcatggtgatctgaaaacactaaaatagcttgaaaccttgaaattttcagaaaaaaattcctagggggttggagaaattttttcgtgaaaggcgaatacgacggatagaaagagcacaaattttcctaaaaaaaggcttcatatgatattagatcgattcgacctctgcttttagaattagctcaaagagctttagaacgttaccaaatttatgaggataaaaacattaaaaaaaataaaagtgtaaaactttttcattttcgagttttgaatcggttcaaaaaggtgtttggacgctttgctgcagaccttgttttcaatcattttcagcatctcagaaaacctacaaaagttgttttgggtgattttggctctgctgtgacaatatttattgggaatttgcctacaaaaggcacaattacagtacccaacctcttactgtctaattaaataaacttaattaattaatttttgctttgttaggaagtgaaggcgctgaatgcttctctttgtgcgcttcaacaaaacgaaggggaagccatggaagagaaagcgcatgagaaacgactgaaagaggagttggtggagaagacgaagcagtacatggaagtaggggagaagagaaaatggaaaggactattggccataggtgatgagtgcagtgaaaaggaagcagcaggaagtgagcgaagaacgcgaacagaacgccacactgaggagacgcgtcgcggagcaagaggcacgcgcagagacaatggccaagacggagaaagtcaggcagagaaagagggaaaggcaccgaccgatcgatcaattgctaattgttaa

SEQ ID NO: 79116 - DNA, 2862 bp, Heterodera glycines
  Genomic contig location: Contig_ID=SeqID_14954; Location=184..3045; Strand=+
  SCN-specific regions: Sequence locations=1-201,226-290,338-384,419 -698,720-774,796-835,939-981,1003-1989,2012-2234,2258-2442,2503 -2527,2601-2862
atgatgcaagccgaggcgcagcagctgttcccgccggcactcgccttcaccgcatccaatgagcaaattgagaaaattgagccgactaaccgtggcggtcagcataattataattaattaatgcacaattagcttttttgcgaatctcttgtttcttcttatcctagaatttttctgagaatttcataaaaaaatatctgaaaaagaaattttccagaaaaaaccgaaaatttcattttttttatagtttgaatgtgaaaatcttagctttaagtaaatttgtttgatagttatatatttgtaaaattaatttagaaaatttgaatatattttttttgccaattgtcatttaagaatgctttgtgtctatgtaatttggcaaccaaattataattattttaattaattctatatttatgaacccctaaatctccttcagttttggacttttcgttggctgcccgtggccaaccgttgccccgccgttacaccgtcccatgccaatttccaaaattctgggctgtcgtcatcgtccaatgcgctgtttccaaggaccaatgcaggtgagaaaacgattagtttgaatatacgtcgatgatttactgtatttggtcagatgtaagagatactgtaactttttttgagcggattaaacaaagcgatcaatcatcaactgtattctcgagtgcataacttttcttaaaagaaaaacttaagtgttcttggtatcattcggtagtttatagttagttctctaactgggtgtgcagttttgaaaaaattaagccttaaaaacatgatgaccaaaaaatttcataaaccagttttacatttctttataatatttttaaaaacatttttaaaaaagattaagttttaaatattgttaagtcttttcgaaaataagttttaaaatattaaatagtttttaaaaaattgtatatgtattctattatgttaaaaacatttacataagctatctaattgtgccaaaatataaaattttagcgtacttttaagtaaaattttgaatttatttttcccattttctgaccactttcgaaattattgaaaagataaatcacttaagaatgttctgcgaaagtttggtccggtgtgccaggtcgcgcggtgttcaaatggaattgccacagcggggcattgaccattttgatgacacgtcactgtgagttaagggtcaattcacggtcacagtttagggggcaaattccgttaatgattcacgcggaaattcaagtttcacgggctcaattccggtcgattcacatggcatttcacggtcactattcattgggaaaattcacgtcatatttcacgggatcatttcacggtcattattcatgggggcaattcacgtcacatttcacggtcactattcatgggggcaattcacgtcacatttcacggtcactattcatggggaaaattcacgtcatatttcacgggattatttcacgtcacatttcacggtcactattcatgggggcaattcacgtcacatttcacggtcactattcatgggggcaattcacgtcacatttcacggtcactattcatggggaaaattcacgtcatatttcacgggattatttcacgtcacatttcacggtcactattcatgggggcaattcacgtcacatttcacggtcactattcatggggaaaattcacgtcatatttcacgggatcatttcacggtcattattcatgggggcaattcacgtcacatttcacggtcactattcatgggggcaattcacgtcacatttcacggtcactattcatggggaaaattcacgtcatatttcacgggattatttcacgtcacattttatggggtcatttcacggtcacttttctcgggatcaattacggtcacgattcacggatttgctcagtcactgacaagactaaatttcttgtcgcctttatttaaaaaatgggcttttctaattgaatatgtgtttaataattttttaaacgcaaattaatagcatctttttccagtgagttcgtccgtgagcaattcggattttactcgaagcatcgtgtccgttttgttcttttcgttgcgcccggaaaggatgcgtcccatgccggtgatgtccaccatacgttcaaattgcaagaaattgaacatggtaagtgtttttctcttccttcttgtagtgatatgttcaagactcaaattcccgaaaatttaactcaaacaatagaggaagaaaatttcaattttgcgcgatgaaatttgaaattctttgcgggacggggatcccatggtcctcacaatttccattgaatgcgggattgcggactgggactccgtcccgcgccgggctcagaatgagtctataaaaacatgagactattctcgactcaatagaccgagagtcgtgaacattaccaccttcctacttcagttttctctctccctgctatctttttcactcttattcccctccattctctctctttttctctgccgtaattcatgtatcttcttttcctctctctcactctctctctctctttctctctctctctctttctctctatctctctctctctcacactctctcctactccattctttgactccccccattttcttctaaggaattgtgacccagcatgtttccccaaaaatcgtggacaaggccactggcccccggggtgccattatggttctggacaacatcatgctgaaaatgaatctgaaactgggcggcgctaattacgacatttgcacggcgcaggcattcaaacaggctaacggaatacgacacgacattgtgtaagtagtcattgatcagtcaggtgctaaacgattgcgttcctaca

SEQ ID NO: 79117 - DNA, 1039 bp, Heterodera glycines
  Genomic contig location: Contig_ID=SeqID_14958; Location=64..1102; Strand=-
  SCN-specific regions: Sequence locations=1-399,421-635,660-1039
  Gene Ontology: Mol. function=dolichyl-phosphate beta-D -mannosyltransferase activity; Cellular component=nuclear envelope -endoplasmic reticulum network; Biological process=protein amino acid glycosylation
cagcaaaacacttttttgactccaaaattctccattttgctgccgacgtttgttgcttattttctgtcatttttcatgatttttccgtattttcaggtacaacgaagctgaaaaccttcccatttgtctctggctgataatcaagtagaaaaaacaataaatttctaataatgatccccatttaaacattttataaatttttagatatttaaaggggctgagttatgaagtgattatcatcgatgacaacagtccagacggaacacaggtggtaaaaccaaattttattgtgtaatccgtttttattgataggaagtcgcaaaaagtttgcagaaagaatttggagcgggaagaattaaattgttgacgagggaaggcaaactcggattgggaagtgcctatgtttttgggtttgttttgactagctttttatgtgcccgaaagactcctccgatttgaggcttaaacaagcacagggcgaatttgtcattttgatggacgccgatttgtcccaccatccgaggcatattccggagatggtcactcttcaggagaagcatggctatgacattgtcacgggaacgcgttatgcgatgggcggcggagtgtccgggtgggactttagacggaaaatgatcagccgaggagccaactttttggcacaagtaaattccctggaaactttgagaatggaattcgttttataatttgtttttcagttccttcttcagccgggcgtctccgacttgactggttcgttccgtctctatcgaaagtccgttttgtcaaaactcgtcgtcgaatcagtgtcaaagggatacgtttttcaggtcttacaattaatccctcccttaattagttcttaattgtttcacatttcgttcagatggaaatgatgtttcgggcaaaaaagggcggcttttctatcggtgaggtgccaattgaatttgtcgaccgtttttacggggaatcaaagttgggaggacaagaaatcgttcagtatttgcatggattaatttatttatttgttgctgtttca

SEQ ID NO: 79118 - DNA, 519 bp, Heterodera glycines
  Genomic contig location: Contig_ID=SeqID_14959; Location=229..747; Strand=+
  SCN-specific regions: Sequence locations=1-181,207-519
atgcaattgagcaaaatttgtccactttggtccgctgccaaaaattgcaaatttgccaaggagacaaactcgcgctgcttcaatccattcagaatttatgtgcatttgtggagggaagggctgctgacgacgaaccaacacggaaagactgtgccaactcattatggtcggccggcacctctgttttatttttaaaaaataacaaaacaacccctaaaggtattcaaaattggccctgctcatttccgcagtcgaactttggtcatcacgagtcaaaagcgagcacattcagccgatatttcatgtaataattcagcaaaatattaacaaaacttacactatttacttttatagcaaatgaaaatcgattgttacagaaaaatcagcgaatttttgttggattcattggaaagggaagttttcggacattcaaaagaggtccaattgcaaaatattgtactcaaattgagtgcatttaattaatttagtgcgataatttgtccgttttggtcgcattaa

SEQ ID NO: 79119 - DNA, 849 bp, Heterodera glycines
  Genomic contig location: Contig_ID=SeqID_14959; Location=1267..2115; Strand=-
  SCN-specific regions: Sequence locations=1-63,89-99,122-665,723-849
  Gene Ontology: Mol. function=ATP binding; Cellular component=membrane fraction; Biological process=axon guidance
tgaaattcgaaataaagaaagtcaatttccgagtgttccttctcggcggacaaagaagcgaacggaagaaatggatccattgttttgacgtaagagacggggaaaagagaaaaaaggaagtaataattgtttaacgaacagaatgtccatgcaattttatttgttgttgccatcagcgaattcgatcagaaattatacgaagacgacagaacggtagaaaagaaaccattcattgtcaattattacaataaaattgcaaaacgattctgccacatttcagaatcggatgatcgaaagtatgcgactgttccgatcggtgtgcaattcgcggtggttctatgaaacggccatcatcctttttctgaacaaaactgatctgttcatggagaaaataaaaaaaacatccatcggttgtctgttcaaaagttattgcggtaaatcaaagccaaattgaaatggcaattataaaaaaaaccctaaaggatcggactcttacgatgaccaaatccaatacatcgaagaaaagttcaaatcgctgaacacaaatccaaacaaagtgatttacatacacgaaacatgcgcaacagacacaaatcaggtcaaaatcaacagcaaaaacatcaaacaaaggaagaaaataatggaaaaagggggggggggggattagagagagagagaaaggggagagacagtgagaggagagagagaaagagggagagagaataaaatgtaatagattaattaagtgtattcttaagagaatctcaattcagttttcagattcaattaatcctggaaaatgttatcgacttgctgatacagaaaattctgcatgtgtacggtctttac

SEQ ID NO: 79120 - DNA, 266 bp, Heterodera glycines
  Genomic contig location: Contig_ID=SeqID_14960; Location=212..477; Strand=+
  SCN-specific regions: Sequence locations=1-266
gcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactgatttctgcggagtacagaaaacgaaggtggacaacgcatttgcgatgccaagcacagattaggacaatgtttgttgaaatgtaccattgctattatattttgtgggaa

SEQ ID NO: 79121 - DNA, 455 bp, Heterodera glycines
  Genomic contig location: Contig_ID=SeqID_14964; Location=162..616; Strand=+
  SCN-specific regions: Sequence locations=1-131,153-214,237-257,282-306
atggtcattatgtttagcatcaatggtattttatgggtcagtttataaaatttagtattagcactgatgctaaacatatgacaatgactgtatgactttttttcattaaaaatctatatgcctttaatatgttatttattatctgtcaatattcatgacttccgaaaaaataaattttcatggattttcagagaacaaagaattaaatgataggaattttaataataaaattatgaaagtacataattacatactaattcaaaaaccaaataacaaaaaagcaagggcaattaaacatgattactgattattaatattaaattaaaacaattttaattgccaaatttataacaagtttaaaaaataagtaaaatatattagaattttactttaatatttagacctataaaaattttattttaaatcataaattaagaatttgtaattatatttaa

SEQ ID NO: 79122 - DNA, 1638 bp, Heterodera glycines
  Genomic contig location: Contig_ID=SeqID_14965; Location=152..1789; Strand=+
  SCN-specific regions: Sequence locations=1-72,94-1638
atgctgcaaaccaaaaccgaacaacttcccgtcactgcagacgagatcgcagaggcgacaccgaaagatgagattttaaagaaaattttggcattcacccaatcgaattggccaaagaaaagcagcgacccggacatcgcaccgtattttccgaaaagggaaaacattttggaaattgagggctgtttgctcttccaaaatcgcgttgtcatcccccaatcgcttcgcaaccgaatgctgaagtccctgcacatggcacatcccggaattgtgcgcatgaaagcactcgcccgccaacacgtctattggccgggcatggactcggaaattgaacggattgtccgtcagtgtgaagaatgccaaaaggcgcaaaaagcaccgatcaaggcaccgctcgccccttggactccaaccgacaaggtgttccaacgggtacacatcgattttgcgggaccatgccaagacggacatgtctacttcattttggtggactcattctccaaatggcctgaggtttaccaaatgaactcaatgacggccgcggcaaccgttttcacaatccgatcaatcatccaccgactcggcattccagacgaaatagtttcggataacggaactcaatttcgttcttccgaatttgcgtcactctgtaaggagttcggaattaagcacacttttacgccgccattccatccccaatgcaacggacaagtcgaacgtttcgtcgacactttcaaaagggcgatgatgaagtgcaaaggcgacaagaacagcctcgaaaaagtgctgctctcctacagatcaacgccaaattctgccatcgacggatattcgcctgatcagttgttccttggacggaaactccgcaccaaattggcacttgtccacccaaaaggacaaattgatcagtcggaaaaatttgaaaaaggtaagttcaaacagcatcaaaaggactactctgccaaaatggcacagcaattcgatcggaatcatggcacaaaagctattgagttcctcccaacggatcccgtcctgctcttgaattatcgtcttggaaaaagccattggcttccgggcacgattgtggaaaggctcaacaattcgcctacataccgtgtctacgttccaacactcggctgaattgtccatcggcatgccaaccagcttcagcgccgattggattttgaggacaattcaaattgggaaccccccattcaggaacaaatggtcaatgagccaaatcaaaggacaccgccacgccaaaacgcagcagccaatcaacggaccacacctgttgatgatcaggctcagcaaaaggctaaaagcccaatcggcgtccgacgttcacaacgcgtgccgaagccgatcaagcgattctcgccaggttgaaactgaggatgtttcaatctcgagaagggaggtgttggagaagagcaaagtacattttctcatggtcacttatcgattgacatttgtccattccctcctccgttcctcccacatcacatttgttatttaaaggcgtggactcttcccccctcgttcacttcttctcctgtcttcacttttattattttattcattctccatccatccattcgccattttattattttattgttatttgactcttcgtaa

SEQ ID NO: 79123 - DNA, 1522 bp, Heterodera glycines
  Genomic contig location: Contig_ID=SeqID_14966; Location=2293..3814; Strand=-
  SCN-specific regions: Sequence locations=1-665,689-698,727-944,967 -998,1020-1148,1177-1522
atgccatccgattttaaaagtgccgttgtacgtcgtcagctgtcagtccaaagcaattccatttcacgagaggcatcaaatttgaaatcatttgacgaactttgtactgaggtacatacacaattcaacttttttgaattattatgccccagggcataaaaaatattgatgttgtggtgaggcgggctcgaacctccgccaccccctcttcccactttcttgcaaaacccactgacaaatgagctacagctttctgaattttgtggccaaaattaaatgtttaagtagaattgagcgggaccgggacctgaacacggacaactgagtaccgaagtcccgattttgaccgggactagtcccggtgttttcccgggttttcaacccgaataggtccccggttccgggtttgcccaaaattcccggtcccgctcaactctatgtttaagtaaagtaaaagtcaccttattttcttaatttttaggcggatttgcagcgcgtacgcaaagcttacgaagagaaactcaaaaaattcgaggaactcaaaaaaaccgctgcggatttggaagcgctcgatcaaaaatttgtttgtctaaaaaagaaaaaaatttgtggttttcagggtcgcagaacccatggctgacaatccatttcgaatcctgaaatcgaacaaaaattcaaaacccaaaaaacaagtctcgaaatttttttttaaatttttcttttttacgaaaatggggctaccatcgacaatatcaccgggttttctagtaaaaataaattcgtgtaccttattttttcaattttttagttggaattgcaacgcaatcgcaaatttggcgaagcggaaatcaaaagattcgaggaactcaaaaaaatcgctgcggatttggaagcgctcgaccaaaaacttgttctttggaaatatgccagtggttccttggtattcaaatttttaaataaaattctcttttctatggtaatttgtggcgctgattaacgagtatgaccttaatttttcagaataccgaacccctgatccgaacttgaacaaaattcgaaactaaaaattcaaggactttagcctaggcttacgcttaggcccaagcttaggcttcacggttttgttgcgtattttgaatttttgacgaaaaattaaatttcaaatttttgctagaatccctggtcatgggttcgtaataggctgaaatatgtgtgttaaaatcggattctccgaccttgaaaatttggaggccaaattgaaaggatgtataagagataatatgcatttttttctttattttttaggcggatttgcagcgcagtcgcaaagctgacgagcaggaacaaaaaatgaaaaggcgcgatcgaatcttttttatttatgtgtgttgctgtttcattatcgtttggtccattattgcctattatttatactgtattgcaacttcgattttccgtgctcagactccataaaatgcttataaatcatggacggtaaaaaagaaaaaaaagcggcaataaa

SEQ ID NO: 79124 - DNA, 625 bp, Heterodera glycines
  Genomic contig location: Contig_ID=SeqID_14967; Location=233..857; Strand=+
  SCN-specific regions: Sequence locations=1-625
  Gene Ontology: Mol. function=permease activity; Cellular component =cytoplasm; Biological process=acrosome formation
atgctcttctcccgggtactgctcggcctcgctgttggctgtgcttctgccacagtgcctgtgttcctagccgagctggcgccatctgagaagcgtggccagatggtaactcggaatgagctgatgtgtgtgacgggacagcttatcgcctttctcagcaacgcaattcttggcaatgtttgggctgacaatttgcacatttggcgctggatgctcgttttggcaattgttccagcatttgtgcttcttttcggcacttgggcctttgttccggaaagcccacgatggcttatggcttcgaacctgcataatgaagcatttgaagtgctgaaaagcatcagaaccaacgaagaacaggcgaaagcagagcttgaagaggtgcagcaacttatagacgaggaccgcaaactgcaccaaaacgagacaattagtcaaataatttcagagaggtgcctcctctaattgccatctgagattccttttaaccctcgaagatgggcccgccaatgcctttttattggccttggcaccgcactgtgccaacaagtcactggggtcaatgcaattatgttctacgggacggaaattctgcagaagagtggcatgtccaacaaagctgcgctga

SEQ ID NO: 79125 - DNA, 1791 bp, Heterodera glycines
  Genomic contig location: Contig_ID=SeqID_14967; Location=1953..3743; Strand=+
  SCN-specific regions: Sequence locations=1-9,71-742,764-865,892 -1247,1269-1594,1619-1624,1646-1791
  Gene Ontology: Mol. function=alkyl sulfatase activity; Cellular component=cell surface; Biological process=metabolism
ttccttctcacttcccttttccaaaatgggtttgtttctttgacataaattttaatgtttttacttatcataattgcatcattttatacaaatgatccgacccaacattgttcttctgatcactgacgatcaggacattgaattgggttccatggcatttatgccgaagacattacgcctcctccagcaacgcgggacggagtttcggaacgcttttgtgtcgacgccaatttgttgtccaagcagaagcaccattctcaccggtctctacgcgcacaatcataaagtgatgaccaacaacggaaattgtgcaggcgaagaatggaggcaattagggggggggggggagagaatgacattggcaataaaattgagcagtccaatgctaaggtctgacttcgaaaaggacactttcgcggtgtacttggaaagaaccggcttcttgacgggctttttcggcaagtatttgaacaattacgacggaagttgggtgcctcccgggtggacgaaatgggccgcgttggtgcgcaacagtcgatattacaattactcgcttaacaaaaacggacacaatgaatggcacggaaatcgttacgaaaatgtcggtccggcgattctgcggaatgaaagagacgtttaggactacttgaccaacttggtggccaacctttcgctgcaattcatcgacgagtctgttttgctgaacccccacgggcagccattcctcgtcgtcctcagtttccccgctccccatgggccagaagacccagcaccgcaatttgccgaccttttcgaaggggtggaaacgcatcggtagggacgaaaagaaaccacagctaattgagcacaaaggactgattcgtggaactacgcgcccaacccggacaaacaatggctgctgaaaaggacggggaaaatggagccgattcacgtggcattcaccgaccaaaagcaccggcgaaggctgcaaacgctgcaaagtgttgacgatgccgtgaacagagtgccgctgggcattacaaggtcagggctaatgaccttcatttagctcgtccaacaccttcgcttccttaaccgactccacaacacttttattttgtacaccagcgaccatggctatcatttaggccaatttggacttgtcaagggcaaatccatgccgtacgaatttgacattcgcgtgccattacttatgcggggaccaggaataccacgcgggaaaatgtgtaaaatttgacgggaatttactgtaacacattttaatgttttgtagaattcgatccgttgtatccaacattgacattgctcccacaattttggacattgcggggctaaataatgccaaattggatggacgatcaatgctggaattagacgaaatcaatggcataaataggagaaaaaaaatggcatggcgtgaaacggtgcttattgaaagagggtaaaccaaaaaggagggggggggtaattggaaattttggaatttgcatttagtaaaatgccaaagttaaaacgaatcggagagagactgaagcaacagaaagaagggttgagcagaaagaagctgattcagagggaatgcgacaagtcaaagaggggcagcagcagaagcagcggaaagagttgtggcaaaagcaaaagggtcagaaaaaggagtcgctggcaatgtgccaaagacgcacacggaaaatggcacattattcgctgtcctctctcagaagaagaagacaaattatgtgaatgtgaagaggagagaaagagaggaaagagagagaaggacgcaagggatga

SEQ ID NO: 79126 - DNA, 1074 bp, Heterodera glycines
  Genomic contig location: Contig_ID=SeqID_2324; Location=170..1243; Strand=+
  SCN-specific regions: Sequence locations=1-1074
atggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcg

SEQ ID NO: 79127 - DNA, 713 bp, Heterodera glycines
  Genomic contig location: Contig_ID=SeqID_14969; Location=224..936; Strand=-
  SCN-specific regions: Sequence locations=1-713
atgaaatcccgaacccgatcaatcccgaacattttggaaaatcgctcgggacggatcccgaggtcgggatcccgatcctgtccggtctctagtgtgcacctagacgatctaacaaatatgtatgtaagtgcaattacgcactaattagaagaattaagaaacgcaagtaacagggaaaatggataagttaaatgcaacgaaaaatattatttaataatcgtttaaagatttttggtagtttttaatcacatagtcgaattattagttcattctgtataaatctcgacaatgcaagtgaattagcaaattatgtacaatacggttaattacaatatacatatacaatcgaaattaaatacataatatatattacatatatacaacacatgttcatatcacagaactatcacagttaattgggcatagcaccgcatcagaacagatttaactggcgcttcagaaagaaattaatgacgtactccacgctcaagaattgttcgtccaagtccactcttcgcccctccacatggcgtccttgggtcagtgaatattcgagcagcgtcggcaattgtcgcaggcccaacgtctcgtcagttttgaagatggatttcggctctttcttcgtcgtgtcccacctgtgcattgttttggaatgtcagattcaaaagtgcgccaaataacataaacgatggtaatacttattttgaaataaa

SEQ ID NO: 79128 - DNA, 683 bp, Heterodera glycines
  Genomic contig location: Contig_ID=SeqID_14969; Location=294..976; Strand=+
  SCN-specific regions: Sequence locations=1-683
atgcacaggtgggacacgacgaagaaagagccgaaatccatcttcaaaactgacgagacgttgggcctgcgacaattgccgacgctgctcgaatattcactgacccaaggacgccatgtggaggggcgaagagtggacttggacgaacaattcttgagcgtggagtacgtcattaatttctttctgaagcgccagttaaatctgttctgatgcggtgctatgcccaattaactgtgatagttctgtgatatgaacatgtgttgtatatatgtaatatatattatgtatttaatttcgattgtatatgtatattgtaattaaccgtattgtacataatttgctaattcacttgcattgtcgagatttatacagaatgaactaataattcgactatgtgattaaaaactaccaaaaatctttaaacgattattaaataatatttttcgttgcatttaacttatccattttccctgttacttgcgtttcttaattcttctaattagtgcgtaattgcacttacatacatatttgttagatcgtctaggtgcacactagagaccggacaggatcgggatcccgacctcgggatccgtcccgagcgattttccaaaatgttcgggattgatcgggttcgggatttcatcgggatccctcccgaccatttaccaatcccgcgggattga

SEQ ID NO: 79129 - DNA, 1051 bp, Heterodera glycines
  Genomic contig location: Contig_ID=SeqID_14971; Location=1054..2104; Strand=-
  SCN-specific regions: Sequence locations=1-283,308-606,641-745,767 -946,968-1051
atgtgcacaattggtgatccggcacatctgccagagactaattcaatgtcgaatatattagctttactaacatattgtgctgaattcacatgttatgcattgatttggctggtcaatcatttccgtaatggacaccacggacaatcatttgctggttgagaaaattaattaatcaatttttaattcctttcttaattgattaatttagaattggaaaaaaacaaacgtttattgatttcactgagtgttattatgtcaatcggtctcatctgcttcattggagtaataatattattattttaattatgattatgtttgctaatgaaaaaccctaatttaataatcagaatttttgtcgaagaccaattttggtactcaattatcttttcgagcagaaattaaggggttactttggtcactaattcattcgctgttactgtctattacagttcccatttaagaatactgtattcttttatggcataatgccattgctcagcttcaactttttaacaattgaacactttgtttggcccattagtaatggtctcggtttgatggcattttccagcagtactcccgtgctttttctgtgcaggtggtttctaattcattaattaatgaaaagaaaaattaataacttttcttattttagcaaagaatatcgaaaagcattttgcaaatatgtttgcagaacagaacatggatcaaatgttgttgtgccattgcataatatccgttcttctcagattcatgcttgaactttgttttcatattttgcatattcattcagactcgaatgatgtcatttcatttaatctttttatcagtgatcatattccacttttaaccctatgaaaattgtattgaaaccagggctggccgtgatcacggaaatcacggggtttttggggtgccgtgatctcggatcacgggtcacggattttttcaaattttccgtgattttgatccgtgattggcattttatatagggaattttattgagacgaaaataggaaagtggtgtgaagaaatttttgagaaaaataaa

SEQ ID NO: 79130 - DNA, 1460 bp, Heterodera glycines
  Genomic contig location: Contig_ID=SeqID_14972; Location=1..1460; Strand=+
  SCN-specific regions: Sequence locations=1-281,303-644,673-986,1008 -1386,1408-1460
gatgggtcggcaattgctgtcctccgttcccccgaccgctttttgggtggcgacgctctttgggaattgcgcgacggtgtgccgcccacgccgttcgcttcccccattgaactcggcttcaccgttttcaagcagctgtgtctgtcgcctgatcagagggcgctttactgtctggccagtggtccccggagggcttcttctctgatcagattggacctgtccactgattgtcccacagtctgtgaccaccaaacgattaatcggcgcaacaaattgactgatcattttctttttctgtgctcaggtcgccgtcatccgtgaagcgcgtgcgcactccgaactctctcagctgcccctctccgtcccaacactgatcactttcaccgccgatggccattccctggaggggtatttctacgctcctcacagtcacacgcattgtgcgcccgagggcaaactcccgccggtggttcttttcgtccacggcggaccgaccgcatgcacaaaaaacgacttgaacatgaaaatgtgggtgattgcaatatttgggacttttggcaatccatcggaaggaattcgactcatttagacaatacttcacttcacgaggcttcgcagcatttgacattaactacagaggtgatcagaagaagaagaaaaataaaataaattgatgaaccaattttgggtgcctgagggcatgcaaaatccattagcattgttttggcaaattaattaatcacgctttcccaggctctgccggttttggccgtgagtttcgcgattctctgctcggccaatggggcgtcgccgaccgcgacgatttgatcggcggggcaaagtgcgtgtgcttcgtgccttgcttttcacatcctttgctttggttcatagatttctcatctcctccggcctggtcgacccgtcccgtgtgtttatcatgggcagttccgccggtggcttcaccgtgctcagtgttttggcccactcggatgttttcgccgccggcgtttccctttacggagtgtccgacttgggacagcttgccatggtgccagcaatccaaacaaaatgtcatgaaagtgtttcattttccccattaaggcgtcgcacaaatttgaacgagacaacacaatgcgactgatcgcccaactgcccgacggcatccaaacgtaccgcgaccgttcgcccattcacaactgcaatcgcatcaacaaacccgtcgcctttttgcacggcaccgaggacaaagtggtgccgaaggagcagagcgaagtgatgcacgaaatgctgagagccaaagggacgccgacgctgctcaaattgttcccgggggaggggcacggattcaaaaaggcggacacaattgcgcaatcattgcaaatcgctcactctttcttctgccagacaatggtctcttgagcacttagcaattcgtttttttcgtttttctaatttccatt

SEQ ID NO: 79131 - DNA, 3675 bp, Heterodera glycines
  misc_feature (1661)..(1661): n is a, c, g, or t
  Genomic contig location: Contig_ID=SeqID_14974; Location=1..3675; Strand=+
  SCN-specific regions: Sequence locations=1-15,37-103,132-172,206 -457,487-1054,1085-1346,1385-1903,1935-2166,2206-2473,2497-2553,2576 -3184,3238-3263,3285-3285,3328-3675
  Gene Ontology: Mol. function=endopeptidase inhibitor activity; Cellular component=basement membrane
aggaaagaggggcgtggaaaagctgaaagaccaaatggtactacaacgcattggacggcacgtgcaatcgcttccattacggaggtgcggggaaatatcaatgaaaaaaatttgataaatttaaaataatacccatttttgccaggtgcaaatttaagtcccaagagaaaacttttgaaaattgaaaaaatatttaaagaaatctacaaggggtacggtaacttgatcggatcaagttttgctgttttttgcttgtatccaaatccccaatcccaaagaatttgtctatctgtgatcagcccaagacaacaattctgatcacattcggtggatcaaacaatggcttaattctttcattgtttaggctgtgatggcaatgcgaatcgctttgacaccgaaaaacagtgcaagaacatatgttggaactacaaaggtgagtgagcatttcgtgctaatcattatttcaaattttaaaattaaataaaacgtttcttaaatccgtattgtggatcacataggattggtctaagtgatcgaaagctttgatcagaaaattttgttacaaattcctgcatttaatctgagtgaaatgtctgttccaaagaatagtgaaatcaactcagtaatgggctgataaatgcatgatggagaccaatgctttctgatcagcagattttagcatggacagtgaaagcaaattcgctgtcaatgctctgatcagataaatgggtgatcaatgcttcctgatctgattttaacatagaaacatgaaaccaaaactgatgaacgctgtcaattctgtgacccgatcaaaattcacacaaaacgtgtggcttaaactgatcagcctgatcattccggcactgcgattgactgatcaaaaaaatgataaaatttgttatcgttagacccgtgcgttctgcccaaagtcagcggtccatgtgagggccattcgcgtcgctttttcttcgacctgcacaccaaccaatgcctgctgtttgagtacggcggttgtctcgggtgagcattgtgcaaataattgccagattttcacaaaatatttttttcaaattattaaataaatccatttaaagatcattaataactactgttatgaaaaatttttgggtccgatacggcggcgccgaaatgtccctaagttgtaccaaaaaaaaaatatgacccattttttcagcaacagcaacaatttccacacgatggaggactgccaggcgcggtgccgtccgaccaggcccatgccaattggtgcgtgatgcgatacgccaaaaaaaacacagatattttgaatgacggacgacacactttgcctcaaaaaatttttgggcatttttaattttaaaatttccttttttttttaatttttgccatttttttttgctaccattatatggaaaaaaaacattcgcaaaaacattctgccatattgttattcccatctattttttttctctattcatgttgcgcctttccaattaaaaattatttttttcgtttcgaaataaaatttttcaaaatttatttgccaatttttggatttgccgttttttgctgtctaaaaatttttccaaaaaaagtactaaaaataactaaccctttggcctttgttttaattttttggtgtgtttttaacaaaaaccttnaactgcaactgatcaaatgcgataagctaacttcaagaaattaaccgattaaaaaagcgctaattcttattgattgatcaaaatatgctaacttagccagataaaaaaactgatctgaccagatcgcgcagagaaaattttgtgtgtgccgttccgcgctaatgcattcccctccggcacttttgtagttgccactaccactaacccatggcctatccgcttgactcgcgctaacccgtcaacaccaacaccagcagcagcagcagctgttgaactgcttgatcaccgtgatgggattttggccattgacaacaacaacgaccggctgatcagcagcaacagtgaccaacagacgccgcatcaacttgatgctgctgatcaacaaagtgatcagcagcaaaccgctgatattgttggtgataaccggagtgatcagcaaagtgaatggaaccaaaacggtgatcaaaagccgagtgatcagagtgaggctaatgatgaccagcaggaagaggtggagattgaagagggggaagaagaagaagaactgattgttgtgcctcgggaacaccttctttacggccaactgccaggtaaattgagtaatgatttactgtattaccgtaatcagtcagtcaactgcgagaaatgggcaacccaaaaacatgtccaaaattttttaaaaatctaccgcctaggtcttagcctgaagtcattccaaaaaacttggtcacatctaaatttttctaaaaatcctaccgcctaagtcatagttctgctgaattcaatcaaaaaaaaacaaccttataacctacaaattttcaaaaattttgccacctcccaaattccagaaaattccatctgtctgggccctagtctgcctctcaatttcaattttccaaaaattttacaaaattccccctcccccctgtgttgaagagttgtgcctgttgccggagcagcgtggcacctgttttggtgagcagttgcgctaccgctacgacgcgtcagtgggcgactgtgtgggctttttcttcactggttgtgacgcaaatgtgaacaactttgactcgtacgaggcgtgcgcacgcgcgtgcggtgcatggaaagcggacgcggtgtgcgagcggtcgccggacgcggggcgcgaccgctgcgacaccggcggcggcgaccatggtcagcgagttgagtggcgacagcgcgacaacagtaacatggcaggcggtatactgtatccataactcagctcataaatgatcagaaacgaattaaaaatttaaaaaggatattagagggaggaggattagcttatctcgaaatttgacatccataagattaagcataaaatttttgatttttcgaattttttgcgcctattttaattgtttatcaaatttaagctctcatagtcatctaatcataaaaaatgcaccaaatgttacatggttagtggagagattagtagtactaactactaagacagtattagcttaaactgacaaatttcggctgtgtaactttgcttaaaatattttaaatttttcttttaattttttcaatatttctaaaaattaatcgttcttctgaaaatgttcagaactgcactaaacattacatgaaaatgataattttaaaagattttgattataaatgttaaaaaatttttggcattttgttgccaatgtgttcgaaccgaaaacttcagccaacgtgccaaaatggtattacgatgcagcgctcggcaaatgtggcctgtttttctggtccggatgtggtggaaatgggaatcgattccaaaggtttctcggggaaaatttaaaaaattcaaaaatttccaccccctcccattttaaagtaaatcggagtgcgaaaacttgtgccgtcgcgaaatgttggcaaaaacacaccaaaaaagtgacatgtgcatgttgccaatggacgcaggaccatgtgccgacctagtgacaatgtggtattttgatgccgtacaacagcagtgccggaggcaagtaca

SEQ ID NO: 79132 - DNA, 740 bp, Heterodera glycines
  Genomic contig location: Contig_ID=SeqID_14975; Location=1782..2521; Strand=-
  SCN-specific regions: Sequence locations=1-464,486-687,709-740
atgcgtgactattccaaaacaaatacaacaaattacggacttatttctgctaccactgcgcggcattgccctgacaatcgtgaaccatataggtattaacagaaatttttttttgaaaattctgaaatttgcaaaattttcaggaatccggaaactggcgaactgcgcagctgtggcactgctgcagcgctgcatggcgaccttgacagcgtgcagcatggcatatgcccgtcctcgttcgtttgcaagcgtgacgtgcagcgacgaaagcctgcaacaaaaggggaggaagcgccgcgcgtatgctgttcgccaatcgcattttgccctgatgcgcgactgccgcaggtcgacccccgcactcggcatgcaaaacggtaagactactttaactaccgtaatccatttaattgagaggcgaattactgtgggtacggctcaattatactgtaacaatatcccaaattttcgttatgtctagctgtttgtctgctgacgtcaaagcatcgccaactgctggtgcagtgaaaaggcatcaccattactatggcgatagttacaatgattatggtaactgtaccccaccgtacacctgccagccgtctaccgtatccggcatttttgtgtgctgtaaggtgccaccgatgacgggaatttaaggtcgtaattacatgacctctatttcgacccattaaattttttgtaaatgtatgccaggggaggttattcaatcgaataaa

SEQ ID NO: 79133 - DNA, 414 bp, Heterodera glycines
  Genomic contig location: Contig_ID=SeqID_14980; Location=1967..2380; Strand=+
  SCN-specific regions: Sequence locations=1-258,285-414
atgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccacagcgcggcaaatgtcgtcgcacaaaaaatcaccaccggcattaaactcacgtgagaattttttaaaattaatttttaaattctcaaatttagcgtttcaaaacagacgcagcctttgcacgagcagccaaaatggtcacttcgctggcgttcgtgccgctggcggaccttacacccgcgttggcagcactagaagactatctaccaaatga

SEQ ID NO: 79134 - DNA, 715 bp, Heterodera glycines
  Genomic contig location: Contig_ID=SeqID_14980; Location=1..715; Strand=+
  SCN-specific regions: Sequence locations=1-12,34-715
  Gene Ontology: Mol. function=transporter activity; Cellular component= integral to plasma membrane; Biological process=transport
ccctttctctcactttttcaggtgctttttcactttgactctcgaccaagtgccaatttggggccttttcatcaattccgttctgctcgggtctctctccccactttccttcgttcgttcacttctctccctttctcagtttctttatgaccggctatttgccgttgggctttgaatttgccgccgaattgacctttccaattgccgaaggcaccacttcgggactgttaaacggatctgctcaggcatttggcatcggaatgacttttggcatgggcttggtaagtgttggcatcggttttcttcccattggcactttcgctggctggcctttcaaggtgatgcattccctgtcgatcctttggtgcaatttgatcatgtccgcattccttctgatcggcttctttctcaccggttttgccctcacatccttccatttaatcttacccaataaatccctctcaatagcaattatcaaatcggatttgagaaggcaaagggcacacaaccaacagcaggcatttttattggggggggggggcaaagaattcttttgtttattttagcgaacggaaactcaagacacaacgcaacctgatcagtgatcagaccgagggccgataaaattctctctaagtcaaattctccaaaggaaatgatctcccacaaacccaatgaattaataacgacagagataccaattaactctcattcg

SEQ ID NO: 79135 - DNA, 1148 bp, Heterodera glycines
  Genomic contig location: Contig_ID=SeqID_14983; Location=623..1770; Strand=+
  SCN-specific regions: Sequence locations=1-93,115-120,142-145,169 -712,748-940,1016-1148
atgatgcgctgcattgaggacatgcaggagcaagatgagcagacactgcgcaaatcggtgggcattttggcaatttgtccacgcccctttttattaatccatttatatatatttagtctgtgtattttagaatttttaattggactatttatttataattaattaattgccaatgtaaatgttcaattatttttaagattgaggaaaaggccttcgaattggccgaacttcgcaacgacgagaaaatgaaggtggagagcaaacgggcccagctgatgggcaaacggtgtgtttatttggtgtgttcatcgtggcatttctaattttactttttccccgttagtttcgatttgaaatgcgcctgcggcactgtgatttgctgcagtgaccgcgtccgatcggtgatgggcactctgtttgtgtgctgtgaccccaaagtgtggaggcgatcgaagcacacgctgacacgcgccccaacggtggggcggggatttagaaaaacattatttattggagcaaattgtcgattgtgatgtcttcgaatgctttaaataatcatctccgtgtttcggcatttgcttcgctgtccaaaaattgtgccaacttaagctcgtttcaatcacagattgatagagccattaatatagcattggttaatagctctgatcggaagtgattttctcacccgtctttcatagattttctttggcagaattatattattattattattttatttataattttccacgctttaagaaagagaaattctacacaaactgtgcccgttgggagtgcgcaaattgtggcgaacattggggccaaattgtcaaattttccaacgtgtttttgcccgaaattcgcgtccgcgcattcatattggagcgagtggatgaacaatggtcagcacagcaaaacaacagatggaaatttgcacaacaataaatatttaattgtttatttttaatagtaacgaaaataaattttattatttttatttaaattttattatttacaattagccaaaaaaaaaaacacttttcagcagtcaattcgaccgaaacgaagtcgtgtgcaaaaagtggaaggacattgagcagaacaatttcaacgtggacgccattagcatggcggacatcgtaaattga

SEQ ID NO: 79136 - DNA, 1664 bp, Heterodera glycines
  misc_feature (447)..(447): n is a, c, g, or t
  Genomic contig location: Contig_ID=SeqID_2325; Location=99..1762; Strand=-
  SCN-specific regions: Sequence locations=1-122,145-216,238-424,446 -674,740-772,797-1095,1118-1121,1143-1664
atgcaaattatgggcgtgcttgccaatggacacttcttacccgattttttaaactttaaatatgcaagcgcacctataatttgcatttttcatcgttttttgacttttagactaattaaaattgtaaaatttgctaattttagggataaatctgttaacaatgttaacaaattgcactcaaattttcaattttacccccggcggcgcctatcggcacctccggccccccaaaatttattatttcgtaaaaaactggctcaaattcgcaaaatttggtcattttttggacaaaatcggtgcacaaataagactcaaattttcaaaaaatttttgcgatggcgtctatcggcgcctatggaccccccttttcccaaaaaaaaatttttggaaaatgataccacaaaaaaagtttaaaaaaaaattcgccgccaaaaaattttttcttanaataaaaattcacggtcacgaaacccgtgaatttcacgggttttttggatcacggtcacggtcacgattcacgggacctattcacggtcacggttcattggtcaattcacggtcacagtcacgattcacggttcacgggttttttcagtcacattattggttcgtaaatttaatgcgtacaaaaaaaagcaaactggcaatattgtcattatctaagaaatttaccctaatttaaattttcaaatattaaatattattggaatttaatttaaaaagtactaaaaatttaattggatttataaaacaaagtaatgaaaaaatgataaaactgacttttttggcctttaaatttgaccaagctcacctgggttaagccaaaaaattatatttaagttttttcacctttaacattgggtggtgtgacctgtttcgatcattcaaatgatatttaaaaatattttcaatggaaagattgataaggattcgaaattcgaaaaaatcaaaaataaattttcagtatccggaaattcattcgctgcaacgaatccaatcaaattgggttccactgataagattaaaagttatcaacttccatcacgaaattgacattgtattcgcatcaattcctggcgaaaaacaaattcattttaatgatgatgataattatgataatgacggtgaccaatggcagcaaaatattttgtcaaaaattgaggaaatgattgaaaaattgggcaaccaaattggagcggtagaccaagaaaccaaaatgcaaaaagatgatgacaaaaatgatcaatccgttctaataaacacgaaggaacaaatgcttcgatcgctccgctcactcgcgggtaataaattactgacacttcacaattatcctaattatgctaattgctatgattaagggtttcactccaatcttcgattgtttgacatggtcacagacaaagaaaattttcaaaaattgcttttgacgcttaaactgtgggcaaaatgtaagtattttacatgaaaattttgatttgccatacggtattaagaggtaaatacggtcctaaattaccgtttttagctcattatatttacaacaatgcgttgggtttctttaacggcacatcattggccattcttgcagcaaaaattatgcttctctatcccgatgcaacagtaccgtttttgttggaacgcttcttcctcacttatgccacatg

SEQ ID NO: 79137 - DNA, 1439 bp, Heterodera glycines
  Genomic contig location: Contig_ID=SeqID_2325; Location=4218..5656; Strand=+
  SCN-specific regions: Sequence locations=1-169,200-663,685-754,779 -815,837-898,939-995,1017-1373,1395-1409,1431-1439
atgtcaagcagttttggcgtcttcaaactgacggacgatgacgcaatgaaatttttggtgatcgaatcgcacatcggcaccaaaaagatggactaccaaatggagcattatgtgtggaagcgtcgatcagacggtttatttttttagtctaaatttctaaatttttttggttcctccaattcaaagtttcatttcagcaacgcttcgtcgcctttttcgagaagaaggagcgcggcgtggacatgcacgcgagcatcaaacggcgcaaggactacatcaacccggcactttacgaggcgttgcgcaacgcgtacggcatcgacgagaagggcacttacttcgccgtgccgtgtacgacccgaacacatttcgctgccgacgacttttacaacgcattggatgaggtaaatacggacggagtataatcgctcccggaagcacccccccccccagtttttgaaaaccaactgtagctgctaaaaacctggatagcgttttttattttcgattaattatcgattagttaaaattaattattttggatttgaacccgtaacatcaaaaaagatgtatttaaccaactgagccaccaattctgctcctttttcggctctaacgcactttatgaattatttagagctatatcaattatatcatttgaataatatagacaatacagacataaaacgtatacacgaaatgaggaatcagagatggcagattctcggggggacgaactgtccaagtgaatcaattgtaaaaaacaattaaaaatcttaaagggttcactttgaacaaggaaagtgcaaaatgatgtcacttaaaatataatttacggatgcaaaagacacaatttgctcttgtgggtgaagagtatcacaatggctttttgggaaagggacggacaatgggaaaaggagaaaagacaaaagaaaggaggggggggggggaaggggtcgaaagactgttttaatctgtgctgatattctttaaagggtcgttttcggctgggggtgggagaagctctctctctgctaattgtcaatcattagagcggctgcagcaccaccttccgttccgcggaataggagggcggtacgaaagggttgttgccgctgtccgtgccgttgtccgttccgccgccctgccgcacccccgcgccggtcgcctgttgttgttgctggtggttgtgctgcgcgtgcatctgctgctccgtcgccattccgccgccaagcgccgcgacggcggcggcgccctcctcaaagaattcgtattttgggtagccgaggaatttgtgtgggtaattgttgttgttattattgctgttgtagaaggccatctgttgaattatacaaaggctttgaattaaatggatttgtttttgaaatgattttaaacatttcgccaaaattatttattttaatgccaaatttaattca

SEQ ID NO: 79138 - DNA, 771 bp, Heterodera glycines
  Genomic contig location: Contig_ID=SeqID_2326; Location=786..1556; Strand=-
  SCN-specific regions: Sequence locations=1-124,146-184,206-503,525 -570,593-771
atgctcgcgcacaccgacgtccgttgttcggaggtctcccgcgatgagtgggttagtcgtccacattatctcgcggtgcaggtgcagcaccatctagtaaaaagcactatgacccgacccataaaaattcattttcaaattttcagactttaaattacgatgaattgataggaaaccaaaatacatattgaccccaatattcctttttagatgtttttctaagattttcatataatgaaataacctccagtgttagttcctttgcgtatatgacgctagtgtttaaaatgtaaaaataacgcgcatcatgctcaaaaagagagcgctggtcctcccatatgaattaattctgcttgtgccaaatttgccattattatgcttaatttcactttcaaaaaagtttttcgtttgattactatccatactaccggtttttttcaataattaatcgctagaaaaagccttcgaacctccatttctgacagggaaagaggtgggtggggcattaaaatgaaacaaaattttgtcgacgacgggaataagcaagatggaaaaaagccgaacaacaaagacgatggtgctgcagaacgacgcgttgtacacgctcaaaactcgcggaacgaccaaataattggaacgccaaggtttatgggcccattttagcataaggatttcagagggggaaagttcaagtctaaaaatgagcaaaaaatatccatgaatttggttgcactccgtcctgtgaattttttaatattgtcagccaataaa

SEQ ID NO: 79139 - DNA, 100 bp, Heterodera glycines
  Genomic contig location: Contig_ID=SeqID_2326; Location=2393..2492; Strand=+
  SCN-specific regions: Sequence locations=1-100
atgggtatttctttcaaggttactgtattttactcaacgatttgagcataaatttttccaggtgccggaggcaccgccgggtcccaatcaaaatggctaa

SEQ ID NO: 79140 - DNA, 1033 bp, Heterodera glycines
  Genomic contig location: Contig_ID=SeqID_2327; Location=206..1238; Strand=-
  SCN-specific regions: Sequence locations=1-661,694-746,793-881,903 -1033
atgctcggcccggcattgttcaaaattcgttttccactaatcccaaaagaggatttcacaaaaggcgttggtaataaattatatatgatgactagagaatttggtatttcgaaaaaaatcttggacctattctgatttcaatgttgggcctggacctgaatttttggacaaatcccagaaaatccaagtagtgcgaatccgtgatttcaagcctgggtccagacttggtctggaacagaacaaaactaatgattcgtttcataatgtattaattggctaattaattatccatttaaatcaaacttcagtttcaactgatgtgttaacaattaaagaagtgatcagcatttatcagtactattccaatccaaagttaagtgatgtccaggcgcttttcccattgaaatttcccactcaacaacggtacaaaaagggagaaacaatttcaatggaaattgaaaaagtgtccgaatttgggctggagccggttgaaagtcgacttagcgatgccgtggacatttggggattttcatggaaaatatgggcacaaatcaaaacgaaagtcggaaacaatgagaaatggttgggattttacctttacaatgatggccctgaaaaaggtgataaaaaagacactttcgtaaatctgtcagtagaaaagataaaaaaataattaatttcattaaaaattatgaaatctttgttttaagctgaattacatttactcgattctttttttctagaggttttattaatacaaaaaatgaaaaaatataaaatattgtaaattttggttcatttgttcataatgaatgcgttaaggtaattattaagtttgatgggtactgtacttttcatatatatccatttatcataaattcttgtgttgaaaacactttgttaatcttggattttcagggtcgcgatcacaatttcgatatgggatagacttgaattcgaacatagtttaaagttgaaattttccaaatttcaacttttgggtctaaaactgtctaaaatgcatagaaataaa

SEQ ID NO: 79141 - DNA, 357 bp, Heterodera glycines
  Genomic contig location: Contig_ID=SeqID_2327; Location=1..357; Strand=+
  SCN-specific regions: Sequence locations=1-336
tatgggcttttcaaggtcgctgaccatgacaagatttttgtatcgccgaagccaaattcgaacaataagtcttaaattcgaaaatctgttttttacccattaaatgatcgttataaaaagttaaaaggaattacttgtttcgggtttcaatttttgtctaagatttatctacatgatcgcttattatagtattggcgattttcaatttatttctatgcattttagacagttttagacccaaaagttgaaatttggaaaatttcaactttaaactatgttcgaattcaagtctatcccatatcgaaattgtgatcgcgaccctgaaaatccaagattaacaaagtgttttcaacacaa

SEQ ID NO: 79142 - DNA, 353 bp, Heterodera glycines
  Genomic contig location: Contig_ID=SeqID_2327; Location=1390..1742; Strand=-
  SCN-specific regions: Sequence locations=1-203,226-353
atgccaagtgcccgcacacttcgacgtcaattcttcggagttcaccggcaacaagggggttagttgtccacataatatgtttgtgtaagtcgaccagcatctaaacaatgcatcatcatgaccttgcccactccataaaaattggaaacaagccccttgtaaaactttcaatgcttttacggcgactctaagattgtttcttcaattttttattaaaaatattttcccaatgacttagaaattccagatgacctcaatttggcaaattccctggctgtaattttcgtaaaataccaaaaataatgcactaaatcgtgctattttggattaaatagaccatttttacaaataaa

SEQ ID NO: 79143 - DNA, 154 bp, Heterodera glycines
  Genomic contig location: Contig_ID=SeqID_2327; Location=3650..3803; Strand=+
  SCN-specific regions: Sequence locations=1-154
attaatttgaatcaccactcaccgcaaaactaatgaaattgtgaaatccacggcttatatttttattaaaaatgcgatcaccacttcttccaattaaattctcagtgcctttcttttgagaaataattcgaaatattcccgaacttttacaaga

SEQ ID NO: 79144 - DNA, 66 bp, Heterodera glycines; identical to SEQ ID NO: 53774
  Genomic contig location: Contig_ID=SeqID_2328; Location=1157..1222; Strand=+
  SCN-specific regions: Sequence locations=1-66

SEQ ID NO: 79145 - DNA, 2216 bp, Heterodera glycines
  Genomic contig location: Contig_ID=SeqID_14985; Location=405..2620; Strand=+
  SCN-specific regions: Sequence locations=1-135,157-165,188-420,443 -579,603-877,899-905,930-948,977-1119,1141-1210,1232-1275,1300 -1347,1384-1398,1423-1424,1453-1511,1534-1735,1759-1870,1895 -2124,2166-2216
atggttgcccttttgtaccatttccaccctgaccaacaaatgccgaggatgctttacgactcattgcaattcccaactcacagacgggcaacatatgacggtatgatttgattgggcaagatttttcatttatattattagtttctatctctgaatttttgatgaatttaaaatattttgttaaaactctattgatcaactgtattttcatcatctttttttttttcagtaatcgaattttgcttctcttgtaagaggtgacagcgaccaataaaacttcggggttttcgtttgtctcggaaattcggctttcaaacattctacaactttccctaataggatgaataaattaattatgcatttttcagaccccaacaaacctcagggaacgctcattatggaaatcaaaaaattctctgaatttttgaaagaaaatgacaacgttacacgtctaagcgatgccgtagtttatatcacggcacttccatggcgattaattgtatataaaaccaaacacagtttgatgtttgaagcgaaatacgacacggcacaaatgagtgggcaaattagccaaaggaaacaatattttaaataaattaagctttgaactacaaatgcccttattcgacaacgtttcgaattgcttcgcaaaaggagggaaaaacggattttgttaagaagaaaatgggcaaaattggctcggatgcatacaaccgatgtacatttagttatatttcattgtcggtatgtgtaagaaagcaaaaaaaaaaaagaaaaatttttgagaaatacgttttcaaataaaatttcgtgaatatttcgggtagcgcctatcggcagacagtaaaccatccgcggctttattttttgagttaaaatgctccaaaaaatgaatttttgctgtgaaatttttaaaaaatttaaattttcgctctgccgtaccctttgtataaaataaaataaataataatttatagaaactgatgtgcccggacaacggatggtacaataaggaggaggacacagtgaaagtgacggtggaagtgaccacaggcgaactttgcggggaggaaaaagcggcgaaatgaaaagaatgaattttattttatccatcccatacaattaattgttttgtgtcggattaaacgcttttcctatacaacatttaattacagtaacctgagtttttttttgccgaaaaaccgttatgaaaagaaaattacagtcaaagatggtaaaaagcaaaacaatttttggttacattgacgcaaatggaagaaataacagaaaataaaatcaaatttcaaatatgcaataaaaatttgagatttatgtaagaaaagtcacaaaatatctaataaaatattgaaataaatatttatacacgcaccaaatgtcctaaaattagttctcaaaaacctcaattttaacaaaaatgaaaatatgtaaaaagtgcgaaatattgacaactatgaacataataaatatgtacactgagccggaaaattggttatagaagaaaacttataatttttagcgaaaaaacgccgcaaaaattgaaaatttacatttttgatttatttttgacataaatttaccaattttcgagaaagtttaaaatttttacgagaaaattttttgaatgttttttaattttccgatcataaaggtcgaaaaggctaatttagcttatggggacagttcaaatagatgatattcgaaaaatgccaaatatggatataaataataaataacaaaatgtggaaacaagaattttcaataattagcattctaattatattcagaaaaagaatttattaattatatcaaaattaaccatcttccagaaacttatacatatttgcgaaaatgaagcttctcccaaaaaagcaaccaaattaaggaattgttggacccgagcaaaggattttacaacaaagatgaggacaaagtaaaattggccatttatttcattgtggacgagccaaaaacagagaaatttgtttccaatccgaacaaatccaacggcacactttcgatggaaattgaaaaattatcggaatttgcgcgagaaatcgaagaaagtgaacgtaaaagcgaagaaactgtgtatataaagggaatgccatggaaaatatgggcaaatattaaaacaaaaaatgaaagcactgagaaatggttgggctttttccttttgtgcgacgcttctgaaaaag

SEQ ID NO: 79146 - DNA, 990 bp, Heterodera glycines
  Genomic contig location: Contig_ID=SeqID_14986; Location=804..1793; Strand=+
  SCN-specific regions: Sequence locations=1-239,282-353,378-541,563 -572,594-862,904-990
atggacaaagacattgtgccaaaagaaggaaatcgctttaaaaagcacttcgacccattgactaccaaagaaggtgggctttgcataaaatgacatcattatttaattttatcctaatttgttaaaaatttaagcaaagtcttccgtcacttttcgatccaccgaaattactggtgattattttgttctaccataacgatcaaaatgggctttggataatttttgaaaattttttaccgaaaaaatttaattttctattttattttgctttaaaaatatatgtcataatgtgcgaccaaattttaacaatggatttcttacaaattatggtcctaaagttcagaattttataattttttcaaaattctcaaagaattcgctaatttttagcccatgaatatttggatttttcattgtttcgtttggtgccaccgcatttggtggaccctggcacaattgtggtgaaaactgtgcgacagccaaatgttcttgaagagcacaattatcacaagcggccaattatgtacattatcaatcaattaattataaaatcaatcaatcatctcacacaagggataaagccaaatgccttatttttgacataaaaattgaaatttgaatttcaaaataattaaatttgtgtagcgatcgttcgctgccatcggtgccaaatttgcctctctttcagcaaaaccctggtcagaaaacggttgtattggctgcgttctccctccccaacttttgctgattctgatcactcgcaaaacaatgaatcgtcgatagaatcagcggcgaatttgcatgagaatacggcgacggaggagagaccgcgcgcagaaagttaggcaaaattttcttttggaaattttcgtgttttcctttaaatttaaaaatttaggggaagaattgatgttttgtaatccattgataactttcaaaatttaaagatttaataattaatgggcggggaaaacattcaaaaagaagcga

SEQ ID NO: 79147 - DNA, 263 bp, Heterodera glycines
  Genomic contig location: Contig_ID=SeqID_14992; Location=967..1229; Strand=+
  SCN-specific regions: Sequence locations=1-151,174-263
atggtatccacacgcagtaaaactgataaattcaagaaaatgggaaattcaagtactgaagcaaagcgaaagcggaaggaatggcgccaggagcacgcaagaaaagctggatcaacaccaaaaagtgatgaaattttgataaaatttcatttcaattaaaaatcaaatttttacaggtccacgacaaaccacaaaagctccatcaacaaccggagagggaacatcgaccgagacaatgccatcgactttgaatgccgagcccc

SEQ ID NO: 79148 - DNA, 330 bp, Heterodera glycines
  Genomic contig location: Contig_ID=SeqID_14993; Location=44..373; Strand=-
  SCN-specific regions: Sequence locations=1-127,150-330
atgaaattcatacatcaattgatatacgtagtgcgaccaatttacggtaagttgataaaataagtctagtagttaatagcgctgttcgagagtctctgtattaggatgtgcgagaaatgatttttaccgagaaccgagaccgagaccgggaaatgaccccgggaaacgatacgagaactgagaccccaaaaaacccgagaaatttctcgattcgggaatcgagaaatctaaaattttttagccgtttttcaccaaaaattactatttttgccattttggtcaccatttttcaacaaatatggtaaaatgggagtccggcagtgccgttag

SEQ ID NO: 79149 - DNA, 163 bp, Heterodera glycines
  Genomic contig location: Contig_ID=SeqID_14993; Location=1131..1293; Strand=+
  SCN-specific regions: Sequence locations=1-118,140-163
cttaagttaaaaatttaagaaaattatattctgaaagagaacaattaaagctattgaatgataccacgaaatattaatttggttgaatttgagccaagctattaatttaattattttacccattttttgttttcaaacccattggcagttttaacaaacgcgc

SEQ ID NO: 79150 - DNA, 207 bp, Heterodera glycines
  Genomic contig location: Contig_ID=SeqID_14994; Location=246..452; Strand=-
  SCN-specific regions: Sequence locations=1-207
atgaataataattgccaattaattttggttttatttttttcaaaaatatttctcggaattttctgtgccaaaggaggcgattctcctgtggaaaaagatgaaaatgttgccccaaatgatgacaaaaaatcatcactagcatcaccatccacagcagcagcagaacaaattgatgttgatgagaagaaagaattactgaagaaagag

SEQ ID NO: 79151 - DNA, 225 bp, Heterodera glycines
  Genomic contig location: Contig_ID=SeqID_14994; Location=1..225; Strand=+
  SCN-specific regions: Sequence locations=1-19,41-129,151-173
tactccccgacgaggatggttcagtcatccccgacactttttcggggaatttactccccgttccccgacttttctctccccgagggtcaggaaggtggtatgggcgttgtctttagaggttttcccatttcttttatcccactttctcccacactccgcttccttttggcaccaaaaatattcaaaattaaattattattattattataataagttatttttatt

SEQ ID NO: 79152 - DNA, 155 bp, Heterodera glycines; identical to SEQ ID NO: 51421
  Genomic contig location: Contig_ID=SeqID_14995; Location=436..590; Strand=+
  SCN-specific regions: Sequence locations=1-155

SEQ ID NO: 79153 - DNA, 1658 bp, Heterodera glycines
  Genomic contig location: Contig_ID=SeqID_14997; Location=99..1756; Strand=-
  SCN-specific regions: Sequence locations=1-288,312-574,597-678,700 -759,781-951,974-1144,1166-1243,1265-1506,1530-1632
  Gene Ontology: Mol. function=cell adhesion molecule activity; Cellular component=cell-cell adherens junction; Biological process =embryonic morphogenesis
atgccaattgctttcgcagcagagccaagccgtccccagctggtcaaggagagcatcggcgaagaccatttcaacatcacatttgtgccgggcgctttcaacgaggccagcggtgcgccggtgggcaacgcgtttttggtgcgctaccgtgaggcggacgacgaaacggcgccgtggcaggagaagcatccggtggacaaatcaacgctgcaggtagtccagcagttgtgtgcgcaaaaacgttgattcctaatgagttctttacttgactttttttgatcacggatcaaaaaatccctgaaaaaattttttcttgaaaatttcgggagaggaacgctttgcggccggaataactaactccccacccttgagttcgaaatcggggcctaaaaacacgataaatttctctcattcttgtttgaaacacttaatccgtcttttgctgatcatcgatcaccaccaatttctttatacagttaacagtggacggtctgacgcaaggcaccaaatacgatgtgaaggttgtggcggtgcaacgggacgaggctggcagcacgttgtccagcaccgagtcgcgtgtccatcacatcacaacggcgggagtttgtaagtgctgtgattggcatttgaacatttttttgttgaaaagggatttttgccgtttgatcactcacttcaattttaaaacattttgaaggaagttttcaattaattcaatatattagtggttttgatcattttggaaggtttatatggatcatgatgatacatttcttcaaaagctttctttgttttctgaccagttcttgagaattatcaagtaggatggatcttttcactaaaaatggaaatttatcgaattttttttttgaaaatttgaatgtcaatcaaaaattcattcctttccatcgtcagctccacgacgtgccaccctctactgggtgctcgctgtgctgctcatcctgttgctgttgctgttctgtgtgtgcgttgcgtgctgcttggtctaccagcgtggtcgcaaatatccggtggcggagaaggagcggttgcacgggcgggagccaatgttgcccaaagagcgtcaatttgaggagtttggaaagtgagcgagtccgtgtttggaaaaaatcttttctgatcatcagaactcagatatttcaccaattcatccgacaaaaaaaaaacatgggattatggcaatctaaacttagggcatcgatcagtttataaaaatcttgaaaatcattgaaatttttatatccctgccttataaacgaactatttttgcaggggagaagagacgaatcgttcactttccggacacgtttggggcggtggcggagagtcggaatcggtgcgttttcaacaaaaaaaaagaagattttttctaatttgtaaacaattaaaacatttttaaatgggctcctttaggattcattgaccgaatttggcactgacaatgaccgggggtacaatgaggacggctcatttgtccgtaagtgcttttttaattataattttttattgaaaaacctctttttattcctttttcagatatgtacgggccgggaagcaaaaatgccggtttggccaccacctcacagccaaccgttgagtcatcctcggcaggcgcacagcagcagcagcagcgatga

SEQ ID NO: 79154 - DNA, 744 bp, Heterodera glycines
  Genomic contig location: Contig_ID=SeqID_14999; Location=1563..2306; Strand=+
  SCN-specific regions: Sequence locations=1-280,302-310,333-344,366 -515,537-744
atgtctgctaatatttctgaaaaggatgaagcattgagcgatctcaactgtctcttcgttcaaatgaagaacaagaagttcagcttcagtttgatgtcaaaagtggcacagaaatttggcgatggtggagtcgccgcaaaagtccttctgccatacgaagtgtacaaagagtgagtcgcgtcgaggatgggattcaatgcgttcctttctttttgcctttagggctgtcgatcttttggcttccgctcgctttgaaattgattatcgcgtggtgatgtacacttttgtttacttttttcttggaagaaatcgcccttttcagtcactttcttcccactttcaaagccattttcctccatctcagttttgacgattggcaattggcgatggaacgtttttttgagatcacagaattgcgtcagactcatcgaggctttccacgagaggaaatgcacacgctcagtcactcatattcggtaataaaacattaaaactgaaacgctttggtccgtcgtttctttcttctctctccgcttttattcttcgcttactaagtttatacctctgaaatgcgtttgtttcagcttgctttgttggaaaatgccaatttcaacaaagaaactgacaggacttctgagtttctcttcactgactatggagacttggccaatttcattgacaattgcttcgaatgccaatgccgtcaattgtcttttctcattttactggagggaaaagcgttga

SEQ ID NO: 79155 - DNA, 1970 bp, Heterodera glycines
  Genomic contig location: Contig_ID=SeqID_2329; Location=1..1970; Strand=+
  SCN-specific regions: Sequence locations=1-8,32-1583,1720-1923,1945 -1970
  Gene Ontology: Mol. function=cell adhesion receptor activity; Cellular component=extracellular matrix; Biological process=cell adhesion
ttcatttacattcattcattcatttccctttttccgtttaagtgccaattccgtcgatgttcaattcgcctccgtttgtcgcaactgcacacttttgatggagaaagatgcgcctgaattgggcgaacacatcatagaaaagggatgcgcagaagtggacatttccgcggaggtaaaaaattaaaaattgccaaaattttccaaaagtgaattttaaaggcggaaaagccgtgccttggcaaagggaaaagtgtcggcggacggtgccaatgcgaacagggcttttccggggaacagtgccaatatcgaggtgggatcagacgaaataaacccattgggcgacaggagggggagtgctaactaacgttcccaccagatgactgtacggaggacggcgactgtggccacggagggcgttgcgtcgcgggagccattcaccacgggcaacggagctgcttctgcccgtttggcttcattgggacgaattgtgaacgaagtcactgacccggggggggggataattgtggctgaaaaacggcgaacattctcagaatcgagcataacgccaaaggacacgcactgtttcgcccacggggggccacggaacggaagtgccaatggcaatggcagcgaagtgttcatctacggaatattcaacccgaactgttactcgtcgagggagctcaacgaggacggagaccgaatctattggcgattggtcggcggggaaagacggcacagccaaagacaatgccaacaattccaataggtgggcaatcagttggaactgctgctcgacttccgcaccaactcgtggctgtccctgggctggcgtcccctcaacatccctccttcgtgtcgactctttccccaaatgcacggcacggcagccgaaggtcggcacggggaggacggagtgcagacgagcggatttggttggtggtgacatggccaacaaatggccattcattggctgccaattcagcaaagtccgcgctgagtttgcctttgcatccaatggactgcaccgacgtaataatggcctcggtgctggagggcaccgaccttttgcacattgccgacatgtactctcgagatcggtcgagcccgttgcgggacgcgtggttagacggcgaagactctctgtcggcagcctacggattggcaaccgacgacggacggacggtggtgatgttccgtcggatggtgcccggtcagaaatcgaatttggcattccattggcattggccttaacccataattcaaatcagaaatcgaacccaccgaccatccgttgggtcccggcgaattgtttctcatttgggcaaaaggtcagccgaagaagccaaaggacaaaggcttttattcggacggccaatggaaataccacggaggtgaaaattggaggggggggggaaattcggaggataaaaatgccatcaaacgaaagacagcggcagcggacgagggcacatgcaaatggaattcgtttcattggagcaaatgggaaaaattcgggggcccctgattcatttggacccgccgcaggggccgaccaacacaagcgaacaacgaacagcagagaaagggtgggaggaagaaggaaaagcaatgccaacagcagaaagggtaaaaaggggaaaagcaaaggaaaaaggaaaagcatgaaaaaggaaaagcaaaggaaaagggaaagcataaaaaaggaaaaataaggaattaaaaaattaaatgttcatcaggtgactaaaacaacaattgccacgacttcgtcagtgccaacaaccgaaagtgatcaaacgacaaaagtttcatcgcccgaggcaacaacgaactcaaaaagcactttgacaacgcaaagtcaaacgacggacaaagaacaaaatttaacgaaaacagaagcaaaaaatgaacaaattcagacagaggaaaaggaggaaattatgcaaaatgaaaaggaaacgacggca

SEQ ID NO: 79156 - DNA, 3846 bp, Heterodera glycines
  Genomic contig location: Contig_ID=SeqID_2330; Location=1687..5532; Strand=+
  SCN-specific regions: Sequence locations=1-23,47-134,156-240,262 -380,402-477,507-1073,1096-1361,1383-1927,1949-1972,2078-2788,2925 -3128,3150-3181,3210-3250,3274-3380,3423-3790,3841-3846
ggggtcaaccaaattttttgcgaaatggtccagccatgtaaattgacaaccttttttatgcttttcaaaacctctttttttgcgacactctttttccaaaaaaagaaaagttcattttttataactgacagttttcattttaaggccttttccatcgccatccgttccgatcatagatgggatcgaatacgaaaagacaattttctgtctccaactttccctgtaagttttgaaaatgcgtatatttgtacattttaaattttagtttccatttgtcgtagataggatcgaatacggttctttggtgcattacgttcatgtgtgcaaactgtgcgccctactcggccgtcaggttaccccctattcattatatctaaacgaacaaaaattcaatttttaaaaacgaaaaagtaaattctgcagattcttgggttttggtaaaaaaaaaaactcgggtgaaactatgaggggaataaatgcacccatttgttcattcattcgttttcctctcaaatcattaaattggtactcataatgtatttgtatttgactgttttgttcggagtctaaacaattaatcctttttaaggctgccaaacagttgcggctcatcaaagacccattggaagtgcggacgcgcactggcgaattgctgatgggcgtcagcaaagagaaggttctatttcattttaagttctttaatttcctattgttcagatcgatattgtaggcccacacgggcgcaccttcacgaggtgtgtggctgtgagtaaccgcccggttcagccgggcggtgaaaggctgtcgcctccacccaatttgaggtttcccgaatcttttttattatcattactgaacaaatttagagcacttacgcccgcaatgcctttccctgttgatggtggtccgatctttggctcatggagggttttgctgcattcatggaatttttgttcaccgacaaatactaccctgaatttaacatttggtccgattttgtcgacgcggaaatggtcaaaacgctggcttttgactctaagcgcagtacgcatccaatcgaggcaatttctataaattgatattatattgtaaatacagaatttttaggttcctattgataacccaaatgaacttgaagaaatttacgattcgatctcttacgcaaaatcaaattcaatcattcggatgctcttcaatcatttgggcgaagcgatttccaaaaggccattcgcgattacttgaaaaagcaccaatacgcaaatgcagagaccaacgacctgtggaagagtttgtccgacgcttctgggattgtgagtttaaacaataaattcaatgtcgaagcaaagaatttccgcacattaaatatatttgcaactttatttcaaagaaacaaaaacactaggaaaggaaaatggttttacattttggtttaggatgtcaaagcactgatgtcaaggcgcttcgcacacgacggaggaggaagggaaactttcctccgccaacttcggctcctgctcgccgccttccaactccgtgatggaatgctcaacaacgacggagcaacggccgggcaccagcgaacacattgacaacgacgaccactgctcatcgccgcccgttaaaccggtgggtgggtctgtttgacattaattcgctttatttaatcagcctaactaaatttgaacgtttagtaaatgaataatcatgactaatttcctttcagttgacttatgcgcaagcagcggccaatagaccgagaagaaatactgcgagcaatttggatacaaaatccttccctttttccaacgtcaaatgattgaatttccctataatttctgattttttccatcactgattgctgattgtgagataaacaaatcgaaactaaattttcgccgttcgatttccaatgtttcggccgaattcgcttccctcttttcttctttatattagcttctcctcgcctttatgcagagaaagggcgggaggaagaaggaaaagcaatgctaacagcagaaagggtaaaaaggggaaaagcaaagaaaaaaggaaaagccaaaaaaagaaaaatagggaatttaaaattaagtaattttcattaggtgacaaaacaaaaattgccacgacgacttcggatttggttggtggtgacatggcgaacaaatggccattcattggctgccaattcagcaaagtccgcgctgagtttgcctttgcatccaatggactgcaccgacgtaataatggcctcggtgctggagggcaccgaccttttgcacattgccgacatgtactctcgagatcggtcgagcccgttgcgggacgcgtggttagacggcgaagactctctgtcggcagcctacggattggcaaccgacgacggacggacggtggtgatgttccgtcggatggtgcccggtcagaaatcgaatttggcattccattggcattggccttaacccataattcaaatcagaaatcgaacccaccgaccatccgttgggtcccggcgaattgtttctcatttgggcaaaaggtcagccgaagaagccaaaggacaaaggcttttattcggacggccaatggaaataccacggaggtgaaaattggaggggggggggaaattcggaggataaaaatgccatcaaacgaaagacagcggcagcggacgagggcacatgcaaatggaattcgtttcattggagcaaatgggaaaaattcgggggcccctgattcatttggacccgccgcaggggccgaccaacacaagcgaacaacgaacagcagagaaagggtgggaggaagaaggaaaagcaatgccaacagcagaaagggtaaaaaggggaaaagcaaaggaaaaaggaaaagcatgaaaaaggaaaagcaaaggaaaagggaaagcataaaaaaggaaaaataaggaattaaaaaattaaatgttcatcaggtgactaaaacaacaattgccacgacttcgtcagtgccaacaaccgaaagtgatcaaacgacaaaagtttcatcgcccgaggcaacaacgaactcaaaaagcactttgacaacgcaaagtcaaacgacggacaaagaacaaaatttaacaaaaacagaagcaaaaaagaaacaaattcagacagaggaaaaggaggaaattatgcataccaagaatttttatccaaaaataaccatttaaaaaattttatttacatattttagtacatggaggtttttgtacatatttcatatatattttagcattttttatatatattttatttacatatttcgcgatttttcttacataaaattcccagccctagtaattataaaatattccccaatcattcaattgaaattgggccgtattttctcaaaaattatgcaccattaaaatttatcagataaatttgaataaataataaaaatttgtaaagtgaaaatgttgcgacgaggtgaaaatgggcgattaaatgagcaaagaaaaacaaacaaagaagaaaaagaaggcgtaatattcacactaacaacgcttaattaattatgctaattaccggcattgtatgtcaatttgtcattatttcgtaaatatttatttgcgcatttttctgtccatgcagtggtcagtccgtcccatcgtccgttccgtcacaccacagttggcattttcaaattcgtcgccattccgccgccatttgccgcaaatgacggcactgtgccaccgttggcactgttcaactttttgcgacggggcaatgactttttgaagtgattgtcagggggagagacgacatacgaagaagcggaagggggaggaaaagcggaagaggaaaaaggaggaggagggagcagctg

SEQ ID NO: 79157 - DNA, 1308 bp, Heterodera glycines
  Genomic contig location: Contig_ID=SeqID_15001; Location=3298..4605; Strand=-
  SCN-specific regions: Sequence locations=1-39,61-64,105-149,171 -512,534-667,689-804,826-1308
atgtctgacaaccgaaaagaagcggaggagaaaatggcgaaagcaatgtaaaattaaaatgccattttcaattcaattgtaaattttgttttccttttcttcagtttcatctccaacgactgttggctttgtgtgttcgatttgattacgccttcacaacttggctttggcattgcaatgatcagccaccgttttgacatttacgtggacgaacacttcaaaacgcgcaaaaggacattggcacttattcgaattcgaagcaaaattggagaaaatggcaccaaggaaatggaaattgtcaattctcgttggaaaccattgccaattccgcaaattcaaatgccacgcaaagtcatcggattcgaatggatcaacatctcgtaaattggccaatgtcaaaattttttgtcaacacttccctttcagtttcatcgaccgcaatgtcatcacttttctccaccattttcgccaacttttcgccgtctgtccaatttttgtggccatggatagctcaaaaagctacatttttgatatgctcgttacccacatttggtcattgctcggaaaaaacattcatggcttacgatcgcctgccccatatttccaccgtttgcgcaaattcgccccgtcatttctcgacgactgtccatcgcttcgctttttcaatctctttcatgacggtttcttcgccgaatttccatgcgatgacagtgccgcggcatcggatggacaagcattggccaaatggcttttcactcctcgtcctgacggtgtgccaaagacattcaaatgcacgttgcatttagttttggaaaaatgggcatcaaaaatcgagccgctcaaaaaggtgatttgattccgtgtttctttagtcaattttcccacattttagacatttgcctcggcttcatctcccgtcaatttcatcgtttccatttggatacgtccaacgtctgtcgatacctccgttgtgccctttgtgctgaccaatgaattgactcgggaacaactggcattgaaaagaacttacaatagcagctatcgttttctgttggtccgtcatccaattgcgcgagatgaaagcaaatggacaaaatgggaagaagaagcgattgagtggaaatgttttgatcagtggaacaaaattgacattcgtgtgcatcgtgatgaacaaataggcgatgggtaagtgatgctttttcaaaaattgaaattgattgtttttcaatttttaggcttttcgacgcaaatcccggcccaagtgatcagctgcagcagttaatgaatgatttgctgagaaatgattga

SEQ ID NO: 79158 - DNA, 1172 bp, Heterodera glycines
  Genomic contig location: Contig_ID=SeqID_15002; Location=1181..2352; Strand=+
  SCN-specific regions: Sequence locations=1-19,42-180,204-489,513 -717,739-1172
atgagttgttggttcaaacatggctatctcaccaatgacaatttgaatatgcttataaatggtatcaacttgtgcttatttgccttttacattgcggcctttgccttttatcagccaaaaagggtaggcgataaaacagagttacactaaactggaaattattatatttttcaagagcaaaatgagaatttgaaaaattgtaattatttttaagttttgtttaaattcgggattcgaaattaccgggttaaatgtcagaatttgtgattagcgagtccgaaataatggatttcacaaaacaagaaataaaggcacaaatttattaaaattatttcctcaacaattcttcctttggttctgataggcgccgccagagaaaatttcaaaatttttgacgaatattgtaacagattttgcccaaaaaatacctgaactattttaatttatggtggaatttgttatgctttcaaaaataataaaacaaaggacaaatcatttaaaatggatcttttagaaatatttgtgtgttcaactgacttctctggtcattgccctctttactttgttctcttatgtgaacaataaaccagccgaggcccagcccgactcaatgggatcaattgcagcagcagctcaagtagcatcattagcaggtgggggagggaaaggggtaatgccacggggcattaattgcagtaaaagagcacatatccattaattcttttcaggaaatgtctatgatttggtcagtttcgtcttttccttcggttgtctctctctattcggtatttcatttaagaaaagggccattttcgacttgaaaacgaccgaatatatccccgcctcaattcaattcggcctctttgcccttaccattcagtggtccatttttgcacttattgtcggcaattcttatatgctggtgagtttcgaagctctccttgtctttcttttgcaaaaatgggcttttaaggttgccaatttggctggtttggcagttaatctcgccactttggcaacatttgttgcgtatccacccaaaacttggaaagtgccaatatttggtgttggtggagaagagaaaaagcagaagtgatcgctcagaagaagtattagtattagtgcaattcacgagtatatgcctagagattgcccaattcaatgcctccgaa

SEQ ID NO: 79159 - DNA, 1681 bp, Heterodera glycines
  Genomic contig location: Contig_ID=SeqID_15006; Location=1899..3579; Strand=+
  SCN-specific regions: Sequence locations=1-148,177-469,492-753,778 -1087,1110-1616,1645-1681
  Gene Ontology: Mol. function=protein kinase activity; Biological process=protein amino acid phosphorylation
atgaactgttcaggggacgggcagttaagagttgtcgcgatcagcgtatccaattgcttggtggtcaacggagttgaagtcgtcggcgcaattgatgaaacagtcctcaatgacgacgcgccgtgttgctgctcgccaccgtccgccatttgttgttgatgatgttgttgatgttgaatgacgatgaataaacagaagcagcgccggagagcaataggagaaataaggaggacgaaattatggattaatgagtgtgaggagggaaaacaaagcacttttatagcaaaatttttttgctttttctaccgaaagtttgaaaatttcgaaactaagagaaacattatgtcaaagcttctattttcaaaaaatttttttttgttttttttcaaaagcagaaaatctacaatttcgccttttcttcaaaaaagccttattgtattccggattactaatttatggttggcaattcaattaaaaaataataataatttgccaaaaaaaattttaggaaaacgatcaacaacaatctccggaagaccaaatttcagcggaagcggcaatcaatttgttggccgttaccaccactcaccagcacatttttgggggcagaaatggtgcactttttgtggaaatacggcgaattgcggagcaacaactggaacacgcgttggcaccagtcgatggtacacaaaatttggatgggattttttggctagtgattagaacatccaaaaaactattccttgctagatttctatttttgtttttatttctccgaacgttcagattaccgacaaaaaactgagtggtaaaacgtgtctgttgcagttagttacattaccacaaaatctgtttttttggccctgtttttatacatttgagaaattttctaatccaatgcaaatctattttaaacaaaggttgcttaatttgtttggtttcagttgctggcggaaaatgggagctgtttgtgaaggacggcgaactgcgcatgtacagccgcgagttggaagtggagaatggcattgcggttgacccgttgaaagcgcttcatgtcattgatgtgcgaaaattgcatttttaagcgtaaaacaaaattcaaaattatggctggtgggccgtccagttttacacaaaaaaaaaacttattcggcgccattttggtcacacagttaagccccatcgagcaaaaattatcaaacaccgacaaaatcaaattttcgacatgaatttatcgtttttcagggtgtgtcggctcacgaattcatcgacctgttctttcgacctgaactcaaaaaggaatgggatggtgaggggagagcgaattcaaggcccaaaattcctaaaaaaatctgttttttttcagatactcttgaactgggtaaagttgtggagactctttcgccgcacactgccgtcatccatcaaatccatcgccgggtttggcctgccgcacaacgcgagtcacttttttggtattttccaattaaattttttgatttttttttcaatttatgtttttaggtcccaacggttgaatgtgttgtcggaatgcagctctgtgactgaccatgtgccgggtgaacttcttggcgcttggatggtaaattttggacaaatttaaaaaaaataaaaataattttaggtatgcaaccaatcggtggaacgcgacgatgttccg

SEQ ID NO: 79160 - DNA, 490 bp, Heterodera glycines
  misc_feature (460)..(460): n is a, c, g, or t
  Genomic contig location: Contig_ID=SeqID_15007; Location=905..1394; Strand=+
  SCN-specific regions: Sequence locations=1-490
atggcaccgcctgtcgtaaaaaagaaaaaactttcatccgtcgttgaaaatcagcagcaacaaccgttgggttcaattgtgacaccatttggaagacggcaaagcgttcgcttagcaaagaaaatgaacaatcgaactttgaagaaaatgtgagccaaatttggcattttttcatggcattaaactataatgtttcagctggatctgtaacgatgttttgatggacattctgccattctttgaccgtgtccaactcggcctcaaattggcaatgatttcgccacgttttgatggtttggtggacacgcatttcgacagtggaaaaacagaattggcacttcggagagaatacattattcgaaaaaacactgatgaagctcaaaagcccatatttgttgttgccgaacacgaaagtgtgcaatttccgatgcccgaccgtccgctgcccaacagaaatcgnttttcgaaggcttacgattgcgtaatttga

SEQ ID NO: 79161 - DNA, 80 bp, Heterodera glycines; identical to SEQ ID NO: 51817
  Genomic contig location: Contig_ID=SeqID_15007; Location=118..197; Strand=-
  SCN-specific regions: Sequence locations=69-80

SEQ ID NO: 79162 - DNA, 1108 bp, Heterodera glycines
  Genomic contig location: Contig_ID=SeqID_15008; Location=709..1816; Strand=+
  SCN-specific regions: Sequence locations=1-267,289-793,815-1108
atggaaccatttgaattgacgaacgaagcgacccaagaaatgttgacattggagaagctacgcaatacaaatctgcagtgtttgaagcgacaacaatgctcaattggggcgaagacggacgacggcgattcgacagcatcaaaaagatggaatttttatgcttcgaacactgtcatctttgatttgcgtcctccaaattgcattgggtgagcagtggggcagggagcagctcgttccccccatcccgagtaatttaaaaaaaattctcaaacaaatttttcatgaaaaatctagaaagtttttctgatccgtggggaatcggcgggggaggggagggaaacgtagtgcacccgcgggacaagttctaggggtatttcgaggcggcgcttagtacgaatttctcctccgttttatccattttgaacccctgacccgaattcgaacatttacacttttgttgttgttgttgttgcaaatgttgcttataaaaccgggacgagtaaattccaccttggggagcaggtcgtttcccctcccccacatcgaaatttttttttaaattttcaaacctagaaatttttcaaaaaaacttataggaaattttctcataagaaaatttcaagaaaaaaattttgaaaaaatttcagcgattttttcaaaattttacgatgaactactaagttttttcaaaaatttttccaaaaaatcgctgaaacattttcaaaaaatttattcgtgaaattttcacatgataaaacttgctacgaattatgcattggctgagcaacaaacagctgcttttccttttttgtttgaattactcaattcaaattgcgttgattttttaggcctttgtctccaccaacggccacaaaagcggggaaaagcagcgaaaagggcgtctgattatttggaaatgaatcctttggcatttgacaaaatggtcgctcattttgaatgaaaattgttgctttgatacatttttctctttaaatgttttttttattggtcggttttttcgacaatatacctatcggagtaagacatttgcgcctatgtccaaactcggattcaaactaaaaaatttttaagtagaagtctaaaatta

SEQ ID NO: 79163 - DNA, 737 bp, Heterodera glycines
  Genomic contig location: Contig_ID=SeqID_15009; Location=176..912; Strand=-
  SCN-specific regions: Sequence locations=1-85,133-240,262-507,529 -622,645-676,699-737
  Gene Ontology: Mol. function=calcium ion binding; Cellular component =brush border; Biological process=actin filament polymerization
atgggcactgctgcgatcaaaacggttgagctggacgactcattaaacggactgcctgtccagtacagagaggtgcgtttttgaaaaatattttattaattactttaattgaattaataattaattaattaaaatgttttgcaggtccaggaccatgagagttcgctcttcctgagctatttcaaagacggaataaagtaaaaaaagcaattgataaagagtgagaagtgatcaaaataagaaaatatattaagtgattttcaaaatataagtaaagtacggcaaaaaacggacaggaaaagcggaaaattggacaatttccaactttaaaaaaatcatctaataggcaaattcaactccgaaaagatagaagaaatccccccacctcataccaatctcaattattgaacttaaccaattctcttacaaaaatgcaggtacctggaaggtggagccgagtccggattccgccatgttgtgcccccctaccaaaattgggccccaaaactgttccactgcaaagggaagcgaaacgtccgctgtacccaagtgaatccatttttttatgagttgaatttaaattttaaaaaaacacatttaaggtcaaatgcattaaagaaagcttgaatttgggtgatgtgttcattttggacatgggactgaatttgtacgtgtggacgccgccgatgagcggacgtttggaacgcattaagggcatgaatgtgggaaatcgttga

SEQ ID NO: 79164 - DNA, 1044 bp, Heterodera glycines
  Genomic contig location: Contig_ID=SeqID_15009; Location=1765..2808; Strand=-
  SCN-specific regions: Sequence locations=1-31,60-290,313-407,454 -468,490-694,716-765,788-825,886-951,980-1044
atgacgaagctttttggcaatttggtgagtgaaattttaaatttttagaattttatatacggcaatttaaatttttttagaattttatgtatggcaattttaagaattttatgtatcggcaattaacatttttttttaatttagtttttgagccgagtgacgaaactttttggcgaattttatggtgtgtcactgtttttcacacaagagaagtgcgtgtaattggtgtgacgtgagaatttcagcacaacacaaattgatgcgagggtggctggtataaaaagagaagttcatcaaatcaaaaagcacttttcactctcaatcattgggcccaacaaaacagcaactaattttcaactccccttttttgatttattcacccattttaatctttttttatacgatagttttttaattcatagttttttaaattaaattatataattaaaaaaagcaactaattttgtgattaattttaattacttaaaaagattggaaaaaatctaattaaatttctttttaattccaaaaattttggtaaaaaataaaatctctctttttaacccaaaaaaatggcaagaaaatctataataaaatctctctttttaatcccaaaaaatggcaaaaaaaatcttaataaaaactcttattaatcccaaaattttaataaaatctcttttcaatcccaaaaatttcagggcaaaaatggcaaaaagtggtcaaaacaacgacaacactttcacacaggaactgttgcatcttttggaaaccaatttttcaccacaactgttggaaattgcactaaggctttacaaggcacagatgtttattaaattattaaattgtaaaatatttttaatatatttaattaattagtttatttttgacataatttttggtcggaagacaaaaaatgaaattggatacatccatccttttgttctaaattaaacatacacacacacacacacacacacacctcaaaatagaaaagatgagcttttcacatttgacatggtctttattctcttccctcaaaataaa

SEQ ID NO: 79165 - DNA, 457 bp, Heterodera glycines
  Genomic contig location: Contig_ID=SeqID_15010; Location=345..801; Strand=+
  SCN-specific regions: Sequence locations=1-190,310-457
ggaaattattcggttaagaagtttttgaaggcatgcaatttttttgataagcgtccttcttccaaactttcacccctggcagacaaaatttggtccggacaatccgtcagtggacaatccgtcagtggtcaatccgtcagtggacaatccgtcagtgaaggacaatccgtcagtggtcattccgtaagtggtcaatcagtcagtggacaatccgtcagtggtcaatcagtcagtggacaatccgtcagtggtcaatccgtcagtggtcaatcagtcagtggtcaatccgtcagtggtcaatcattcagtggacaatccgtcagtggacaactcttctgtgaaggacaatccgtcagtaatggacaatccgtcagtggataatccgtcagtgtactattcgacacaaaatttttttgagcaataattaaaaatcttgcttgaatgattgttaaattta

SEQ ID NO: 79166 - DNA, 3067 bp, Heterodera glycines
  misc_feature (2977)..(2977): n is a, c, g, or t
  Genomic contig location: Contig_ID=SeqID_15010; Location=1..3067; Strand=-
  SCN-specific regions: Sequence locations=1-74,99-419,441-899,947 -1144,1166-1243,1282-1342,1454-1473,1555-1590,1630-1732,1754 -1835,1857-1931,1967-2060,2089-2143,2198-2253,2275-2414,2534 -2724,2768-2781,2806-2858,2880-2917,2945-2955,2977-3067
  Gene Ontology: Mol. function=zinc ion binding; Biological process =negative regulation of EGF receptor activity
ctcatccatcattggtaaaattgtcgcggatatctctttttcattgggttgatcttcgatggaaatccttcccaattttttgtttatccaaaattcatggcctccgttcgttgtacgtttccatatcgacgttcaggtggacggcagcagggagggcttttacctttacccaaatggtcggaacaaaaacatggacttgtcctacgtgtcgcaatttcctcccgagtcgggcaaagttcaggtggggtttatgttatttagttgtcacattgcttaatcggactcaaccggcacgatcagcagggctgcaaaaaaaagcacgaaaaatgaccagaatatgcacataaatatgcaaataaaattgccaaatatgcacaaaaatcgcaaaatatgcacaaaaaatcttaaattaggggtgcaaaataaataaaaattttattcctcataaattatatcggttgtttttgtaattgtaaatcaaaaatttctcaaggttttcggcagtgaaactcactgttgacccactcgcgcatcaattcagatttggatttaattttaggcattttcgaaattttttcctaagagatagtgaaatctgaaaaatttgacgaaaaatggcaaaatatgcaaaaaatctgaaaatacgtacaaaaaatgacaaaatatgcataaaaacccaaatatgcaaaaatatgcaaataaaagtcccgatttttatacgcaaacacaaaaaaaaaagtgtttttcctactatttagagcatggagaagccaggaaaaaatatgcatttgcatattttttgcagccctgctgatcagtgaccgattcattcgcaatttaattctatcaaaatttcccaatccgcttgatcatttctgaataattctgaattttgtgccaaattataaatttagattttaatgttcaaaaaataattattttatatgtagaaaatgatgcaagtaaaactcaaccaaaaaataaaattaattaaaccaaaaaatgccctctctcccgcaggtttcgtcggagcaataccaaatttactgtgagatgggcacgacctttgaattgtgcaaaatttgtgatgaacgcaacaaaaactgcaagttggagccgtgcgggcatttgctatgcaaactttgtctgatcagttggcaggtgaaaaatgggagactttctttggatatacgatttttagagaattttctgaaaattctatggtgtttaagggatttttgagtattttatttatttttaatgaattttttcattaataaacaaccaaaaatgatgagttgatcaaaaacaaaaaaattaaattatttttgaggttttcacgaattttattaaaattttttttcatttttcatttaattataatcttaaaataaaatataaaatattatttaatcttcaatatgataacgaaaaattaattttttatataaaagttattccgcttgctccaatggcgagatggccgagcggtctaaggcgctggtttaaggcaccagtctcttcggaggcgtgggttcgaatcccactctcgtcataattttttccatttttcatttattttttcctatcatttttttttctatttttaaaaaattaaaatttttatttcattttaggaaaaagcggacggcgagaaaaattgtccgttttgtcgatgcgaaatcaaagggaccgaaagcattgtgatcgaatcgtacgacccctgcccatcgtcatcaacattattaacaaatggccacactaagcaacggagtcgagccgaagcgcagcaacacaactcgaaggcggcggcaacaacgacaacgccggcttcttcaatggcaccagaaaagccaaaagtgcctccgcaaccgccgccacgacgggtggccaacctgcaattacataggtggatggatacctgaaatagcaacaccaattttataattttgttgttttcttttaaaatggggatcatacaaaggggagagggaggggtcgactcccggctcccggacaatccgtcagtggtcaatccgtcagtaattaatccataagcaaatttatttttaaatcactcagatttatttgtaataatgtgagattaatttaagtcgttaaaaatatgaattaataatttgggttattttataaaaattatgaattaatcttttttaaaagaattaaatgataatttctcgagatggtcaattaattgaattaaaattaattagaaaggttagaatctataagaaattgtatttattaaatttaacaatcattcaagcaagatttttaattattgctcaaaaaaattttgtgtcgaatagtacactgacggattatccactgacggattgtccattactgacggattgtccttcacagaagagttgtccactgacggattgtccactgaatgattgaccactgacggattgaccactgactgattgaccactgacggattgaccactgacggattgtccactgactgattgaccactgacggattgtccactgactgattgaccacttacggaatgaccactgacggattgtccttcactgacggattgtccactgacggattgaccactgacggattgtccactgacggattgtccggaccaaattttgtctgccaggggtgaaagtttggaagaaggacgcttatcaaaaaaattgcatgccttcaaaaacttcttaaccgaataatttccctttaaaatttattctctattttatttttcaatattatttaaaagggaaggaaattataaaatcaaattttaaatcaattatttcatcattaataacatgactaattataattgatttggtaatttcaatttaatgaagaaagaaaaaatttagaatcaacaagttaaaaagcaaatatgaattgcaatcattgatatttttaataaataatattaatatacaattatcacaattttgattttcgatattttgnccctaaaaagatggtgaaaattaattttgtgattattttcttctccagggtgaggttctaattgatggaattgatgaagatttatttgat

SEQ ID NO: 79167 - DNA, 504 bp, Heterodera glycines
  Genomic contig location: Contig_ID=SeqID_15012; Location=1232..1735; Strand=+
  SCN-specific regions: Sequence locations=1-137,159-504
atgtcagcgaaagttaaaacggaggcgtcgtcgccaaaacaaatgaacgaaaaggcggaagagaatgaattgacagagcgtttggagttagactttgtcgaagtgcgccttttttctcgatagtatttggcaccatcaatccaaattgattgctaaaacttggcgaaaatggctaaatttcctgggttttcccgccgtgcagaaaaatttaagggaagttacatttgtcaaaaacttgggccagaagagtaaaaacttgtagagcctcttccgaaattttctttcttctatacgcacctgtttagaatgtccagtttcacccatctttatgaactgtttaggagtcagtcggcgacgattgggacggaaatgccatcatggaatgcgacgacactttagccaccgcagatgaagcggaggaggagggcccactcaaaccgtcgcccgactcgccgcgttcgttgtctgccccgcgttcccccgaagacgaagtggagacaattg

SEQ ID NO: 79168 - DNA, 272 bp, Heterodera glycines
  Genomic contig location: Contig_ID=SeqID_15012; Location=358..629; Strand=+
  SCN-specific regions: Sequence locations=1-272
gaaatgaatgccattttgaacaaaaatagcgcttccgttgtcggggcaacattgtgtaagtaagaagaatcgggcattttctgtggaaacagagaacattgttcagacacgacgctttttccatgtgcggaatgtgccaaaatgatcatccaatcgcgcatcagtcgggttgtttatttgagcgacaaaaataccgtccaaatggaggcttcgcgtcgccttttcaacatcacaggcatcaaattcaggtccgtccttccttatccctctcg

SEQ ID NO: 79169 - DNA, 687 bp, Heterodera glycines
  Genomic contig location: Contig_ID=SeqID_15014; Location=47..733; Strand=-
  SCN-specific regions: Sequence locations=1-634,656-687
atggctgtgaacaatgaacaaatgatggtatggtggcatgaacttttatataaatttaatttgtgccggttcatttggggtcagtgcgtgcggtgccgtgcccaaaacgatttttatgcagtcagaaaaaaaaacaaataggcgcataacttaataaatataaattttgaatacgattttttgagaaaaattttttatttcttaggtgagtatttttgaaaattttatgctctttcagacaatagggagagcttaggaaaaaaaataggtaaacacctaaaaattgtatccctagtcattacaaatcgtcgtaactttgatgactttttttttattaaactttatttttgttgttgcacatttgatggaattatgaggcttttgtcagcacgttaatttggattaaaagctagataattatttcagttcgaaagaaagccaacaaatgccgatattccgtataataatgacacaattggaacggacggggagggcaatgagaaccaattgggcattgtcaatgttgtaggggtggacaaacggcggcggatgactcaggtggtctggaagatcggacatgacatttttacaattgtttgactggtcgtacattttccaagctttttttagcaactaataattatttccaaaatttttgtctgcctgaaaattcaatttaatattaaa

SEQ ID NO: 79170 - DNA, 651 bp, Heterodera glycines
  Genomic contig location: Contig_ID=SeqID_15015; Location=643..1293; Strand=+
  SCN-specific regions: Sequence locations=1-92,114-282,304-410,448-651
atgttaaaaattcgaaattgtatttgtaaagtttgaaaagcaaattttttgcaattgtcaaaaaatgctctaggcattgttttgatgtttttaaggccaaatctgtatttttacacaatttttagcatttttatgagggttaaaatccatgtttggcactttttaaggcatattatcatatttagcatttttttagtgcatataatttaaccctaattatgtcacgaaaaaaacggacaatcatagatgaacccgtcggcaatgagctttttcgatgcggacaatttgtttgccttttgtaccatacgaactgtttcaattggttgaacctcgtcgtacaatttgaaacggcataatttgtgcttgctggggcccgagtcgacaatgtaaatgctttagatcaagaaaagtttttttttaaatattaaaaaataaaataaatttattgccttgatgtatttatttttacagaaaggtcccgggaatcctattcaactcggttcccactctcccgcatcgacggatgggagctttaatgaaggagggtatgtgttaatgatgtgcgagaaaattacccgggaatctggaactgagacctggaaaaaagccccctggaaacatcaatgggatcccaaaatacccggaccctag

SEQ ID NO: 79171 - DNA, 285 bp, Heterodera glycines
  Genomic contig location: Contig_ID=SeqID_15015; Location=2360..2644; Strand=+
  SCN-specific regions: Sequence locations=1-126,151-285
attttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatcaattcttaggggtgtaaaagtcgcatttcgcgccaaaaagcgaaatgcgaaaagcgaaatgcgaaacgccaaaaatgcgaataatgcgaaaggcgaaatgcgaaaagcgaaaccctcggccatccctg

SEQ ID NO: 79172 - DNA, 1135 bp, Heterodera glycines
  Genomic contig location: Contig_ID=SeqID_15015; Location=1309..2443; Strand=-
  SCN-specific regions: Sequence locations=1-152,174-223,245-644,666 -670,950-1086,1108-1135
atgatcaaaatttccaatttttttccccggcggcgcctatcggcaccgccgcgcccccaaaactcctattttttcttagaaaatggcccaaaatcgcaaaatttggtaatttgatgaaaaactgttcgcagcggcgcgccaaaactcttatttctcattagaaaaatgatacaaaaatcacaaaatttgatgattttttggtgaaaatctgtcaacaaattttaatcaaattttcaaaaattttcccggcgccgcctgccccctcttccaaaaagtttttttggaaaaagcgcgcctcaaaaaagcgttttattgatttttaaatttggaataaaattttaaaaaatgatttttgctttatgattttaactattaaaaagttgtagaaaaaatttcgcttttcgcatttcgcttttcgcattttcgcatattttggcttttcgcatttcgcttttttttcatttcgcatttttcagtttcgcaaatttcgcttttcgcatttcgctttttatttttcaatttggcccatccctggattgtatatattttcgagttttccgcttaaaaattgcaatcagtgtacggaaattttcaactgatattcgacttttatagattttttagggtgaaattcagaattttatgttcctgaaattttgggggcacggaattccatctttcgcgcttgtctttttatttctctctctatctttcactcagtctattctttcttttgttatctcatcactctatttctctctttcctcctcctctctctcttttccccactctctctctctctccttctctctctcctcccacatctttccctctctatcccctccctatctctctctctctctcgcctctctgtctatccatctctttctccctcccgctctctattctatctcccgctctcctctatctctcattcactcactctctcaacgcttattcctttttcagcttgttgctgatccaactcgtttgctcggcactttgccttacatggatgaagtgcttcgaaatctcaacaaagatgctgctgatgtcgccgtagcagctgatgatctggcaaagcgggaggaggaagattcggagcagtacacgggaaaaattctgtaaaaataaa

SEQ ID NO: 79173 - DNA, 995 bp, Heterodera glycines
  Genomic contig location: Contig_ID=SeqID_2332; Location=82..1076; Strand=-
  SCN-specific regions: Sequence locations=1-420,442-972
atggacaatccgatgaacaaagacaatgaacataatgaacgacggtcgtcggttgggtcagtgagacgacactttgccaatgcatcggtaaaagagagaagagaggacaaattgcggaaaaaagagtcgacggtgactaatgaaagcaagtgagtaggggaaagagtgttttgttaattgttcacttttactgttagactcagttcggcaagcggcggcacaacaaattccatttcgtccccacaaaaacgccaacgtgccgtttcggattttggcgcttcgtatttgcccgcattgaaaaccgacgacattttggcattgggcgctgccgcaacggaagagaaatcgcacgaaagaccacagcgttacagaaggcacaagacaagtgctggtggattcctcgagttaaagttcagaaactttccattttctgatttttaatttcagttcctttgactccgactccgacagcggcgataacaaaagcggaaacgcaaaaagaataattgactcgactcaacgaggcgaatacaaaccacaattgccatccgcattgtccatgtactcatttttgggcgacgaagaggaggaaaatgccgaagaatcaaatgttttctccaaatcgtcggctaatgtgcgcttaaacgttgaccatcgacttcggcccaatttcggcgactgtttctgtttgttatccctctctcaaacccaaacattgattgatactttcagcaattgaaagtcgcaataggccagaagactcttccgacggtcgctcgcccttcgcttctgcagtcgaacgtttcgctcgggtggaaaatgcaactgatgcggtttcctggagcagtgcaaagctatcgacaaaagaggacagtcgttccaaatgggggtgagttttgatttgccctcaaatgtttgtcttctcagaacggaacaccccaataatttcaataattcacaaatagacaagtcattatatttattttttaaataaa

SEQ ID NO: 79174 - DNA, 1992 bp, Heterodera glycines
  misc_feature (45)..(45): n is a, c, g, or t
  Genomic contig location: Contig_ID=SeqID_2333; Location=1..1992; Strand=-
  SCN-specific regions: Sequence locations=1-199,221-1201,1223 -1241,1263-1745,1768-1992
  Gene Ontology: Mol. function=non-membrane spanning protein tyrosine phosphatase activity; Cellular component=cytoplasm; Biological process=protein amino acid dephosphorylation
ctgatgagtcgaaagggcgactcgacgactcttttttggactcgnccgatggaattgtcagtggcttttcgccagggacgaaacgaaaaagtggcgcatgaaagggacagtcaaagggacgaaacgacgacgaaagagcaaaacgcgcaatttcaacgcaaaaattcactcgaaccttcgcgttgcagcaaaaggagggaaagcggcgggagaaggacacttccgggccccaaatgtgctgcgattcaacacctccttctgagtttcccctttttagtccctttcgcttcttccgactgttcccgaatttctgagtccaaatgttcggcctatcattcggctcagagcgcagagtatgaaaagagttccgtggtttttcatcgcattctttcttcacctccattctaactttttttagaagaaaatggtctcattgcaccgttctgactcggccgtggttttcgtccgtcttttgaatgggcacagtgtcgaagtgaattgccggaccgacactttgattggctcggtctttcacaccgttgccgaagttcggtgcgaataaatccgttattaatccaaaatttcagcatttgaacataactgaacatttgttcttcgggttggccctccaaaggcaatttggggagaacatttttctggaggagcatcagcgacttgagaaatgggcgccgccggggtggaagggcggggccgggctgaggcgaagcttcggagccggcggtgccaatgcaaatttaaatttaccgcgtcgtttcgtttccatttgtccaggcactctttcccgtcacttcgacccctccgcgagtggtggcgtcgaacagttcgcacttttgttgcgattccgttactatcccaaaaaacgcgaatttgtcaagttaatcaaatatttgttgtgccgtgccacgactccattcacaaatttgcagaacggcgaacacagcgcaccaattgtacctccaactgcgccaggacattctcagcggaacgctgcgcttttcgcccaaagagcgcgcgatggaaatggcggcgttggcattgtgtgccgaagcgaattcaattccaaaaggggacgaggagtacttcagaatggaggattacatgccaacggtaaaacaaactcgaacttacgaaatcctgatgagctatttgttaaccatttgctcaaaaagattattttgtgatttttcttgtagaaattttacgcaatcgaagcaaacgaagtccttcaaacacagcaaagaattgccgaaaggcaccgccgtttcgccgcctcttttggctatttggaggcggaagaacagttcatcgcgcgatgccaagccgaagttccgccaattccgctgctttcattcactcccttttttctccctttagcccctttatggtgcccatttttaccgtgtgcacaagataaagcctaagcgtggctatgccacgccttcccgtccttttttgtctgacactcggattgttgctgtgcttccttccggcattggcatttgtcgtgaggagcgaaacggcgcacaacgcctgctaaattcaacacacgaatggttcgttcgactggtgttttttaaagacatattatgacatttaccgtccattttcaaattggtaggcatacgattcggacactccaattcgaccgaaaacgctttctgttgggcaccatcgaagagaacatcgccgtggaccacgttttctacacggatcaccattcgaagtgatgccttcttttttgttttgtccaactgcaattttcataagggcctcttatttggttcgttttgccgcctctcagcacagattcatgctgaaaatgcgccaatggcaggggacgctgaacagaatgcatttggtggagtggcagaaggacgtcggcgtggaacaaaggaggcgaagcgaaggtcgacgagcgaagcggggaaattggaagacaaagcggaaaaagccatttctaatggggggggg

SEQ ID NO: 79175 - DNA, 142 bp, Heterodera glycines
  Genomic contig location: Contig_ID=SeqID_2334; Location=2153..2294; Strand=+
  SCN-specific regions: Sequence locations=1-142
ctaaaacagaaaacatctgcgaatacaattttcataacattttgtaaggtcactgatggattttgaaaatgttggcacttccgtcgctgctccatttttggcaccattgagcggaatcgttgtcacatttaccggattgagc

SEQ ID NO: 79176 - DNA, 1358 bp, Heterodera glycines
  Genomic contig location: Contig_ID=SeqID_2335; Location=1825..3182; Strand=-
  SCN-specific regions: Sequence locations=1-1159,1187-1268,1291 -1304,1326-1358
atgacggtcaacgctttgtatgtgctggttgccggaaaatcaaggaccggaaagatgttccaagcgacagaaaattaccaaccagaaaagtgcttgaaaatggatcatgggccagcgatggtgcaaagtaccctcacttttgcgaaccgattcgaaaaacaagtaagcctctatggctgacttatcgtggaagaattgcacacgaggaaagcgatcacttccaagaactttttttgctagagtgtacggacgtgatggcactcttttcttcgccccgtcggttggcgctttttaaacgaacggaaacgattgtttgtgatggcactttcaaaatggcaccgcgaggcatttatcaagtttaatgtgaatatatttgattaattcaatatgctcatccagatttaccgagtatttggatttattgcacaaacgcattgtgttccattggcatgatttgctcagatttcccaagcgaattttgactacgaatctgcgtcagtgaatgcattttgcgatgtttttccaactgtcagaccaaaaatgtgcgcgtttcatgtgaagcaagcgataaatcgccgaattcaatcaatgggatttatgcaattgtacagctcaaaagaatcaaccatgctgagtcttaccacggacgacagcaacgcttttaccagcctggtttcttgctcggccgatggatagcaagttttcaggtacttgtttgtctctaacttttgtatcgtaaatgataggaactaaggcatgctgaagaagaaaccgcagtggccgttgatgaaggaagacaattgccagctcgcccgcttgaattaactcttgaattggacagaggaattgcctcagcgaaggcggatattttggcttttttgaacacggattactgcaatgatgaatttgttgaagccatgtctaattattatggaagaattggacatttggttggcttcaatccgccgtcaaaccgtaatgaagctgaagaaatgataattgaagaagatgcaaggcttttgcttgaacaaagtttggatgaaaatgggctgcttgttgatcaatactttgaagaaatgggtttgaatgaagtgcaagatgaaaactcgcctgatgttaattcagaggatggagaagtggatatcatgaattaattcatatgaatttttatttaacttttatatttgaagatgcttaaattttacattgttattaaaatacatgaaaattgggtcagaatcatttagactgcaattcattagcgctgagtcttgttttattaagcagtagcgtgtaatacataaaaattttcattgaaaatgaagtttttaaccaaaaaaacgaatcgggataataaa

SEQ ID NO: 79177 - DNA, 365 bp, Heterodera glycines
  Genomic contig location: Contig_ID=SeqID_2335; Location=611..975; Strand=+
  SCN-specific regions: Sequence locations=1-226,248-313,351-365
gaaatcacagtgtccggcttccccggcgccgaccgcgttgacattggccgtctcgtcgagttgcacggcggggtgttcaccggacagatgaaccgttcttcgtgtacgcatttaatcgcagccacaaattcgggcgaaaaattccgtaaggcgcgcgaatggggcactgtttgggtggtgacgagccgatggcttcgcaaatgcattgaaacggcacgaccgattatttaattttaatttcttcattttattttccagggatatcgtttatcggagagtcgttttgcgcattcacacgacgaagacaaacagcaaagggtttccccaagtttttctctgataacgaaaaaatgaaagatatttga

SEQ ID NO: 79178 - DNA, 1242 bp, Heterodera glycines
  Genomic contig location: Contig_ID=SeqID_2336; Location=2383..3624; Strand=-
  SCN-specific regions: Sequence locations=22-180,203-469,491-549,580 -1159,1184-1242
  Gene Ontology: Mol. function=ATP-binding cassette (ABC) transporter activity; Cellular component=membrane; Biological process=transport
ttgccccttccttctctatttcatgctttctcgacatgtagacgatgttctcgttgattaagctggagagtcgcgtcgtcgatcgcatcgatgcccccattttgaatgtatctccccccaattcgcaaatttcttttcgcgacatcactttcgcgtccgtctttgcttggtatgtcagccaaagttaatttcatttatatttagttacatccccggcaaacctattctccgttctttgtcctttgacgtgccttcgggcaagaaagttgccctcgtcggtggttcgggttccggcaaatcgacgattgtccgactgctctaccgtctctgcgacccacaaagcggtcaaattcgcattaatggacaggacatcgccgccgtcaaattggacagccttcgtcgggcaattgcaattgtcccccaggacagtgtgctgtttcatgataccattctgtacaatatccattatggggacagtgcagcaccagtgaagaaggtttttagaaaaataaaataaaaattgcttgaaattgaaccaaaggttttctgtattataattttttaaaaattttaaaatatcaaaacgaattaggtattcgaagtggcaaagactgcggaccttcacaatgccatcttagggatgcccgcgggatacgacacaattgtcggggagagaggactgaaactttccggcggagagaaacagagagtagccatcgcacgggcaattctcaaagacgcgccaattgtaagggagtcaaagaaatgagagaattggaattggggtattttaaagaaaagggacgtccgtctttttctcagattgtttacgatgaggccacttcgtcattggacgctattactgaggaaaatataatgcgttcgctgaagaaagcattctctggtcgaacgtcgttgttcattgcccaccggttggccaccattgtcgacgcggacatcatttacgtgttggatcgggggatggtcgtcgagtctggcacgcactcccaactggtggggttgccaggtacgacttaattcgaccaatgaacgtactgacgcggagtcatttttgtaggtggtaaatacgccgatctttggcattctcagcatcgaattggagcggaattagaattggcacaaagagaggcggagcggcagaagaaaagagaggaggaggaggtaatgttggacatggagttgagcgaaggcaaatgctgtgggggaatgacttgcaatcgc

SEQ ID NO: 79179 - DNA, 1277 bp, Heterodera glycines
  Genomic contig location: Contig_ID=SeqID_15017; Location=1088..2364; Strand=+
  SCN-specific regions: Sequence locations=1-253,289-436,532-749,772 -1051,1073-1277
atgaatctttctcggcacattcccagtcaggcgttttttcctgatgtgtcttggagcaatcccaatcaggcgttttttcctgatgcgtcttatcctttgcgcgtttccagtcaggcgtttttccctgatgcgcattatcaattattttcatccgttaaaatcgtttttaacatcaattcgctaccaattatctcacccgttcgttccaatatattgaatgtattgaacattaaatttataagcatttgcgacctataatttaacttacataatatatatatatttttagccttaaattaaaaaaatctcattttcaattctcttattattattgatttttaccatgactatttaacttttaaaaaagaaacgattactgctgaaatttaaaaattagaagggtaagacgcaataaaactttgtaatgattaaaagcaaattaaaattaaaatagaaatgttttttttaattatatacaaaaattgttatgcagaaaatttaaatcaaagttaaaataaaaattttttttatcgagtttggaatatctgtcgccaatttttctattggcgacgagaaggccggtgccaacccgccacggcgtgcgcgagtgctcgcgttcaacaagggcatggacgggcagcgaatcgggagagaattggacacggacgaagaggaccgccatggggactcagttttctcggtaccgaatacgaacccgtgggccggaccctccaagacgaagaaataccgaaagaagagcagaaaggcaactagacgatcgggcggactcccgattcatcaatttctcaatcgctgatttcgatcatttttcctttcgttattcgtaccatacaacaccattttcctattcttcttgtcccatttttacttcacttttcaaattcatttctcatcggctggctaatctccggcccaaactttgtgcaaaacaattttgcacaaagttctttcttctcaatttccttaacttttcacatctgccaatttacattttatttttatgcgccatttctttgttcacatttttcacatcacaatttctgcccattttttgtcccatttttctcatcgcattaccgggccgtctgtcactccgcccattttttcgaattgtctatttaagcggccctgctcaaggggtcgctctcttcgcttccttcacccccccccccaaccattcgcgtttattcgttttgctggacttttcgatcaattttcaccatttacgcatttttaattcgtcgatcgcttcgtta

SEQ ID NO: 79180 - DNA, 1364 bp, Heterodera glycines
  Genomic contig location: Contig_ID=SeqID_15018; Location=1473..2836; Strand=-
  SCN-specific regions: Sequence locations=1-490,512-588,633-1315,1338 -1364
  Gene Ontology: Mol. function=transcriptional activator activity; Cellular component=nucleus; Biological process=neuron differentiation
agggcgatgatgaaaaacagtcaaatttagccttatccctttggcactacggcaaagtccgagcggacgactgactttctacgcgatttacgagtacataatgaacaaattcccattctatcggtcagaatttgagtgggattttatcaatttaaatttgccgttttcagcacaaatcgaaaggcgtggcaaaacagcataaggcacaatctgtcgctgaacaaatgcttcaaaaaggacccccgcccatacgacgacccgggaaaaggtgaacacggacggagtcggcactaaattcacaattcttggcccaattttcatgccaaactcaccaattgtccccatttccttggctttctctcccaacattcgcccccccccccccaattcattgaagcattctgtaaatgacagccgatcggtggttgggccgagcacaaatttacgacgatcataacaagtcgagggagagggacaaatgattgattgttttgcggaaaacagaaaatggcaatgaaagaaaaccatgggaattttcagggaaaaaccttgaattatgcaaaatccgtccctttcgaattggcacttttctaaatttttcaatttcccctcagaatttttcatcactctcatttgccaggcaattattggatgctcgaccctgatttcaaagacgaaattttcatcggtgccaccacggggaaactccaacgacggcgacgtccgaacggaattgggcacaattaccaccaccagcaatacggcatgctgagaaaaagcggctcggccgtgctgaaagggctgaacgaaggccggcccaatcaccagcacggcctagtgcagcagcagtcaatgccatgcctgcagcagagtccgttcgcagctccgacttcgtcccaatcgctgctatgccagccgagcggcgcggcactggcggcgctgggcacaatgccggccaaagtgccggcacagcactcaaccacttcgccattcatgcggccaccgccctttttctgcttggccgcccaatcgcctccgcccagccatttgctgtcctccccgctgtcgctggtgctgcactcgccgcctctgctgccctctccgctgttcccccaacaaatgatcgaagcgtacgcgcaacacagccaaaacgaacagtcgcagcagcacttggcactgcttcaactcatccagcgagcgcatcagcagataatcaccaatcagcagcaaaaaatgatggtggaagtggccggggaagggaacggcacggccaattgagacgaaagtgtaataaaattggaaattcgactttgcttttacatttatttattgggtgtaaaatgcatttatatacaaagaagcat

SEQ ID NO: 79181 - DNA, 1363 bp, Heterodera glycines
  Genomic contig location: Contig_ID=SeqID_15020; Location=58..1420; Strand=-
  SCN-specific regions: Sequence locations=1-57,79-248,270-293,357 -646,668-741,764-974,997-1049,1071-1083,1115-1304,1341-1363
atggcggaaggtaacgcaagagtggggaagagacagtgtgggaaagccgagaaatgcgcagaggaatagtgtgtgcaattgagagcgcgagagcaagcgaatgaaaggggaaaaatttgagtgagagagagtgtgtgagggaaaagaaaaaggcaaaaaattttgagaaataaggaaatatgtaaaaggcgggagaatggacgagaagaaagagagcggaaaaatagttgataaaattgagacaacacagaactggcgaaagaaagagagataatgaggaaattttccctatgtataattttaatttttgtcaataatttgtaaaatttaaagaaactttcttttaaaaaaaatttcaggcgacgccagacccgtaatcagaaaaaaatttcgggagcggcaaccgaagagcttttttttttgctcttcgtgccaaaaaaggaattgtcgccggtgttattttaaaattttcagcgccggagagcaaaaacatgaatttatagccgcaaaaaaaggaataatttttgccattttttggttaaagtttcataaattcggaaaaatatgggttacagacgacgggtccctaaaaaccccgtatacaggtacgacccgtattcgctctccaaccgtcactaatcaggaaatataatgagaaaaagagaaagcggaaaaccaagcgagagaaaaagagggggataatgataataattagggtcgcgacttttagtgacgaaaaatcccgaaatagttaactaaaatagtgacgaaaaagtgccaaaataatgaagaaatagtgaaaaaagtccgaaatagtgtcgaatagtgacgtaattttcagccaaaaattaagcaaaactaatttttattcactgattgcagttgcaaatgagctacatttcctttataaaattctcttagtaaatattgacattttttatatcaaaaattttgtcaagaaaaaaaatttgggggaagaatttttgaaaaatttttccaattcttagtggtgtatttaaaaaaaattttttggtcgattcttaggggtgtattttttgaaaaaatttttaggtcgattcttaggggtgtattttttggttttattgcatttttgttaaagaattttccaaaaaatgtcgaaatagtgacaaaatagtgacaaaacgccaaaatagtgatttttaactattttagtgacgtccaaacgaaaaattttaatgtagaaatgggttttttgagctcctttcttcaaaacaattgagcaaaaaaaaagttttttcactagaaatcccgaccctaataataatcacttttaatgcaaatatttatgcttatactatacatatgcattttgtgtaataaa

SEQ ID NO: 79182 - DNA, 696 bp, Heterodera glycines
  Genomic contig location: Contig_ID=SeqID_15021; Location=222..917; Strand=+
  SCN-specific regions: Sequence locations=1-6,30-163,188-210,232 -275,298-696
atgcactagttagttttttaatttcatttaatcgcctctctcagtttgatatatttcttttataaattagttgacattcttcctttaaaattaaagaagaatcggcacaaataataacccaatttgatatttaaatcaattagttgatcattaattaatcttctatatatttattaataaaaagtatctattctatttttcattctctgcaaaaaatttataaaatatggaaatttttgccgagtttaccatttccgaggaaaattcaaaatacctaaaaaatattaaaatattttagcgaggccctgctcgacagtttttggctgaaattcaaagatgtgggaaacgttcttgaacaaaatgtgccattagcacaaatcattttatgggcgtgggacgacaacggggcacaagtcatcaaagaagtgattaccgaccaaaatgctgtttcacaaaattcttaatttagtcagtgatcctgaaaagcggcggaatggtttctttaccggtagatgcaatttcatcgccttcaattgtcgtccgttttctcaaaaaacgcgaagactcagaaaagtgaaaaatttacttcatttgtattttggttttcccctaattttttcatttttctccagtccttgccctccgctgagttcgccagccgatgatttgactgtgcatattggagaccggcaggta

SEQ ID NO: 79183 - DNA, 356 bp, Heterodera glycines
  Genomic contig location: Contig_ID=SeqID_15022; Location=421..776; Strand=-
  SCN-specific regions: Sequence locations=1-356
tgacttaattggtgatttattctttttgaataccaacaaaaaaacaaaacaattagttgaacaataatgctaataaagtgattttccattggtgggctttgcatccgtttttcgtccttaatctccgttaatccaaattcggttctccgtttgaacttttgtcacgtcacggggctcacccaaacattgcaatgcttttcgggcgcgtattttgaattcaacggacaattgaaagcgttgcggaaggcgggaaaattgcgcaaggagccgaacacgcggaactttgcgggagaatgagaatcgccgatcagctgaaggtacgtctcgaaatcgtcgggctgatcacaccacggctg

SEQ ID NO: 79184 - DNA, 615 bp, Heterodera glycines
  Genomic contig location: Contig_ID=SeqID_15022; Location=1..615; Strand=+
  SCN-specific regions: Sequence locations=1-255,277-418,441-615
  Gene Ontology: Mol. function=metalloendopeptidase activity; Cellular component=integral to membrane; Biological process=cell-cell signaling
ttccaatgataataagtgattacattgtgctgataatgcgcttttgtcagataaccacggggtccaatgggacgccgaaggtgcggccaacaaatggatggacgcgcattcgcaacgcgcattcgacagaatggccaaatgcgtggtggacgagtactcgcagctgtgcccattccctcccgatggcattgttcaacccgcgtgcattgacggagacaaaactcaggcggaaaacatcgccgacaacggaggtcaccaaataaacggactcaaatgtgatctgcttttgccttcaaaggtctccacgccgccttccgtgcctatcgctctgcgctcgaagtggacggaccaagcaaagcgttaccgggcaaattggtcggccgcttcaaccacgaccagctgttcttcctgtcctttgctcagccgtggtgtgatcagcccgacgatttcgagacgtaccttcagctgatcggcgattctcattctcccgcaaagttccgcgtgttcggctccttgcgcaattttcccgccttccgcaacgctttcaattgtccgttgaattcaaaatacgcgcccgaaaagcattgcaatgtttgggtgagccccgtgacgtga

SEQ ID NO: 79185 - DNA, 228 bp, Heterodera glycines
  Genomic contig location: Contig_ID=SeqID_15023; Location=56..283; Strand=+
  SCN-specific regions: Sequence locations=1-228
atgttaccgtcgtcattcacaacaatttcccgcaaagtccgttcccggtaagtaaagcaatggaagtgcatttgcaaatatttgatcttttttacaacactatcattaactaattaattcaggtgcgctctttccatttccggaaaggtttgaccactgaaattgaaagtttaccagcggcaaataatttcaagaaaaactgaccgataaacgaacaaaaaaaatcga

SEQ ID NO: 79186 - DNA, 327 bp, Heterodera glycines
  Genomic contig location: Contig_ID=SeqID_15024; Location=2151..2477; Strand=+
  SCN-specific regions: Sequence locations=1-80,155-306
atggacaaagtgactccgaattttaaagaggagaaacgaacaaatgccatcgttgttcccccaaaggatgcaattggtacaaattaataattaaacaaaaaatgatttaaataattattaaataataattgaaattaatatttttcataaatttcagtgaaacgaaataataaaactgctgttattgcccatttgcacgtcttttaccaaaaatgggctctttttgtggtgaaacatcgcactttaataatggcaatttgctcaattctttcgactttgggcgcagtgaaaatattcaaaacgccgtaaatgaaaattaattaaata

SEQ ID NO: 79187 - DNA, 600 bp, Heterodera glycines
  Genomic contig location: Contig_ID=SeqID_15024; Location=3968..4567; Strand=+
  SCN-specific regions: Sequence locations=1-7,45-480,502-600
aattggtacatcaccagcagcagcagcaacttgccaccagtggcctattccaacgtcaacaacaacaaaatttttatgctgaaagaaccagcaactcctcgtcggttgttacgaccgcgctgctggcacaacgtaattagtgtgccaaccgtctggtctcgagagtctcggtatcggttcttgaggccaaaaaacgatcggaatttttggagacttcatgtcatttaagcagctcgagagtctcggtatcgaatctcgagcccatgaaaaatattcgggattcttagatacggtatatgttggtacagtcactcaaaatataagacaaatgccatttatacatataggcacattgtaattgtactctcttcagatcccctggttgtcaacatggacaccaacaatgttgctgttgctggcgatgataatgatgttgccatagttgaacaacaacaacaacaacagtgtcggaatggtggtgttgctgctgatgagggagaaaatgctgcagcaacaaaaatgacggcaacaacgcccgtggttgttgaagcagtagcagcagcacacgaaggccagcagcaaccgacggagccgaataag

SEQ ID NO: 79188 - DNA, 1510 bp, Heterodera glycines
  Genomic contig location: Contig_ID=SeqID_15025; Location=1109..2618; Strand=-
  SCN-specific regions: Sequence locations=1-183,205-1510
atgcgtcgctcgaacttcgttaaaacccaattggaaacattgccacacatttttgcacgtgccaaagtactgctcgacgaaggggaaaatgccgcctctgttttgctccatcgctgtttggcacaaacattcaaaattgtccaggggttggttgctgaactcatctcattcaattaacctatccaattgcccatttcagttttaatcagcttaccatgcgcaaattcctcctttcatcggctttgagcaaacctttgtcggatggcgggtgggcaatctgttctcgttcggagttggcaaaggcgcgcattcgttcgctggtcgctgtgctgcgggcaaatcgaagggcgtccgacacgtggaacgaattaggaaaggtcaattaactaattagcaggatattattttcctaacattttgtttaggcatttttggacacatttttattaaatattggcaagaaatccaagccaaacacttttctcgagaggtgctctctcgtttttatttctttccgttaattttccgcttttttcctttcagtgctcttcattgttttcaagcggctgttcgtttttcgagctcaagtctcaaaaaatcggaatacctttgcaatttgggtgatatttaatgggttgtttaccgattttgccgttgaaattgccaattttcgttgatttagctcgactttatttgctggagggaaatgcctcccgggcccaacattgcctcgtccgtgccattcagctgaatcggcactgtgccatcgcgtgggctctcctttcctttctctacctccaacttggccttgttggtgtttcccgaatatttcaataaattaaacacttaaaattctcagaatgacgaagcgcttgaggcgatgaacaatgcgcaaatgatcaatccgtcaatgtccgaaacttggcttccacacgtaagtatttcccaatgtagcccttaattgctgttttaattactttcaatttactcttgattacccctcgtgcccatccctttaggccattcatgccgaacagtcaaatcattatgacacgatggatttgtatcggcatgccattgttctgaagccatccgtcagttttctttctttttatgatatttgttatatatttttctgttttaaggcttttgcagtccaaaaatattgttactttttgcttgaccgccaacggcgacggaatgccctcgcggaagggtccatgataaacttcgaagtgctcaaaagccttttttgtaattattgtcccattttgctttgttccctttaccccccccccccccctcattaagttaattgccctctcagtgctcaatttgttcacgcgttggcttcacttgcggagcatttttggcatttggaagaagcggtggaatttttttgcgagccgaagagtttggaaaacgttctgaaggaggacaaaataatggccagaaacaaagagcggattctgatgttagtcaaagcgaagaagcgaaacatttccattaa

SEQ ID NO: 79189 - DNA, 789 bp, Heterodera glycines
  Genomic contig location: Contig_ID=SeqID_15026; Location=227..1015; Strand=-
  SCN-specific regions: Sequence locations=1-58,87-209,238-375,397-789
atgtcatttcaagaattggaggcccaatggattttggttgagaatgaattcgatgccaaaaaattatcagaaaaattgaaaaataacggagggaatgtggcggagggaatgcctttgtcttcttcggattgcgaggagtcctttcggaatgctttgttgcttaaatgtctgattagggcaggtgaaattggcacttcctatgagttacaggtgccttttcctttaaaaaacgccattcttttcaaaaaattcctttcagagtgaatttgacgcgttgttccccgataaaaatgaccaatctttgcatatctttcatcatttattggcgctttttcatctatttgtggacaaacatttggaaaatgcgcgtgccaatataagaaaggcattggccttcagtttcattccaattttaaaatgccttcaaatttcaggcgattgcttttgcggagactgacattgaggacactctcatttcggcacaaattttcatcgccaaaggccaacgacaattggcgaacactcaattggtgaacgcggcgaaggaaggcgagtggacggacagttacatttattcggaaaatgcaataaaacgaccataaaataggccaacgaataaattatgcaaattttagcacccaatgattggcgtgttttctattggctttccgagaatttgctggcgattggaatgttggagaaggcaaagatttgtgtggaacacgcgcgaaaaaccaatacgaaaagcgaactgtgcgcgaaactgctggacgaaatcctcgaaaacgg

SEQ ID NO: 79190 - DNA, 488 bp, Heterodera glycines
  misc_feature (392)..(392): n is a, c, g, or t
  Genomic contig location: Contig_ID=SeqID_15027; Location=2449..2936; Strand=+
  SCN-specific regions: Sequence locations=1-66,95-198,254-320,402 -415,437-488
atgccagccgccctgtcccgcgccgcttccgccaatgtgcgactgtccatcgtgttgcacatatttgccaccaccgcccccgccgccatgctgctgcggtgagttttttggggggcgtaaatcacaaaataattggaattttttattgagcaatttggtttttaaatagaaaaaaattagtctatttacaaatgtttcaaaaaaatattttttaattttgattctttcaataaaaaaaaaatattttttaattctgattctttcaataaaactttaagctttatcgaatttttcccgaaattttcaccgaaaaattcttctttattattaaaaataattttattaaaactattttttcactcgaaaaaattattatatatatatttgattanaaataatatgcgagattaaattcgaaaatgaatatttaaattttcaggtggaggaggatatggcaaataatcaaatcaatgccgtgccctttttga

SEQ ID NO: 79191 - DNA, 1030 bp, Heterodera glycines
  Genomic contig location: Contig_ID=SeqID_15028; Location=181..1210; Strand=+
  SCN-specific regions: Sequence locations=1-453,475-599,623-638,660 -1030
atgttcagaaggatgctaaccaaaacatacacaaaacagcaaaagcaacaaatggccaaaatggtgaaagaaatgcttgaaaaaaaggttaatcagcatactgtacttcactgctgtagttacaattcaattttaaaatgaacgatttatgtacataaaattctcgtgtaaaaatctcaaaccaatttccaacagcagatgaaaaaggaacgtgggactggtaaacaccaaattcatggacaaaaactaagtgatgatgaacaccagctgagagcgttgccgaatgacggtggatttttttttttattttagattttttgctttgggacgattttgtttttgagattaagagttacctatccgttcgggccaagaaaaataattggtaaattttatttaaaaaaaagtcgggaataaaaatttaaaaatcttagttttcggatttaaaatgaaaattattacaggaaatcataaaatgatacaaaaaccccaacgattagcaaagcgaaattaaattgggaaaaattaagatagtacattaagtattaaaattaaccgattttaagcttttgtgatcgaaaagaaaaaagaaaatcttttaattttaaaattttagatttaagatctgccaatttgaattttggaaaaattaaggctggcaaattaaatggagtttctgagggcgttttgacacgaaaactgagttaaatcttttcactttttggcatttttctttgttttttaagctgattttctgaggaagaaagtagcggctggtggtgaaaatggtgaatttaattatgctttttaatttaaatagttgatattgtgaatttatattaattttagattcgtcaaaaatgccaattgtgctaattggccatttggacccggaacagacaaacgcactcacaaaagcagtcataccaattggccttgaaaagctggcctaatttatgagaaatctgaaaaaagagatactattgtgatgaaattactactaatatttgtcatttgatatttgagaata

SEQ ID NO: 79192 - DNA, 1170 bp, Heterodera glycines
  Genomic contig location: Contig_ID=SeqID_15028; Location=2032..3201; Strand=+
  SCN-specific regions: Sequence locations=1-146,168-198,236-420,442 -642,664-746,768-788,810-872,897-1057,1079-1170
atggacgcgccaaaagttccagcggaagagccattcaatgaagagggattgatcgccgaaaaagtgcgacttttgaatgaaattgaggatttaaagcaccgattggaagaaacagaaaaaaggaaggcggaggcggagaaaaagagaagtaagaataatgagcaaaggccagtagatgaaattgtcctggatatggacgaggaagacgaagaagaagaggaggaagaagaagaagcaccccaagagtcaaaaagggcacgtttggaccctttggccacaaaggaaatagtgcaaaaaaccattaatgaaaaatgggaggcttcgggattgataatgattgacccccgaccggtagattcaaaggaagcgccgaaaggtgtggaaagtcgggattgggaggactcccgccgcttgctaacgagagaagagcgagacagagggtggagtgatttcgtttcaacaataagaaaggaagatcgattaagcgtcattggaaaagtcggacttggatttaacggccgacgtatggccggtaattgcataagaagtgcggaaaagagcattttgcagtcagagatcattcaacctgaaggaatgaggaaacaaattccagtccggaacgaattggaggcaaaagaaacagaagaagagttggagcgaagaaaacgcttcgcagcaaaaacaccggcaacccaagggcagtttgccaattgtgtttgggaggaaacagcacaaaatacaaaagaggagaaaatgaagaaaattgagaacagcatttgccaaaaaataaaccaaattcaacaacaaatgacagaggcgtttggaggattaaaagaattagccaaagaaatggatgaactgacgaaaatcgccaaaaaagaagaaatggaaaaagcggaagaatttcatccgaattcgaaccgatttgccaacacaaatacgtcgacttggcgacaacatgacgagttccgctaccgtaatcgtgggacggtcggcagatgggtcaacaacagccgtggacgcgggcgacagcgcccataccaccacaattggcgcgggaatgaaggatggccagaaatgatcattcacaatcagaaccatcaacaagtggcgcatttaccgttgaccaaagatcaatttaaaaatgattcgaataaataccgaccatag

SEQ ID NO: 79193 - DNA, 388 bp, Heterodera glycines
  Genomic contig location: Contig_ID=SeqID_15029; Location=987..1374; Strand=+
  SCN-specific regions: Sequence locations=1-363,386-388
atgccttacgtgaacgaaagtaagacgaattcaattgtatagggctctccatcttataaaaaatttaattctggcggcccttaaaaaattatcactttttcagggggtgagatgcaggacggcgctagcttttcaatcgtccggtcattttggagcctcgtctacttcttagcattcttgtaatcattcgcagcccattttaacaccattaaactcaatcattttactggtttaagttattgtcggcaaaaagtttattaatgagcaaattttttttttgcaaaaaatggaaaatttagaacctagcgtttttcaaaaatttcgatttaaaaattgtatcattggcacctcaaaaaacgatcattttgtttgcaacttttttgtcata

SEQ ID NO: 79194 - DNA, 75 bp, Heterodera glycines
  Genomic contig location: Contig_ID=SeqID_15029; Location=3186..3260; Strand=+
  SCN-specific regions: Sequence locations=1-75
atgactgttgttgtaaccggtgaagaagagacaaaaagtgtgaagaaacacaaggagaaggatgagatgaccaaa

SEQ ID NO: 79195 - DNA, 155 bp, Heterodera glycines
  Genomic contig location: Contig_ID=SeqID_235; Location=1009..1163; Strand=-
  SCN-specific regions: Sequence locations=1-155
ttcttcaaatttattggttgaaattgcatatgaaatacatttccaaattttttgactcggtaaggcgctttgacaaagacggctttcgttttgcaattagtcggtcaacattcggaaattggtctcgaattttttcggcaattacgtgcaatcat

SEQ ID NO: 79196 - DNA, 901 bp, Heterodera glycines
  Genomic contig location: Contig_ID=SeqID_235; Location=5230..6130; Strand=+
  SCN-specific regions: Sequence locations=1-370,392-603,625-654,676 -868,890-901
atgcaagaaattgcatggatgagttggaaaggtgtgtggacatttcgccaactgacacttcgccaactgacatctcgccaactaagccaaattcagacgtttcgccgactcacccaaaaaatgacatttcgccaactaagccaaattcagacgtttcgccgactcacccaaaaaatgacatttcgccaactaagccaaattcggacgtttcgccaactaagctaaattcggacgtttcgccaactgacattttgccaaaaacattcatttcgccaaatagccataatattaacatatgagaaaaaaaataaacgaaactgtttctttttcatcaaacatatcattattccctgtcacttccctttttgtgttaaagttttaaaatttcttttctacctaaacaaaaaggattttcagattctagtaagaaatgccaacggtacgtgaaatacttgagagtctgcaaaagccaattaaaaggccccgaattccaacaaatgaagacatcgtactgaatgctgataggactgacgcagaacaacaaatgcgtcgtaacacacagaaaggcgatggcggtgaattagcgagaagaagcaattaccgcacacacaattagccaaatggggatggagaattgtatcccgaatccaaaatccaaacaatttacttttacaattaaagtccgaggcagcaaattaaattcacagcagaaaacaaaaacgaataatatcataaaacaaaaaccgaaagaatgagaagggaatgacgtggctgctggtcagcagcagaaacacaatcgatattacagtaatatagaattggcgggaaatacaaattcaaagcaaagggagatgaaaaattgagaaggaaacaaccaaattaaataagtcaaaaatgggaa

SEQ ID NO: 79197 - DNA, 1109 bp, Heterodera glycines
  Genomic contig location: Contig_ID=SeqID_235; Location=1745..2853; Strand=-
  SCN-specific regions: Sequence locations=1-73,96-197,219-380,402 -451,473-795,828-1109
atgcctctgaagagttacgtgtgcgacccggaagaagtgttaagcgcggacgagcgacaaaaactcgcggaaatgctcgactctttccaggaacagacgaaaaatgtaaccaaagtcatgctcattgtcagtgttatgagtgatgatgtcacaccgttaaagaaaagttgtgatttgaaagaagaccaaaaatgccattcaatcaattggattcctttctttatcctccaataaatttcaggacggtggtcaaaatgggtgtaaaaagaagggagtcactggtgccgttgcgctttccaagaagccgctttattttgaaataaatgtgatggtaattttagtggtgccaaatgacacacatagacatttttttattgcttgtttaattattcgtttaaaaagtaatattttatggcaaattgttgaacaacaccgtcgacgcgcctttccgacttttgcatcaatgggagttggacaacgaatgccacaaggcctttctattgactcttcccattgatttgtttaattttggccgcgtcgcattttatttcgccacgccaattttgcaggacgaaataaaccatttgtatgcagcggaggttggccatttgagaaacagaaaaaataacgagaattattacaacatattgcatcaaaaaaaagcaaataatttggcatataaatttattagcaacaattgtttcaacaaaagcgttgggcggatgcaatccatggcattttggctggcataagaaaaataattaatgaccggcatgggactttgtccgttgaatcgggagacagaggaggaggaggaagggaagaacaagtaataaattaagtggataattcaaattctcgaaaactttttaatcggaaaataaaagaataaatatttttacaattcccagcagcaagccgttctgagtgccaatttagtggttgcccattcgtcctccatgttcgctcattttatgctttcaatttgctccattttggcatcagtggcattaacacttggcatcctgtggatatttcgggctcgtatctttttcatgcgctacgacattccactagtgcagtttaatgcacgaacgatggcggattaa

SEQ ID NO: 79198 - DNA, 6990 bp, Heterodera glycines
  Genomic contig location: Contig_ID=SeqID_235; Location=6247..13236; Strand=-
  SCN-specific regions: Sequence locations=1-1255,1277-1485,1507 -1728,1773-2389,2411-2424,2446-2592,2614-2662,2686-4269,4292 -5013,5036-5286,5309-5435,5457-5680,5702-6188,6210-6308,6330 -6436,6458-6522,6544-6767,6790-6990
atgccggttatgcgaagtccgccattaacgcgacaaagagcgttaaacctcggcatacaattgcgaaacgagggcataggagttgcgcaagaacagcagcgagttcagcaacagcactccgacgtcggaaatgctcctttgagcgaaaacgaaaatcgccaaagccacgtttcatcggtttcatctgttttaggaccagacacaatccaccggcgacttttgcaaatcccaaatccacggaacgatatggacgcgcaacaaaatcgaaacgatttggacgaagatgctcttttggatgaccatggtgactcaatttttggtaacgaaaatccccatgaacaaaatttgggtggagaaaatgttcgaaatgcagttagtgttatgagaagcattgaccaggggagagtgcgcgttgatattgtggatgattttgggtttcacccgggcatgacttcgaccccaaacgtggtcgcaaattatcagcgtggtgaaccgagttttatgctcaatcaaccaccggcagtccaccaacgcaatttgatgctggaggaacagcattttcgttttgtcgcacagcctaacgccggggaacgcgctgaaccaagagaccaactttattttcgacaagcgcagcaaccaacgaatgtcgggccgcaacaaaatgccgaatatcatcaccagtacattcatcagcgaaattttccgcagtttgaaacgcgtgaaccccatcaacaaaaccaacgcaattttgttgaaaataaccaacaaatgcgtttttacggaaatgctgctcccaaattttgtcacgacccaataaatgttccacaaacaaattgccaagggccggtacaatccccgcttagtaatttggagtacgtgctgattctcgaccgtcttcccgagcttaaagggaacgaaggcgctgataaagtgcgctattttttcaaaaaattcgtgtctgcgacagagggatggccggacaacaaacggatttcctctctcgaatcaaaaatttcgggcagagctgagcgtgcgttcaatgctgctttggcaaatcagccataccggtttgatgcaattcgccgagcaatgcaagcgcatttagaggagactgattgcagagagatgggtgcttttgatgagcttatgaatggagtgaagagaaaaccgaacgaaagcatggatgcacttgccgatcgggttcagaacgtagtccaacgcgcataccccggcctaactcaaaatttgattgacgaatatgctacaaagcatttaattcgtgctttgtcaaacccggaattgtctttatcgcttgaaatggcacgccggcctggcatgtgctttgacgaatttgtcgcattggctgctcgtgcagagtcaatccaaaaggcgacaaaaaatgtgtcaaccgaacgtcaaaacattgacgaaagaaatcgtcctacccagcgaaacttttcccaatttggacagcaattccaaactcagcaaaaatcaaaatttttacaaagttttcaaccgcgtgaaaacattgtttgttacaattgtaacgaacccgggcacttttctcgtgactgtcgacgacgaaaacaaaatttcgattacagggctaaccaaagccacgcagtgcccgccactggagcaaacagttttcagatccggccaaatggtcctgaaaatcgagcacttccacagacttcaacaaaagagtctgatcaacgtcgttcacaaaattttttaaaacaaaattgcataattatgcaagaagaggcaccacctgaagttttttgccgcggcgtacagctttcgtccgaaatcgaggaatttttcgaaaatgagttcaaaggaaaaaatgaggaacaaaacgaagtgaaaagtttgggccgagtcgggaagattttggtcataaaagttgagacttttggggccaaaacggaagcaatgatcgacggaggagcacaaatttcgttgatcggcgctacattcctgtataaattgatcagagaaaacggcttagacctgcaaaaagcaaattttgcccgtacaaaggaccgaattgccgacgtcaatggaaaggaacttcaatgttttggcacccttacaatgccaattcttcgaaaaggctgtatcgaagtgcctatccatttttacgtgaccagtgccccatttgggttcgacattttattcggaacaaattcattaactgcactcggtttttcactgtacgatgcaccaaacaaagaacttataaagtttgaagaagcgaccaaaaatgaaaatgcagtcagaattatcttcaacacaatactgcagccacggacttccaaattcgtccaaatggaagttggaaagcaatggaacggccaagacgtgctgatttgcccagtgccaaacaaaactgaaatcaaactggaacaatcagttggaaaagttgaaaacggaaaagttgtgtgtcaaatttcgaatttgtcttcaatgacggaacaaatcgaaagcaaaacaatagttggcaatgtcgagacactcgaatcgacatgggaagccgacaattcacttctgccgtcaaaaattttcagaatcgatcattgtcaaaacggaaacaaaattggagaagctgaacaggctttgaaaattggacaaatcccaccggaaggaaaggacgatttaatggatttgttgcacaattttgaacaaattttcgctttttctgaagaagagctgagtcaaacaaatttggctagccatcacatcgacacaggaaattcggtcccagttcgctcaagaatgcgaccagtgccttatgcatatagagagaaagtctctgaaatgatccaaaactatcttggacgcggtatcatccgcccttcatcttccccgtgggcatctccgattgtcattgtgccgaaaaaagatggcactcttcgattctgtgtggactacaggggactaaactcagtcactgtaaaagacgcttacccgttacctaatatcgacaatacactattggcactcgggggtaaaaaattcttctctacacttgatttcctttccggttattggcaaattaaaatgtcaccggattcgattgaaaaaacggcatttgccacggaatttggactacatgaatttgtcgttttgccgttcggactttgcaacgcagtcgcaacgtttcaacgatttatgactcaactttttgagggacttatcaacgacttcgttttcatctacatagatgatattttaattgcttccgaaacgtggaagaagcaccaacaacacttaaaagctgtgtttgagagaattcaggacgcaggccttaaactaaaaatcagcaagtgccattttgctgcaagcgaattaccgttcctcgggcacgtgctaacaacagaaggaattaaaatggatgtgaacaaagtccgtccagtaatggaattaccaattccaacatcaaaaaaggctcttcaatcactgctcggatttttggcctattaccgtaaatttattttcggttttggtgctatagcagctccgctgtattcgcttctgaagaaggacactagttttgccatcggcaaattagaaaaagaggcaatcaacgccttgaaagacaaaattttggacaacgccgttttgcacttcccaaattttgaagcagcaaaaaatgaaccatcccgtcaattcataatgatgaccgacgccagtaaaatcggaattgccgctattctctgtcaaccggatgataatggcaatgttcgaccaatttacttcgcttcgagaaagtgtaacacttacgaaagcaaatattgcccaaccgagttggaagcactcgctgttcggtttggagccaaaagattttcgcaatttatcacgatgcttccaacgagagtctttaccgaccaccgagctcttatccatatgtttaaaagtaaaacagagaccggaaacagtcgcgtcgataagtggctgatgcagttgaactcaagatttatcctacaggttgaatatcaaccagggaaaaagaatgtgatcgctgacattttatctcgttcgccagctttaaaatgccccgaaccaccggcaaaaagcgaaatttcgagaattgcgcaaataaaaatttgccaaattcaaagttcggtggaggaagccaacaatcgtatggaatggatcgaaaaaacgaagcaaagcgaattaaatttcgtttatgagtttctgtccaaaagaattgtgccgcaggagccgaaaaataagcaaaggcttacggcatttctcccaaatttcacaattttggatgggcttctctacaagtgcgaagccgacggaaaactacgtctcttcgtgccattcaccttcagagaagcgctgatcagagaacggcactcaggaatttgtgctggacacatgagtggcaaaaagatttatttgcaactcgcgcatcaattcttctggccgaatatgtatgcagactgcgtcaaaattgccttaaaatgccgaatttgtgcacattcgcgaaagccccgagctaatgaaccaccaatgaaaatcgttcaaacatcggaaccattcgaattagtgtgcatagatatactatcgattgggcccgctaattcgtcgcacaaatacattttagtagcggtcgatcatttttcgaaatatttggtcgcagtcccaataccaaataaaagtgcggacacaattgcgaatgaattcgtcaagaatttcattttgattcttggaactccgaagaagcttcacagcgatagggggaaagaatttgtaaatgaaacgctcaacgaaatcaccaaagttttaaaaattgagaaatcgcttacatcgggttacgaccctcaggcgaatggaattacggaaagagcaaaccaaacaattttggggatgctgaaacgatcaacggcatctaattggacttgggacgagaggctcccattcgttgtctttgcctacaacatcactccgtccgagaccacgaaattctcgccttaccatcttattttcggcaaaacaccaaatttcccatcagaaatttctttgccagtaaacccgaattacacgattgatgtggacacttacatccaactttttcgtgaaaatatcgtacaattaagcgaaattgcacagaaaaactccgaaattgctcgtaaaaatatgaaaaatcagtacgatcaacagccaaaagtcacggcaaataaattccgcatcggcgaaagagcaatggtcatttatccgggagttaatacccgttcagctcaccggaaacttctttggaatcactttggcccatttaaaattttggatctcactgattcgacagcgtcagtcataccaatcgataaaccgaattttgagcctataaaggtcccaatagaacgccttgtaaaagtgcctgaaggtgtaccaaacattagtacacttccccggggtaaaaaccccttcaaaaatcagttaaatgcgctgataagtgtcgtgtgtttgatcagtcgcgaaatggaaaatgaaccgtgtggaaaaagtgcggccatggaaaagatcaaagatcgggaaaccgaaaatgaaaccacaaatttgggcaattctcaaaaattggaacacttgggccgtcatttaattgggcaattgaggacaattgcaaattcagttggtggaaaagtgatggagacggaaaacagctgcgggcctttgctttgggacacgcaatgcggtggactcggcatcgaacaccgaaactgcgtacaaatgacagcagccgacctcgacccagtgcttgaaagggccggtcttggcctcaaagtgatcagaaaatggaaaaagatccaaaatggggatgaatgtggcgattttaaggtgatcggcaccccaatgaaagcccttcttagcaatttcttgctaaaatcgaatgccgtttcatcagtcgccggcggtcggaaattgacacagctgatcgtcagtgctccggttggctttgaactgatcacttactccggcgcacgcgaagaccaagtgaaaagcggcaatttcccaacggaaaaggacatcgaaagtgcctttacggcgtgggtcgaaagatgcgcagtgacaagggacaaattgctgaagactggctacactccgatcgaagtgccaatgccaaatgtcgttgccgaattgccggaatcggaaaaactcggatggaacgaggtgctaaagaaggccagcttcgtactagaaaaagtacgcgcaacgacgatccaccgcaagccattgttcgtcgagaagccaagagtcatcgtaggcgactcatcggccaaacaattgttaaaaatgtggccaaaatcccaattcattggcactgaagaaggcacaatcaccgaagtgatcagagcttttgatggcgcaattttatcatcaaaagtgaaggccgtcattgtgatgatcggaagagattcgatcagaggtgaagaaacgatcgaaaatgtgctggaacgtgtggggcgacttgaacagctgttgaagcgctttagccatgcccctgtgttttggctgccacctcctttcatcaaagagaaaatgattgaatacgaagaactgatcatacgaatgaaggaacattttgggacggcacaaggcaatgtcaaatttgtaacgacaacgccggcgggacgatcagtgctggaactgtggcgctatggctccggtttcaataccgaccatgtgtcaaatgatggcaaaatgacggaaaagggcttattggttttgagggcctgggtcatgtcccaaatcaaagggatgccaaaggaggacgaaaaagaagagtcagaaccgaaaaagaagagtgaagaggggccaaatggagggacaagcagaattggaagaggccgtggacagttcaaccagtcagggtcgcgtggagctcggcatgttcaccagcaccacccgtatcgccgtcagttcgcgcagtcctttccgagtcgttctcgttttggagctgatcgccgttga

SEQ ID NO: 79199 - DNA, 865 bp, Heterodera glycines
  Genomic contig location: Contig_ID=SeqID_236; Location=1770..2634; Strand=+
  SCN-specific regions: Sequence locations=1-865
atgccaatttggcaagctctatcgatgctcgcctttcggcctttcattacaatccggaggtcggcaccacatttgaaagttggttcaaacggtttgggaaattgatcgaggacgacggaagcacactgtaggaggcctcaaaagtgcgacttctcctcggcaaactcggagaggaggagtacagcaaatatcgggacacgatcagcccaacccagccggaccaagtgaattggaatgacaccatttcgcacctcaaacagctttttgccgagacacgttcgctgttcgtccgtcgcttcgaatgctttaaaattcgacagcaacaagggcaagacatctcatcactaattgcgcagatcaacgcatcatgtgaaaatgccgacctgagtctgacaaaggagcagctcaagtgcattattttggtcatcgcactcaacgatgaacaccatgatttgcgacaaaaggcattgaaaatgttggaggactctcagaaaaatggcaccaacatttcgctcaagaaaattgaggaggaattaagggcaattcaagttgtcaaggagagcgccctttcgctggtcaacccaccaattgccacaaacgccattcgcacaaggccacgacaatgggccgacccagcgcaaagacaaagcggcggctccaatcaaaagcaaactccaaatgccaattcaagcggaaagccaacgcgtggtcaaccgacgcatccatgcggatcatgtggcaaatccgaccattggcgctccgactgcacattcaaggacgccacttgcctcaagtgcaacaaaaaaggacacatttcaacaatttgccggcaaaagaaagcaaaggcaccaccgaacagccaccg

SEQ ID NO: 79200 - DNA, 632 bp, Heterodera glycines
  Genomic contig location: Contig_ID=SeqID_236; Location=1944..2575; Strand=-
  SCN-specific regions: Sequence locations=1-632
ttttttgttgcacttgaggcaagtggcgtccttgaatgtgcagtcggagcgccaatggtcggatttgccacatgatccgcatggatgcgtcggttgaccacgcgttggctttccgcttgaattggcatttggagtttgcttttgattggagccgccgctttgtctttgcgctgggtcggcccattgtcgtggccttgtgcgaatggcgtttgtggcaattggtgggttgaccagcgaaagggcgctctccttgacaacttgaattgcccttaattcctcctcaattttcttgagcgaaatgttggtgccatttttctgagagtcctccaacattttcaatgccttttgtcgcaaatcatggtgttcatcgttgagtgcgatgaccaaaataatgcacttgagctgctcctttgtcagactcaggtcggcattttcacatgatgcgttgatctgcgcaattagtgatgagatgtcttgcccttgttgctgtcgaattttaaagcattcgaagcgacggacgaacagcgaacgtgtctcggcaaaaagctgtttgaggtgcgaaatggtgtcattccaattcacttggtccggctgggttgggctgatcgtgtcccgatatttgctgtactcct

SEQ ID NO: 79201 - DNA, 2638 bp, Heterodera glycines
  Genomic contig location: Contig_ID=SeqID_2337; Location=532..3169; Strand=+
  SCN-specific regions: Sequence locations=1-321,415-596,638-784,806 -815,929-934,958-1137,1187-1324,1346-1437,1501-1530,1622-1785,1807 -1937,2025-2151,2173-2518,2597-2638
  Gene Ontology: Mol. function=protein binding; Cellular component =transcription factor complex; Biological process=regulation of transcription, DNA-dependent
atgctttgtccatccaatgcacttgttggtggtggtccatcattatttggcgagaatggcaccgatgaatatagcctaaatgttcacggatatatgacacaaaatcatgtgatttaatccctttttttcaaataattttatttcaattaaagtcatttattatgtcggcggcatattcccatccgattggctattatcaattaattgacagcaataatgccccaacaaatcaagaacagatccgagatgaatttcaaacatcagcaattcatcgcgcagcgcaacaagatgccaatggtaaaggtaaatgatgccaaattgaattaattattttgtaaaaaataaatttagctaattaaataaaaacaaaataatttatgtatttcatttttttatcaattattttctaattaaggaaagtcagcagctaatgaccaactaagaaatgaggcacaacaaaataatgcgatgcatgccgaagttgttgcgacacaaatgccacaaccagcgacatcagtcaattatgttcataatcactctaatcatctgatgcacaaccgatcaccgtttgaaccgttttgcacagttccaggcactttttaaacattttatttaaattaattaattattatttttaggtcgtatgagtttgttgagcagcacaacaaagtacaaagtgagcattggtgatattcaacgtcatatcaacccgcctgaatgtttgaatgcatcattaattggcggtattttgagaaagtcagtaattttgggggattttgtgaatataataccaccttctaaatttagtgtaagacaaatttagtaaataattgtatttttagagaaaatttaattaattttgtaaaaatttattaaaaatttttatattatcaagaaatgaaaatatttttatgctaaataataaaatcccgcatcataaaaaagaaaattatagaatgtgagtaaatattttggaatttcgttttactcaaataaaagccccccccacccctcaattagaagctcccccctatatgccaaccttcgaggggggttgaaaaatagaaaatactctgaggcttagtttcagtaaattttgttgttcattttttttttttggtttaatgagataaaacctttaaaaaaactaaataattgatcattattttattcattttaattaattgccattaaattttttccctaaaattagggctaaatccaaggacggcggcaaagcattgagggaatcgttgaagcgaattggcctttcattgccggccggacgccgaaagtcggcttgtgtgaccgcattcactgcattagttgaggaagaagccctccatatggtcgggcattaattaaaatttgtgccattaaaaaacaagcatttttaattttcaaatttatttgtccaaatcaattttaaaaaatgccaaattttatatgatttattaaaatgacaataaaaattttaatttaagcttttttaattttatagacattaaaaggagaatatttttttacgccatttaaattaatttctttaacagtttattaatttcaattattttttaaataattttattattttatttaaaatttgaatttactaatttttgattacatagtatttttgacactttaaatttttaacatttaaggccaatgattttaatgctgttctccaacacgatttcccggccaaggacatcggttttttcctcaatgcgcaattcctcagatatgttggccaatcgccgatggattccgaattggtggccagacgtcgtacaattttaaattgttcaaggtttttattgcaaaatccgaaccttatgattagtggatttagctgtccttggctttcataaatacatacatctcccgtatttaaaaaggctaatttgtaaggaatattttccgtttaaatgtcgtttttttaaaaataaattgacattgaaatttatttatttaacaatcgttgttatttaaaattttcattaatttttcaaatttattttcgggcaaaaattttagtgaatataataactcaaaaatcagaggttttgaaattgagtttctattatttgtactaatttcttcatctcttattaatgcgttacccatattttcgtaaaaaaaataaataaagaaattacaaaaattgcattttttaggatttttatcaaggagatcaccagccttttggctgcggaccgaagcccaatttgcgatcgtcgacctgaattgatgttggacccgagcatacaaaagcaactcacgcatttttcaatggcaatttttatgggttttttgtaaaatttttgaatcaaaatcttattaaatgctttaaattttttaaattcccatcgataagctctgcgttttctgccgctaccgtctcacaaaaaattgaaaaatacataaattttttaaacaaaataattgttctaacttttattaaaatgcgattatttattttagattactcatggctttggaggaattgcaatggtatttttcattatatgttttttttttgaatataattaataaatcttataaatatttatttataaaaataaaaatttttgcagatttcattgttggaagcattggccacctgcttggatga

SEQ ID NO: 79202 - DNA, 4213 bp, Heterodera glycines
  Genomic contig location: Contig_ID=SeqID_2338; Location=25..4237; Strand=+
  SCN-specific regions: Sequence locations=1-970,1022-1348,1393 -1613,1635-1679,1706-1754,1777-1783,1805-1885,1939-1950,1975 -2166,2218-2338,2370-2385,2407-2431,2453-2613,2635-2678,2700 -2806,2853-2955,3019-3024,3046-3361,...
  SCN-specific regions: Sequence locations=...3454-3545,3567-3634,3656 -3698,3912-4040,4210-4213
atgtcggtccggcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggctaacccataaaatatatgtttacaaaaaatcaaaaataaaatcatttttcttttttttcattcattttcatcctcaaattcgttgagcatgcctatcgtactttgaatcatgaattgcatttctaagtcgtcatactgttgttgtacgtcagcattttgactctgtatatctttcgtacaatttttctggcgcaatggatttggactgatgccaaaaactaaaatattaaaaattctaattaaaaaataaaattattattttcataatatccctccttaaaaattggaataaaatatttaatgatacaacattttttagataatttatgtatttttttttaccattttttaattcgaattcgtttggtagtggcggtggcgatggcacttcaagctttaattggacacttttttcgtttttcgctttcatttttaataattttgcgtctcttccaccatcttttttacgattttgcagattttttgctttatttgccgattcaattaaatatttttgtgcatttttcaaattttggtatgagttttttcccaatttttcgtcactttttaggcgataagtccaaacatttacctatcaaattaaaataattataacaaatcaaaaaataaaattaaaattacataatgaaaatccgtttgttcgtccttttttatcttctggtcaatttcgtagataaatgcccatattgaaacctgtaaaaaaacatcaaagcctaatcttttcattttttaaatccttgcaaaaaatctcaaagcctaaccatttttgtttataaaactcaaaaaatttcaaaaagcctcaaaggcctaattattaaaacatgaaaacacaagaagaggccaaaacatgcaatatataaacgaattttggattatcaaaccttgattgaatcttctttgttttcaaaattcatttctgaagaatttcttcttgcttaattatttttttgtaacaatttcggaaaattttttcacagtttcccatgaaaatatttttgtatgcttcaacaatgttagccattgccttggcaattggcaaaatgccatttctgtttggcaatgtaaactttggcttcagtgaaattgacattagcaatgcttcgccattaactgatttaaaaaaaaattcatttttttcctattttattattttaaatttaaatataccatttttagaattgatatatgttttgagattttcacaatagttgaaccaacgttcaatagatgaatagcgaatttgccactcaattaaagtctcaaatttgtccataatttgctcattgtggataattgttttgatatgttgccaatctttagtgtttctgtataaatttgcttcatcattttcagtcaactctttgcacataaattcgtgtaatgtaataatttccttaatttgtttaaatattttaataatttaaaaattaattaaagtaattaatcaatctaagtttaccttttcattcgcaccacatactaaaatgataaattgttgaatcaaaatagtggcaagaagataattcatgtcggcttctttaaatgcttaaaagtctctgcaaaatcatattaaataaatacatataaataaaaaattccgtagcaaatatgcaatatataatttgtaaaatacaacaacaaagaaataatcaattgtatatggaatcaaaattattccctatataagaataatatacccatgatccaagcttaaaaactaatttaagactttctagcgagttttacaggtcgagcgtggggtcaatcgacgcagtttttcaagggctataagggaaaaatagtgcggtttcgatcggtttagaactgttcgaactgtgttcgaaaaatgactcaaaaaatcaaacttttttgaatgtcccatttttgaacgctttttgcatgccttaaaattggtcaaaccaaaaaatgaaacaatttcttccaatctacaaagcctgggctttcgaatgataccagggttgtttgggtccgggtccgggaagtgccctaaaaagggattacaagcacttttggtcggaatttttcccaaaaaagaaggaaaatgaaaagggaattaaaagggatggtcgcaagcgacccggtggtcaagtggttagtgtgcttgcctttggtcatggggtgttgtgggtgcgagtcccaataatttatgagattttcccgtcaaatattatatttaaattattcgttttaaaatttttttttaatgttttttataagaattttatgagtgagttaaaagagaaagaaaggcataataaaaaatatggagcaaagtacttttggataaaaattgattactttcttttctttcctttttttatatgtaatgcacactcgccagtggtctttaacctcgccttttcaatcagcaaaaaatgtctcctccttttctttccccagttcattatcaattgtttccatttacatcagttttttactgctcctacttttattcaataaatatttccaactaaattattgctgttttaatagcataaatttttagtttttgccattggtggtggtggtcgacggttcgggtcccacctattctgggtgttttcatccattattttattaaattttttgaatgattttattttttttaattaattaagtttattaaaaataatttattttaaatattaaaaataataattctttctttctaatttagcccaaaaatctattgtttgaccttttttgtgcaaaatcatttaaaaatggagacaaattaataagttacctaaacataaaattataaatattttatgccaaaaaagaaggaaagtgaaaaggaaattaaaaggaggcaagcgatccggtggtcaagtagttagtgtgccttcctttggtgctggcttcccatgagttaaagtcccatttcttctgattattttaaagcaaatattatattgaaattattctaatttttgtttttttaaatttatttttttaattaattaactttatggtattttaaattaatgataatgattttttgaattaataaaataataaatatttttaattaatagaataataaagtctaaattaaatattaaaattaatcgaataaaaattaaaaataaacaaatattaataaatatttaaataatttataaatctcaaaatgagttaattttagggttagacgaatccgggtatttgggcaaaaccgggtccggatatttccgggtccagaaaagccgggtccgggtccaagtttttaaaccgggtacgggaggaagagaaagtggaagaggaacagaaagtggaagagaaagtggaagaggaacagaaagtggaagagaaagtggaagaggaacagtaagtggaagaggaacagaaagtggaagagaaagtggaagaggaccagaaagtggaagaggaaggaaagaggaagagaacgagaaatag

SEQ ID NO: 79203 - DNA, 373 bp, Heterodera glycines
  Genomic contig location: Contig_ID=SeqID_2338; Location=833..1205; Strand=-
  SCN-specific regions: Sequence locations=1-160,212-373
atgaaagcgaaaaacgaaaaaagtgtccaattaaagcttgaagtgccatcgccaccgccactaccaaacgaattcgaattaaaaaatggtaaaaaaaaatacataaattatctaaaaaatgttgtatcattaaatattttattccaatttttaaggagggatattatgaaaataataattttattttttaattagaatttttaatattttagtttttggcatcagtccaaatccattgcgccagaaaaattgtacgaaagatatacagagtcaaaatgctgacgtacaacaacagtatgacgacttagaaatgcaattcatgattcaaagtacgataggcatgctcaacgaatttgaggatgaaaatgaatga

SEQ ID NO: 79204 - DNA, 298 bp, Heterodera glycines
  Genomic contig location: Contig_ID=SeqID_2338; Location=1263..1560; Strand=-
  SCN-specific regions: Sequence locations=1-18,40-144,189-298
atggttaggctttgagattttttgcaaggatttaaaaaatgaaaagattaggctttgatgtttttttacaggtttcaatatgggcatttatctacgaaattgaccagaagataaaaaaggacgaacaaacggattttcattatgtaattttaattttattttttgatttgttataattattttaatttgataggtaaatgtttggacttatcgcctaaaaagtgacgaaaaattgggaaaaaactcataccaaaatttgaaaaatgcacaaaaatatttaattgaatcggcaaataaa

SEQ ID NO: 79205 - DNA, 618 bp, Heterodera glycines
  Genomic contig location: Contig_ID=SeqID_2338; Location=1707..2324; Strand=-
  SCN-specific regions: Sequence locations=1-83,135-326,351-362,416 -496,518-524,547-595,617-618
atgaattatcttcttgccactattttgattcaacaatttatcattttagtatgtggtgcgaatgaaaaggtaaacttagattgattaattactttaattaatttttaaattattaaaatatttaaacaaattaaggaaattattacattacacgaatttatgtgcaaagagttgactgaaaatgatgaagcaaatttatacagaaacactaaagattggcaacatatcaaaacaattatccacaatgagcaaattatggacaaatttgagactttaattgagtggcaaattcgctattcatctattgaacgttggttcaactattgtgaaaatctcaaaacatatatcaattctaaaaatggtatatttaaatttaaaataataaaataggaaaaaaatgaatttttttttaaatcagttaatggcgaagcattgctaatgtcaatttcactgaagccaaagtttacattgccaaacagaaatggcattttgccaattgccaaggcaatggctaacattgttgaagcatacaaaaatattttcatgggaaactgtgaaaaaattttccgaaattgttacaaaaaaataattaagcaagaagaaattcttcagaaatga

SEQ ID NO: 79206 - DNA, 2194 bp, Heterodera glycines
  misc_feature (2020)..(2021): n is a, c, g, or t
  misc_feature (2105)..(2105): n is a, c, g, or t
  misc_feature (2111)..(2111): n is a, c, g, or t
  misc_feature (2175)..(2175): n is a, c, g, or t
  Genomic contig location: Contig_ID=SeqID_15030; Location=34..2227; Strand=+
  SCN-specific regions: Sequence locations=1-99,121-205,227-795,817 -1074,1096-1261,1296-1497,1538-2194
  Gene Ontology: Mol. function=structural constituent of muscle; Cellular component=sarcomere; Biological process=mitotic chromosome condensation
ttgccaaaaattgtcaaagcgttgttggaccaaattgttgcggaaggcgaagaattgacattcgaagtgcaagtggcaggcgaagtggaccaaattcgatggctgaagaacggccaaccgctggacaaagacggaagagtcaaaatgatcaaagtggacgaacaaacgtacgtcgttgcttttgctctgatcattcagcaatcttagcaacaatcgcctcacactgacatttttccttagcagttacggtatccgattgattcattcgggccaaatacagtaccattatatatatattgattattggacagcctgtaaatctgattccgacctgactgctgctagtggacctctaataagctagcatttttaccaatagtaccgtatgctgagtttgaatttgttcagctaccgtatgacaattccaagtgccgcgctgtccgatgccggcgagttcgaagtgcaggccatcaacgacacgggcaaagctgtgtcctcagcgcatgctgaggtggaccaggcaccgcgcattgtgcaaggcctcgtcccagcagacatcgccgagggggacgagcaggtgttccgtgtggagacatcggcaccaattcggacgggttgaaattaaagataattaattaaaaatccattcgccttatttagtcaaatggttcaaaaatggccgggagattgaagcgccgccgggtgctcgcattcggctgaaggatgtgtcgccgaagaaatacgaactgctaattgatgacgcacagcttgacgatggggcgaattacaaggtacagaaaaaagagagagagtgagtgctacagtaattgtcggaaaagtaatggttgggttactgtattataagggtaacggattatggtaataaacctgcaccggtcaatgggcgtatattggtacttgtccttttctgttcaggttgtgctgtccaatcgtgctggcgaatgcgaatcgtccgccgatttgggcgtgtgcaaaccatcggtgttcaaactgcgcagcggactgcaggacgtgaccattgacgaggggcaaccgctggaattgatggccgagttggacggcgaaccggcggcggtcaaatggttcagtaatggcgaagagataaagccggacaaacgcattaaaattgtaagcacttaagttagcattggccttggcatagtgatcaatcttttttttcaaattatttcttaattaccccctcctaattaccccccactcttcgcaaggtgtccaatccgtccaccggtgtctattccctgagcattccaagtgcgcttgcctctgacggtggtgcgtaccgcgtcgtgttcgagaacccgcgcggcggagagctgtctagcggttcggtggcgcatgtgcgggccaaaaaacgcgcgccggagacgaacccagcagtgtttctgagcccactcgaagacgtggaattgccggagggcgacacgctcagcctgaaatgcaaagtaagtgtgatttgtaagcatttaaaaaatgtatttttaattgactaaaatgcaaaaaaaaaggttggtggacagccgttgcctgaggaggtcaaatggtaccgtgaggagaccgagctgaagccggacggggatcgaattgccatacgactcggcctcgacggcacggccacgctgcgcattcgcgaagtgcagctcagtgaggccggacagttcaaggtaatgaatgccatttgaaaataattatcttttttaattttaaggctaccgcctccaatgaagctggccaagcggagacaaaatgtcaagtgaaagtgctgacgcgtgagccggaaccgatggcaccgaagttcgtcatcccgctgcggagcatcgaaggcacgcccggcgagcgtgccgagttcacggtcaaagtgcgcggagtgccaacgccggaactgcaatggatcctcaacgacgcacccattgactttgcgagagaaccgcgcttcaaattggaggatatgcgcgacggcaattgggcaatgaccattcanngtaaagcattaatttcgtatcttggatatgtaccgtatacccataccgtacatccactgcatccccaattttataggatatccnagagancgactttggcactttgcgctgtgtggctatcaatccgctcggacgcgatgagtgcgagcccaanttcgacccagcgcggactg

SEQ ID NO: 79207 - DNA, 1608 bp, Heterodera glycines
  Genomic contig location: Contig_ID=SeqID_15031; Location=689..2296; Strand=+
  SCN-specific regions: Sequence locations=1-90,113-494,516-1608
atgttgtggaaagaaaaaatgttcaatgtgaagtgggtccagccatgtaaaattaaaaaaatgggggaaatgaatctcggaatggaatctattttaatatgaaaaaataatgaattttaagcgataaatcaacttatttatatgcccagtttgtagtggttgtatacatttatagggaaataataaaagaaaattccggacaattttaagaagcgatcattttgctgggaagatacaattccaaggacataataaaagaagactgttaggggcagcgccctttggctttcgagtgtggtcaacataacgccacacgcaatgccctttgacccaatcgatatttccttcccctctgttcgtttgttatttaaattccccctttccctcattcatgttcactcttccctattcagttcactttttgtgcaattgacattattgttcttccccaatttctcttcatttattttcttctaaataaattgtattgtctgcacccaaaataaatatttatatttgttgaacactaaacattggcttagcacccattgtgtggaccgaacaaaattggcgacgcccgttcggaagcagaaaaaaatagaggaggacaaataaaattgcagcttttagcagcaattcaacaatttgttgactcaaagagaagtcaacaaccaccgcaacttttcaacaaatttgtcatcccttctatacagcttggcgctgttagcagaagaaccggcattcagctagaaagctttcagcttttagtgtgaaagaaatattttgcgctgctatttatttgtctaggcgacaaaaacttagctcaaccacgcgcacccacactgatagcatccaggcgctgttatcaatagtgtggtgaacaaccaaaagaatggcacaaccgacggcacaagagcttttaaagctgattgccgaccagcagacggcgatgacacaacagcagcaacaaattgcacagcttttagctctgcaacaaacgcaaaaggctgatacagtgctcacactgccggatgtggccatcttagagccgagtgatgacaaatcgcgaataagcgaatggctaaagcgcgcacaattcgcaatcgattgcgtgtctccaaacgcatcggacgctgtcaaggttaagggattatgaacaaactctccgaggcggcattcagcgagtacaccaaattctgtctgccagagcccgtgacaagtttcagcttagacacaacagtcaaaaagcttgagaagctgttcgtcaagcctcaatcgatcttcatcgaccgatttgagtgcttgatcgcccgcaaaggaaagggagaggacttccgatcttttgtcaaccgtcacaagcgtttgatcacggatttcaaattcagcgacttaaaagaacaacagttctatgtcctgatgttgctgacagcgctcaaatcgcacggcgatgcaatgctaaggcaaagaattctgtccaaattgaccgcggatggagacaacatcacgtatgatgcggtggtggaggactgcatgaagtttatgactacaattgcggagaacaaagtcatcgagtcttcgtctagtggaagtcaacgaagaaaaccgtaa

SEQ ID NO: 79208 - DNA, 1182 bp, Heterodera glycines
  Genomic contig location: Contig_ID=SeqID_15032; Location=1542..2723; Strand=+
  SCN-specific regions: Sequence locations=1-253,275-362,384-399,421 -484,506-608,630-716,738-865,900-1104,1126-1147
atgcgcgggatgaaatttcttttggcatttttaatagtaaaaatctaaaaatagtatttaaaaacaaaatactactaaacaaataagcataaatgtgcaactcccgtttcattttccaagattcctttattctatgtaaatattttcgtttttattgaatttttgctaacaaattttgggcaaaacgccaaaataggcaaaaataggctctttcaaatttttttaggctttataggcgctaaaaataaaagcctagaaaataggcattaataacttgaaaagtagcttaacaaccgccgaaaaaaacatgtttttcgtgcatttcagaccatagggagctcaggaaaaaaataggcttttgcctaaaaatatcatccctacttataaatcagtttcagcttgggcaagcaaatgttgaattgttttctggacaatgactcaccatttaaattttgatcaatttctccaagttcatgagccccaattgttggcttctggtttgcctgaactgttctggaaatccttatacaaaaagatatccaatcaggcaatttgaactcaaatacctaaataaaaaaaacaaatatttttagattttcgatgcaggaaaatattttgaggttatcatcgaagaaagcgaaccgaatgaaacaatttcatcgcaagtcaaagctatgagcgaattgaaaatggacgacccggaaaagtcattcacttaaaattgttaaagaaaatcaaaaaagagtttagtgtttttctcattgaccatgcgtggactttccgtccgaatacagcacgttttgcacttcaacaagttgacggactgaggaagagattattggacatgttcaatatcaaagtcaacttatatttattaaaaaaaaatcaaaatattttttcatgaataggcttggtatgccaacaaagaatgtttaaaggacccttttgctgatgatagcgcagaccaacagcaaaagtgtgctgatgccgtagccactcattccgctgattgtgaggactcggaagtcgcatcgccatgcggccaaaatgtcgaagaaatatgggaaaagcattgcgaaatggacgacctaataattgacgaaatgtggaaatatgcaatgacatattcaattcgaatgctcaatttggtcccaaattttattccctttaataggccataaa

SEQ ID NO: 79209 - DNA, 685 bp, Heterodera glycines
  Genomic contig location: Contig_ID=SeqID_15033; Location=787..1471; Strand=-
  SCN-specific regions: Sequence locations=1-12,34-231,253-624,646-685
atgctaagcaatttgggattggatacacaatttcagatggaaaaggtaaatttgcatcgctttcgattaacttattttatgatgggtctcatgggacagctttgcgtttttcgaaaaattagtgcgtttctcatttaatggaatttccacttatggattatgaaatttcagtttagcccacatatcccatttctggaaactttttgccatttattgttgtagattttttgcaaaattattttccttatctctgctctctcccacataatttttcttcacactgacactctctcgtctattccccccccctaccactcacatttttttgttcttttctctgccggggattttgctgggtaaatggaaaattgatcatcttcattgtgcgaaaaggccttaaattgtcgggtgacggaacatttgcgtccctacatttgcgccccgaatatttgcgcacctacacttgcgcccgaacatttgcgccccaattgtgaatcaaaaaaacattatcatgtaaatgcctttcccaagggctaatgtgagtgattttattaaaaaatcatcatgcacatccaaacaactctaacaattagaataatctcccgttagcccttgggaaaggcaattttatgacaaattttatttaaatcacaccttagctcaaaggtattttttgaaaaataaa

SEQ ID NO: 79210 - DNA, 1216 bp, Heterodera glycines
  Genomic contig location: Contig_ID=SeqID_15036; Location=254..1469; Strand=+
  SCN-specific regions: Sequence locations=1-24,46-249,373-788,814 -1052,1076-1105,1136-1166,1213-1216
atgtcacacactgatttgccgccaaaggcaaaggcacaaaggggtttgcctcaaaatgggtttcaatttgatgcccttaaatgggcccaggtgcatcaactcatacccccgcccactgtcttgtaccccaatccacagatattgcgtactgcggtggtggtgcccattaaccagcagagttgttcgagcagttcagttaatggtgtacaattgatgccaaccaatggagaaatgatcgtaactccatgccaacagcagcagccgcaacatcaaagccaaccagaacaccaaaatcatcagcaacagcagcaccaaaaccaacagcaacagccgcaacaccaaattcaacagcaacaccaccaaatgcatcagaatcaacgccaaagggcaattgaaggggaaagccgattcacaccgcggcgttttggcccgaatcgctctcatccttatggaggccgaacaaccgcttcccatcggttcattagggaacaacgggaaacacaactacctatcaattggccatggaatccccttccccgaattcaaattccagtcgaaattcgtcgtgtcctcttgcgccgattagcacaggagcgggagcatgcctttggtcttgctggagtcatgcgccaatggaatccaccaatggcccttttgttgctgtcaatggaagctttctacagtactcttttggcatttgtagtgaatgaaggcgagccggggccatcacttccccaactttaattcgcgcggccggagtgtcatcgcttcgcagagcgatgacgaagcacggaaaaagaaagaaagaaatgactaatcataaagcgaggacggaggccaaattgactgttatttaaccgccaccattttgccttttctgtcagttgaagcataaagagcaatttgttgggcttttcattcaataggcaaataatttaatattgttcatttaagcttgtaaaatttcgggttcctctggcggctataccagagaaggttcacttaatttattataacagtaaataagacgtaacaatttgatttaactcactaaaaaagtccaaaaatataaataatgattactctgaattttggcaatgatatgtaaaatagttttaattattttatgagaaaataatcaagcttaaatttgccaaaatatcgagaatattttttatatttccaaaaattaattttttaatatatttttttctaa

SEQ ID NO: 79211 - DNA, 706 bp, Heterodera glycines
  Genomic contig location: Contig_ID=SeqID_15037; Location=283..988; Strand=+
  SCN-specific regions: Sequence locations=1-383,406-706
atgactttctcctcctccgtcgtcttattactgcccgttcaacttctgctggttgtcatcggcgctgtgttcatcatcctcagccaatgctgtggtggcggctccaagaagaaaaaggtgccaccgtttttgatcaccccccccctttttcacaaatgaattcattcctttttcagcccaaagccggagcagcggtgccaacgccacaaacatcggcagtgggcggaccaccgggagcagcggaagcgccctcgtcagtgtcctgcgcgcgtcttggtttttgtggatggcctgcgcgctgagacacgctccacgacggtgcacacaatgtcaaatatccaatttgttccgctcgcccaatttccaatttgccaatgcgtccaatttgcaatttgttctgcgcgtccaatttccgatttgtcagtgcgtccaatttccaatttgtcagtgcgtccaaatttccaatttgtcagtgcgtccaatctgcaaattgtcagtgcgtccaatgtccgatttgttcaatgcgtccaatgtccaattgcgcgatttgtctttgtccaattgtcggcgtcaatttgtccaatgtttcccgattgtccggcgcaatggttgtccgtgtcaattggtcgcagtggtcgaattgagtcaaattcccttggtgaggtgagaatgtgatttgacgaaatgagtgaaaatccaaatgcca

SEQ ID NO: 79212 - DNA, 540 bp, Heterodera glycines
  Genomic contig location: Contig_ID=SeqID_15038; Location=2376..2915; Strand=+
  SCN-specific regions: Sequence locations=1-298,320-413,436-540
atggttctcgtcagcgaattttgtgctcaatttctctcctgccctacaaagtcacttcgcgatcgactgaaccacccagaggaccgagtccgagttttgcagcaattgattgggaaaaaggtccagacaacatacaaggatcggaatggaatgcgcaagtgttttttcgttggtggaatgactgaacgaggcgcggcatttgaaccagcatatggacgtctgcgtaagccgttcaacattaacgtggcagcgcatttttacgctcgtcaccgtgtcaaattgcactacccctatgtgccatgcatcattgaaggctttatccatggtgaggaccgttattatccgatggaactgcttgaaattgtcgacgacaaaaagggagggcgattatttggtcgattgttcactgaaattgaggagcaggaggaggaggacaccaaaagtgaatgttcacactcttcaaacacttctatttacaatgttacggtaaaggatgcacatggtatgaaagcattgacgaaattgccaccactgggcgtg

SEQ ID NO: 79213 - DNA, 935 bp, Heterodera glycines
  Genomic contig location: Contig_ID=SeqID_15039; Location=624..1558; Strand=+
  SCN-specific regions: Sequence locations=1-148,170-311,343-479,516 -724,763-820,842-935
atggacacatttgaagaatttgttattgtcaacgaaaaatcattcaccgatattttactcacatttggttataatcgaggcggtatcagtgagatcaaattcagtgatgtcactcaattcgctgcactgtaattaccataattaatttaattacaagaaaaagaaagttctttttaagcgaatttcaacttgattatgccaaatcattggaaatcaaacacattggcaaaacggcgagggaaatcttgccattggcacaaattattcgctggcaatgggatgagaagggctcacaacaaatcacagatgtgaattaataaaaatatttaaattaaaaaaaatgtcagtatttttagacacaaatactcacgacggaaggaagtgttcggtttcattgcctcgattatttgggttccattgttgtacgaattttgaagaaaaaggacgactcacatacagcggaaaagtaaaattcatacaattaaaatttgtttaattaattaattaatttttttgtttgcttttaagtccatttcaatctctcaattctccggacgatgattttatggtggaaatcggtgacagaaaggtgaatattattaatttgcattttcaatctgtcattttattttattttttatgatgcttcatccgttttttaggtggctttgtccgcttctcggcttcgctgcttctccccggtgatcgatcggatgctaagcgtggagatgagggagaagcagcagcgatcagtcactttgaacgaattgagcattgacatggaccaatttttggattttcttttgtacatttcgccaaatgctctgagccaaccaattcttcccaatcgtaaaattgaaaataagaataagttacaatcagctaatattttactgtatgattcaaataatttaatttatgaaattatagtataa

SEQ ID NO: 79214 - DNA, 481 bp, Heterodera glycines
  Genomic contig location: Contig_ID=SeqID_15040; Location=95..575; Strand=+
  SCN-specific regions: Sequence locations=1-62,85-198,222-481
gtgactttgtccgcttatctgtttcgctgcttctccccggtgatcgatcggatgctcagcgtggagatgagggagaagcagcaacgatcggtcactttgaacgaattgcattgacatggactaattcatggattttgttttgtatatttctccaaaggagattccgttgatcgaccgagttaatctaatcgaaaaatatgggcttacaaatttgaaagttctttttttagttttgtcattttttaaattttttttctttcagaatttctttttgaatttcaatgtggacaaattgcgtgcctttttcaaggaaaatcatgaattttttttggcgacgatcagcaaagaattttatggcgaattgatcgcgcgaatttgtggttgaatttcaaaatgaattttatctaatcaattctttcgccagcagatgtgttaattggtacgtattgaagttaattataatttttggattgcaaatcga

SEQ ID NO: 79215 - DNA, 1607 bp, Heterodera glycines
  Genomic contig location: Contig_ID=SeqID_15042; Location=34..1640; Strand=-
  SCN-specific regions: Sequence locations=1-557,579-731,753-761,783 -1009,1031-1229,1267-1607
atggcttcaaaaattgaaacaaaaaaacaacaagtgaagcttcctcacgaaggacatctttacatattcgacaaaatgagtgtgaatggagcaataaaattttgggtgtgcgaattcaaagacagcgtcaacaaatgtaaaggccgtctttggacggacctaaacaatcacttcattcgtctttcaacgccacacacttgtcccgcaaatgcttcgaatgttgaggctcaacaagtcaaaactacaatcaaactccgtgccatcactaccttggaaccgccatctgtcattcgttcagaagcattgcagaacgtgccatcaccagccgcaattttggtgacaaaaagggctgcgaatgacgtacgagaatttttttaacaaattaaaaataacaagcaaactaattttagttaatcaaacgggcgcgccacgaaatcaatgcaccaccagcagtcccgaccaatctgaattttgagatcaaccaagcatacaggacctacacgtccacggaaggcgttgaggagctgtttctgttgggcgactccggtgtttattttgaaaatggaaaaaccccgcaacggtaatttagaaaaaaaatgcgaaattctttttttctcagaattttattgtttggtcgcgattcattcgggcgttttgcggacagaatgaatgagtgttttggcgacgaaactttctcattggcaccagcccaattttctcagatttatacgatcttggcaaagtctgtttgttttaattcagtttttcaaaattgtaaattaaatatttaggtgtgaaaaatggattttcccggtgtgccatgccttaatgacttccaaatcgcaaacatcgtacgaaagaatgtttacacttttgcgtgctgcgtggccaaattttgctcccatttctttttccgtggattttgaaatggccatgtcaaatgccgttacgacaatctttcccggatgccagatccggttttgcttttttcattttgtacggaacttacaaaagaaagtgaagcagcaaggcttatggcaggtaaatttccctttaaaattttttttcaaattttaagcgttattgttctgatccggtgtttgctttgaatgttcggatgcttacatcagtcgcattcgttccactttgtgatatcaggaatgcagtgacggcacttgacatggaatttggaaatttggtggcttttcgacctctcattgattggtcagaaataaaattttattttcaatttagaataattttttaggcttttggacaattatgttgggcgtcctcgtcccaatggcacatggtcgcaaccactgttccgcccggaccagtggaacgtctatcaacgaacattggatggaaatgcgaggacgaacaataacgcaaaagcggaacaccaccgtttgcagggcgcgttcaattgtcgtcatccatcgttgtggcatttcactgatgttcttcgacgtgaacagaaaattgccgaccacaaatacaattctgcgatcgctggattgtcacctgagaaaaagcgaggcaaatatttggcagcagatagacgaattttgaatatggttcgcaattacattccattgaatgca

SEQ ID NO: 79216 - DNA, 897 bp, Heterodera glycines
  misc_feature (888)..(888): n is a, c, g, or t
  Genomic contig location: Contig_ID=SeqID_15043; Location=17..913; Strand=-
  SCN-specific regions: Sequence locations=1-154,177-223,255-259,295 -434,471-656,678-897
atgtgcggtatgcaaaccttgccgcagaatgcacatgtgtatttggcatgttgagacacctccatctttttgactgtcttccgcaacgaggcgccgtaccgagtgccgtacttcccgacaatgccgaccttttttgtgcgctttgcctaagcaattgaatatgaattaattgagttatcaggaatgctattccgttacaacttaccatttcttgttgtcggacgaaaccaaataaaaaagtgaattcaataaatttctgaaaaattaaaaatgtttttgtttaaaataaaatatggaatttgatgaaaagtggaatgaaatgaaaaactcaattagtcataccagctttaaatgtctctaacacatgaaaaatagaaattcacaaattataataatcttgattgtaaaggtacaaaaacactatggacatttagaatcaataaaaaatgattaattttagcatttttgttaaaacggcggcctaggacttatgttataacaattccgactggtggaacgttgatccaagtctacgtccaaccaaaagagaagccgacgcatcagcccattgtacagatacagtttgatgtgaagaaccttccgcgacgaaagccagtgagtgctgatgatgaggaggatcgaagtgatgatgagatggatgacgacgaggaggatgacatgtacagtccaaaacagcagaaggaagcgtgcaaacaaccaaaacggttggaggatgggacactgaagaatgctcttgacaaagatgacatgaacaacgtgccggacgcattgaagatcaacaaaggcggaggtgacgtgcaacagattcgtggaacgacgaaactgaagaagtacaacgtgccggacgcattgaagagcaacaaaggncggaggtga

SEQ ID NO: 79217 - DNA, 97 bp, Heterodera glycines
  Genomic contig location: Contig_ID=SeqID_15043; Location=1052..1148; Strand=+
  SCN-specific regions: Sequence locations=1-97
tctgacattaattttggaccctaaatttgtgaaataatttgcttattctcaaaattaccatccaaattgcttattgcatttaatacattgtcaaagc

SEQ ID NO: 79218 - DNA, 356 bp, Heterodera glycines
  Genomic contig location: Contig_ID=SeqID_2339; Location=107..462; Strand=-
  SCN-specific regions: Sequence locations=1-190,212-282,304-356
atgccgaatccatttttatttgtgcttttcacgtgcccactttccgtcatctgggctacgcgaaaatcagctactcgtaacacattcgaaaaggtaaaggtcgcttccatacgtgatcgccagacgcctatgattcgacttggagacaaaaaatgattaggtaatagcatcaacatactcaaaatgcagaaatacaaaattatttaagaaacagggatggagcgaggacagaaagctcacgcggtcgcgcagcccggatccaaattgctgcgtcgcgctccacccctggtaagaaatttaaaagagaaattcagagattatgcagaatgaagggctggcgaccacctataaataaa

SEQ ID NO: 79219 - DNA, 1279 bp, Heterodera glycines
  Genomic contig location: Contig_ID=SeqID_2339; Location=2678..3956; Strand=-
  SCN-specific regions: Sequence locations=1-457,479-588,610-653,676 -931,955-1037,1061-1254,1276-1279
atgactgcgcagttcagcgccattgcggaacgcctgggtgaaattgagcgcaaaattaacaacaatggcattggcagcgcggaggagaaagaacgaaaaaggagccttgtgctcatcggtcttccggaatcggaggaggaagtgtcatcactgcgtgcgaaggatgacgcgaaaacggtggaggaagtgttggaccggctggacgtggaagtgtgcccgcaaatggtctacaggatgggcaggaggattgacgagaagaggaaaggaccgcgcttggtgaaggtggtcctgccggcttcaactttccaacgttttgcgctgatgcagtgggggcgtcgtcggacggagctgaagaagagacctggatgggagcgtcttctggtcaggccatccctgacgaaggaggagttggaaattgagcgggaacagcgccaaaagaagtggatggaatttggaaagaagaaaacgggggaaaacatcacgacgcgacgcggaggcaatgaaaaaaacttttgaggtcacctccttttttaaattgtttatatttcaatgcacgaagtttggcgaacaaattggacaagttaaggtttttgttattagaaaataggtttaaaatcattgctgtatctgagagttggttgagtaacaaaatagaaaacccccaaattttggaaaatctcccctattctataataagatcagatagacttaacaaaaaaggtggcggggttgctttcataatatcgaatttaattccttttgaaattatcaaaactacaaaaaacaaaaattccgatattctttgtgttgacctattttcaccccttaaccacacaaaaatacgttttattttggtctatagacccacctcccatgaaaaacaagaagatttcgaaaaattggtcgaacaactctctgttttagtctcggcttctgaaaaatgcattttgttgggtgattttaattattttcctcttttaaaagcaaaagactttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttggaaataaa

SEQ ID NO: 79220 - DNA, 110 bp, Heterodera glycines; identical to SEQ ID NO: 58552
  Genomic contig location: Contig_ID=SeqID_2339; Location=4408..4517; Strand=+
  SCN-specific regions: Sequence locations=1-73,95-110

SEQ ID NO: 79221 - DNA, 2053 bp, Heterodera glycines
  Genomic contig location: Contig_ID=SeqID_2340; Location=650..2702; Strand=+
  SCN-specific regions: Sequence locations=1-123,154-199,242-430,455 -581,609-919,941-969,993-1231,1253-1507,1529-1554,1644-1712,1734 -1860,1882-1889,1982-2053
atgacaaaatatcagggaaatttgaagaacgtgaacgtacagaatgccaaaaatcgaaaagatttggatattttgtacgaatatttgtacagagaatatgccggaattccaacagtgaagccaaaatttgtatttaaaaatgaaattgaaattgaaggaccaataatttatgcggtgaattatttggccagaatttcgcaatttttttcaaattgaattattattataaatacaaatttaacaatttgttcaattcttattttgatccaaaattgttgaatgaggagaggttgaaatacgaaataaaattggaaaatcaaccaaaattaccaattaatgaaatgattttgcaattagcaattgacacagcgaatgaatgtcaaacaaataaaagtttagacggaataattcgacaaaaatttaacaaaaaattggaggaaatgttcaaaaaggcagaagaaaaggcaaaaaaagatgcaccatcatggaaagccaataaaattaatgatgataagcatgaaataattttggatacaaaattcgatgaccaaaaaacattggtgagacttaacttaacattcaataataataataataataataataatccaaatttagattgaagatgctctattttcggaatttgtcaaaggattagcaacaaattggaataaattttttgaaatggctaaagaatattcaaattatttaagtcgaaggaaaaagcaaagaaatttttatgggtattatgatgagcaacgaatgatctcttatggattagacgaaattgacaaaatgaaagagcatttgacgcaaaaatatgaagcacatcttggcattatgtatttgatgagagagacttggcaatgtgaaaaaattgtggatcaattaactaaatataaacggaaagaatatttggacattttatttgaatatttattccggttgtacgttgaaggtttgtttgaattttacataaatttgaattttttgatttaaaaaaatttgttaagctaaaaacccgaaggtgtcgaaacaattgccaccactggtgaagccaatatttattatgggagtaacttctcaaggatattcttacagactaattgaaattatcgaaacactgaacaccaattcaaaattgttttgggaaaaagatgaatatgccactttaaaatttgaattggtaaatgaggaggaattaaattttgaaaataaagaggaaaaaaatttgttccataaaaatatacaaaagggaaaacaaattttaaaaggaccaacggacattgaagaaagaattcgggaagaatttgaacaaaaaatgaaaaaaatgtatgaaaatgctaaagaaaatgccaaagaagaaaaggccaaaatggaaaaagcaattgaaaaggcggcaaatattgacgaaaagggagctctgaaagatgaatacaatgaaaaattcggcactttcatttcttcgccatttttataaaaatgcctttttcacaaaacgattgactcttctggtttttggaattttatatgccttttcctttcgaatgattcttctgtcttttttcaattttcagcttattttttgttttgttattttccttttcttttttaaatatatatttgattttatttaaacttttttcgaatgttttcatagtttaccataaaaaaaggcggcgcgcaacaattttaaagctgtataataagcaatttatatgtaaatttaaagttctgaaaaaaagtacaatcaatttttatttcatatttccaatgaaatggctaattattagggctgctaattttatgtaaatacatattttttcctggcttctccatgctctaattagtaggaaaaactctttcttttttgtgtttgcgaacaaaaccgggaccgggccgggaattcccggtcatccgaggtcccggtcccgggttttgaaaagctcaggtcccggtcccggtagggcaaccgggaaccaggaaaaacaagcactggtaagaacgggggtctgagtgaaaaattagtgatgaaaattggagttaaaatgga

SEQ ID NO: 79222 - DNA, 1062 bp, Heterodera glycines
  Genomic contig location: Contig_ID=SeqID_15044; Location=910..1971; Strand=+
  SCN-specific regions: Sequence locations=1-636,658-879,901-991,1013 -1062
  Gene Ontology: Mol. function=electron transporter activity; Cellular component=nucleus; Biological process=carbohydrate metabolism
gctaaatacaaagcctttcgactggaaaataaagtcgcggtgatcacagcagcgacaaatgggtgagcaacaccggcattctgaagggcactcaatcgatgatcactgataggaaaatgccatacaaaatgggcctattcacaggattggattggcaattgctgaacgattaggccacgagggagcacgtctggtggtcagcagcagagacgaagacaatgtgaagcgggcgatcgatcggctcgtctcttcgggactgaaacgttcggaccttgccgggtcgtcacttttgcattggcttttcgtccgtccaatttcaccttcccccccccctttcttttcagttgcacttgccatgtgtccaattcggaggaccgaagtcgcctgctgaaactgaccatccaacggttcggaagtgtgcacattttggtgaacaatgctggcatcaacccaattttcggcgatttgttggacgtggacgagtcagcctgggacaaactgttcgacgtgaatgtcaaggcgggcttcatgattgccaagctgttcgcgccagaaattgaacagagcgggtcggtcaaatgttcccggtttttgaaaggataaacgccgttgacagaatagcttcgaaattgtgccttttattttaattttccagtggagggtccatcgttttcaactcgtccatcggcgcctataggtccccccagggaatcgctgcttacggcatcacaaaaacggcactgctaggtcttaccagagctctggcagaatcacttgcacccaaagggattcgcgtgaatgcaattgcgcccgggattattaaaacaaaaatgagcaaagcggtggggatggaaattaaaattaaaaaatggaaaacactgttttaattagctttgggaaggcattgacgaacggagcagtgccgaagccattggcacacttatgggacggctgggaatgccggaagaatgtgctgcactcgtcgcttttctctgctcttccgacgccagttacataacgggcgaaactgtgccggtcgccggaggcgcctactcacgatta

SEQ ID NO: 79223 - DNA, 493 bp, Heterodera glycines
  Genomic contig location: Contig_ID=SeqID_15046; Location=1..493; Strand=+
  SCN-specific regions: Sequence locations=1-493
  Gene Ontology: Mol. function=ribose-phosphate pyrophosphokinase activity; Biological process=nucleobase, nucleoside, nucleotide and nucleic acid metabolism
actagttttgtcttacagcacaagttgcaaaggagaagcccccactgactgttgttggggatgttggcggcaaaattgccatccttgtcgacgatattattgacgatgcacaatcctttgtggcagcagctgaagtaatttaattttccccttttaatataaaggccagcaaattaactatttgcaggttttaaaagcgcgtggtgcctacaaaatttacgtggttgcgactcacgggttaatgtcactcgacgccccttccttactcgagtcatccccaattgacgaagtcggattaggacacaacgattattatgataaaaattcaacggtttagataattgttacgaatactgtgccacacgaaatgcaaaagttgcgttgccataagataaaaaccgttgacatttccttgctgctcagtgaagcgattcgccgcatttataacaacgaatcgatgggccctcttttcagagaccttacaatcgatgat

SEQ ID NO: 79224 - DNA, 1304 bp, Heterodera glycines
  Genomic contig location: Contig_ID=SeqID_15048; Location=844..2147; Strand=+
  SCN-specific regions: Sequence locations=1-121,147-1129,1178-1304
atggcaaaaattagtctttttttggctaaaaatggttacaaaaaaaaattttttggagtgttttgggaccgctgatcaagaacacgacatccattttgcccaattccgaaccctcacccgaacttgaataaaatcaaattaaaaaacgcttgaatttttaatatttttgatcattttgtgattaaacctcatttcgttatattttggacttacaaaaaaatgattggactcataaatatttgattggactcaaaaactcagattgctttccttttcagatcaaagtgttcatgaaggaggtgcggatcatgcgacagctccaacaccccaatgtcgtccagttcatcggtgtggcggttggccaggagcccctgatgatcgtcatggagttggggacggacctccggcgctatttggacatgagcaagcgacatcggctcaacgctcgcgccaaactcttcatgtgcctcggagcagccgccggactggaccacatccactcgaaggacatcatccattgcgacatcgctgccaggaactgcctctacgcggacggcatggtgggtgagaacatgatggacgagggaggggtcagaaaaattggataccaaaatttaaggaaattgaaaaaaaattttgagacttttgcttttcaagagtgaagtgattgaaagagcatgcttttcaatcgaatttaatttttcttttttttccttccccaattttttatgtaaatgaattctctggttgactattaattttgctcatttttcaacaggtgaaaatctccgacttcggcatggcgcacaaagggacggtgaaaaggtggacaacaacgccaagctgcccatcaactggcgccgttccccttcgggggtggagacgaaaaggcattgagtgaaaagtccaaaaaagttcttttttttatcatttctcccttttgcagaaaatgaagggccagaggatagtcttcccccggactgcgccaccggagttcgtcatgctgcacatctgggactcgaagcacaacaaccgttactcaatgggcgcggtgtacgactggctgaagcgacacaccgaagaaggaggaagaaggacgaggagagcgcctgaactagtaaatatgatgatgtgtgtatgtatattgtatatgtgtatattatatatgtgtatttgtgaaatttctgtatttttcatgtcaccgtttagaaaaagtgggacggggacagcgggacaaacgccacaattaccggcccaacaaaaagacattcaacatggacaccagttttggatttgtgggttta

SEQ ID NO: 79225 - DNA, 416 bp, Heterodera glycines
  Genomic contig location: Contig_ID=SeqID_15050; Location=428..843; Strand=-
  SCN-specific regions: Sequence locations=1-81,103-213,243-312,343 -385,410-416
atggacattttgacaccagcgaaaaagaggaaggacaaatggacaaaagtgaaatggtacattaaacacaaaataaatattgtatttcaaataatttaccttggaatatgagttgtttttgcagccttttgaccaaaatgggcattttgacagcagtgaaaaagaggaaggacaaatggacaaaaacggacaaatggacaaaagtaaattggcaaatattcaaattttatttttaaatttaaggtctgtgagcaattatgactgttcagtgttatgtgttttttacaaataaccttctttcgttctctccaaattattattattatcattattattattattttttttttgggtattattgaaatgatgtttttttcttttacttatttttgttaaattttatgaaaaacaataaa

SEQ ID NO: 79226 - DNA, 1070 bp, Heterodera glycines
  Genomic contig location: Contig_ID=SeqID_15050; Location=1133..2202; Strand=-
  SCN-specific regions: Sequence locations=1-644,768-962,984-1070
atggaatgggcggaaatgccggccgaatggcttctgccttccatgcttcatgtgctgtccaatcgcgaattgtcttcagtagcgaatggaagtgaaattgaaatggactcgaaactaagggaagaagcggaaaagggcgcgaagcaattggcatttgtggagcacgtgcccgaactttgcgattatttgccctcacttggccgtcagcaggtggcgacaccacccaaaaaggccattcaggacgaacattcagttggaatttggcataagccatctcatcgacgaattgcaaatgacggagaaagcggacgacgaattgctgaagaaaagttcaacgaggacgagcatcggactgtacaattgcggaaagttcgaagcggaggacgacttaatcggccgagcattcctttccccgggagcgaaggcaaaaacggagaaattaagcgaagtgagcgaccaaaggggcggacgacttattcagtccgtatttccgtcacttacagctgaacaaacgactcatttcggacatatttagccgcagaaacgaacgatggattgcgagaatcgttcagttgattgaacagaattcacagaagcgcactttcttcgcttttggaataagtaaattggcaggaccgatcgtttctctctctctctctctctcacccccccccactctcctctctctctccctccctcccactcttcctctctcgcctcaccctctttacactctctccctttcctttctctctctctcctctctcaaatagctttattactctcactcattaatcggtccttccttaccacaaaaggtcatttgctcggcaatggttccatcgtgcaactgttgcgattgcgcggatattccgttgatgaacgacaatttgagccaaatggaaaaagaaaagaaacggaaaatgccatcgtaaaaatcaatgccaatcagcaaaagactgacacagggaaagaagaagagacgaggtaaaaaaggcgaaggcattcctttggagatgggcacagctcttttggccaattgaactttttatttcattttcctaaataaa

SEQ ID NO: 79227 - DNA, 739 bp, Heterodera glycines
  Genomic contig location: Contig_ID=SeqID_15056; Location=872..1610; Strand=+
  SCN-specific regions: Sequence locations=1-4,26-36,58-349,371-618,640- 739
atggctgatgatgatttagaagataaatatgtggcattaaaggcaaaggtccaagacttagaagatcgtttggccaatcgggtcccgaattatcttcccccgggagttaaattccgaaatatgatgcgagcggtgattttttcaagtttttaaaagaatttaatgtgcttgcgacagcgagcaactggcatccgccggattgtgtccgctttttacctctgtttttggaaggggaagctaaggaaatttaccagaatatttcggcagataagaaaacaaattggaggacccttactagtgaaatagcggaactgaccaagaaacttgatggaccaatgtgggcgagaaaaatgctgaataagacgaaaatgggaataaatggatcagtaactgagtttgcgaataaaattcgtgagttagttgagcaggcaagcccggacccgaactatacagatgaggcaagagaaagtgagagcgtgcactattttttgaatggattaccaaccaaactaaaacggaaattatttgttatggaaaagcccgatagtttaattgaggcaattgcgcaagcaaaaaaggttatccaagtgaatgaggaaattgagaaagatgaaaaaggggatgaaatgaaacaacaaatagctgagctaacggaacaagtcaatgcgatttcgttccagagtaaagtgaataatgagagaaatggtcatgaaaatggtcgcgaattcgtgaatccgac

SEQ ID NO: 79228 - DNA, 1397 bp, Heterodera glycines
  Genomic contig location: Contig_ID=SeqID_15057; Location=555..1951; Strand=+
  SCN-specific regions: Sequence locations=1-202,224-260,282-537,559 -780,802-1397
atgggacatacaatgaagagattgacagagaatttatggacaactgagaggccttcaaaagttgaatatgcatggattggtgaaagatgtgagacaacagtgaatgatttcattgaaaaaggacaaggcggaattctggatttttatttggtaacatcgtttggatataactttaatccgtacaacggatgggaagaaggacaaaaatggacatttatttgggaaattccggaaccaagtgaggcttattgggcaactcatttccctgtcggtgattttgtggcagaagtaacggagaacgcaattgtgttagaaagcgaacaaagcgtgttttattttgaaaaagaaaagggcgatgaaagagagggtattgttggcgtaccagacgaggcgtataaaatgtcaaatgacgttttcattctaatacacactccgagtccacaaaaagcaagagaaaaaagggaaacaaagcagaaaagtgaacctcagagaaaagagcgaccagcgaaacaggaagtgtttctgaaaatcaggccggatcaaaattcaaaatttgagaatttggacccagcgtccagacccaaaagcaattggacacggacaactttgggaccaaaaaggaacacaacggagctaataattttgagtaccccggttccccagtccacaagcacagtggggagtacgacaaaagtaaccatggcaattccgaccaaaattattacaacacggttccaacgactataaggcctaagacagaagtcaaaaaaccaattttcgagaaaattcaaataaaaaatgagcaaaaattcagtcagtatacaaggcagttgggaaaaaggtgaaacaattggtagctacgacaactaaagctccttttacaacgactaaaaaatcgaaaattgaaaacacactgaaaaaggcaacaccaaaaccaaaaattgtgggtttgaagagcacaacactgaaggttcttagcacagttagaccaagcactaagaaagtggtcagtgagctttttccaaagtcagctacaactccgagtacattttggtagtaaaaagcacaaataattccaaaaaattttctaagcatgcgctggttaaaaaaccggaggttgaattggaaaaggccacaacagcaagtctatttccaaagacaattaaacacaaacaatgaatgtgacagagattccagcacgtatgactccaattcctccaaccactcaaaaaattgtggaaaagttggaattgccgaaagagaaaggggaaaagaaatcagacagcattaaagctgaaaagaaaatgaaaagttattaattccatccacggcaattacggttgtgaagaaaattgaggacgaaaaagtaagagatgtgtcggaaaagacagtaaaga

SEQ ID NO: 79229 - DNA, 636 bp, Heterodera glycines
  Genomic contig location: Contig_ID=SeqID_15057; Location=2029..2664; Strand=+
  SCN-specific regions: Sequence locations=1-636
atggaagaattcgaaaattcattcgaggatgaaagcgatgaggaagttagtgtggaattattcgatgagaatgaaatcttcgacatggaacgaagaaaaagaacgacagttacaacacctgacgcccggtggattaaaaaagttgagaaaagcaaagtgtgaaataaagcaggacaggaaaataagaatttgaatacgcgagtcaattatgcattgtatcgactaaatgaggagaaaagaaggcaatacgatcatatttataaacaagcgtgcgaaaatactaaatttcagctacaattggccaaagcggttttacaaattaatccaaatgagggagtcaaaaaatatttaatcgagacgatttagtggcacgatggaaaggagataatttggaagttggtttttgtgcgccggttataccagaaaaaatattctgggatagaaaaatggggagcgattgttacgaatggataccaattttcgcagaaaatacaacattttttattcggccgggtaccagagaattgagcattataggcaaaagaatggagtgtacagaaatggaaaaaaccaataatatgaacaatgcgacacaaaaggaaattgttcaaaaattaactgaaaatttgggaaaca

SEQ ID NO: 79230 - DNA, 298 bp, Heterodera glycines
  Genomic contig location: Contig_ID=SeqID_15058; Location=880..1177; Strand=+
  SCN-specific regions: Sequence locations=1-298
atgaccgagcagcactttggcattaattgcgttgacctcgaattgccgatggacatttcacaattcaccgttaacgtctcagcaacactttttgatttatcgtgtgaagaattcctaaaaaaaccggaccttgacgaactgccggactattatcttcaagtctcaaagcggtggcaacttgatgcctgtgaaatggttccaacagtcatgagatgcaaaaagtagagtgattctctggttagccgacatttgtcgaccgaattttgcggatgattagtgaacaaaaaatgatgaatta

SEQ ID NO: 79231 - DNA, 338 bp, Heterodera glycines
  Genomic contig location: Contig_ID=SeqID_15061; Location=64..401; Strand=-
  SCN-specific regions: Sequence locations=1-338
atgacaattaatttttggcattggcacaaaatgcgtcagaagaaaatctgttattaaaatatatgatggagttctaagttacggcatttatgtattattttacagaaatggaactgttctttttgcgccattcggagtatgaacgtctgttcaattgtacagggctcgacattgattccatcccgttggagcgacgtcaaaatgtgccggagtcaattgctgtctgtgtactgtgcaccatttattatgtatgattcaaatttcaatacaatagtgtaaagttaccgtataccaaagtgaatgcatttaaaaaatgatgccctgaaaagcagaataaa

SEQ ID NO: 79232 - DNA, 644 bp, Heterodera glycines
  Genomic contig location: Contig_ID=SeqID_15062; Location=68..711; Strand=+
  SCN-specific regions: Sequence locations=1-95,117-453,477-644
atgggccgaagccgactgagtgatcaagtaagtttttggattattatttttttagggtttgtcccagacccgaggcaccggggttttttttgccgtttttcttagccccaaaaaccgactgtctactcctgtcgataatatccttaacaaatgaacggcataaaatattcaagccgacctcattaaccctcattttccaacttcgggtttggcatatgactgaccctgattttttttttggcatttgtaaccctaccatgccgttctcaaatgatttcaaatgtcgttagccgaaataccgaagcgtctgggaaatgcttcatacaaaggggcggaatgcaacatgcttttttctcttttttggcatttttttcacggtctcaaataatttctaattacgttagccaaaatccggaaccccgaagaagcttcctacaaaagggcggaatgcacttaaattaaaattaaattttaatggtttttagatgctaattggtctacgtgaagtgtcggctaaacttcgttccgacatcaaacagaatggtccgtgcaacattgacttgagcaaactgatcagtgtgctcaacggttcctccattagcatgcttttgtttggccacccgcttgaagaggcaaataattag

SEQ ID NO: 79233 - DNA, 1282 bp, Heterodera glycines
  Genomic contig location: Contig_ID=SeqID_2343; Location=161..1442; Strand=+
  SCN-specific regions: Sequence locations=1-122,182-488,511-1049,1071 -1111,1133-1282
atggacccggcgagtccggccgcacaatcactgagcggttccaacagtcagcagccccctctaaagacacacggagtaatgcgagcaggtaccatcggttcagctgcaggaacggcttttacacaaccgcagcaacaacaacaacagcatgttcaacaactttttcaacaacaacaaccaccaagcgctttctcagcgccgaacaccccaaaccaacaacagcagaacatttcccagcaacagctgacgccggcagctgcgcagttgggcacagcgaacagtccatgcccattgggcatcgaagaggtgaagccgcgttctctgcgctttacttggtcaatgaagacgacttcgtcacttgcaccggacgaaataatgaagtccgaagaacaaaggagtaaatgttacagagaatgcatttttagagaaatacgaaaagtactcgacagcaatggatgcgaatatgagcaaagggagaggtcgtcttttctgtgttttgaatgcattttttcctttaggtatttgttactttgtgcacacggcgacccaagcaaagactcattgatacaatgggagatggaggtattgtttcaggctgaatattttcggagtatttttttaatttaaaggtttgcaaattgccaagactttccctcaatggagtgaggtttaaacgtaagtttctcatttctttactgtcaaattttatcgcatacgttcttcttttaaagccctccaatcataacgttatttttatgcaaagttatataatgcgtatttattttattaagggatttctggctcttcgatcgggttcaagaacattgcttctaaaatcgctcaggagcttaacctctgacggttttgtgaaatcggatgctgcctccaaaccatttattgaactttgtcttcgatgttgtggattctgtttctcaaataactaattattgctaacattttcttctgcatgcttttgctctgttcgtgcttctctctctattcgtttgttttatcttttgccactatcgcttttttggtcggtcggtaaccaattttcttcagtttctcagcgacaatattcttattgttcgtgagtatttaaagataatttaactttcatttaaatgaaataattctacataaattgctataaatgtttggttaagttttatattagcattaataatattttgtgagagcacaaaaaattttgtttatcagggcgacggtgtaaaaaggtcgggggggaggagccggcggaggagtaaagggcaaaccttga

SEQ ID NO: 79234 - DNA, 3297 bp, Heterodera glycines
  Genomic contig location: Contig_ID=SeqID_2343; Location=461..3757; Strand=-
  SCN-specific regions: Sequence locations=1-165,189-410,432-573,596 -1205,1228-1408,1430-1514,1536-1552,1575-1921,1943-1968,2006 -2250,2285-2465,2487-2527,2549-3087,3110-3297
atgccgacagaatttttttttcaagtcctcagttatctttcaagttcttgcagtacttgcccggtacgtttgctgttacccagttggcgtcgcccatttgacattgcccagttgacccccaccattcgtttttaaacttgaccactttccatttatcgtcagaagtactcttaattgtgtttgccctgtccaatatttatcggcaattctgcttttgactttaatgttcacattgatccgccttgttaattaaaaaaattgattcattttagccacagctttcaaacgatggctcgtgcgcctgttttcctcaatgtttatgacatgtataagctcaacgacatcgtcttttcgagtttgggcattggagtgtttcacagcgggatcgaagtgtacgataccggtctgactatttctattttcttgcattttaacgtattcccactttaaatgtgaaggcggtttattgtcttatattttgcaaaacactttcagaatatgcctacggtggacatcccttccccttttccggaattttcgaaaatacgccacgcgatgctgaagaattgggggagaatttcaacttcaggttgttgtgtttgagagtttttatctgatgctcttttattcaagggaaagcattcctttgggcgaaactgatttttctgctgaagatgtgaacaaaatgattcagaatttgggccaagagtaccggggggacagctaccatttgatcactaaaaactgtaaccatttctctgccatccttagcaaggtgagaattaaaattcgtagcaatttatgagcggagtggtccaggtttttgtctcttgtgtatggttcggaaatcccaccaagggcatcaaaactaaattcacgattctctaaaagacggtccacttaagaatttttgcgtggattactcgttagctggtaatgattgaactctaaagggcttcttaaacttgagcgattcttaagcaattactctggtcttggtccattcaggttctaacgggccaggagttgcccccgtggattaaccgtttggccaacatttccggttctttgccatttgtcgagcgatggatccctcaggtgccacctccgatttctacatttaaatttgttattctttcaaggaatggcttactccaatcgcccttcaacagtcgttggattcgcggtcgcgcagtattcccttacaaaatggcatcagcacggcggcactgagtgtcccggaggaaacgaaagcggacggtgagttggccaaatgaaacttcaaggattgctattcgtgaagacatatttccctagatttttattctctctgaaaaacttctaacccgaattcgacaaaaggtttttgaatggttaggaccgcattttttatcgattttaattgcgattttgatcaaattttgaaaattaaaactttgttttgttcgaaaggactgtaaatttggttaaattcaaaagtattttatccttagaatctaaataaattctcggcctttaggcatttttaaaatgttgattgccaaaaaacccgttaattaattaattaattttttgtattgttttgttttgtgagtgtgttcccattttaagtttcgactgattccaccgcaaggccttcgtcttacaccgtcggttggcggctgttccaacggcgcaaccccagctgcgatcaatcgtcgtcccctgcgaatgcgtcctcctcctcggcacccgccacctctagacagcccaactcacaatcagcgtccaacaccctctcacccaccctttctcgcttgtggcaatttggaaagtccacccttttctccccaactgcagggaatgtcccaacagatgaaaaaaatgccaagtgaagtccttccgtaacactctctacttattgaatactaatatcttgtaaaaattgcttataataaaagattgtctccttccaacgttaatgataagtcaaagaatttaagattttttgagaaaaatttgggttttagttcaatgacatttgtggttttttcatttgaaaagcatataattttcaaatgcaaatgattttttgttaaaatagtataaacccaattagtcttagaatcaataaggtagaagttggacgggagaatcgggcggactgtgcgctggtggcaaagtgcgcaactttacaaataattgctggtgggaattaaggcggacatgggcaagcaaaaacagggaatttagcctcgtaaaaccaaaacatggagaaatcatttttctttttccccttctctggtgaattttttctgaatgttaagaaaatttattcaaggtttgccctttactcctccgccggctcctcccccccgacctttttacaccgtcgccctgataaacaaaattttttgtgctctcacaaaatattattaatgctaatataaaacttaaccaaacatttatagcaatttatgtagaattatttcatttaaatgaaagttaaattatctttaaatactcacgaacaataagaatattgtcgctgagaaactgaagaaaattggttaccgaccgaccaaaaaagcgatagtggcaaaagataaaacaaacgaatagagagagaagcacgaacagagcaaaagcatgcagaagaaaatgttagcaataattagttatttgagaaacagaatccacaacatcgaagacaaagttcaataaatggtttggaggcagcatccgatttcacaaaaccgtcagaggttaagctcctgagcgattttagaagcaatgttcttgaacccgatcgaagagccagaaatcccttaataaaataaatacgcattatataactttgcataaaaataacgttatgattggagggctttaaaagaagaacgtatgcgataaaatttgacagtaaagaaatgagaaacttacgtttaaacctcactccattgagggaaagtcttggcaatttgcaaacctttaaattaaaaaaatactccgaaaatattcagcctgaaacaatacctccatctcccattgtatcaatgagtctttgcttgggtcgccgtgtgcacaaagtaacaaatacctaaaggaaaaaatgcattcaaaacacagaaaagacgacctctccctttgctcatattcgcatccattgctgtcgagtacttttcgtatttctctaaaaatgcattctctgtaacatttactcctttgttcttcggacttcattatttcgtccggtgcaagtgacgaagtcgtcttcattgaccaagtaaagcgcagagaacgcggcttcacctcttc

SEQ ID NO: 79235 - DNA, 699 bp, Heterodera glycines
  Genomic contig location: Contig_ID=SeqID_2343; Location=8400..9098; Strand=-
  SCN-specific regions: Sequence locations=1-160,182-232,254-631,653-699
caattttcgcagaatgcttcgagaaatctattaggtattctcggataaattaactcatccaatgcattgcctttaaaagctccgcaatttccttgctcaacgtctcaattttcaaacgtcgcacattatcacccttcttttaatccaacaattgcaagcaacatttacataaacccatctgttttcaatacttctcacgaccagtcctttgttcacagcaatcagttacaacacctttcctcaaaaagcagccaaaattggcatttgatggtcgatgatttcgttaaaaaaactatttcgggtattattttatcacatcttttgttgtctcattcgaactctgttttagttcctccacgcaattacccgaagaatcgttccccatcctccgattcttcctttcccgtttctcacccttcgacgcgatcgaacagtcgaaattcccgaaagacatcgccaccgacacgcaaaaggcgtttgaagcacaatatttcacaaggcaaaagaacgcaaagacagacgaaagaggttgtatcacacttaaggcaacaattccttttaatttgtgaattaggcgcatttatcaaagcaaacgatggaatgtgcgaaggcaattggacttgacagtgactacctaaggaaaatcgaagaacaaaagaaactgagagaagaaattgcgcgcaaaaaaaaccaacaccg

SEQ ID NO: 79236 - DNA, 982 bp, Heterodera glycines
  Genomic contig location: Contig_ID=SeqID_15063; Location=469..1450; Strand=+
  SCN-specific regions: Sequence locations=1-201,224-902,924-955,978-982
atgaagacttgctggcgtttctttttaattataaatgagatagtgatcaatagtgatcagatttcgaatttgatgcttttgaggtggtgtcaactccgggaacaagcggcgccacgggtgccaccgctgtgtcacaactcattgaaggtactaacgcttgtctttgacacttcataaaattaatcgtaattgtgaccaaattgaaatttagaagacgaggaaaaatgtgcccgttgtgccacagcatcagccactgtacgaaggattgtaacaagcgttgaatccaaagaattattttattttcatttgtgcgtttgttttgatgtgttaagcataaaaatttttcattttttcgtgcctattaaagtgcctttcacgatttttggtgcctaaaaatttttgaaattcttttttttaaagggagcccactttggcgattttttgaaaaatttggttttttacaaaaatgtcttttttggcactcaaattcggtaatagtatggtttacaggtcccacaaaaaaaagaggcaaaaggggggttttatgcaattcttcaaagtcctttagggttctcgagggcgctgatcacgaatataatattcatttcgaccaatttcgaaccccgaacccgaattcgaacaatttttttgttacttttttttgacttaaaatcaacgtcaatattgaaaatttaaaaatgaagaacaaagcaatgtcaggcacccaacgcaatttgctgccgggttatatggacgaatacatgtggcgccaatttaatggaaaaaacaattgcggcctatgaaaacatttttgaacaaattgctcaattttatgttgtcaatgcttgagtttgtatgcatatttaaatgcacacggcgattcaattttgggctccaagtacaaataagtttattatttatttagtaatcagaacgccaaaactttgcaaaacttaaaatttattggggattttcccttaaa

SEQ ID NO: 79237 - DNA, 491 bp, Heterodera glycines
  Genomic contig location: Contig_ID=SeqID_15063; Location=2307..2797; Strand=+
  SCN-specific regions: Sequence locations=1-491
atgatcagcaattacttaattaatcatatcttctttggtaagtgtctaaacgctgcaattttatatatttaagcttcgttagactgtgtgctttcgaatgataccaaaaaaataggtgttgttcaaatgaacaaagttattgtataaaaaccgagtattttcaattgattggactcataaagtgcactagagccgttttcccttccaaatatttctcaggtcgcacttcgaaaggccccacaaaacggcgccgtcggcttcaaacaggaagtgaacacaagcagaaatgccacattcaattgggctttaatttccccaaatcgttcgcaggtgaacaaatgggtcgtgctggtcaaattgctcatcggcgaaatccccgagcgcagtctcttccgcacggccgaacttcgccacgtgttggcgccgtatttgctgctgacccaaagttggttttatgcgcggcgaatggaaacgcacatttggacatttga

SEQ ID NO: 79238 - DNA, 1377 bp, Heterodera glycines
  Genomic contig location: Contig_ID=SeqID_15065; Location=1128..2504; Strand=+
  SCN-specific regions: Sequence locations=1-190,226-529,551-1377
atgagtcattttggcgtttcactgctcccgattggcatagggctaatcataatgctcatactcctgataccatcatccacggatggcatgaaaattacactcagagtggaaatgggtgaacggtggatagtcaagcaaatgaaggacaatccttttttcacctttgaggtggagggcacggacagtgtggcaacattgaagaagaaaatcaaggataaaattaaagaatatactgggaggagcttttcactcgctctacaaacactgagactcaacaaatttggtcttgcgcttgaggacaccaaaacaatgcaagaatatggaattaaagacgaccaaaccatcattgtttgtacgttgggtgaatttcaaattgacgtaaagtatggcaagaaaaggcattccgttaatgtgaaagacacggacactgtggcaacattgaaggggaggatcgaaaacattaaagaatttggaaacattccgcacgaaaaacaaatattgataggagacggagttattgtgtttaagaatagtgaaacaatggacgaatgtcgcattaaaaaaggcgatactgttaccgtgtcgtgggagaaatttgaaatttcagtgaaatacgacgaaaaagaaccgatcaatgtagaggtcagaattgtcagaaaaaaaatttccaaaggccttattttagaaaaaaaaatatattgaaattaaaagttagggggatgttaaatatcaatttgagggttttttcgaaaataaaacagaaaattctgacaagcaacatatatatgtatctcaaaagcttagatttgagagttagccttatttccgcccaaaaaccacaaatgagtctaaacccgcatttgcgtatcttcggacaaatttaatattaaggtgaaatttggagagaaagagtggtccgttgaggtgaaggccactgattatttgtctcagttgaaggagaagatcaaagatttgactggaatttcaatagaacggcaaaaactgcacttaaaccgaagaatgctttttggccatactatgatgttcaatgacattgtaaaaggcgataccattttcttagaagatgtgtttgaaatttccgtaaaataccaattctccattccttatagtgtatttgatttttgcaaagttgaggtgaatgccggggacactgtgaaaattgtgaaggaaaagatcaaggcgatgatcgaagaaaactgggaacgctgtggaaaattagtggaaatggagctgagaaagaacgatagatttggtgaagttttggacaattacaacgaaacaattgagaaagctggcattaaaaaagaaggagatacaatttatgtgaagtgtgctttccctccgaaatcggcttaa

SEQ ID NO: 79239 - DNA, 270 bp, Heterodera glycines
  Genomic contig location: Contig_ID=SeqID_15066; Location=502..771; Strand=+
  SCN-specific regions: Sequence locations=1-270
atgcgttccgtccgctgctccatcgtttcatttggtgccgaagtgttcgcatttaaacgcctttgtgcgacaacggagggtaattttttttgaaaattttgcaatgatttgacactgccatataattgtaaggcaaatacagcgttgccctggacgaacagcatttggagcttctgcttgacgaacatgtccaaccgccgcccgtccaacgccgtccgggtcagcaggactcaatcgtccgcatgggctttccccaactccgccgcgtga

SEQ ID NO: 79240 - DNA, 1017 bp, Heterodera glycines
  Genomic contig location: Contig_ID=SeqID_15067; Location=1..1017; Strand=-
  SCN-specific regions: Sequence locations=1-305,327-358,382-1017
ggcgaccgtccgcagcaccgcacttccacgctgggcgaaatggccgccgcggcagcggtcggcaacgcgtccgcctccgccattctggtgaacatcgcacgagcactgttcgtccgcgccctgctgatggcccactcgctgctgtgcatttgggcagcagccgaaacgcaaggggacaactcagtgtgggccttcgcactgctcgccgtctgtttggtcggcgaagggttttacgcggtggtcgtccgggcgggcgacgaccccaaatggttctcgcccgccgtgctgctgtatctgttcgccactgtgtgtgatttttgaatttgcattttttcttgaaatatggccccgcggttccataaaaaagggggcgggtaaaagtcgccactttttgaccgcccgtcccccgccttaggtgcccccgctttggttggtgcacgcgtcgatgtgtcccacggcagcgttttcccaccttccgcttcctccttctccggtgaacgtgtccgccctctgtgccgcggcccccgccgctccgtcgttcggtctgcagcccaacccgcgcgaggacaccgtcggtaagcagttgctcggccattcgctgttccttgcgcttctcctcacgcgttggctgcttccgcgcgcggagctcagccgcgaagagctcacccaaattctgctcgcctacgcggccgtcgtcacggacattctcgagttcgtcgggctgctcaacgcgtgcgcagtgtgcgccgatccgacgcttcagacggcggtgctcggcgcgtggactctgtcgctggcccaatttgcgctcgttttgaccgcgagccgagcgcgcaaaatgcgaatcgcattggccaccaaaatcatcgtcaccaccaactgcagggccgactttcggcaggtgaaaaaggaaaagtcaaaagagaaagaaaagcaacggatggccagaaaaattgaagaaagagacgcggttactgtacttttgctaccgtacttttattggggcaattcttggca

SEQ ID NO: 79241 - DNA, 242 bp, Heterodera glycines
  Genomic contig location: Contig_ID=SeqID_15068; Location=693..934; Strand=+
  SCN-specific regions: Sequence locations=1-50,77-96,120-242
ccccacaaagtgtccaagccacgaaatgtccaaaagagtaaaaacccacgaaatgtccaaaatttttcaaaatttataaaaacaaaatgagtttaatttaggatttttagggttttcggggtcgctgaatacgaatataccctttatattaccccttgcctaaccttaggcccatctgaataataaaaaactcaaattcgagacttggacatttcgtgggctggacattttgtgggtcagcg

SEQ ID NO: 79242 - DNA, 936 bp, Heterodera glycines
  Genomic contig location: Contig_ID=SeqID_15070; Location=634..1569; Strand=+
  SCN-specific regions: Sequence locations=1-843,865-936
aactttacgcaacccaacgaatttgaagaccaaattggccatcaattaacctgtcaatcaatcgccactgatttggcccatttgcaaattgcgatcccttcgacttcgaatgtttttgccgcaattgaacagcatgaacttagcgttgttgaggcggcagaagacgtcactttggagcggattagctcgttgaaaagtcggctggccaaagttgacttggacacggcacaaacggggccaagcagtactcaaaaagtgggcaaaaagaacgacgaaacaattggcactttaattggccatttcaggtggatctgtgggcactgctgaagaagaaacgcaccattttggctagggatgagagttctgaagaggaggcgcgtgcctcactacgcgaaatggcactgatcgacgacgaattaggcgatgagctcaaaggcaatgccgaatttgaaaaattgagccgacaatggacgagcaaaaaagccgaattggatcgactgatgattctgaatgaccaactgaaacgaatttgtgggcgattggacgaagggcagggcgaagaagccaatgccgaagagttggagactgaattggacgcgttggcccggtcattggcaacgacggcactcgcccattcggacaatggcacttctgctgccggtgattaggaatggctttatccattggcattttgaagcttatcaggccagctgacttagcattctgccattggaaaagttgacagaacaatgtttgcatttttaagcatttccgctgcatcgtcaattcatccgccgagtcgaaacgatcaaaaagcgaattcatcgccgaatggcggaggagcaacgccaacaacggcacgcactcatgcacaaaatcgaggcgctgaaaatgagtcccgagggcgatttgccagttgcgttggaagtggccgag

SEQ ID NO: 79243 - DNA, 279 bp, Heterodera glycines
  Genomic contig location: Contig_ID=SeqID_15071; Location=535..813; Strand=+
  SCN-specific regions: Sequence locations=1-279
atgtgcgcttttaaagctctctttgaaaaatgtatggaaaaagcgcaaagtgaaaaacaaatcgaaggaaaagagacgaaaaaaacggtggaaattcaaaacaaaatgaatttaaatccgtttaaatccgttaagcaattggaattgaacgcgttaaaaacacaaatccttggcgcagtgcccgaactttttgaagcgcaaacaaatgcacggatatcggtccctgacattgacttgcaacgaatgctcgaccaaattttgggcgattcgattggaccc

SEQ ID NO: 79244 - DNA, 1991 bp, Heterodera glycines
  Genomic contig location: Contig_ID=SeqID_15074; Location=690..2680; Strand=+
  SCN-specific regions: Sequence locations=1-737,759-773,795-1140,1179 -1390,1415-1560,1582-1655,1677-1991
atgggagaacatccgaacgacatgagcatcgagcagattctggacaaagagtccgaggagaaagcgcgacgaatagccgagaaacaggtcattttcatttgccatcaacaaataaacgcacaaaatcccattttacaatcccttgaggattttcgtcagatttttgaaatccgatagtaattaatggtgggtggtaccgatatacgcctccataaaattttttagaaattcatggtgggttgggtcgatgaattaattattcaagctcttaaaaacttatttgaaaaggggcattaccccctgagtattggtctgcatttatttttttagataattcaaacacttcaaaaggccgacaatggagtaacacgcatttttttttgtacttattgataaaaggaaatattttagactatccaaaagcttcgtttgtctgacgacttgccgaatttgttggaacgcgaggaagcggagttgaaagcggaattggcatgtatggaactgaacggcacggagaagagcagcacgacaacagacgaaccaaaggtggcgagtgtgccgaaaatggcgaagcaaagcaattgccaaccatcgcaatcttaagccaaattcgcattctccctacgatgacgtcgtcgaaaaccatcgatttgacatccattttgagtccaacggtccttctgtccagccaaccaccagcagtgccgctggtgccacaaatcggccgccgacggacggcaaaattcgtcaaattgcgtcatttccccacctcaaacaatcaccctttttgagcaatggaagagaggaacagctcgaattctatggtgcatttggtcagtgatttatttgttggtgtttttccttttgcagataatgtcaattcattttgtccatttgaatcaaatggccgttcaccaaacaatttgaattataacgtaaaaaacggacgacaaacagacgaccggccaacgccaccgccggtgccggagaagccggcatttttaagacggacggtgtccaacacgatggtgatgaacagtagcaacgacgccaacaatagcagcaaaatcattggggtgagcactgcgaatgctttgcccgcgttaggaatgttcgctttcaatgtgctcttcatttttgacaaaatttaccattagaattttaaaaatttaaaaatcggtcttcaaaatttgcttttctgtttaccgttgcttttgatgactctttgattctctctgctttttcagtccatccgaacttatattcccgactctgaggtggagaagcgccaatcccaaatattcgaccagttgcgcgagcagcgtgaacggttcgattttgctttaattactgtatatcagtgaatgttgattttgaggttggaacgcgaggcggaggaggaggcgcggagggaacagacgcaatgggaggagcagcagagacgcgcgagggaagcggaggagtccatccggcggattgcccaaaaggcgcggtaggcctaactcgccgaacccaaccaactcggccactgtgcccttaagggagcagcaccggaagtgtctgcgcacctccgactctctgctgccgctgttccaacgcaacggctgtcaatttgccggaacggcgcagtcaatgcgcgaggctctgagggcactgccgaggccgccgaagccaaagagtcgccaaaacgtaaagggggcacaaataattcaattccatcggcacccaaattcccccttttcgggttcagctcttctcccccccatgtttccctccggaaaaatgtttaaacctagaaatttttacaagaaaaaacagaaaacttaaaggaaacgaatttctcaaaatctaacaacaaaatttcacaaattatctccaccttttggttgtgagaccacatgacacaaacttacattctcagatcatccaatggtttcgttcgtcggagttgggccaatgggcacaaaagaaaccgcctctttggttccatg

SEQ ID NO: 79245 - DNA, 3042 bp, Heterodera glycines
  Genomic contig location: Contig_ID=SeqID_15075; Location=139..3180; Strand=+
  SCN-specific regions: Sequence locations=1-92,122-137,160-233,255 -372,402-633,655-701,723-811,833-987,1010-1252,1274-1570,1593 -1855,1877-1944,1983-2167,2190-2499,2521-2529,2642-3042
atgactgcacggagattggcatctgctgtttggcggccatctcctgattctgttttgaatccatcacatcctttggtaagttaaagaaatgcttaatttaagaataaaaaaattaattattcactttgtgcaatggcttaaatatattttaaatttaaaccctccttttgtctacccgctttttctccttaattaaatgaccactttttggtttcattttcaacatgtgaaaaccaaaaacatccattctcactttttggctctgattacttttttatcgtttagtttaaggtgagcgagagattttgtacgcatttgtagccacttttgcctttaattattaaaaattaatctcttcggcggctgtaccccaatttaattaattatatattctaatttttgtcctcctcacttttatcgaaacgaatgcctcctcttcttcaataaatatgctgaaatttagaatagcacgtattggcccggacgctctctcacgaatacaataattgcttactttgataagaattatacccaggtgagtgaacgaggggggaaaaagttcgaacttggttttggagattttaaatcgcataaaaagccttaaatgtgttttaggaggtgattttattcacgaaataaaatttcattttccaagtccatattttaaataagcatttctattttcaagtccttttcacaacaaataaattccccggcttccattcagcagcatcgtattttttcttagtgttcgtaagactcataaccccttttttggaaatcagttccttgtgccaatgtggcccggtcacttcaaaatatgttttatttttccattcacagttggagcgaaatagactcgtcggtgcggtcggacggaaaatggtactagaagaaaatcgagcacaagacgcaaaactatgggagaaaaaccaccccgaccccagatataagtgtaagcccgacatcgtccaagaggtggaaaattgataattaaattataaattatggttttgtccaaagcctgcgaatggtcagccaaagcctgcgaatggaaagccaaagcctgcgaatggtcagccaaagcctgcgaatggaaagccaaagcctgcgaatggtcagccaaagcctgcgaatggtcagccaaagcctgcgaatggtcagccaaagcctgcgaatggaaagccaaaggagttcattgagatcaagtcgattacggaggggagtaaaacgaaacccaagtagagaacattattttatgaatttttaaatttacgatcgaattatataagatgcggtcactctttttaggtataatttttttttacgtccattttgactgccatttcgatttacagcgaaaaaatttggattttccatattttttgtaaatattttggcttttttcatataaaattcagaaattctttaacaataatgatttttttgatgcgattatattttttatcgatttagctttgaaacgtggcattttctgtagtatattgaaacgtcatactgaaaaacataacgaagccttcctcgataatttttattttatttgacagacaaaattttttatataattattagagaccggtgggatcggaactcccgcgggattttacgggagtcccgctctcgactcctgttttttcggtgaatgggatttttaacgggagcgggatttttacgggattcccgtttgggactcccgtcccggaaaattttgaactcccgatcccgcttccggaaatttttacccaaaaaacgggagtaaaaatgcacttgtaagaattgagttttttttttggtaaaaataatgattttctttgaaaatctgttaaatatatagccaaaattttacaaatcatttagactatctggacctcagaagcaagctgtaaaggacgggaagcttaaatccgtaatcaagatgtaagcaaaaaataaaaaaatctgaatataaaaatttaataaaagtaggcacaaaatcagtttcaaaatctcgattttcactccgagatagcaattagcactaaataagtaccggaaatggttgcacatgatacttttatctttaatgaagctgcctatcgggatcgcaggcaccccaaaaaacctaaaaattttgctcaaaatcgaaaaaatttataattttagacaaaatctgttatagatctatccaaattttcaaaatttttcccggcggaacggcaccgccggacccccttctccctaaaagtctttagaaaaagcgcgccgcgaaaaaaagatgctttgaaaaattttgggaacaagggtccggcggtgtcagtaagcgccgccgcgaaaatttttcgaaaattagagaattagaatgcaatttattaactgattttcatcaaaaataaccaatttttgactttgagtcaaatttttttaagaaaaaataagtttggggacccggcgccggaggaaaaatttgaaattttgactatttttacagattttcactcaaaaattgttcattttaaaaatgtcttatcgtttttaattaattctatacaaaaatatttatgataaaaagaaataaaaaaagtacataaacttattattattaataataaaaatttttaagctaaaataataaaaaaaatttgactatatggtataaggcaaaaattgaaaaaccccgaccccgaaccatttggtcaaccctgaccccgaccccgaacttgctgaccccgacgactccgaaccccgacttttccgaccccgacggtcgggggcccaaccctaaatatcaccgtaaaaattgtttatgtcaatgtttagagtgccaaagaaaaatgtcgccactacgtccctatcacgaacagaacaacatggtttaaagggaaaagaaagatctctgttggacgctgctaaatggggaagaagggtgcttaaaggattgaatgttgtcggagtagtttcggactgtggcaaagtaattctcgtctgcaaagaaaaaggactatcggaagcagctgggaccactgttggaattgttgtcgaacg

SEQ ID NO: 79246 - DNA, 204 bp, Heterodera glycines
  Genomic contig location: Contig_ID=SeqID_15076; Location=93..296; Strand=-
  SCN-specific regions: Sequence locations=1-91,113-204
atgtctcatcccaatgcttttcgtcattccaagtgtatcgaagcatatgatcaaacagagtgagaagaaataaattaaaaattgtaataccgtaaaaattatttacatttttatagattactgtacaaaattaactctctctatgaatgcagttctgctgaataacaaaaaaatattaattttttcagaagctaatttattaaa

SEQ ID NO: 79247 - DNA, 651 bp, Heterodera glycines
  Genomic contig location: Contig_ID=SeqID_15077; Location=806..1456; Strand=+
  SCN-specific regions: Sequence locations=1-61,83-102,134-228,250 -377,408-563
atgataattttttggatgtcaatgcttgtcacagtgacctcgaaattttttggccccaactgtttgataattaattacaaaagcgatggaagtggtaaattttgaaaattttaatgaattttatacaatgattagttaattattctattttaaaaggttgtcgttctgtgttcgcaaaacatcctattttctgcagtgaatccgccaccatttttttacttcgaaatgaaaaccataaatgtgaaaaagtatgttgaaatgcaacaatattgcatttcatgtgaacatttgttcagcagtgaatttttgtctgttgtggcattaatttggccactcggcggattattttcacaaagaatggactttgtttgggttggttatttttttattattaaattgttttttaacaagtctttgtctgaccttttttactatgaaatttcagttatgaaaaaagaatagtaagcgaaaaaaatcagaaatttgaagaaatatttttgcctattttaaaaaaatgaaattaaagcctttatttaaacttagaattaagacaaaaattcaagaaaaaatatttaaaataataatgattaaaaaagaatttgtatttataaacaaaaaattaatttaaagacaaaaattataaatttaaaa

SEQ ID NO: 79248 - DNA, 2694 bp, Heterodera glycines
  Genomic contig location: Contig_ID=SeqID_2345; Location=94..2787; Strand=+
  SCN-specific regions: Sequence locations=1-11,35-145,172-427,473 -526,552-623,647-1315,1337-1636,1658-1661,1683-1982,2004-2173,2317 -2694
gttcacacaccgcaggaggaggacagcagcagcatcagatagaggaggaagagcacagcagagtgaggacggaggaggcgaacgcgtgactgacgaaggaagagcagcgggaggagggcggggccaacagccgacgaccgaagcagcgagaaggaggaggaggcggagtcacaaacagcgaccgaccggcgaacgaccgccaaccgtcgataacaacaaaaaaacagcacagcgaacgggtcggctgctggtgtcccaaccctcaatcgatcatcatcggccggcgaccgggcggaatagcggcgccggggacagcgacgacagaaaagaggcggcggaggcgagcggcggcgggcggggagcaccccaattgatgcgctgttggtggtggttgtgctgctggggctgttggttggccattccttcgaccatcgtcatcatcatcaccaccacctttactagcaccacaaccgcagcggacggcgactactctttggttgaccacgagcaggagcagaaacaacagcaacaccaccaccaggaggaggaggggtcgaacgcgttcaaatcgttgtttttgttggcggtggacaaagatcatcagcaagacaaggagtttttattgaacgacgacgacgacaacaaccagcaccaccgagtggaggaacagttgccgttgttgttcattgttggcagcaccgttggcaccgcgttgcaccgactgttgttgagcattgcccgcacgacgcccatgggttggcccgactggctgcagccgcacattggtcagtctcagtgttccgtgtcgatccaaatgtggcgatgtttctgctgctccccgttcatatccaacgaagcggaccccccccccccccccaccgccacttgagggcttttattgctaattgactataattagaggcaattactacgtgaattcatttccatttttcgctaattggttgggattgttttccccaagtgtgtctgactgctggtcaattaccaaatgtttgtttgttttatgaggtaatccgtaattagcgaatgctttatccctgtagataatgtcacggatatgaatgtcttttttccaaaaatccgctgcattaaattttcaattcttatccctcgctggttgtgagctttagtagtttttgttaatctctttcttctgtgtgccctgttttacaaagtatgcttttcaagactctgatttttcaatcaattctccaataaaacactatgtggctttctctcaatgaaagtgcatttgaaacaaaaatcaaatgagcctcatttttctttttttgcgaaagaaattaaaagccatttgacgaagtgatgagtcacatgcattttaaaaatagaaaatgagacaaaatgcaatcccctattttttgttgcacattccacaaaaattacaatgattcaacaatagcaaatgtttttgctgcaaattcggggtaactttcgcttcatttcggccggcattttcatctattttcaaaatgccgaaatttccaacaaaaacaaatcccccattttcagatgccttcgtgctctgggtgaatgggttgctcgagtattggcatctcggctacttggaagtgcgttgtttttgagaggggttgcaaccccgccccgaccccgaaccccgacatttttggccattttcgggaaaaaccccgaaccccgacgcttcataccccgacaaccccgacccttaaccccgatcggggtcggggttaaatatacacccctaagaatggcattttcgtgggagaaaatgcaaaaaagttagacgaaatttgaattttttttaaccatttgccaaatttttattaaataaagaagatttgctcaattttggacatttggaatgtggtgtagaggttagtgccatgacattactttctgtcgtgatttcgataccgttcgacgttttcttctttaattattttccagggcccaaaaagtcataaaccttattaaaaaattggctcaaaatcgcaaaagtttagcatattttggacaaaatctgttaacagatctaaccaaattttcaaaattttcccgcggcgcctatcggcaccgccggacgccgtaccctttctccttaagtctttagaaaagagcgacgtgaaaaaagatgttatggaaaacaaaaaagtaataaaaattttaaaatttcaagaaaaaaattaattctatacaaaatttctgataaaaagaaataaaaaaatataaaaacaatacaaatattattatggaaattaataaatattatttccgaaaaaatattaaaaaaattttgactatttggcataaggcaaaaattgaaaaaccccgaaccccgacacttccaaccccgaaccccgaattttccaacctcgacgtcggggttgcaacttgcaaccctatttttgagtgttccgcccgtgccattaatcccccgtccgtttcagtacctcgtctggcttctcctcccaattttcattgtgttcgttttgcccattgtttttctgttcttcagctacggttgtgtgattttcttgcgcatttacaagcatcggaatcgtatccgagaagcggtgaggggtttttttgccgttttttcagactaataaaaacggattgacgagtttttgcaccgatcagaggccgagaggagtcggcctttttggccattag

SEQ ID NO: 79249 - DNA, 867 bp, Heterodera glycines
  Genomic contig location: Contig_ID=SeqID_2346; Location=253..1119; Strand=+
  SCN-specific regions: Sequence locations=1-264,287-304,326-337,359 -660,682-813,841-867
atggtcacccaccttggcaagccgttgaacttcgagatcggcgacgccgccatgacagatggtcgaccgccagtgtccgcggaacagatcaagcgggcggtgcgtgacgcggtatgtcgtgccgcgttccacgccgatccctcccggaatcccttaaaatttgccagaaattccaaattctatttttgacgggtgaccatgtaaatctacggttttttaatggatttcataccgttttttggcacgctttttcaaaaaaagtaagtttttggggaaccaggggtccggcgatgccgatttcatgtcattttttatgatttcaaaaaacatgtatgaatctaatcccccctggtaccacgattccaaggtggatatccaaggactttaggattcgtagtcggtcactgtccggaggctctattcattacatatcgccacccccccccccccatttttaggtggacgtgctcatccaacggcaccagcgtttgccgggcagcatttggcgtgcaatgttccaacggataggcgccaagcggacaacgcccagcgggctggacgacggcgcgctgctgccagccgacgcggaggcggcacgcaaagagtggcggcgacggcaccgccggcggaccgaccgtgaggacaacgagctgcagcaaaatgccgaagatgacgacgacaaggatggcaccatcgatcaatcgcggcggggacatttcggcacggcggtgatggtccgggacgaatcgtcaattgttgtggacgcactgagcccaagcgacaaagagctggcggaagtgccgttgttgctgccttcgtcctcctcgtcgtcctcggcacggcatgccgaccggcggttcggcgacg

SEQ ID NO: 79250 - DNA, 2129 bp, Heterodera glycines
  Genomic contig location: Contig_ID=SeqID_2348; Location=1789..3917; Strand=-
  SCN-specific regions: Sequence locations=1-92,124-148,170-259,281 -608,637-677,703-707,738-826,868-1036,1074-1134,1187-1258,1280 -1387,1410-1461,1483-1646,1668-2129
gaaagcactgaagaggctgtgctccgcgagttgcgcgaggaggccggcatccgtggcaaagtgctgttttgcatcggcgaattcgttgtaagaaataaataaaataatttttaaattttttaagtccgattcccatgattgaggacacagcaatttaaaatgatttgaccgcaccgtatttggaggggcgcgcttaaaattattgtcccatggctcgtcagtagagttccggacctggatttcccggacaaaaatccaatggccttgtcctggattccaggaaaaatgcaggcctggctctacactaggttcaggtcgaactctactcgtcatacatgcccacgacactccgatttcatcattttacccatttttgtaccaaatattttttgctccgttttattttttggtttgttcaggacgaccagcgctttcaccacacaacactgttcttcttgacggtgcgcgaagtgttcacggaatggggcgaaaattgtgagaatgggcgacaacgacgatggatgggcatggacgaggcacggaaaagcatcaaacacaaccagcgggacatgctggagaggagcatcaaaatgttggtacttttttttaaattttcccaaaaaatttccaaattttctgcgtccaactcccgttcttcttttgttcgacgatagatttttgggttttaaaaatgtaaaaagtcatggacccgtgtctcattttccatcctttttgtgtttagcattgagcaaacactgggcgaacagttggagccgtcggtcagcaaatgtctcagtgctgtgcccgttgtgtcactgcgcgcggcggaggatggcattggcattcaacagcagcagcaaaaacaactgtcaccgccatcgacagcaaaatcaacggcacaaggtggtgacgacgacggcacggacctttgccggtgatggtggcagaaatgggggccgtcactttttgttcaacggccattccaatttgtattgcgcaaattagccatgttgttaatgaggacgacgaacaaatgattattattattacttttgtttttttaatttttttttccattggtcttcttctaattctgttaaatccccaccaaaaattcgcttctgctgcagctaatttgtttttttctgttttttattgtttttgttactgttttttgttccgttttccattgacttttctctctccgctttttgttggttcattcacattaattccattcaaatcccccctttttttgtgatgcttttctcaatgcttttggcataaaaaagcccttccaatttccatgttaatttgttgcatttttcagtaattcggcttcacctatattcctatttaattcacatacatagctaattgtaagttgttttccatctgttctcttttgtccgtttttcccctggaaaaaagacattttccgtataaaattcaacaaaaaaagagtgtattttgtttatttttaacggaattttcccgtcaaaaacggtattttatacataattcaaagttaggcacctaactggactttggcttacattttctctgatttttgccatgaaatttgtcacttcgttcgcccgtcgttggcccctttcgctttctgtcgccgcttcgtttggccgcgtcggtgcgacgcgcgccgcctcgacgctgacaattcgcgacgcattaaaccaggcaagtttttagggtttttggtcatgtattcggcatcgtttcaatcaatttcatgggttaccggacccgaaattcgaccgtaaatcgggttgggttttaaattgataattttttattcaaaccgtttcacgcaagtccgaattttgccattttcatcgtccagcaaccccgaacagattccatgaaatgagtttcggtaacacaaaattaaagcgtgccgaaaattttgtttttccctcggtgccatttttgcagatttttaagtgcttgtgacataccatcatgcatttgtcgtattaaataatttctcatcgtcaacagcagcagtgtctcaatccgtctccactgatcgctcccatcgatcgtcggcgatttgcgacagtcaaaaagaaacggcaatggaacagaacggcacaacaatcggaggatga

SEQ ID NO: 79251 - DNA, 145 bp, Heterodera glycines
  Genomic contig location: Contig_ID=SeqID_15079; Location=2419..2563; Strand=+
  SCN-specific regions: Sequence locations=1-145
atttgttgaagaatctcatttgccaagttccatttagacgatgctacggcacattgattcaaccaacaccttttatttgcgaaagaatgcaacatgatccaaaattgaaagaaaaagtggaaagagtccagaaagaatatgaggt

SEQ ID NO: 79252 - DNA, 328 bp, Heterodera glycines
  Genomic contig location: Contig_ID=SeqID_15079; Location=3189..3516; Strand=-
  SCN-specific regions: Sequence locations=1-150,179-328
ctcggcaagccattcaaggcatcgacaaccgccaagaagttcgaagggatcgtcgcaatggttttgtgaatttatcattcaaataaggcttgataagatctttttttttgcagagtgcgtcttttccattgcgcttcggcgttcttttggtaatatttttttaatataagtataaaaaggcttatgaccaggcttgtaaaattcgtttcctattgttctttgttgaatgggcaataaaattttaaatttatcaggacatgctgagagtattcgagccactgctgccccgcttctccaaattgcgcgggctgtgcaaaacgcgtttgcc

SEQ ID NO: 79253 - DNA, 988 bp, Heterodera glycines
  Genomic contig location: Contig_ID=SeqID_15080; Location=341..1328; Strand=-
  SCN-specific regions: Sequence locations=1-321,343-495,517-988
atgatcttcacaattgccccttccgtcgctttggtcgcttttttattttttcccaattttttcctttacgtttgttttgccaatactcactttttggccaaccatcaaagcggtgccattgattctgtggtcagtacccatccatcataatttgcctggacttctctcaaattgtttctttcagtccgattctccgtttcaaatccgtcagcctcattcccttcccgaccttttgggccaattggaatggattcgggaattaacggcgatcagaacattcattagagataaacaagtacgaacaatttttgccaggttaggtaaataaattttgtttacatttcaacaaaggctaacattgaccagcgatatggggaagatgaccccgaaattgagaagaaagtgcgggaaacggacgaggactgtgtacggagcaaaccgatggaactgcaaacggagaattttgttgtcacttatcccattgacattatgcccaaatttgtgattggaaaagaatcaatgtaaagaccaaaaaaaaaaaaaattagaaaaatcttttagcattcattcgacgacagaaacactgaaaatggactttctcagccgaatgtttccgaatgatgagttgggcaattctcaacaatcattgtcagaagaaccaaactgtgcccatttgacgggtacaaccgaagagagaaaagccaacgaagtgagcacgacaaaggtattcctcgccttggcaattcattcattaggcataattatcttaggaattccgttcgttcgtttccgagtatcaattggcacgactaagtgaggagcaattgcaccatttggggcttttccttgcacaaaaactgacggcaaatgacgaaaaatcgcgcgaattggccctttattatgcacatttttactggagaattcggggcgacccgttaaagtcgcagcagtgccttcgcctctatttgaagcgacggccgaattgcgt

SEQ ID NO: 79254 - DNA, 1311 bp, Heterodera glycines
  Genomic contig location: Contig_ID=SeqID_15082; Location=787..2097; Strand=-
  SCN-specific regions: Sequence locations=1-761,783-869,892-1311
tgccaattattttgccttcactcatatttgatcagcagcaacattctgctcagaatcggtccattcatcgtcgttttaccacctctacaaccagcttcaccacctatccggcacaacccccatcgtactcgattgaacctgttggccaagctatgccatcgctaagctacccaatcgggccaccacagccgcctgtgccaccttcttacccaacagtgccgcaagcgccttttgctggcacaacgagtccaacggcatgtgaatgttgctgttgttctgccgtatgtttttatgtattttaatctcttagaaaacaaaaaattggcaaatgaataatatacaccaagaaattgaaaaaatattgtcacaggctcgaaaaaacaatttaaaaaagcgagattaatcccttatttatgatgtttttctaatctcttggtggttttcagttttgaatcttcaaaataaggagcattgattgatggattatcaattgaaaatatttcaagtataaatttatttgtcatttggcatggggtttaagccttttaaagcatctactatttttttttaattcttaaaccaattctagtatcgcagttgtccatgccggccgagctgcccgccatgttgtggtggaacggtaattaaaaaaaatgatttttttggaaatttaatttttgttcatacatagcatacaacgtcaaccacagtaccaccaacaaagcccacagaagagacaaccacgactacaaccaccaaggataaaacccccaaaaccacaacatcaagcagtacaccggttacaaatccgctattacatccgtacaagtaaggaacacttcacattattaaaattcttatataggaatattaaagaaaattaaattaaaatcagtttttttagcagataagaaatttctataaattctcaaaacatcgaaatctaaaatattaataggtttctttcatctagtccatgctgtctttcattgatcatcaattgtccaaacaacaactgcaattgtccaccgtcatcatgctttccgtacacacacagtggtggttgttctgcaacagagccttgccctattccgccttatttggccggcaccggtggttatccgattgggatgccgccgaagtttccagccattttcccacccatgccaaactatcctggcattccaatgccaaactattacccaacgatgccaagaaatccaggcattatttacccacctgttggggcaacaaattatcctattattccgcctttaccctacgccgtttcaccgttgccaaactatccgg

SEQ ID NO: 79255 - DNA, 1232 bp, Heterodera glycines
  Genomic contig location: Contig_ID=SeqID_15082; Location=1840..3071; Strand=+
  SCN-specific regions: Sequence locations=1-240,262-312,345-396,443 -503,526-1033,1143-1232
atgccgttggactcgttgtgccagcaaaaggcgcttgcggcactgttgggtaagaaggtggcacaggcggctgtggtggcccgattgggtagcttagcgatggcatagcttggccaacaggttcaatcgagtacgatgggggttgtgccggataggtggtgaagctggttgtagaggtggtaaaacgacgatgaatggaccgattctgagcagaatgttgctgctgatcaaatatgagtgaaggcaaaataattggcactgagtttggcagaatgtcatcgtcaattcgctaatttgtgagtttggcgaaagtaaaatttaaaaaaaatgtaaatttaaaattacctttgcatcggtagtatttccatgaataaggtccgatgcagccacagaaacttaaaaaagaaaaaaattaaatattttaatttattttatttttttaccgataatgaaaaggtgaagcaaaataattattaaaaacatttgtttaagttattaatctaaaacctaagaaaattgaccaaatgacatgactttataaattacacataagtgggtaatattagtcaaattaattaatttagtttatgggttcttgatccgtcatatccaagatgaaaatttccttattgaatcatatgtgtatacacaaacattaaatagtttttttttacacttgattttccaaaatagaagttaggtaatacaaatgtatgaacaaatgaaaattcagcgtatttatacagaattttcagtgtaataaaaaaaattatcaaagaaatgtaaaaaaaaaaaacgttttaaattggtatatttcaatggacatttgatgggtggtcaaaaaagccgccaaccgattggatgaaaaattgcattgttagttcacctcaaaataggcaaactattgtaatattagaaattttatttatacaatgcaatcagcagacagaggctgacgacaaatgtaacaattctttcaaagaaatggaaattttttacaatatttattttatgttgctgcttaaatttcttcaaaaaattttcattttaatatttgaatttatttaattattctggtagaaaattcttttatttattttttttttgatttaagtaaatttcaattaatttaattattaattcagttcctctacttttacgcaaaaaattaaacggttatttttatcgaagtactaactaattacgttttttaagttatgatctttgataaa

SEQ ID NO: 79256 - DNA, 666 bp, Heterodera glycines
  Genomic contig location: Contig_ID=SeqID_15083; Location=469..1134; Strand=+
  SCN-specific regions: Sequence locations=1-267,289-666
atgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaattctctacaatattcaaaaaaccgcatgtctctatgacttataccggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcttgcggatcgacttttgcggaccgacattatcgtttttgggcaataaaggtgtattctggtgaaaattgaattttcgacttttgttcgagttcgggatttgaaattggtagaaatggatgtcatattcgtgaaccccgaatacccctagaagatttttatcattaaaaacaaaaaaaatttttatctggtccaaactgtatgtacatgtaccgaatgtttttcaaaaaacccgtaagaaattaaacagcattataccgcctaaacacaattcggagctacatattatatgagttttaaaaaaatttatttta

SEQ ID NO: 79257 - DNA, 66 bp, Heterodera glycines; identical to SEQ ID NO: 53774
  Genomic contig location: Contig_ID=SeqID_15083; Location=319..384; Strand=+
  SCN-specific regions: Sequence locations=1-66

SEQ ID NO: 79258 - DNA, 1031 bp, Heterodera glycines
  Genomic contig location: Contig_ID=SeqID_15084; Location=490..1520; Strand=-
  SCN-specific regions: Sequence locations=1-452,475-1031
caatgaaaatactcaattaaacaaagagaagtgcgaagagaatgcgacggcttcggaagatcctctgcacattttcgaccttttgagcataacggacacgcgaattcccgaactgtcggcacgcgccgggcagccttcaccgtaccttatccttcaggtgggtgtccgaagtagggaatcgaaactgtaaattgttgaaagtttgaaaggagaagccatgcaacgccttttcaggagtatctgaaacgatgctcaacttatggcaacacaacaatccaactgacgacgcgccgtctccgccatcaaaggcatgaatttgcgttgagtgttggcggcaacaacagcgaaagagtgcgcgttgtgtccaccaacaaacgcgaggggaaacagaaggcggcgcaagcgatgctgaagaaattgcatccgaatgtgagttgaacagaattggaatttgaaaataactccaaatattttggaataaaaaagagttaaatattttttcttgcattaattggcgtcgttctttcatccctcagaattcaacgtgggggtcacttctccgtctgtacggttacgaggctcaaatgaaactgaaggaagcgcggaagtgcaaggacagcgttacaaagttacaaggcatttcaggtgaacaaaaagccacggcaaatgacaaatcgaaaaaaatcaaacattcctctgcagatgaaaaatggcaagaaggaaaagcaacgggagagtttcaaccgaacaccattattctgaaaaagcttcaaagcgaaatgcttaagttatctgaaggcattattagccagcaaaaagacacaaaaataatgccgaactgtcagcaaacgattgaacgccttttggagaaggaagaaagtggggagccgaccgcgaaactaagaaggagtgatttccactcggaattgcccattctcactgaagaacaattgcgccaattgtcttcgaaattggccatcaaataccccaatgatgaagagcttgtgcacattccctcacttaaatcttaa

SEQ ID NO: 79259 - DNA, 310 bp, Heterodera glycines
  Genomic contig location: Contig_ID=SeqID_15084; Location=2349..2658; Strand=-
  SCN-specific regions: Sequence locations=1-106,143-310
acagtggaaggagatgccaatattttatgcaaattgagtgcaccgagtgttaaagttaaggtaattccttattaaggcgaaactgaggccaaagaatatttgaatgtttaattaaattatttgaaataatgtaatttatattgaaaaggaacactaacgaagtctggatattttagactgaagttgacctccacaattcgcaattaaatgccgatcaattgtacgaatacgccaagaattgcttcaaattcaaaaacatttgcgttttacgctttcggaaatggtccgaagctcgcaatttttataagca

SEQ ID NO: 79260 - DNA, 1116 bp, Heterodera glycines
  Genomic contig location: Contig_ID=SeqID_15086; Location=536..1651; Strand=-
  SCN-specific regions: Sequence locations=1-1116
atggcgaaatttcggcttatcgtccgatgggagggagccgagcgcaggaggggacaaagggcgaatgtgtgccggatcagggagttcggatcgacggccgaggccaatggcagggttagccaacagtgtcaatgccagggtggggataatggcaggatgggcaccgtgggtcaatcaatgctaattgtcaataatgggcaactggaagggtgagccaatcatcggctgatcactccccccgccctccctactgattaggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgtacgcaagccgattatgtcaaatacccccctcggttttaggcatgtgcaccggccaaatttgcgagacaaatcgcgcaaatgccctcgagggactcccatttaaatttgacaggtcgaatagtgcgaaattgactgactaagaagcatcagtgttgactcccgtgtttgttaagccgtttcaacggagtgcgcgggtgggaaatcgtttgtccgaatgttcggcccgaagagccgaattcgtcgggcgaatcgcctgaacaaagtgacaacagacaaacaatgagtcccaaaatttacaggtgatggcacaattattgaacgatcgaaatttcaaagtgccatttcagtcccatcgaaggcgaagtgatcggtcgcgtgcggctgagtgcgtcgagcaactcgcaaagctattcgggctgtgccaacgaaggaatatttgtagttggcacgggaaaatggacggactacgaagtgcgcatttacaacgcgcgattccgcgaatccctcgcgcttggcaagcagcacatcgaacaggtggtggaggacgacgcggacagaacgccacactgaacataatgcactcattcatctccagggacagcacattggccatcgcttggactgtgccggggaggaggtggtccaatcggtgttcatggag

SEQ ID NO: 79261 - DNA, 459 bp, Heterodera glycines
  Genomic contig location: Contig_ID=SeqID_15086; Location=2434..2892; Strand=-
  SCN-specific regions: Sequence locations=1-141,163-196,219-221,245-459
  Gene Ontology: Mol. function=protein methyltransferase activity; Cellular component=nucleus; Biological process=organogenesis
gaagtcgacttgtacaccgtccaagtgtccgaccttgcctttgagaccactttttctttgcgtgtcattcgaaacgattatgtgcaagcgttggtcactttcttcaccgtcgaattcaccaaatgtcacaaacgagttgggttcagcacagctccggactgcaaatacacggtcagttgggcacagcaaaacaacattttatttaattgaattattttcaatgtttttagcattggaaacagacaggttggtgattctttccatttttaccggaaattctttttttcagtcttttacctttacgaatcgctgacagtgaagaaaaacgaggaaatccatggcgtttttagcgttgtcccgaacgtccgcaacccacgcgacttggactttcgcattcagatcagtttccatggcgatttgtgcgacttggacgaggacaacacgtacattatgcactga

SEQ ID NO: 79262 - DNA, 1019 bp, Heterodera glycines
  misc_feature (960)..(960): n is a, c, g, or t
  misc_feature (1012)..(1012): n is a, c, g, or t
  Genomic contig location: Contig_ID=SeqID_15087; Location=996..2014; Strand=+
  SCN-specific regions: Sequence locations=1-737,760-791,813-819,847 -1019
cgaaatccacaagcttcgcaaggagcgcgaagcgcaagccaaagagcggcgcacgcagcgccgtcgcgagcgcatcgagcaaagcaccgtttgggagcaattgacacgcacattcaccgtgggcattttcgtttgaacattttcaaaaattgatattttctaaatcaaaaaattctcgtctcttgtcagcttttttgaaaattattttttcgctgtgctttaggccggcagtggtgacgacgattcggacgaggacaatgcggcggagggagccgcggagcggtggaagatggagccgatcagtctgttccagcgggtgaccaccgcactgtccaccaaagcggtgaacatggtcagtcgggacaatggtggacactaatgagccactaatgggtgtggtaatgacgatgaaaattaagcaattaacttggtcgtttcgtccggtggtgccggcagacgcggaattttgcaaaattaacgaaattgaaatgaaaattgaaacaatttaaaaaactactaattggaattcaccatttgttgtccattggttttcattttccaggccgccatgctttacctaggcatcgatttgctgttgtgcatcgtcttcttggccgtccaaatggtcggtgcccattgggtgcaattgtctgacattttccggtatttttaaaacatttatgtatatttcctgggatctttaattttggggtacttaactgtttaatcttctactcattttttgaaaaaattatttttcatgaaattaaaaaaactactacctctttagcaatttcaaactttattttccgttttttcaaaattttaaaaattttttattttttagggattgccgattaccgatatttttgagggtcggatttccgattcagtcacgggattcatatttccaaaattttgtgggcctcggaatgccatcccttcttttcacctatgttncattttccgagcaacaaatgtcttgtaaccgcaccgatggggatggtccccnaaagtga

SEQ ID NO: 79263 - DNA, 594 bp, Heterodera glycines
  Genomic contig location: Contig_ID=SeqID_15088; Location=1021..1614; Strand=+
  SCN-specific regions: Sequence locations=1-151,174-285,308-594
atgccaagcgaagtgaacgccgccgcgttggttctgtttgcgatgaaactgttctttgggcttgacggggaagaagacaagcagcagtcgcgcgatggcacaaagtaaacaaactgaaaaacagagggtgcacttcctttctttaccttctatgaaaattttttgatttgtgggagggtaacggatacactacacccccccccccccgttccgaaatttttaaaatttatggtgaattactaacaaaatgtttttttttaatttttccaaaatcgctgaaaaatatttcaaaatatatttcttcaaacttttcgtataaataaatttcaaggacaaaatttttttaaaacttcgaggggggagaacgacgggggaaatgagctgctgccgagggcgactagggtcagaggcaaacgacctgctcccaaaaataaaaaagtttattttggaattaaacattttcagcgaagcgactcaatgcgccgacgatgacagtccgtcgccggtgttcagcttcgaccattggctgctgcaacttcagctgcgcatgcactgctggcagggcacaacggttcagaaggtgttggacaacac

SEQ ID NO: 79264 - DNA, 1259 bp, Heterodera glycines
  Genomic contig location: Contig_ID=SeqID_15089; Location=558..1816; Strand=-
  SCN-specific regions: Sequence locations=1-278,301-352,380-612,634 -698,917-937,1169-1259
  Gene Ontology: Mol. function=DNA binding; Cellular component=nucleus; Biological process=regulation of transcription, DNA-dependent
atggacagagatcggattgagaaacaaaaaggaaacgacaggactgagttgaccggcgttcatttggtccggcacggaaatggaaacggaaagtcggacaacgccgagcagttcagcgtcgtgcgtaccaacgggacttgtttcaccctgaagctgaacagaccgttggaagcggacgtgtgttgggcacggattggtctatcacttaatgaaatgctttgtccctctttagccccctttcccctcgcccaattcatccgatgcttttcccccatcctcttccccctcattttctctgcttttcgagagagacggcaccggtgaccacgcgtctgtccaagtacaattggtcgatgtcaatgacaatgctccccgcttcttcggcggccctttccccgccgaagtgatcgtccccgaagtcctttccccggcagcagttttcttgtccattagccttctttttcgctttttacagctctcttcccccggtttccttctgcgccgtttggaagtgattgacattgacagaggaattggcggaatttgtcgcttttcgttggagaaaacgcaaaacgaaaaaggggcggcggagaaaggggaaatgttcgcattggactctcagcagtgccagtggccacgatgttgggccaaccttcgcttgaaaaggccaatggcagagggagaagtggccaaagtgcgagtgaaggcgagggacggggcggggatgacgaggagggcgaacgaagcgacggtggaattggaagtgatcggggcgggggcaaatggagcggagggagggggaggagaaaagaggggacgcggaagagggggaaaagaggggcggaagaaggaacacgaaacagaagaggcgaaagtagtggaagataaaataaacaaaaaagaggggaggaaggagcaaaacggaaacggaagaaacgggggagaaggaagagaaagaggaggaagagaaggaggagggaccgaagaagagggaggaagagaaagggaaagaggaagaaaaggagaaggaggaactgaagaagagggaggaagagaaagggaaataggaagagaaggagaaagaggaagaaaaggaggagaggccgaagaagagggaggaagagaaagggaaagaggaggaggggaaggaggagaaagaggaggagaagtaaaagaagaaggaagtggtaaacgaaagatagaaagaaaagaagaaaaattaaaggagggcacatccttagacgaatacagaatgccag

SEQ ID NO: 79265 - DNA, 663 bp, Heterodera glycines
  Genomic contig location: Contig_ID=SeqID_15089; Location=812..1474; Strand=+
  SCN-specific regions: Sequence locations=24-27,69-89,308-372,394 -626,654-663
ctttctcttcctccctcttcttcggtccctcctccttctcttcctcctctttctcttccttctcccccgtttcttccgtttccgttttgctccttcctcccctcttttttgtttattttatcttccactactttcgcctcttctgtttcgtgttccttcttccgcccctcttttccccctcttccgcgtcccctcttttctcctccccctccctccgctccatttgcccccgccccgatcacttccaattccaccgtcgcttcgttcgccctcctcgtcatccccgccccgtccctcgccttcactcgcactttggccacttctccctctgccattggccttttcaagcgaaggttggcccaacatcgtggccactggcactgctgagagtccaatgcgaacatttcccctttctccgccgcccctttttcgttttgcgttttctccaacgaaaagcgacaaattccgccaattcctctgtcaatgtcaatcacttccaaacggcgcagaaggaaaccgggggaagagagctgtaaaaagcgaaaaagaaggctaatggacaagaaaactgctgccggggaaaggacttcggggacgatcacttcggcggggaaagggccgccgaagaagcggggagcattgtcattgacatcgaccaattgt

SEQ ID NO: 79266 - DNA, 863 bp, Heterodera glycines
  Genomic contig location: Contig_ID=SeqID_2350; Location=437..1299; Strand=+
  SCN-specific regions: Sequence locations=1-325,348-374,397-406,450 -527,549-597,621-863
gtaaacggaagggtggcgggcactctctctccactagagaccggacaactggggtcggagggatcccgagtcgggatcccgactgaatcccgatcccgatcaatcccgaacattttggaaaaacgatcgggacggatcccgggtcgggatcccgaccgaatcccgatcaatcccgaagattttttttcgggatcccgcgggattatcgggatttgctcaaacccaattttttttacattttgtgccaagttttgttcaaatgtttatctaatatttataattgatcaattcgattgaagaaaaaaagggatgtgaattatatcagatttttatagaaatttttcaaaattgaatatcatgcccaaaaaatcagattttcaaaaatgagaacatttaacaacatgccttaaataattttattacaatttaatcaattaatatcaatttttgtattttcgcctcagataatcatttttaataattttgagaaacggaatcaaaaaatcagatttttaagattttttttgctgcaaattttttcaaaaactttagaggaaccgggggggggaggtcggcggtgccgataggcgccgccgggaaaattttgaaaatttgaaatgtaattgttaacagaatttataaaaaaaactgtccatatttagtgattttgaactaatttataagaaaataatgggttcttgggtctggtgatgtccgattgcaccgaaggaaaaatgcgtagacaacaatttttatctgattattggacagaattcttagaaatcgttgtgccataaaactacctaataagatttagaataatgttttagaaattaaaaaaaaataattctttttatgaagaa

SEQ ID NO: 79267 - DNA, 1900 bp, Heterodera glycines
  Genomic contig location: Contig_ID=SeqID_2350; Location=1427..3326; Strand=-
  SCN-specific regions: Sequence locations=1-251,273-563,585-734,756 -935,958-994,1023-1313,1359-1368,1401-1579,1631-1900
  Gene Ontology: Mol. function=ATP binding; Cellular component=nucleus; Biological process=negative regulation of cell proliferation
atggaacgcactttcgtctgcattaagcccgaatctgttcgacgatgccttgtcggcaaaatcattgagcgatttgaggcccacggatttcggctaattgccattaaaatggtttgctaattttgtttaattggttggactctcttcatttgcgatgctttcagattgtttcaacacgcaaacaagctgcggaccattacattggatgctccgaccagcccttcttcccaaaagtgatcagttacatgacatcgggacctgtggttgccatgatttgggaaggtagacaaatttgttcaattttgattatactgacaatcaaaggattaaaaattgagaaatataagcatttttaacataaatttcagagatttaacaaatacaaaagattttttttgtttcgtttttattttgagccttaaaaacaaaaaattttgtgccgttctgatcactcgccaaaaaagacaattaattgagcttctcttttatgttttaggaacttttttttttgtattttcaataaattgcaaatgatttcaaacttaattttatttttaaacgaaacttcttcaaattaaaatggaaatgcgaaattttttaaggtgtcggcgttgtaaaaggaattcgcaaaattttgggtgccacgccggacaaagttcccccgcccggcactctccgtgccgaattccggaacaacagcgatgtcggcaagtaccatgacacggtctgccacggttcggactctgcggaggatgcagtgcgcgaatttgctatttggttcgacaaaagtgagatgccgccgcctctctcgagagtattgggctaattgaacagaagagcaattagaatggaggaaaaagaccattaaaagtgccatttaatttaattcgttgtacaaataaagcaaatttaaattctccaattttacttataagttaccataaaaatatattaagttcatccctaatccatccccgaatcgtaatgaatggggttttttatttaaaataaaaaaatattttgacatatttgaattgaatcatggcaaccaaaagcagatgaaaaaagtttgccttaattttcattccccgtaaactttttcgtgaatggataatccgacagaagtagacaatttgacagcgaactacttaaaatatttaaaattattcctaggcattaaacaaaaatttaattgcaagaattatgagtgaaaaaataatgaaaactactttaattgttatgaaaatgaataaattaatcttcaaagagttaatgagaaattatttgaaaaaaaacaatggatttttacttatattttagggatatatttttattagaatttcaatgcaaaataaataatttatggaagtaattttccatgcaatttaatttcattttttctctcttgagaatttcgcaaaaaaataaaacatatgcaaagtctcccagcactttttgtttataattttgactgtttgtaaattccctatttttaaatttttttcggatttcctaatcgaaattctaaaattgtcataaataataacattctagcgcatcgctgaaaaatgagaaattcttaatttttattagtcatttaaattgatatttttaaaaattttaaatttttcagaggcatcggtggagagtagagaccagacgggatcgggatcccgcgggatttcttcgggatcccgcgggattaaattcgggatcccgacctcgggatccgtcccgagcgattttttaaattcatcgggattgatcgggatcgggatttcatcgggatcccgaatcggaatccctcccgacctcccgtgggatcccgcgggactgaagtcacgataatttttcaaaaaatctacattttttaaattaagatcttgaattttaaattaaa

SEQ ID NO: 79268 - DNA, 1207 bp, Heterodera glycines
  Genomic contig location: Contig_ID=SeqID_2352; Location=242..1448; Strand=+
  SCN-specific regions: Sequence locations=1-200,227-452,495-674,717 -739,761-927,949-1009,1031-1207
atgttccgcacgtttgccctacttttagctgtggtcaaagtgtacggagggtaattaatttaattttgaattaatttgagtagagctaaatccttggtcaacctttcagagtctgttctgaatgggataaatgtgaaccgattaatgcaaatgggaaaacgtcaattcaattggatggaaacagtaaaaagtgagtgggcaaaaaaaaattaaattatataattttcatttttcggcacctgatctgttacccgagcaagttggcaaaaaatttcggaaattggaaagccagtggacggttgaaagttgcaaaagtggactaccaggaattaagcaagaaatgtgccgaaagtgacgggccaaaacaggacggcggatggcacggcttaatgctaacgaaacaaagtgacgggcatttggcttttcaatcatccctcaggtgagtagtttccattttttaattatttaatttaattttgttaattttaattatagtgccaatttttccggcatattagatgagcaattctttagcaatgccgagctcaatttcacccaaggtcaatttcaaaccaagttttttttcatctcatgttgggctacagtaaaaatgcatctgacactgtagcttacaattagcaaaaaaaaaatgtcaacgaatttattcactaaaaaatccatagttgttttttaaaggtttggtttggtttttggctacagaaagtgttggtgatacagtagatttggcttattttattttaggaaatttctggttaataaaatgatggaccttttgtaaattaatttacaatatctgtttttaatagagaatttatgacgcattcaccgtttccctgttccagctttgctcaagcaaaatgggcttctttcgccagatgagtttcgagaggcacttcctcttggcgcctttttgtacgattttgatgggatggcattacgtgttgtggcattggaaattaccaacggcatcggaaaaataaacgggacaaaaatttgcaaaataaagtccagcacgtcaagcacttccagcattgattgttctctggacggcatcgacatggcatctcttcccgattttaagcggccctgtgaagagcggtggcccgagttggccccaatttattgctacggcaaaattcttgaagtctgatttaagcagctttgagaaattcaaatgaattgcata

SEQ ID NO: 79269 - DNA, 1412 bp, Heterodera glycines
  Genomic contig location: Contig_ID=SeqID_2353; Location=62..1473; Strand=+
  SCN-specific regions: Sequence locations=1-10,32-176,251-696,718 -719,742-1034,1058-1255,1277-1412
cccgttggatcaaggaggacacagaggacaaaaaggacccatggaaattgctcaatttgaggaccactcaaattgtgccggttgacttgaacgcactgatctgtgggaattacaggaagctgtcggaactgttttccaaaattggtcattttaatgtggatcaaatgcgcaaaatctaaaatatttttatatcgttttttaattcttaaatatttttttattgtttaaaaattgattttaatcataaaaacaagcccccggcacatttacggtttcgcatccgaaatttaaaatttttctatcttaagacaacagtgaaaagtcggcatcgtacaacaaaacacattcggaatttcgtaagaattttgtcgccgtgttcaaaagtgatggtggcacgttcaacgattacgaattggacacaaagaaagtgcgcaaaaggacctattatgggagcaccgtggtgccacttttcacggggtgcctaggggacgacaaagatgcggaaaaggcggcaaaacgaatgtttaaaggactgatggagattgacaagaagcatggcattttcaataattacccattcggcgttccgaccaggtccaatttttggggtttgcgagtgcatgaggaggaaaatggggaaattgaaattaattgaggattcggaaaagaattactaagcgttaaatttattttacgcttgagactaatcaatggcatgaaaaaccaattggttaaatatacgcagggttcgcaaatgatgtgaatttatcagcgagtcaaagctgattttttaaaatgctgttttcttgaattttgctgcttttttaaatttgattgtttttgtggtttttagggggaaattaagaaaaaaaattcaaaaaagttttgcttgctttttgtaatagaaaaattttgaatgcttattttttgtcacccaaatactgatttttgaaaaatttcaacggcgcataaagaatgaaaaaaatgtgcccgtttttttctaaaatatccttcctgattttggattggatgtcatttataaaagtgcaaaaaataatatggttttcagctctgtgctcaactccgcacagcagtgggatttcccaaatatttggccggttaatttttcgcctatttggtccgcccaattagtccccttttaagccggtgagtcacatgatggtcgaagcatttcgccggtccggcagcaaacagtaacagaccaaaactgtacttacagtgcaccgagactgttcaaattcatttacagaatgcagaaattcgcatttgataaggcccagcaatggctgtctgccaactataagctgtacaaaagctgccaaaattttatgtggatgaaaatggctgcccaaacgggcacccccggggcaaagggagatttccatgcgcaa

SEQ ID NO: 79270 - DNA, 337 bp, Heterodera glycines
  Genomic contig location: Contig_ID=SeqID_15093; Location=129..465; Strand=+
  SCN-specific regions: Sequence locations=1-247,280-337
atgaaagatgtctgcccgaactcatcaccagcatttgatggtgccaccaatgttccgttgttggccaatacgcttaatccggccaccgccgacggcaccggcgcgtccagcacaatgggatgctcaatgtgccagtcgtaggtgcgcggagtgtacacgcggaaaatcggccaaacggtcagccattcgccgttgtccgtgttgcattggtggtaaacgcgcaggtaaaattcgggcctatcaaaagtataaaatttttttattttttagtaaaaaattcacgtccagacctttgcctgggtttttgcgtaccgcttatttgttagttaaatattga

SEQ ID NO: 79271 - DNA, 1004 bp, Heterodera glycines
  Genomic contig location: Contig_ID=SeqID_15094; Location=1212..2215; Strand=-
  SCN-specific regions: Sequence locations=1-333,367-371,393-575,597 -1004
atgagcgcaatcatcgaccattgttcagtcccatgcgtttatgggctattgccaaataaggagggggcaacatatgtacgtttctttgaggcaatcagagacagcattggcaacaattggtcgccgcaaaggctaatgagtgactttgaatcggcagccattcattctgctcgaattgtttttccaaatgcaatccgaaatggctgcctttttcactttgggcaggcaatttaccgccgcatccaaaggctccaaaacctacacacccaataccttcaggaaattgagttccaacgaagcattaggtcagggctaggacaatattataaatagtcaaaaacactgttataaaaatgggaaaaattcgcttgtaaaatttgtttgtttatgagtagccttatttcaccgtaggtcattgcaagcattggcatttgttcctattggcctcgtttataactacttttgcattgtggtgtcaaccctcaatccaacagctgagctacagggttatttttttgtcgaattaaattttataatttatgaatatggatcggatttttaagtttttacagcttgaaggctggcatgccatttggaatgcccatcttaaaggaaatcagcgactcagcggttttgtccggaaaatgattgaagaagatgagatgtggtctcagcgaattattgattatcagattgcgcctgctgatggaataagggggccacacgcagcaagaaaggggaaatatgtcagacaagacaacaatttaaatgctcttttacaggacattggaaaccgtgatccgcttgaatatcttcgggcctgtgcataccatttgcacttttgaattgaattaagcatttttaaaaaaaaggaattcactgacaaaatcgtccactgtcgaatttgtttgaaattaaataggcgtttaaatatttagttttttttgtggtgaaataattaaatcatatcattttatggtgcttaagcccattttttgaataaa

SEQ ID NO: 79272 - DNA, 357 bp, Heterodera glycines
  Genomic contig location: Contig_ID=SeqID_15095; Location=83..439; Strand=-
  SCN-specific regions: Sequence locations=1-357
atgcttttatggcatttcatattttccataattttctttgtttataaaattgaatccgccaaaattcgaccaaactttgatgaaatatttggcgacggattggacaaaaaagaaagtgagcaaacagtaaaaattgaacaaaaagagcaaaatgaaaatttggaatttattcattttcttcaaccaaacggtgatgaaatgggaaatgatcaaattgatcaaatggacaattcggatgatcaaaaaattctcaaatgtgatcagagttataaaaagaatgaaactgatcagcaaaagagcgaaattgttcaaaatttgatgcaattaaagaaaagttggggaaacgggaaaatttga

SEQ ID NO: 79273 - DNA, 1026 bp, Heterodera glycines
  Genomic contig location: Contig_ID=SeqID_15096; Location=1735..2760; Strand=-
  SCN-specific regions: Sequence locations=1-13,46-407,429-518,540 -611,634-1026
atgaatttgtggcatttattatttattatatttttctttatttttgcaattaaatccggcaaaatccaaccaaattttgaagaaatatttggccaaagatgggacaaaaacgaaagtgaagaaattgtgataataaaaattgaacaaaacgaccaaaaggagcaaaatgaaactacgggcattgatcaaattggtggagaaaatggaacggacccaaatgatcaacaaaaaagacaaataattttgaaatttgaagcaattaaagaaaaattaaaagaaaaaggaaaatacaaatggaaagaccaaaacaaaattgagagaaaaattgcaaaattattaggaattggtcgtcataaaatatacaaatggaaaaaagaattaaatataattaaaaagatgggaaagagtttttatgaggagaaaaagagagaattcactgaacgatttgatgaatttaaagaattatatggccaaggcaaacagaaagaatttgcgaaagaattgggcatttctgaagcaacatttttaaaatggaaaaaggaattgatgccaaatgatcataaaagtaagggtttttctttttaagcatataataattttctattcagaagagaacaaattaaaaaagttgaagcattattttgaaataaaagaagccaacccaaaagtgactgacgaaataattgccaaaaaattgggaattggaagtgcaactctgaccagatggaaaagagaatttgctaccagttgatcacagtgattaaaaaaattcaagaaactgagatacgatcatttactcatttaacacatttaattgttccccctaatctatcattaacaaatgtccctggggcgaaacggggcggtcccttcaattgttatcctccccccgtcgttcttctctgatcacttttgggatttggccgatccaactttgcgagagggaccccctcaagcgctcctctgttcccgaggacgttctgggctggggcctccagttgtacccctttattattacccaataaa

SEQ ID NO: 79274 - DNA, 1017 bp, Heterodera glycines
  Genomic contig location: Contig_ID=SeqID_15097; Location=1..1017; Strand=-
  SCN-specific regions: Sequence locations=1-352,374-613,636-690,721 -750,773-815,846-1017
gagaaactttttcgagaatgggagaagccgatcaattccctcttattttgggccgcgattgtagcggagaagtggtggagaaaggacgggcggtaaaggatttggatgtcggagatcaagtcagttcgaaagtttattttaaatttactagatttgttatatccccatttgcaggtcatcgctgtcgtccctccccattgccaaggatgtcactccgaattcgctctctcattcacaaacgctgtcgcccccaaaccggcgtcactcagccacacagagtctgccgctttgccgtacgtcgcatgtactgcttgggctgcactcgtcacggtgaccacggaacggcggagatgaattttaaaaagttaatcaccattcagacaggcagaatagacccaaataaggcgcaacatttacgtgtgcttatccatggcggtgccggtggcgttggcacaatggcaattcaaatgctgcgctgttggggagtcgaaaaagtggtcgccacatgttcagcgaaaaagttttgagtctataaataatgcaagagccatcgcaattttcaggatgcaattggtggaagaattgggggcaaaagcggtggactatcgcgcgaaggatgcaaagcaacaactggtcgcagagggaccatttgaactgattttaggtggataaacgtgtatccctcccggcaaaaaaaatatttaaaaacaaaataaatttgcaaattttcaattaaaacttattgtttgattttttcaaaaatcttgaacaaacttgaaaaatagcgaaaacttagcaaacaatattttttaggattttaaagagaaaaaatccctttttaatttaaagtaaaaaaaatgaaactccattgattgccatcgaaccatccctcacaaattttccataatttggtcctctttatcgtcacaatactgacaataaatttattctagactgtgcaagtactgaattggccgaatggagtgatgaactgcttgggatttggcgttgctgtgt

SEQ ID NO: 79275 - DNA, 392 bp, Heterodera glycines
  Genomic contig location: Contig_ID=SeqID_15097; Location=1654..2045; Strand=-
  SCN-specific regions: Sequence locations=1-392
  Gene Ontology: Mol. function=ubiquitin-protein ligase activity; Cellular component=ubiquitin ligase complex; Biological process =protein modification
aattcaatggtaatgcaacaaattgaacaaattaaatatctattgccatacatttaaaggttctggcgcgctcttaaagctttcgatgccgaggacaaggccaaatttcttcaatttgtcacagggacttcgaaggttccgctgcagggtttcgcgcatctcgagggaatgaacggtgtacagaaattcacgtaagcattagcacacaaattcattcctctctaacaaacacgcacttaagtatacaaaaggacacgcgttccaacagtcggctcccatccgcccacacgtgcttcaaccagctggacttgcccgaataccctgattacgaaactcttcacaaaatgctgcttttggccagtcgcgaatgttcggaggggtttgcttttgcg

SEQ ID NO: 79276 - DNA, 281 bp, Heterodera glycines
  Genomic contig location: Contig_ID=SeqID_15098; Location=338..618; Strand=-
  SCN-specific regions: Sequence locations=1-111,133-281
atgcgagcatgggcagtgaacgcattcaatgcaccgcttgttctcagcaatgttccaatgccaaccatccaaaatgacaaccaagtgatcatccgtgttaaggtggctgatttttatttggaattagaattaatagctaattctcaagtttgtatgcgtttttcatgtgtttgtctcgactttttcgttttaggctgcttcagtaaatccaattgacgtgcgaatgagcgaaggctatggaaatgaagtgctaagcaaaatcaaatgtttgactgaattcg

SEQ ID NO: 79277 - DNA, 1944 bp, Heterodera glycines
  Genomic contig location: Contig_ID=SeqID_15099; Location=434..2377; Strand=-
  SCN-specific regions: Sequence locations=1-82,104-109,131-277,299 -514,536-569,591-787,833-901,923-929,957-962,1147-1154,1176-1321,1343- 1404,1426-1504,1526-1637,1679-1944
atgttacggtaggtacagtaattaaccattgctcatttcccttaactatttgacagtaacttccttcgtctgcactttcacatcaatttgtgccatgacatttttctcaagcttttcttatttttcatgttgtcatcattctccttttcggcatcagcgttcgtctgtagcatcttttacggcattttagcaaaaaagaaaatcaaattcaaaatgtgctgatcaatttgcttcattttccttttttcacattttcccaccttttccatctgatcaatgcttttctgttgttctttctgctgatgatccatttcgaccaactttttctgtaattcctccaaattttggaaactttatttttatataatgagaaaagcggaaaaccaaaaattctaacgaaaatcacattttattcaacaatttttgaattttgttcgtcttaaattgttgccaatggccaatgggaggcgaaaaatcattgacaaaaacggaaggcgcggaaacattttgacataaaaaggccaaaccgttttttattagcctataaaatttcaaaaagtttcgttaagtttcaaaaaagttataacttgagaagctcaaaaacccaagttttttacaacattttagctcataactttcttgaaacttaacgaaactttttgaaattttgtaggctaatagaaaacatctagaactatcgaatgatataaggaattaaaaatttgattgattttaagtaaagatatgaaaaaattgctacaattgatggtaccatttgccgggcgttttaccttatccccccacccacaaatcaatcaatcaaataatcaattggacggataatttttatccaactttcatttgcaaaaggttagaaattttctttgtcaaccaaatccaacatttttggtagcaaaaatggaaaaacgagggaagaggaggaaaaggatgaaaatagcattggggaaggaggagagacggaagagaaagagagaaaaaggaaaaattcgaagcaagaaggaatggagaaagaggaagaaaaggatgaaaatagcattggggaaggagcagagacggaagagaaagagagaaaaaggaaaaattcgaagcaagaaggaggggagaaagaggaggaaaagagaatgaagctgaaaagagggaggaacagcagcaaatcgacactttttaattttgccggtgctaatattgctaatggatgtcgtaaatccccgtcaaaatcctgaaaactacacaattttcgaaagaaaaatgcattcattcgattacataggcaaaaaatttatgttgtggcgtgggttttgcaggagcacagcttgttccccaaatcccattaacgattttaaaaaaatcattaaatttctcagggaatttccggcaaatttcaaacaatttattacaaatagagctaaaatttttagaccctctaagaatcggtcggggccgttttcgcgtgagtagctgtttaggactgaaattggttggatttgtgcaaaacatccatgtttcgaatccgaacccgcattcggacaaatttcttaactttttaatttttttatttcttgcggctaatatcttctacagtaatttgtcagtttggtcggatgtgcgtcaaacggaaaaaatatttaaaattttataaaaatataacaaaaaataacaaatttcagaacaaactaaggtcgcatttcatggtttcgggaaacaccagtgagaaaattgataatgttttcgggattcacattggcattggcataattgggatcattttgggggaggtgaatgttattgatgtcgttatagagtgcgccgtcatgttctaacataactttgtttcgttttgttttaattttttgctgctggtccatattatataatttaaaaagccttaatttagtttataaactcattaaattataaaataaa

SEQ ID NO: 79278 - DNA, 498 bp, Heterodera glycines
  Genomic contig location: Contig_ID=SeqID_15101; Location=59..556; Strand=+
  SCN-specific regions: Sequence locations=1-462,486-498
atgacatttaatttcggaaagggtggctctttcaacgcacaaagtaacaatcacaatggaagccaatcaatccattacgattcaaaaatgccgtccaaattttcaggtggcggaggagtgctggtcggaggagacaaattcggcaccaactcaacattcggtgtggacaaaaaggggctggtggcggacacggacatgcatttgctggacaacaaaacattacatgtaaatgggggggggagagaaagagacaaacagtgccatcagtcaaatccatcatgttaatattgtaccttaaaaatatgattaagggcggattaggcaaggagaaaaacttcatcgacgatttggccgatttgatacggcaaagaaaagaggagaagcaacgacagaaggaacagagaatcgccgaaaggatttgaaaaaaacgatgaacgtggaaatgatccaaaaatgtaccaccaaagaacaaatggataaatttattactttacgaca

SEQ ID NO: 79279 - DNA, 1036 bp, Heterodera glycines
  Genomic contig location: Contig_ID=SeqID_15101; Location=686..1721; Strand=+
  SCN-specific regions: Sequence locations=1-269,300-326,350-389,414 -1036
atgccatccaaagaagtcattccggtgactgctttcaaattgcccaatcttcagtttctttggccataattttgactttttcgttgttatttctttcttaatgtcagtattttttcttttttttgtatttatgaattcccgggacttaaagctttcgtctgataccaagaatgtaggtattgcaaaaataagaaaaaagttatggtcaagaaactgaagattgggcgcctaaagtgcattagagcccaaatttgtttttggttaatagatcacttcataattatttttaggataaaaatcgctctcgattttcgtttttcaccacgagaaaactgttttaacagaaaattttattacggatttatagatttttcaaattcatttatccctttatatttaaatttttaaaaattgacgtcaatttttttcctttctatatttgtctacatttacatatctttataaattttaagccattttctgctccctttctgtgtaacaatggattcgccgtcaagtgtgaaagcgggcttaaaaaaatcagtttttttagcgattaaggtcatttattttagtggcattctagtgggcgcgcaacttcaaaataaaaaaaaagtcaacgacaagacttattgttaatttgatttaggggacggatcgtttgttgcgagcgaacaacgcaaatgtgcgaccgcaactgcaaggagtggacaacgccaaagactgtttgacaccgtcgacaacaggcaataatcaaccgacacgagaacagccaaaactgatggacattgacgaaaggattgggatggacgacgaagacaacgacgacggggacagattcggagaagcagcagaggtattgggtggaggagacaacgctaaccgagttggtggtgagagagtcgtgggtaacagactgcggaaacggcgctccgtttcctgtgagccgacagcgaacagtccggccaaaatggcaccgcatcagccagccgatgaccaatccgctggttgtctgctgcaggtcactgaacaatga

SEQ ID NO: 79280 - DNA, 453 bp, Heterodera glycines
  Genomic contig location: Contig_ID=SeqID_15104; Location=162..614; Strand=-
  SCN-specific regions: Sequence locations=1-4,36-453
atgattgttgttgttgatgttgttgttgctgttgtctgtgcctttctgctgcttgcgcattgccttcccgaattgttaaaggcggattattttgcgtttggagcgatggagacaacagctaaattaaaatattgggttctgcagaatgaggcacaaatggaaccgtattgtgagcggagtgccgcggcacaacagaagttgggctattcaacaaaagactctgaagagatggcggcgattccaatggcatcccgtgccaatttgaagatggcggcgattccaatggcattccgtgcctatttgaagatggcggcgattccaatggcattccgtgccaatttgatgattgtgcaccgtattggaagggatttgacactcgcggaatgtttagttggaggagcggcttttgcgcgatgcattaaaaggcgagtgaacgaattgggccgattatga

SEQ ID NO: 79281 - DNA, 497 bp, Heterodera glycines
  Genomic contig location: Contig_ID=SeqID_15104; Location=635..1131; Strand=+
  SCN-specific regions: Sequence locations=1-227,250-277,299-497
atgaagcggccaatggacgatgaagcgggcgaggggccgagtgccatcgaaattcaaaatgtgcaaatggcacggtcagaaaatgacagcagaacggcaccgaaactgtttatcagaacgggtaattgtgattgttttaaaataattttaggatttttagtcaatgtttcaagtttctacatacagtcatggtcatatgtttaacaacactcaaaattttctaccaaatttgatttaaattgattataaaatctcaatatgactatattgtgtatatatgttttatatttcttgtagcattttttgtgggctttataatgataccattcactatcccctgtcaaaatgttattattagttacaaaccattttaccaactgcactccctttttggggtggtcatatgtttaacaacactacccatatattttttcatcagcattaaaaaaatctaaaaaaattcaggtaagcataaaaaggtagcaacaccaagttga

SEQ ID NO: 79282 - DNA, 620 bp, Heterodera glycines
  Genomic contig location: Contig_ID=SeqID_15104; Location=2778..3397; Strand=+
  SCN-specific regions: Sequence locations=1-428,453-620
atgctccgttcactgctcttcgctgccgtgttcgcttcactgctcatcaattgctacgaggcgcggacgatacgcctggccaacagtttcttatgtgccaagagcggtttcacagtcgaggaaggcctcacgcagcacgaggcgaacaacatgtgagtgacaaggggaattacacattttcgaataatatgactttccccccatttcagtcaagtcaaaggcgaagagatatcaaacacacagacggagccagtgcccattctgctggtgacagcgaatgtggagttcgacgtggtgttccacactaacagcaaggagtgcaaggagcaattcaaaatcaaagaggacagcaaaggatgcaagaaaaaaggcactctcgttggccatgtgagtttttcaagaaatggcgaaaatttggctttggaatgttttgtttgtttcagaatgattttccgaagacgcctcactgtggtgaaagttgcacagggtacgaagtcgtctgcaccgttgtcaaactggcttcagtcgaggaacaggaaacaggcggcattgttggactcaagcgatcggaattcgccagaatgttcggcggcgccaagtgcgagtgggaagcggtcatt

SEQ ID NO: 79283 - DNA, 483 bp, Heterodera glycines
  Genomic contig location: Contig_ID=SeqID_15105; Location=11..493; Strand=-
  SCN-specific regions: Sequence locations=1-34,56-81,161-161,183 -186,209-209,232-263,285-287,328-376,399-483
  Gene Ontology: Mol. function=satellite DNA binding; Cellular component=chromosome, pericentric region; Biological process=N -linked glycosylation
atggaaacattgcaacggcagagaaaattggacatttatgacaaaacacaaatgaaaggggaggggggagaacaaaagtgggaggaagaagaagaggaggaggaggaagaagaggagagtgaatatgaaacagatgaagaagaggaggaggaagaaggaggaaattgcacgggggaaaaagagagtggaaaagaaatggaggaattggaagagagtgggaagaaagaaaaagcggacgaaggggacaaaggaaatggcgaaatggaagagaatggagatgaagaaacggaagaggaggaaaaggaagaggaggaagagggagaggagaaagcggcagaaaagaagcagcaagtccaacgagagaataaagtatcatttttggagttggaagaggaagaaaacagcagcaggggagaagaagctgaagaggaactgaggatgttcacactttttgagaagatcggagaattggtgctgagagat

SEQ ID NO: 79284 - DNA, 771 bp, Heterodera glycines
  Genomic contig location: Contig_ID=SeqID_15106; Location=48..818; Strand=-
  SCN-specific regions: Sequence locations=1-418,441-481,504-771
atgagttcttttccgaaagcggtaaacatcaagattgagcacaacaattctttttcggaccacgattactgttacaaagaatctgcagttgaagaaatggacgaagaaaatcgttccttttttgtcgacgtggagaacgatgacgaatatgacgatgagtataatgcccgtggtcggaaacggaggttttttttaatggaattggaaagtgataatgaaataaggcgagcaaatccgaattttgctgcaaatcggtgaattttattgtctttgtcattaaaaatattatcttttgagttttaaccaacaaaatgcttaggagcgtcaaacagccggatttttttatgatcaacaacaaagccaacaattcgaataagaaaacgtcaaaggcgaggccgaggaaaagcgaaagcaaaagaggaaagagtggggagaaaaaagtcaaatacgaagtggaatacatgtgagggtttttttaaatttggaaaaggaaaatttaaaatcgtcaataaaaattctgattgagataaatttgcaaaaagtcatgtttcttacgcgactttctcttttttcagatggggcaaacgcacggacaaattgcgtcctgataaggtggaatatcgcgtttattggaaggggtatccgattgagaagagcacttgggagcccgaagataatttggtcagcggtggtctgaagaaagtcaaattatgccaccttttttcagcgtttatgccaagaatccatcgaccgttacgaacaacgcgaaat

SEQ ID NO: 79285 - DNA, 574 bp, Heterodera glycines
  Genomic contig location: Contig_ID=SeqID_15110; Location=11..584; Strand=-
  SCN-specific regions: Sequence locations=1-29,51-574
atgtttttatgtcatttaattataataattttctttccttataaaattgaaactgcacaaaaccaaccaacttttgacgaaatttttggtaacggatgggacactcaatatgatagcgaagaaaaattgttggacaaaaacgagtcaaaaaatgaacaaaactatcaaaaagaaaactttgaattcaatcattatgctgatcacgtaattgaagaaaatgaaaccgacccatttgatcaaatgaacaattgggacaagcggaatattatgaaaagttatcagaaaaatgaatcaaattataagcaaaaaagagaaatcattcaaaaatttgatgcaattaaaaataaattgaagcaaaaggggaaatataaaaagaaatatcaatgcaaaattgagatgaaaattggaaagcatttaggagttagccgatatttaatattcaaatggaaaaaagaatttctgaatgatcagcaaaaaactgatttttccgatcaacaaaaaagagaaactgttcaaaaatttgatgcaattaaaaacaaattgaaagaaaaaggaaaatatgaatggaaaaaca

SEQ ID NO: 79286 - DNA, 1755 bp, Heterodera glycines
  Genomic contig location: Contig_ID=SeqID_15110; Location=1560..3314; Strand=+
  SCN-specific regions: Sequence locations=1-74,118-347,401-1219,1246 -1497,1521-1629,1651-1755
  Gene Ontology: Mol. function=glucosidase activity; Cellular component= basement membrane; Biological process=protein folding
atgcggacccaaactattttttcaattgcaattgttctgatgatatgcgaagtcaactcattcccggtaaaatgaattttttttttaatttgaattttttaacgatttataatttaaggcattttcatcactattctcttcagcatttggtggaagtaaaaaagtagaaaatattgggactacaaatgatgaatcgcacagccgacagaagagacaagctgaaactgttgttagtgatgcagacacaatcacactaacaatatctggggaaaatttgacagtcacccaagagacattggcggacggaacggttgtgctaagaataactgggcaaaatacaaacgttgaaacaagtaaaaaaataaaaaataaataaatcgaaataatttaaatacaataataaggtaatgctgatgattccgcaatcgaaacagccactgaagagtcagcaactgcggcggaagacgcagcaaatgatgagtccgcaaccgaagcagccaatgaagagtcagcaactgcggcggaagacgcagcaaatgatgagtccgcaaccgaagcagccactgaagagtcagcaactgcggcggaagacgcagcaaatgatgagtccgcaaccgaagcagccactgaagagtcagcaactgcggcggaagacgcagcaaatgatgagtccgcaaccgaagcagccactgaagagtcagcaactgcagcggaagacgcagcaaatgatgagtccgcaaccgaagcagcaactgaagagtcagcaactgcagcggaagacgcagcaaatgatgagtccgcaaccgaagcagccattgaagtatcttcaacatcagttgccgcgtcccccactactaaagccactgcacctttgaaacccccagcgaaaaagccaggaaataaatctagtagcagcagcagttgttcgtctagcgaaagtgatgaaaagaagcaaggcccaaaacgtcgtcctactcctcctcataaagccaataaaaagaagggcaatcagaagcacaaaaaaggacgcaaccaccaaaagaaaggtcatggccatcacaagaagggtcatgggcggccccatcgccatcagcacaagttcgctaggcctgattttggatggtttcacgcatttcctcaatatttcagaggacttcgcttttggtaaaaagaaatgaacagaacaagatgaaattggcttggaaatcgaatttgaaccatatttaaaattatttttatattattgtaaattgtattgatgagaatattgaaacacattgttggaaaaatttttcttgaatgtgtttgaaagttataaatcatctgagaaaacaaactaaaaaaatatagcttgtggaaaagctgcgttttaaaattggaatttcctattatttctttgatgcgacacgcttaactccaaaaacatttaaaatagttcaaaaacacggcaaaaaattccaactttttttaaaacacggcaaaaaaaaatgtcaacttttaaagtttttccaagaaaaattctgaaaatatgttgaaatttcttgtccaaaaatgaccacatatcgaagaattaaagtcaattttaaaaaattgcacaatttctgtgtgaatagttgccgccgagggaaaaatttaaattttttattggaatttttttaggaattagctaaagtgttagaacatagaagttaaaaaatgggcaaattccttcacttataactaactatgttattaatttataatttatgaaattta

SEQ ID NO: 79287 - DNA, 2736 bp, Heterodera glycines
  Genomic contig location: Contig_ID=SeqID_2354; Location=1825..4560; Strand=-
  SCN-specific regions: Sequence locations=1-113,137-318,342-353,377 -971,1060-1062,1084-1221,1307-1325,1347-1400,1627-1936,1965-2736
  Gene Ontology: Mol. function=integrin binding; Cellular component =cytosol; Biological process=odontogenesis
atggaaaaagttatagttcaaaaactaggctggcgcgaaaacgaccggcgcgaaaacgaccccgacccgatttgtgagggtatgtgttagtcaaaaaaccaaccatcaaaaggaaaaatttttttttaattttaaacaaagttatggccaaagaaactcaaaaaatcaatgatatcaaaattgttagatttggttgcttttgatcaaatttctaagcataattttttattttgatcggttttttgactaacttcataacatcgttttttcgggttaaaattctctccatttttttcaaggactgtccttattccctatttttctgtacaatttacccattttcaagtgctatctttttatatttatatattttaaaccattttttggcatttgtttttcatttctctgattttctattttttcaattaactctttgctggccggtaggggtcaactccgtctcagcaatgttcaaaaagctataacttttttctttgttggccaaactccacaatcatggtatcattcgaaagccctagatgtttagaagatatttataagctattctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgattgatatcaagattgtttgattcggtcaataacttcaagagttatattgactcaaagttggctcagacggagttggcccgttccgttgctggcactgtttttaaatcggtttttaaattttggcaaaatttgccacataatttgctaatttaacatttgtgtagaaaacaaattggaaattttctcgagtcccacacttgagtccgtctcgaattttaccgcattttcaaggaatgcccttgatgatttcctgtaaatttgtttatatgtccatttgtttttaagtgttcatctttcggtatttatttatttattttttgtgttcttttctctgcttttctattctgaattaaattttgaatttaaatggcttgcttaagaattgaatttttatatttttttcaagtactcttaatttttcaagatcaatcctataaatccagtttagaatttccaacagtattaccattgtctgaagatggatttttcagacaaaccacaatgacaaaaaaaaatttacaaaataataattttatccttaaatatttaaatagctgatcaaataaaataaaacaaaattttaaaatatttcttcacggttacttcatattaattttaataattagtttttaccgtaccgcaagcagatttctgtctaattgagattgtcaagaactttctaatgaaaaaaaatttgatttaataattaaaaaataaattttttaaattgttttctggcaaaagaaataaaaatttatagtttcttaaaattttcaaacaaattacaataaaaattttaatttcttaaatgtgaaatatctgatgaaaatatgcaattaattaaataaaaattaaaaataattattctttgttatttcttattaaattattttaaaaattttatttatttactttttgctttttctacaaatgcacgcaaaagaacttaaattgaatcatcacaaacaaaaaaaaatttccgattttccgcttcaataacataaaccatttagagtaagtggtctttcagcatatgcatttcctaatttggctgctcgtactttttaacatttaaacgaaaattggatgtgacatatgaattgatcatcgccctcaggcgaagaccgaatgtttcgcacaaatcgccccgagggtcactaattaaatgggcggaaattagtgaaacaaattcaattttttgttgcaaaattaaatgtgcaaaatctgatgatgatgatgatgattattagtagattttttttctgaagctttattttgatggtaaatgcacgaaaaacttttggtttaagcgaaagatccgacacaagcagaaaatccgacacaagcggaaaatccgacaaaagcagaaaatccgacacaagcggaaaatccgacaaaagcagaaaatccggcactggaaaatccgacacaagcagaaaatccggcactggaaaatccgacacaagcagaaaatccggcactggaaaatccgacacaagcagaaaatccggcactggaaaatccgacacaagcagaaaatccgacacaagcggaaaatccggcactggaaaatccgacacaagcagaaaatccggcactggaaaatccgacacaagcagaaaatccggcactggaaaatccgacacaagcggaaaatccggcactggaaaatccgacacaagcagaaaatccggcacaagcagaaaatccggcactggaaaatccgacacaagcagaaaatccgacacaagcagaaaatccggcactggaaaatccgacacaagcagaaaaattcgaataatctctgtgatccttgggaaacgagaatgtaaatagtgcctaacaatttttaacatatggatgagggatatcctccattttgcatgctattccgtcctctgttctcgaatcatttggttccaccaaaccccctgagtttgtcacaatgtcttccgaagagggcgaaattcatgagaattcaactggacctaatcctccccaggcaaccgaagttgattaaa

SEQ ID NO: 79288 - DNA, 370 bp, Heterodera glycines
  Genomic contig location: Contig_ID=SeqID_2354; Location=4781..5150; Strand=+
  SCN-specific regions: Sequence locations=1-255,285-339,368-370
atgccaagaaagttggatttggttggcaatgaaaaaacttatagttcaaaaactaggctggcgcgaaaacgacccggtacgaaaacgtcctggcccgccactgggccagagacgctcacattggcttcacattctttataaatgatattgatatagtaaaaaggaaaagcttcatatctcggccagaagcttcattcttgggtaccactcccttgttagtgaagaaaatttaaattatatttacgaaaaaacgccaaatatttacaaaaatattaataaaaattgcagtgcaaaaaataattgactcggcttttctcgagttgagtgagactcgagtcctataattttttaaaattatatttaaaaacca

SEQ ID NO: 79289 - DNA, 81 bp, Heterodera glycines
  Genomic contig location: Contig_ID=SeqID_2354; Location=5980..6060; Strand=+
  SCN-specific regions: Sequence locations=1-81
atgtgttattatgctatatctttttattttatcaacgttatagttcatttttttattgcaatttcaagtgcaacgtcaccg

SEQ ID NO: 79290 - DNA, 1108 bp, Heterodera glycines
  Genomic contig location: Contig_ID=SeqID_2356; Location=134..1241; Strand=+
  SCN-specific regions: Sequence locations=1-91,121-189,315-687,710 -790,813-853,888-1087
atgaaccaaaaattgttgaatgaggaaagattgaattattttgacaacaaacggctaattaacgtgaattattatgacaaaaatcggtcaattaatgaaattattttgaatttggcaattgacgcagggaatgaacgccaaaagaatgaaagtgatttcgaagaaataatttgcagacaatgttttgacaagaacatggaggagatgttaagaaaagcggaagaaagggcaaaagaggaagaagacaaattgttggaagataatcccgaagaatttgaggatgaagaaatagaagaagaagaaggagaaagaaagtttgacgtgcataaaattgtcacgaactcaaaattcgatgacgcaattaattgggtgagtttttttaatacatactagggtaggccgggtcggggtatttaggcaaaaaccgggtccgggtattaccgggtattgaaaagtcgggtaccgggtcgggtattagtttttaaaccgggtgccaggtcgggtattagtttttaaaccgggtatcggctcgggtattagtttttaaaccgggtatcggctcgggtattagtttttaaaccgggtatcggctcgggtattagtttttaaaccgggtatcggctcgggtattagtttttaaaccgggtaccgggtcgggtatggtgtaccaggtgaaatcgggtattgaaaaaatttttaatttttatttccttctaaattattactatacagaaattttttttactgtaataaatgctaaagaaaatagttcaatcaaaaattttcatattattctccaaaatcttcaaaaagcttttcatcgacaatcacttttttctcttaaaatatgtgcataaaataataattattcattttttattttatttcttaaagaagtcaattttagacggatgaagccatttttactgaatttgtgaaaggaaaggcaacaaaacttgagaaattcttctttttgatgaaagcattcccgaaaattattgattacctgaatacgagcgcttttagtttctttaaatttgggtattgtttggctggtcccttaatttggcaattttctcaaaatttggttgattgcttaattttttga

SEQ ID NO: 79291 - DNA, 1279 bp, Heterodera glycines
  Genomic contig location: Contig_ID=SeqID_2356; Location=1343..2621; Strand=+
  SCN-specific regions: Sequence locations=1-117,139-214,236-601,682 -1024,1056-1203,1231-1279
atggaggctgagcttggccttgtgcatttgatgaaggtgaattgggactgtaacaatgtgagaaaggaacaggaaagtgaatgcttaaaatatcgcaaatatttacattatttgaacaattatttattcagaaaatatgtcgaaggtacgattttattcatttctttatgaaaagtaatgcgaattttagtaaaaaatcgcaattagagcttaaacaggaaaaaattcaaaaataggcacaatataagaggaaaattgcaattcagaggatcgatccatttctaaaaaaattttcattaattgaaggatgaattaaagggattgaatgttgtcacattaaaacgatcctttatgactttaaccgttattttaagtgttgattgaatatttataaaaatattgataactcactcaattaagcaaaaaacccggagatggcagcacaattaacaacagtgaagccagtgtttttatatggcgaaaaaattatgagtttatttatcattgtcaaagaattgaattttgttacgaaatgtttttgggaaaaatgcgaaaacaaattggagaatgtggatctaaaaaacgagaagatggaattgctaaatgagaaggaaataaaagaggagaaaaatggaggaaacacaccgaagagaaaagtcaaaaagcaaaaaacaaaaaaaattattgtgccaacaaaaattgaaaaacttcaaaaagaatttgagcaaaaaatggaaaaaatgtgcgaaaatgtaaaagaaaaggcaaaggaagaaaaggcgaaattggaaaaagcgatggtaaaaaatgaaaattacaagaaagaagaagcagaaaacatggaaaaagaatacgagcacaaatttggcactttcaattcgtcgccctttttataacaatgccttcgttcgtttgcctaaaaacggcgaattttccccaattctttcggcttttccttgggaatttctcttgttttttatcttttatttattttttgctttttgttccttaagatttatttgcattttttatgtaagaaaatttatataaaatttctcttggcataaagcctttttaagaattgttgacatgagacggtttttatctttaatctatcacaagctcactcccctatatttttattcgagaccatctcgcccagtctatagaaaaaaaaactatttccatgctattatttattgtcatggcatttttcttcattttctcaaaaattaattctatttttttacattgaaagaaagacaccataataagcaaa

SEQ ID NO: 79292 - DNA, 1089 bp, Heterodera glycines
  Genomic contig location: Contig_ID=SeqID_15111; Location=38..1126; Strand=-
  SCN-specific regions: Sequence locations=1-1089
atggctatcatgctatcattccatccacagattgacaagctgaacgcgttaaccatccaacaatcggctaaactttccccaattttgccgcctccgtccgccgatgaattccacgcggttgccgtcgcattgaccgaatcggccaatcgtttgcccacccttttgcacaattcgaccgaagagaacgcccgggggatcaacgaattcaccaccaattttgcccgatttcatacgacagtcagcaaaatgacagcgcaagcgaatgacacgacgggccaagaaatggcagaaagactcggagatgccaaggaatcggcactaattatgttggaaaggtggagggggggggcaaatcaaactcaatttgttgaacaaatttcggcattttagtctccgcaccgcccaaaccgacccaaataacgcgtcacttgctcaggtgttccattggaaatgaatataaatactcatccccaattcaagtcactttcgtcctccgttcgccaattcgttgtgacaatttcggcacttgtcgaattggcacaatcgcaagggacgagcgcgtggctgcgcgagtgcgaagaagccatccaacaaattcattcggtccggcatttgttcgacggcgcaacgacgagtccattgaatgtgccgttgaacgggaacagttactacgagtcattggccgaagtgacaaacgaagctcgcaatttgggcgacggttggttttggcaaagggaaaggcaaaatgcaagtgaattgaattggaagggatgaacggattggcacattacgcacgtcgcaatgacaacgaacagttgtgcttagcagtgcgacaagtggcaaatgccgtctgcggattggccaaaaacgcggcgcaatccgtaagaaaatggcataacggaagaggcaaattcgaaactgattctctctcattctcaaggcgtatttgatcggagttggcgacccacaaagtgagcccggacgagcggccatttacgacgttggacgatgcgaacagtctcttgaggcagtcaaacaattaaccgaacaaatctgcacaggacggagcgaaaagcggcaaataataaa

SEQ ID NO: 79293 - DNA, 2509 bp, Heterodera glycines
  Genomic contig location: Contig_ID=SeqID_15111; Location=1384..3892; Strand=-
  SCN-specific regions: Sequence locations=1-676,712-940,969-1578,1601 -2509
  Gene Ontology: Mol. function=structural molecule activity; Cellular component=focal adhesion; Biological process=cell adhesion
aaatcgtcgaatcatccaaccgaatcatcacaaaccaaggccatcagccgggggccattgtgcgcgactccgagtcagcaattcggtactgatcaatcctctgatcactccgtccgtcgtttgttcagttcgtcccaattactcgtggagggcatggagcaagaggctcagctcagtccggcggaacagcgcaacaaattgttgaacgctgctcgtaagcgaggaaagcgcaatgctttacgcggtgcatcgttttaaggttcggttgcccaagcgacgagttcgatgatcgacgcgacgcgcgagtgccaaagtcgacccggcgaagttggacctcaagtggcactgcgaaacgcggccgaacaccttgtgcaggtgggaggcagctgcaaaacatgacattgcaatgggaaaatgattgaaagcataatatatgggagggtgagaaaaagccgatcagtgatcagaggaacgaacaaaggcaaatttagccagaacgccatcggagggaaacagcggcgggctgaggagagagtgtcagttgagattgagccgaattgaatggggttgggggaggacgatctgatcaccatcattgatcagagcgatcagcgaatctccgcctcactcttttcccacaaaacttttcccgccgctttgtgtctgcgccgtcttctctttctctctctctttctttgtttgtctctttctcttcctcctcttttcccacactcttttcattgaccgatcgccctctctttcatcccctgcacatatccttcaaagtgtcctttgccacttttgccatgcccatttatcactaattatcccttttatagccattttttctttttatcttccgacaatagcctcttttcgccctgctactgattagcattttcatttttgtaaattatgctttctcctttttatcataggcttttcctctctctctgtgcttttctgttactgcaatgttttgccttgttattttatgatatattagtacatataaatattccaatttggcatttcatttttgctgcttttctcctttaattagtttcttaattacttttgtgtccctccctctccccccccccctttttcaatttttcgtcgcctcccatcgctgattagttggttcacttcattttccatgccattccttgcccatcatccgcaagacgttcttcgccgtctcggcaacacttttcctcctccttttggtaagcttccgtcgttccttcgtcttctgcttttttgttcgcttttctcgttttgctgtgtttgtcccccccccccctcaaatttccaattcctttgtccaaattcgggctcaattcgactcatttttattctcttcagctgccgctgtgttcctccaccattgtaaggctaaaaaaaaagtcccgattttttttgtttgttttgaatttgattgttttggcgttccgtttgggtgtgtgagtgatcactgatcagaaataactcaactcccattttggcattttttgttgtgaaattgcatttttcacaggtgaccaatcaggcgactggcgaacgacaaattcaacaaaccatccaacagcttgaaaaagtgtccaaagagaccgccgcttcgatcactcaaaccgtcgctgccgccaattcggtcagtgcctatacagtacgtctgccgatgccttcatcccccatttgttactgtataggctcgccctcacattctcgcccagcaaccgctcgattcgcttgttcgcgagtgtgccgatgttagccgttatgtgcctccgctgatcaaacgcatcaaacagcaccagggggcgagcgaagcgggcgcacagttccgagctgtcagttatatcaattcacaaaaatgcagcatttgtgtgccttgcagaaggtcggccttattcacgactctcaggcggtggttggccccgcgacgcgactcgtcgacgaaagtcgctcttccgtttcgcatgtgcgcgacaaacactccgccggccttttgctccaaaactgtcagcagctttcggtagtccaatttcgattgcgtttgccctaattaattaactatttggttaattgattaaagataaatgtcgctgagcttcgtacagtgcttaataatgtgcagcaattggactttggctcccaattggaccattcggaggagctcatccgttcattggatgcccagcttcagcaattgtcgcaacgaattcgactcggtcagccgcttctcccgccctcctccccgccgatggacagtccgcagcaaactacgcgaacatttcgccagcagtgccgtcttttgaactcgacgatcgcccaaatggtctccgccacacattccagcgaaagtcgccaaatgggcacagcgatgctcgaaatggcacaagcactcagtgattttgccgattcggttgaagacgtcgcagcgacagaagcaaatgccaatggaagcggcgaactcgcagagggcgacgagagggtggacaagtga

SEQ ID NO: 79294 - DNA, 972 bp, Heterodera glycines
  Genomic contig location: Contig_ID=SeqID_15112; Location=21..992; Strand=+
  SCN-specific regions: Sequence locations=1-572,596-622,680-833,876-972
atgggggcgaacattgtaactgcggacgaattcgggaacaccgcgctgacgatcgctttagcaacgggacgagtgagttttctctttctcctccgtgggtcggaaacactgatcagggttgtgattttgccctataaaccgggcatttaccggattttcgagatctgtgcaaattttagcaagtgccacggttttggaatgctttgccgcagtactgaactcatgtgtccagttttttgagttttggccataacatccatggttttggtcccgattttttattttcgagaaagattcttcttaaatgatccccaaaatttcatccccgaaggcttaatgaagctaaaacagaaggaaacgacttttttagaaatgctccaaacagtcttttcgattatcgccattttatgttcgcttttgtgcagaatttttggaattttcggtagtttttgggttcgacattgccgatagccgatgtaggaaaatttttttgattttgcttaatttctctaattagaattttggaaatatgtgctaagacccaataaaaatatagaaatcgaaccccatttatgaaatttattatctcaaaaaatactctttttgaaatataaccgaacggaaaattattttttaattttttttccataaaatattttaatttagtaaataaaaatttctaagtgcaattaattttattttgcccattatatataaatttagaaagtgctgatgtcataaacattgctctggtcaaaactgaactttgacgcagttgttaagaaaagttgacgcaaaaatccgattcagttttcgccattttcctaatcttgttaaatttaaaaaacttatttaagtttgaattaaaattaaatgtttctggccattatggcgccgtgctccatatctttttttgaaactaatattttaaaattttacagactaattgagaagatagaattaaataatgta

SEQ ID NO: 79295 - DNA, 91 bp, Heterodera glycines; identical to SEQ ID NO: 53030
  Genomic contig location: Contig_ID=SeqID_15112; Location=1100..1190; Strand=-
  SCN-specific regions: Sequence locations=1-91

SEQ ID NO: 79296 - DNA, 452 bp, Heterodera glycines
  Genomic contig location: Contig_ID=SeqID_15113; Location=1886..2337; Strand=-
  SCN-specific regions: Sequence locations=1-32,62-452
atggcttttgattttctaccgttactgctcttattactgttttatttccaaattgatcaaacacattcggatggcataattaaatgccgtggcatttcaattgatcaaatgcaatcatttaattaccaatcggatcaatggacgaagccaaaggaagtcaaattttctgagagaccgcactttagtgtaatttttgttaaaatttaatgccttagcttaggtctgagctgaagtctttcttcattctctgcctcggttcaatcccccaaaatctttattcattttcgaaaaaatgattacaatatgcttacgaaaatttgaccgcttttggcatggtttttcaatagtgaagaacaaaattatgattatttaaaaatttttacacatatctgaaaattggggataaatattggcggatttaccgacaaacaaatgagtcaattttgaataaa

SEQ ID NO: 79297 - DNA, 1424 bp, Heterodera glycines
  Genomic contig location: Contig_ID=SeqID_15114; Location=129..1552; Strand=-
  SCN-specific regions: Sequence locations=1-2,32-126,164-200,239 -576,608-1317,1339-1382
atgacaacatccaaggcatcaccaagaatgattttgcccgtaattaaggagtcaagggcacctccggcgggatcaacgaaatttggccaaacgatttcagaatggtaaatattaaatcaaaaacagaataattataattaattaacaaaaaatatattaatttggtaaatcttaacaaattcatgtagacacgacaggtcaaatctcaaagtattaataaaactaagtaattatattttgtatagggagatcgaaggcgctactggtttttggagattaggtccaattttaaatgatttcaaaaaaaatctttcaacgtattattaattttgttaaggccgagggggtcaggccagagaaaatttgagcaaaaatgtcgatcgaaaaagaaattaaacgaaattttacgcaaaaaaatctcataggcaatacgattggctttttttagattttcattaatcaaattatgatcgatcaatcccgatttgtgaggaaaattggtcgaatcgtaggaatagacggtagaaagaacggctaaaatttgtttttttaattccaaaaatttcatgctcgtccataaattctttatttttcttaaaaatttgctaggacttagaaattttattgaaaatctgttaacaaatagcttttcaacaaatgatcttgagctggaaatttgttcaggacaacaaaagtaacacaattgtcgaaaatttccaaatcgatgagaccgaagagcaaattgactgggaccctgacgcgaattcggcatttctcgacattggtgcaactgttgaacttgttggtgccgagtctgacattgatgatgggaatagaagttcaactttcaccgccacttcaacatcatccaagcgggcaaaaaacacggcaaaacaacaaagaaaacgcgcaaacaaacgcaccaagccgaagccggtagaaaagcgaaatataaaaaattgaatcgtgaaattctgtataataaataagaatcagagcctggagattgggacccccgcgggatttttacgagatttccggtcccgcacccgtttttttttggtgaacgggattgtaacggcagcgggatttttatgggatccccgatcgggactcccgtcccagaaaagttttaactcctgctcccgcctccggaaaattttttaccgggctctaataaaaattatcaatccgccttttaagttggcagtccaaattgatgaaggaaatccggacagcagaattgcaccggatgagcacggtcgctatttgatcagcaaagttcatgccgtttatgtacaccaaaataatagaaaagcatattttctttcatttcatggcatgttttttatctattgaatttcttgttaatcaaagttaggaattaaaaatatattttgagaattaatcaattataaaataaa

SEQ ID NO: 79298 - DNA, 695 bp, Heterodera glycines
  Genomic contig location: Contig_ID=SeqID_15115; Location=79..773; Strand=+
  SCN-specific regions: Sequence locations=1-31,54-449,471-494,516-695
atgaaaagtggtagcgtaggggaatttgaaattgaatatgaaaaagctgaaataacggatgcggaagggggaggagaggggactaggggtggggggaattgggggcccaattttgggggggaatttgggggcggaataagggtccttacactactaaggcacaacaaatcaaaaacggatgaacaaaaaattgaaattgttcaacaatttatagtaatgaaagatgaatataagccaaaaggaataaaatattcaagaaaagaatggcaccaaaattatgacgaaattggcaagaaaattggagttggttatgtaacaattgaaaaatggaagaaacaatttggaatgggtgaaagaataaatgagaaagaaaaaatggaaaaaatgaaaatgtaaaaataagtgatgaaaaaattgccaattgttgcaaattagtgggcagaatattcgaagatggaaaaaacaatttgtagaacaaaaaaggtaaccttagaaagaaatgggaatttttactgatttttatttgtttggagctgtttgacaaatttattcatataatttctctatttaaatttattgctttttaaaatgcataaatttgctgaaaaattagcccgaaaatggcgcatataaattatgaaacaatataaagaaggatttttttggaaattttcattaactctgacattttcgga

SEQ ID NO: 79299 - DNA, 801 bp, Heterodera glycines
  Genomic contig location: Contig_ID=SeqID_15116; Location=579..1379; Strand=+
  SCN-specific regions: Sequence locations=1-728,754-801
atgaaacaagacgaactcctcgcaaattttctcagcagccctctaccaccattgccaccaagaaaaaattcatcaacgaatacccgaaagagcacatcgatcaatgatcagctgaatgatccgagttggatatatgatatcaaaattaactatggacaatcatcgcgcaacaaaacgtaccaaaatagaactaagctgaccaaacatgaaacgaactttcacaaacaatttggtcaaaatatttttaacagtaaggacggatcaactgaatctgaaaaacgatctaatcagcagacaaaaaaaaatccaattagcatatatggacgagaaggacaagaagtttccggcaaccaaagtgatcagaatactaaaaagacatcctctgataagcaaaggaacgaaaagaataaaggcatttcatttgctaagaatgtagtcaaatatttatctgggcattcatctgacacccagaaagatcaaaagccaaaaaatcgcaagaacgaagctggatcaactggaaagaatactaatcagtcgaatgatgtcccttctataaataaccagcgtgatcaaatttctcaaaaagcaaccaatgatttatatggacaaccatctgaaaccccaagttatcaaaagaaagcaaatcgcatgaacggagccggaccatcggagaagaaaagcgatcagaatgacaaaagcgagctgaatgaagggacaccatcagaaaatcaaattgacaaaaccaaaacaaatcgcctgttaaaagcaaaagaaattttgccctttcaacagaaagagtag

SEQ ID NO: 79300 - DNA, 698 bp, Heterodera glycines
  Genomic contig location: Contig_ID=SeqID_15117; Location=565..1262; Strand=+
  SCN-specific regions: Sequence locations=1-48,71-99,126-158,181 -378,400-498,523-698
atgagtttcttcgataatccaattgttctgaatggtggaaaggcattatttgcctttttgatgcttttctccaacggattgttggtgttcgtctcgtttaaagcaaagtattttgttaattatataaaattcgcataatttagataatagttaattcaaaattttccctttaaggttcctcaacagcacctgcaattggctgatcacagccaactcggcatgcattgccatctattcattcacttattttatccagttttggcattgtgttgatcagtccctccggcattcccctctggctttgttttctgctcgtctccgtcccgctgttcgccgtctgttgccaatacattttgttcccagtgatcgctttggacagattgatcggagccctttttccatttaagtaagtaataatataatttacaaatcttcaaacgtctagcgggggtttttttaacccctcgtaggaaggcacaaatttttggtcaaactttaagaaatacggtaatttaaattaattatccagacaaatgggcaaacgttataagcgccgtttcatgctatttgcattaattgcctcaatttcgtttgccatttttatgctggccgcctcaatcaacaaatccatcattcatttctctgaaaagtaatttcccatttatttctgtagttaaaaaatctttgataatgaaaaa

SEQ ID NO: 79301 - DNA, 520 bp, Heterodera glycines
  Genomic contig location: Contig_ID=SeqID_15118; Location=846..1365; Strand=+
  SCN-specific regions: Sequence locations=1-316,338-384,410-520
atgtcgcagcctcaagaagtgcagccaatggaagcatttgatgaggtgaacacgcaacaatggcatgacttagataatttaaaatgtagagcagacgaacattgcggagcagataaagcagcagctgctgaccccgtgccaattcagctacgcggacagagtgatcgaacgcgtgccgtgcccccaggacgcggaggagtggtcgaagaatcaaaaaagcggtgttgaagttccaggtgactgggcatctgatgccgaactgcttgaccaatatgggcgttcaaaaaattgttttccttataactcatgaaataattaccgtatttcctcgattatacgcccccccccctcgaatggaagccccccctcgaatataagccccccttggaggggggttgaacaatagaagccccccctcgagtagaagcccccttcgaatataagcccccctcaaaaaaaaattttttttcaaaacttttgaagtcagaaacgtgcaaaaactattgaacaatttgtttta

SEQ ID NO: 79302 - DNA, 187 bp, Heterodera glycines
  Genomic contig location: Contig_ID=SeqID_15118; Location=1443..1629; Strand=-
  SCN-specific regions: Sequence locations=1-31,53-104
atgttgtatttggatgtcaaagaaaaaagctatcgtggaaaaagagctggcgccgaaacgcgagcgccgaaacgcgtgggtcccgtttgtacatttagtctttctaaaatattttatgaattttaaaaaaatactatttttttcagaaaatttttgtgttttaaaagtatttaaaataacaaataaa

SEQ ID NO: 79303 - DNA, 157 bp, Heterodera glycines
  Genomic contig location: Contig_ID=SeqID_15119; Location=847..1003; Strand=+
  SCN-specific regions: Sequence locations=1-157
gcacaggccgattttgcgttgaaattgctgcgcgaagtgtccacggacgaccgttcgtgcattgtttcgccgttttctgccgccgtcactttgtccatggtttacgcgggcgccaaggaaaagaccggcgaagaaatgggccaactgctggcaaatg

SEQ ID NO: 79304 - DNA, 599 bp, Heterodera glycines
  Genomic contig location: Contig_ID=SeqID_15120; Location=1253..1851; Strand=+
  SCN-specific regions: Sequence locations=1-599
atgaccagtttgatcgccgatctcggaggtctcagcggactttggattggcatctctgtggtcagcattttggaggtggtccaactgatttggttctgcatgcaatacatccacaagaagaagtcggtttcaaccaaagaaggaactgacaaattccagctttttttactcaattattttgtgattttaagaacgcccgaactgttggcaatggtgcgcagtgcgcggcaacgctcatctgctggccacacagacaaatcgccgtccggcagctcttcgtcgccacctcgtgcccggactgagtcggtcggcgcctactcactcaaatcgttgcattccgtgcgcagcgatttgcggcccggcattcgcattacacaggtgcgaaacggcgccaatcggcggcatgttcaaacaccaatccgaatcaccccaattaggagcggttaaaaccgtaaaatttgcaggaacgtcgcccatctcatagcactggttcatcaacgccttacttggcgcccgaagtggaattgccctgtacatgtttgtacggtgcgcgaggccaaattgtgtttatgaagccgctctgccctttccacgggtaa

SEQ ID NO: 79305 - DNA, 860 bp, Heterodera glycines
  Genomic contig location: Contig_ID=SeqID_15122; Location=168..1027; Strand=-
  SCN-specific regions: Sequence locations=1-132,156-223,261-307,332 -637,662-668,690-860
atgctttttttgctgctccttttttcctccgccccttttgcccttttgtttttgccgttggatatttttttcacgcaaattgtgcccgcaaaagggggaaacggcggtgggaaggggggctgttatgtgagttagaaaattaatttcattatttaaatgtgattattataagaaacgttgcccttttttgttgaataaatttaaggaatttgattttttatggattattaaatttttaaatattttttaacaaataataagtatttgttagttaaataaggagaaaaaatcagaattatttttgtgcatttttatttattttttataaattgattaatctctctaatttataagggatattgtgaaaagtttaatgcgttggaggatgacttggagaaaatgaagcaaataaaggcaaacgctgaatgttttgttgacgacatgggaaaagtcatcaaagggtttgagaagaatctggacatattgaggaccagcgtaacgaaattggaggaagaaaatgagagtttaaccggggactagcagggattaattaactaattgaagcgtttaactgggattaattaagcataaccttggctaattaaattaagattggataagcgccggttcgtttcgcttattatttttttttaatttataagtagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaa

SEQ ID NO: 79306 - DNA, 1340 bp, Heterodera glycines
  Genomic contig location: Contig_ID=SeqID_15123; Location=1380..2719; Strand=-
  SCN-specific regions: Sequence locations=1-214,236-254,293-451,473 -561,584-738,760-994,1016-1019,1044-1159,1181-1273,1295-1340
atgaaagtttatcacccgctcgtctctccaacactgaaaagcattgaagaggtgagctgtcacttttgcatatttgttcatagtttggcatggtaattagtccaattgggttccttaattgtctcattaattaaggaacatcattcacttgagcattcggaagcgcaccagcaagacacatatcttaataaggtgagaattcgtttttatggcaaatttattgtactatccatggcacaaaaagagaggttcggattatttgtttttattttcttaaaattaatttaaaaatcattagggacccattttcctttattatatacaaaaaccgtcgggtttgcctctcccacgccatttcttcgagtcgggcctctcatgtccagaaaaaacgacaaaatcgacggccttttctctgttcttttgacataaaaaacgccgttagaattaaaaattttgaagcagattttccccaaactgctgctggtcctttttaggatacttataaccaaaattctaatttggaggtgccgtcgctatgcgtgtgccgtccaaaatattcaattcactaaattttgaaaatttactcagagtttataaaggggaaaggccttcaatttgtttgtgatcataatctcattattttctattaatttgtttccgtatttgcataaccattccaaatttcagcgtattcaagattctcgtgccgaactttcctttttcgttggtgccaatttggtgcagcgtttggcaacatatgaaacggcaggccaagtgatgaccgaactgttgaacagcgtcgttaacatgcaccaattcattgaaaagcaagtcccagtggaaatgcggggctatggtacacggagtaagcaccccccccccccaaaaaaaaaaaaaaagtaaattccagcgggaactccccagttaaaaaatcctaaattatggcaccatccttttttatcccggaatgtgttttaagaatcatttcagaaaaatgccaataaatttgaaaacactcatattttttgaaattaaaattttctaataaaatacaaactcactgaatttttcttatgaaaccttgcctaattggccgaaatatgctttaaaaagtctaaaaaaatcgtgccataggcatttatatgcactaaatgttcacttaaacaaaacaaaaaacgaatgccaaaaggttttatatttttgagcccctttcttaagcacaaggccgcaatatttaatccaacgtcatatgaacaatttcaatttttcagctttaagaagcgaatgaaagaaatggacgagcgattcaacgaagtcaaaaggcttgccgaccgaataaa

SEQ ID NO: 79307 - DNA, 1380 bp, Heterodera glycines
  Genomic contig location: Contig_ID=SeqID_15124; Location=125..1504; Strand=-
  SCN-specific regions: Sequence locations=1-205,227-1380
atggtatggagcaatggcctggacagagtcatgccttacaaaaatatgacatttgggtacgaccctaatgttccggcagaagttatacttttgccagtacatttccctggacattgggctctcattgtccatgatgtgcaatttggcactcattttgccgattctttgcctaccccatatggcaggttggatccgcaactgacggataaaattaaaaagatcatttgtgacattttgccgtcgacagtgttgaccgggattcttaatgccgaaaatctcacggtacaacacgatggaaatagctgcgggtacttcgtttgcctgtatgctgaatcctggcttatgaacaatcgaacatttgttctaccaagtttattcataaattatgaaaagaagcgtattttgtggcacattaacgagctgtatggctctgataatgtgccatatcatccaagggaaggggtgccaactccttgcccaattgtctatcgacatacggatgaagcgcagtcgacatccaaggccgctgagtcaatggaagttgatgataaaaatgacattatgatcatcgaacctcatatgagtgtaaatgctgtcaatgccgttctcacccaagcccaagtggcaggtgaaaaccaagctgacacacttggtttggtgtcggagtcttgcgcaccgcaagagccaattgcgcaggccgacgatgcaatatttgtcagaccgaagacgcctccaaggcgatcagcgcgcattggcaggcggcaatctgcttcgattagccgttcgccttcacccgcaccaaagcggcgcacatcggcaaatacactcagccaggttacacctttcactaaacggtgtcatcttatccacaagggctggtgctgtgctgctgcagcagctaagcattatccggaatattccgattctggaaagcttggcgacaaaaagtgctctcattgtggagcactactcttcccgcatgagaacagcagcctttgctgtcgacaaggaagggttgttttgccaaagcttaacccgcacccaaaagagcttgaagagctcatcgtgtgcgacaaacaaccccgcgaagggaaggagtttgttaggaatatgtcgcggtacaataatttgctccaatttgcgagtgtttcggctggcaataagccaagtcctgcaggcggaccgatggcagtaattctcaatggagaattccatcgccgtataagcagcatgcaggctggcacaacccagattcctggcttcggtcagttatacattctggatccagtcgaagccatggagcagcgacgaaaaaatcccacctttactggtgaaaaaatcacaaacgatgaagagtttgtgcagggtcatcagctttga

SEQ ID NO: 79308 - DNA, 893 bp, Heterodera glycines
  Genomic contig location: Contig_ID=SeqID_15125; Location=296..1188; Strand=-
  SCN-specific regions: Sequence locations=1-175,198-304,368-399,423 -438,470-694,738-845,867-893
atgccggcggcacagcaggtgatagtgccacccctggcacaacaacaactgcttcaatgtccaccaatgccgccatgccccgtggcaattccggtcccaatgagattgccaagggttagagcaatgaggggggggggggcagtttttggaattttaaaattgctccataaagcctcctcccagaccgccaacattcatttgcccaccaccacaacagtgcccacctccaccggtgtgcccgagaccaggcaagttttatgcatgttttcatcggatgtattacgcgcagttacccctcccctccaaaatttttatttagaaaattttcttataaaatttaaagaaaaaaaaattgattttttttttagcgatttttaaaattttatgctgaattagtgctttttcaaaaaattttccaaaaaccgctaaaatgatttcaaaaaatttttttttttaattttcttataaagattttcaggttttttgattttctgtctaaaattctcaatttcaagacaatgaccttgaaagtcccaaaaaatcagaaccctgtcctgtgcaaacaccggccccgcaagtgccgctgccagagccaattccggcactacccactttcattgccccaccgccgcaattgttgcgccagccaccaatggtgccattggttgttggcacacaggtggctctgatggccaatttttcaattatttttctaattttgttttaataattaaaaagaatgattgttgttgcaattgcgtacaaacaacatgccgtgcgatgggaattgccggcggaaggttggcaaaggaaaaatattattgtacatgtttttttcccatttttaccgtggtggtagggaaatttgaaaaaaaattgatttttaaaataaa

SEQ ID NO: 79309 - DNA, 653 bp, Heterodera glycines
  Genomic contig location: Contig_ID=SeqID_15127; Location=140..792; Strand=-
  SCN-specific regions: Sequence locations=1-380,446-512,535-540,571-653
atgtctgaaacggattttgtattcaagatcatagcgatcccgataagcccttggaaaattgtcttacttttcaggacgaaaaatttgttgttaaaaagggtggcaccatcggtaatttaccatattacatacataaaaagactagataaacataaaaaaattcggcgaaaaaaaaaaatcttttgccaccaaaatcatttatactatatatacctgagagcggagattacacaacacaaaaaataaaaacgagtaaaaaaaaaatcaatttttaggagaagtgtactcttgttgttgtggcggtgattgaatgagtgccggctggtgatattgctgctggtgcgggtccataatgacgggcgcggacggaaccgtctaacaaaaaatttttcaaaaaaaaaaatcataaaaaatttttgtaagaaaatttcaaaaaatttttttagagcattcatgacaattttttaaggtttgaaaaaatgtaaatttgaaggcgggaaaagcggcaacagctcttttccccgtttttatttacttctgttttattttaaaaaaaacattttttttttacttacaatatttaagagaaaaattttgaaatccaagttttgaaatgctttcaaatgacgaaaaaatttttgaaaagcaataaa

SEQ ID NO: 79310 - DNA, 716 bp, Heterodera glycines
  Genomic contig location: Contig_ID=SeqID_15129; Location=611..1326; Strand=+
  SCN-specific regions: Sequence locations=1-185,213-716
atggacttaagtgctggtgatgaacagttgaagcggaactttagctgcaaaatttgttttgaggtaaataaaaaaagcttacaaagactaactctgtaattccaaaaattttttttgaaagtgactcgaattttcacattttaatattttgactccggtaataccggagaattggtgtcccggcgaaaaataaattaaaaaattttttttaagtcgttaaaacatatttatgggggttttctgggtcgctgatcgcgaatctgacatagttttgactaatttcgaatctcggacccgaacaaaagtagagattcaaaattctcacaaaatcaattttttaatttcgacttttggtccgaattcgagacctcgactccaaattattttgtcagataacataaaatacctttttttaatatattaaaaccaagagggagttcaaccaaactctctttcaatttctttaaaaacaatccgattatctctttttcctttagcccttctccaaggatcgtcgttatcccatttcgctaaattgcggtcacaccttttgcgctcgttgcgtcaggcagctcagcagcttcggcacttcaattgcttgtggtctctgtcgccgaggcacttactccgactttcgtcaactcggcaagaacgtcacactgctaggttttgtgcttttttattggaagaattcaaatttggttgccatcgggtga

SEQ ID NO: 79311 - DNA, 1460 bp, Heterodera glycines
  Genomic contig location: Contig_ID=SeqID_2357; Location=363..1822; Strand=-
  SCN-specific regions: Sequence locations=1-677,699-748,791-866,904 -1219,1253-1460
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaaagtgtcaacagacttttggaaaaaaatccccccccccctagatacgggcctgggtggcaatctcgccctctcccaacaccttccctgatacgggcctgatatggagctaaaaattaccttgcgaagcattttcttttgtcgaaatagtcgacgccttgccgttttgacctcgtgtagctcaatcaatttttgtttttgctcttcggaaagcttctcgaaattctcacgcttttcatcgccaatttgctttgctctgtcagcataaaacttaaaatggttattgcaatatttatgtattcccggcgacgttttgtcatgagccgttcctgggccagttgatcgagattacccgtggtggtggtagccccacccacccgctctctcctcgttcggaaagattttcgacaacatcctcattccacttgccgattggaaaccgaaacaggacaaaattttttcgccgtaactttagtaatccaaataattcacgaataattaaatttaattatttcacaaaattgtataaagagtagtaatccatcccccccccttcctgatatgtattttatttgaaaaaaatttttcaaagaaattttattttttctagcgattttttggaaattttttttaaaaactagtaaatcatcataaaattccgaaaaacgctagaaaacctttcatatttttaatttaaaatattattataaaaaaaatttcttgacttgttttaggtgtgcacccattggaaacacagattaaaagaaagtttgggaaacaattccttttatagacaaaaaataaataaaataaatgctacctgtttttcagcatcgctcaaagttttccaattaacactgacagttttaacaatttccttcgctaagccagtctgataaccaaatttttcacgaagaaaaattgcaaaagatcgaggcgcattgaatttggacggaagacgaagttcaacaccactaatagaagttggaacaacaagacgcggaaaagtcgttgacaatttggacacacttttacaaaaaaaaaataattaaaaattagttaattaatcagggctcacaattgagcattgtgaaaggcattttttggacaatgttttagactttgttttaagaacgggaccatccatgtttgtttatagtgaacgacagacacccgcttagaaatggttaaatacttaaatgatgtacctacaagattttttgctcggcgaatttaatatgaacaaatcggtccctacggaaatggcaaaaataaa

SEQ ID NO: 79312 - DNA, 560 bp, Heterodera glycines
  Genomic contig location: Contig_ID=SeqID_2358; Location=442..1001; Strand=+
  SCN-specific regions: Sequence locations=1-560
atgaaagcagcgaaaaaggtcggactgaagaagaaggagacgaagttggcaagcgggcagaaaaagggacgaatcgctaaaggcggcggcacttcgacgacaggcgccaaaaagggagacgaagaggcggcgacggaactgcttcactctgcgactttgagcgaaccaattattttgggtgggacgaatttcaaaaatttttttttcgttttcaaaaggcatgaaaacaaagtgtcgacagtagaagggatactcctgtgttaattttcaaaaattttcagcatcgggcgaaaaacaggaaaatttgtggcgttttgcgccaaaaatgacaaattttgctattttggagtcaagttttcaaaaaataataatggtacaatgataggcgacaccatgaaaattttttgtgaatttaattagatatgacaaaaaatagtgtaaaatttcaacaaaaaaaagcttgccaatttcttggaaaatttattccaagtcaagaaaaaacccatggaaacatgtgttcataattttgaaatactaaaaaaaagaatttttttctagca

SEQ ID NO: 79313 - DNA, 487 bp, Heterodera glycines
  Genomic contig location: Contig_ID=SeqID_2358; Location=1493..1979; Strand=+
  SCN-specific regions: Sequence locations=1-66,88-108,131-430,453-487
atggcggcgacatcaaagctgcaaaaaagtggacgaaagcggttgagatacgattcagaggagtcatctgatgatgatggcattggaggaggtgaatgggatttcaaatttgcaattagtacttgaaaacgggttgacctgaaatttgattgcgctcgttagccaacttttcgctttattgcagttaacacgaccataaaatttggcaagtttattacaccataacattgtgtaaacaccaaaattaaacattcttggtatcattcgatagtcccgagaggtctttattaggcccataattgaaaaactactttttatgactggttgattttcatcagatggggccactgttgcaatcattccgacgccgagcattgatttggtcctgcaaaatttggcaacaaatgcactcgcttctacagcggcgcccgaaatggaggagaatgaagagcagggcgatgccattcaattgggtaataatatctga

SEQ ID NO: 79314 - DNA, 231 bp, Heterodera glycines
  Genomic contig location: Contig_ID=SeqID_2359; Location=115..345; Strand=-
  SCN-specific regions: Sequence locations=1-65,89-137,159-231
atgcttcggccactgccatcaccgcgaaacttcctttttggcactgttgttgttgacaacggccaaagagaggaagaagaaacagaaacaccaccgtcggcaattttggtggttgtgtgccgtgatgaggagacaagcgatgatgatgaagccgatgatgacggttttgttgcaactgatcgtgcagcaacaacatcgtttatcgttgcaccaattgttgacgaggcctga

SEQ ID NO: 79315 - DNA, 3064 bp, Heterodera glycines
  Genomic contig location: Contig_ID=SeqID_2359; Location=1877..4940; Strand=+
  SCN-specific regions: Sequence locations=1-496,521-582,604-987,1009 -1371,1393-1400,1423-1865,1888-1956,2011-3064
  Gene Ontology: Mol. function=carnitine O-palmitoyltransferase activity; Cellular component=endoplasmic reticulum; Biological process=fatty acid beta-oxidation
atggacgatgatcaccaggttgaattggggttttagttccacgcaaacccacggttttgtacagttttcgtgccgcctctgatgtgccgtcggcggttggcttgccccccgattggttgtcagactcctgtcaattaatccacaaaagccgtttgcccacttatcatttccaggtcaattagtgttttttgtgtttctacacacaaatcattaccaaaagtaaaaaaaaattcggcttaaaattttgttttatacacgtttttgtactatattaaccgcatccatttactcacctaaatctgtttcagaaatcgcttttccgattaccagtgcccagtttggaacactcttgcgaccgatatctatgctctgttggtgctgtgtttggcgaacattcagacgaatttgtggactccaaggaattggtggccgattttctcgatggcactaaaggcggagggccgggtaaaaaacaaaaaattgatcattttaagtgtttaatttttaaatttaatttattcagcgcttcaagccgaactcaaaagatacgcccaacacaataaacatacctcatacatagttagtttttgggggctttttgaatttaaaactatttttgggagtcgggggcgagctgttcacctaaaaacacatattgttattccagtcagaaccatggtttgacatgtatcttcgttcacgcatcccatgccccatcaacttcaacccgttcatgatgtttgcacccgaccctgagcctatctacaacgaccaggtgcagctttttttggaatttatttcgaaaataaaaatttattgcattattttagcttatacgagcaacaaatttggtcatttcctgtggccgcttcaaaaaggcgttggatgctgaattgctgaaacccgaagtattccacatgaatccgctcaaaagtgacaccgaaaaattcgaaaacatttgtcggtcggtttttgtcttttgcgcaagaaattttttggttttaaattatttgcatcgttttcaaaggttcgcccccaatgcaattcgatggcttgtggcagcgttggctttcaaagcgtacccattggacatggtaatttttcatacaatggcaaagcaacatagcttgggacaattttgttaccaaaaatctcgcacaaaaatttaaaaaaattgtgaaatttaaagaaaaaaatactctgataaatcatttgtccatgtaatacattttttaattggctcagagtcaatatcaatcgctgtttggaggttgtcgaattccgcagcgggacaaagatcgtttacatctcaacagaaattcgtaagtcaatttttcagatattttttttctttgacccacaacgttttccgggctaattttttaaaattatggtctctattggcgaaaaacataatgttttaacagtttttcgccgaatgatgaccaatttaaaccgaatttatttaacaaaattgatacaaatttgttcaaaaaatggcacccactttctttgatttttttccccaaataattcgtcaccatcccctggtttttaaggaagcattttgttgtttcacgccatggacatttctacactgtcaagctgtttgatcagaatggttggtttgaataataataattgtcttaaaatgagattttttttcttgtaggcatgcttctcgagcccaaacaaatttttgccagtctttcccatatttgtaaatcgccgccgtcgtcgtctgctagcaaaaccaattttgcgccagcagacgaatgtgttggctcattgaccacattggtttgtgttaaaattcaaacccgaactaataacaaccaccatggtctaaaatttcagtaagaaataaatttgaaaattaagggttttcaaaaaaaaaatcagcagttaattatagttttttttccgaaaaagacatctcatttgctaaagaaaaacaatatttatttaaaagtttaatccattttttattaaattattattattattattgaaattctgatcgtttttttttttgaaaaaaaatcgtgacattatgaaattttattcggaataattgtttttgttttttcaaaggaccgtgacacgtgggcggacattcgttctgaactgattggcaccgactcgagaaaccatgaagcgctgactgcaattgaggatggcctgttcctgttgtgcttggacgagttgcacagcagcgatccggaaagactgatgcattcgctgttgtgcggcgatgacgggagcaacagatggtcagtcagttcagttattgtttaatttcaatggtttaggccaggggagaccctccatttggggggggggtgagatgggagtaaaccggaacaggacaaaacacagccgccgaaacgcagtcgagacataacacagccgggaaaaaattttcaaaaaattttctaacagaatttttcatgaaaaaatgttagaaaatttcttagaaagttcaaagaaaaaaaaatttcaaaaattttccagcgatttttcaaagtttaatgttgaatgttgcattactaagatttacaaaaaaatttcaaaaaaatcgctggaaaattttttgaaaattttttttcctttgaattttctaagaaaaatttttctgagatttttttcatgaaaaatttctgtttgaaaattttttcccggctgtgttatgtctcgactgtgtttcggcggctgtgttttgtcctgttccgcctttttacttgcctatctgtacatatcaaatttaaattggtgcctttgtctccgaacattgcccaatttaataattaaaaaaaagtacgtttattttcagaaaattatccgtgtcgatttgcacaacggaggccaatggacgtgcatcccaacggaacatttggagggcaattgggttttgttggatgttttcttcgacattttgcttgctcaacactcggctcccaaccgtccgcactctttgcatattgccgacagtgccactaacggcgacgacaatgacgccgaacacggtacggtactcattgtcagccaaaatggcattttttaa

SEQ ID NO: 79316 - DNA, 74 bp, Heterodera glycines
  Genomic contig location: Contig_ID=SeqID_2359; Location=4707..4780; Strand=-
  SCN-specific regions: Sequence locations=1-74
ttgccctccaaatgttccgttgggatgcacgtccattggcctccgttgtgcaaatcgacacggataattttctg

SEQ ID NO: 79317 - DNA, 814 bp, Heterodera glycines
  Genomic contig location: Contig_ID=SeqID_15130; Location=587..1400; Strand=-
  SCN-specific regions: Sequence locations=1-112,134-290,312-454,491 -662,684-814
atgcaaattatcggcattattccacgagttaaaatcaatgaattggtgaaacaaaaagaacaattggccatggatgatttgagaatggttgatcagcccgagctgtacaattttgatccaatttttcaacagattaaggaacaaaagatggaaattctgaaagctttcgactttagctttgacacggtaattttgggtggatgccgaaatgctcagagactttgtgccaaactttcaattaacttttttttgccaaaattggttgtttaaattgtgctaaaatgtcggtggaattccaccaaaattagttccaggaaatgccgatcaaattttctaacatgcacaattaatcgaacttaaaaattttttgaaaacgaaatttccagtattttcgctcataaaattttttttgaccatatttggtatatgtttaaaaatttccaattaaatttcgattttatttattttttttaacaaaattactttttaaggtgggacaattccgtcggagcttgtccattcgagaacatcttcagcgtccacattaagaaaaaaaaatcatgaatttttacacagggggagaaaaaaattagaaatttattcgagaaagaattatttttataaatagaacttggaaattaattttctatggttttttaagtaaaaatgtgctttttaagtgaaattgtaggcattttttcagaatttacttgcccggtgaaaaaccataggggaagcaatattttaaaaatgaaatgggacaacacttttgaccacctatattttgatcaaattgtgaatatggtaaaataaa

SEQ ID NO: 79318 - DNA, 61 bp, Heterodera glycines
  Genomic contig location: Contig_ID=SeqID_15130; Location=575..635; Strand=+
  SCN-specific regions: Sequence locations=1-61
acatttatttgatttattttaccatattcacaatttgatcaaaatataggtggtcaaaagt

SEQ ID NO: 79319 - DNA, 532 bp, Heterodera glycines
  Genomic contig location: Contig_ID=SeqID_15130; Location=1710..2241; Strand=+
  SCN-specific regions: Sequence locations=1-532
atggcgattttgttcgagccgactccgaccgaatacaaccgtcgtcaatgtccgaccatctccaggccaaaacgggtgaagctagccctaaatagggtcattaaagctctccatatggcaatggctgagcccgctggccctaaatggtcccgcaatcactccgtccccgtccgaaacgttcagagggacaacgctcgccgctaaccataggcaagcgctagcgtactcagcgagcagcccggtgcacttggctagccacaagtccgcagcagcgactagcgagcgggaaacggcgccggcgagcaaatcgcatatttggcgttgtgttattgttcgttttatatatagtgggataataatgaatcttttttggatggggtgtaaaatgcgtgagggaagacagacaattgggtggggtattttcattgggcgctcgtttctttgtcagcggcaaagagaaaatatgccatgctatttcgcccttttcattttcactaattgtcacctaattacatgtaattcattaacttaa

SEQ ID NO: 79320 - DNA, 757 bp, Heterodera glycines
  Genomic contig location: Contig_ID=SeqID_15131; Location=290..1046; Strand=-
  SCN-specific regions: Sequence locations=1-595,686-718
atggaaggtgaaatggaagccaaaattcacgtttattcaacacagccaattgatggcgacggatttatggcatttgcacgcgattttctcaatgaatccaaggaacttcttaaaatcattgaaaatttgtcgaacccaattcaagaaaatgttcgtaaaaatttgaaaaatttggccagtgttgcgcaacaaaagtccaaacagttgcgccagagcattgcgcaacaattggaacaattggtggcaaatgccgcaaacgaacttgccaatttgcagagccagacaggcaagttcggggacaacacggcatccgaatatttacgcatttttaggtgtaagtttggggaatattatgaatatttttgctaattaattaacaagggcttagattaatgtaagataaataaaatctcaaaaaaaatgtttgacataagaaactggaaaattaaagttttaaaaggtctttaaaaatagaaaaatgactgtatttttccaaaaaatcattaatttgcttgataacttcgtgaatttatcagtatttttatgaattttaatcaatttttttgattgattattagatgcaaatcaacggcagaaaattaaaaaattttgaaatttaaaaattctgttttttatattttatgttttacattcatttaataaaatatttttaataataattttagtcacctgttttggaaaaactctttaatttacgttatttaattttaattctaaattttttcataaaaataaa

SEQ ID NO: 79321 - DNA, 264 bp, Heterodera glycines
  Genomic contig location: Contig_ID=SeqID_15132; Location=707..970; Strand=-
  SCN-specific regions: Sequence locations=1-96,118-181
atgcgatttttaggtaagaaaaatcccagaataggtacttaaataggtaaaaaaaaaatctcaataggtattaaataggtacaaaaattccaaaataggtaaataaaattttttattaacgatttttagtggaaaaaagcaaacaaaaggggaaaattttggttctatttctttgtaaacgaataatttaaatatttttaatatgttcttagaaaatattgacattttaaattaaaaattttgttacataaaaaaacaaataaa

SEQ ID NO: 79322 - DNA, 705 bp, Heterodera glycines
  Genomic contig location: Contig_ID=SeqID_15132; Location=1368..2072; Strand=-
  SCN-specific regions: Sequence locations=1-235,258-397,419-705
attaaacttcctattcttttcaaaggtctgggccgaaggcggtccgagtgctatcgaaatctattggacgcctgagcaggaggcgcgtcctgttaaacattactttgtgcaacgtatggacaagggccgttggattaatgtgtcgaaggttattaattgggttttttaaattgttatgtggggtgagggaggttcagctaatgtcctggatttttgagatcgggaaaatcgcgaattccagttttcttcaaaaatctttcgagaaatcctcccgttgaatattttacccgagccaaacatcggttatgctgctctctctctactgcactcaaactttaaaaatttaagttgatttactgatgggcaggcaccgcactgaaaatttagcaaatttatatttctataagaattttaatcactacaatcaattcttttcagtccattcctttcactggacaaagcaaatactgccacaactttctgcctctttcacttgttcacaccatcgagtacagtttccgcgtcatcactgtgtttgttgatggacaggaggaggcgagtgaaacgtttactggccgtctcactatgaatgcggtaagcttcaattgaccgtaattgctgcttaaacattgaatcatttttcttgacttgtttagtgagtgaggaaggcccaacaaatgctgtatcagtgtgcggagaaataaa

SEQ ID NO: 79323 - DNA, 589 bp, Heterodera glycines
  Genomic contig location: Contig_ID=SeqID_15134; Location=75..663; Strand=+
  SCN-specific regions: Sequence locations=1-409,456-589
atggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccggaacgtgtgccaaaagcaaaccgacagaccaccaacaacaacaacaacaggatctgaagcgcaaggcaaaggtagcacttgacctcgtggaggctggactaatggccgatgctatgcaggacggcacacggtggaagaaggccaaaacagctatcaacgtgcttggcaatctcctattggctgaatcactggactccaccaacagcaattccactgatgccccgacgcaggcaaatgaagccgctgacatcaaagaagaagaggaaaatgtgcagggagaagaagaaaacaaagaagacattggagacattgataaaactcttgacgacttctttaacagccttaatgcttcaacctcaaatgtgcctatttaagtgaataatttaacacacatcattttctcaaaaatattaaacacacaagcattcacca

SEQ ID NO: 79324 - DNA, 819 bp, Heterodera glycines
  Genomic contig location: Contig_ID=SeqID_15135; Location=14..832; Strand=+
  SCN-specific regions: Sequence locations=1-115,137-236,258-266,295 -318,340-819
  Gene Ontology: Mol. function=structural constituent of muscle; Cellular component=sarcomere; Biological process=striated muscle contraction
atgtgggagagtgggtttgcgttgccagcgccatcacaatactatggcgatttgcctgtgctgccagacaacgcggacgaaattgaggagatggacaccgcacagcgcaggattgcaagcagaagaaaattaaaaaaggatgaagcagaagatgatgatgatgatgatgctttgcatcacaaaaaatacaggatttatcagcgttcacctccacggctcccttccccacctcgagcgaaaccaaaaccaccaccacgccaaccgaccacaaagagagagcaacagaagccaaaaaagttggaactaaaaccaccaaaaatagagccaaaatttgaacccgattcacgaccatcgacatcaaaagtcgcgcctcggtcgaaaaaagagcctgagttccagcttgacccacggccatccacatccaggcaggctggacacttgcctcccccagcacccaaaattgtaacaaaacatgagccgacaaagagacccgtgccataccgtatcccgaaaagagaacccaaaattgttgaagaaacgccacagaggcaacagcaaccccttcctgctgctgtcgtcgaagaaatgcctcctgttcctccgcctaggagggggaccaaacgccgccaccccgtaaatggtgagaatgatggtgaggtgcgcataagaaaacgcgtgaggcaagcgaggagggtgcgagtacagtactcacccgagccgggtccatcaacatctgcacaaagtgatgaacaacaacaacatcgagaactgtttgccatcccgtcaaatcagctggagagcgggccgccctaccattaa

SEQ ID NO: 79325 - DNA, 1195 bp, Heterodera glycines
  Genomic contig location: Contig_ID=SeqID_15135; Location=890..2084; Strand=+
  SCN-specific regions: Sequence locations=1-534,556-573,595-922,945 -980,1002-1023,1045-1195
atggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgtttgcaggtgttacagcgctgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgaggagatgttggaggcattcagacaactcatcgaccaaatgccaatggtcccacatcgcatcttctccgacaaaggcaccgaattcaagaaccgattgttgaaggaattctttgatgagcaggaaattgagaagcatgagccagtgcattcatccgtcaaggcatcggttgctgagcgggccatccggaatgtgaagcagcgactgtaccggtattttgctgaaaaggagacgctgaattgggtggatgcagtacagaaaattgtgaacggaattaacagcgctccaactcgtgttcacgagatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagagatatttaccaaattatggagacgaaatcctggagattgatgatgtgctgaaagcggtgcgcccaattcggtacaaactgcgggatgagcacggtgagaaattcaagggcagcttttatgagcaggagctggcgcgcgtaagaaaagatgcagacacaagctaccgcatcgagaaggtgtacagaaagaggaaaagagcggatggatccacagagatgcttgtcaaatttataggatatcccaatcgggaatggattaatgagtctcagcttgtataaaagcatgtgcatttttcattttgttgtgata

SEQ ID NO: 79326 - DNA, 131 bp, Heterodera glycines
  Genomic contig location: Contig_ID=SeqID_15136; Location=1953..2083; Strand=-
  SCN-specific regions: Sequence locations=1-131
ctaaaatgcgtcttctattaatcctcccaaatttacttccaatgctcgctttaatgatcgccatgggcataattggttctgttgtgtttggaatggacccaaacataaaggagccattgctaggctactag

SEQ ID NO: 79327 - DNA, 309 bp, Heterodera glycines
  Genomic contig location: Contig_ID=SeqID_15136; Location=1132..1440; Strand=-
  SCN-specific regions: Sequence locations=1-309
atgcgtcttctattaatcctcccaaatttacttccaatgctcgctttaatgatcgccatgggcataattggttctgttgtgtttggaatggacccaaacataaaggagccattgcttgaaaaagtacaaaatgctgatcaggatcagcagcttaaaattgatcacattaatcagccaaaaatggaagtgatcgtcgacgatggcacaacggaggatgccgacatggccaaggcattgaaattgcgagaaactttggttttggcgcaaaatgatgacaaaatgggaatgcaaagagaacgacgaaaataa

SEQ ID NO: 79328 - DNA, 914 bp, Heterodera glycines
  Genomic contig location: Contig_ID=SeqID_15137; Location=250..1163; Strand=+
  SCN-specific regions: Sequence locations=1-405,428-489,511-742,765 -766,792-885,907-914
  Gene Ontology: Mol. function=structural constituent of epidermis; Cellular component=extracellular
tgtaatccgatgatcattgtcattgcttttctaatcatttggtcccctcaagggtttctcccaacgcggcacgtctccgtcggcgagtgcggttgcggcgggtgccctcctccgcccgagcggcggtggctcgagtccaactcggcatcgagctgcgactcgccgcgccctccaccgccccctccgtgctgcggttgtcgagtcgtcttgcggctgcggtggcggcggatgtgagaattttcaaatttaaaactgagtagtgccaatctgatccggacaatttttgccattaggaaaattctcggcattttaaggtacagacggttttgtttagctttggaatttttccttttcgatttttacattttttgcataaattaaaattaattttcgattttttaaggtggcggcggttgcggcggcggtgccattaaactgacaattggctgcgactccccacgccctccgcctccccctccgtgctgcggttgcgggtgcggctgcggcggcggatgtgagttcatttggtgacaaattaagacaaactgaattaattggccatatttgcacaataattctttcaatgaaaatccaaagattacttttcattgctttcacatcgctttctcaaccaagaactctgactttgtgattttggcttttttttgggtatattcgaattcgattgaccacgacattcctcgggggtcaattccctaatttaaatttgctattattattaaggtggtggtggcggttatggtgcaaatggcggcggcggctgcggcggttccattaagctgacaattggctgcgaaggcccaaaagccccgccaccgccccctccgtgctgcggttgcgggtgcggctgcggttgcggcgggtgccctcctccccccagcggcggtggctct

SEQ ID NO: 79329 - DNA, 421 bp, Heterodera glycines
  Genomic contig location: Contig_ID=SeqID_15139; Location=700..1120; Strand=+
  SCN-specific regions: Sequence locations=1-249,284-421
atgctatttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagacaacaatttgcggcaactcttcgctgaattccaacaacgagcgggtcaagacccattgcaatatttaagagcgatttcatatcacttggctcaaatttaatgcttttttattcaaaaa

SEQ ID NO: 79330 - DNA, 369 bp, Heterodera glycines
  Genomic contig location: Contig_ID=SeqID_15140; Location=571..939; Strand=+
  SCN-specific regions: Sequence locations=1-218,240-369
atggaagaacaaacggaaacgaagaaagggaaggcaacaaaagaagagcctatcgacagaagcgaccccgcagttgaaagaaaaaagcacgatgaacatcgaatccgatgggcaacacaacgaaaagcagcagtggatgaacttcgccaacggataaagctacgcaaaaaacaatggtcagcagcagacatcgaaaaagaaatgaaggaaactgaaaaagacgacgaagaacacaacagcgaatgcccgacttctatccaacagatggagaaaaagttctggcctactgcgatagaagatacggcacaaatctcatggcatcctggagacgcaacagagtccaaacggaattaaaagaactcctggaga

SEQ ID NO: 79331 - DNA, 336 bp, Heterodera glycines
  Genomic contig location: Contig_ID=SeqID_15142; Location=501..836; Strand=-
  SCN-specific regions: Sequence locations=1-91,113-113,162-162,184-336
atttatgagccacccaatttggcaaatcggtctttttaaacgcattaaagaagatttcagtcgattgcttggagtgtaagcaaaaaaacgctattaatttttcatcttcatcattttttggtttaaaaatatatttgaatacttttttatactttgaaagacttttttattaatacagaattttttgaaatttcctaaaatccgcaatcctgcgcaggatcctgcagattttaaatgcaggatttgcaggattaatcctaccggatcctgtcctgtaaaaaattttgaattccaatcctgcaacaggatccgcaaatttgaaatttccggtctcta

SEQ ID NO: 79332 - DNA, 941 bp, Heterodera glycines
  Genomic contig location: Contig_ID=SeqID_15142; Location=1991..2931; Strand=+
  SCN-specific regions: Sequence locations=1-559,581-702,737-941
atgagctccaacaatgcgttgactgaaatgatgcggcgtgagaagaaaaagttgctgggaaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctggacattttgcgccaatgtggcacgtgcacctcgatggaactttcaaatgtgctccagcgatgtgggagcagtgcttcgtcattggtgcttcagtacatcagaggatgtgcatcagcatgtggtgtctcctgcctggaaaacagcgacgctactacgaagaagcactgaagcatcggctcaccggcaccatcaactcttacgtggccaaccactgtgagtccacgggagcagcttgttcaatattcgttgagcccgctaccgactttgacagctccttcaggcagaatccttaatcaatcatccgtttaaatttaataaaaaaattcagttccagcgtgggaggacgaaatcgttcgtgcgccacattttccaattccgctttggaacatgcactcacaggcaacatctgccctcgctcgtacaaacaacggactggaggcaactcatcttcattttatggtctttaatttattaaaaacaaattgaaaagaaacatttagaaaggcctctgtcaccacaccaccccgccctctcggacttcatttgtggggttaatgaaagcatcgacagacaggtggacgctgcccgatctgctcgccatttcattcacaagcgacacaaacgatacatcctcccagatgctgtcattatgcgaattttggcggacgcgtcgtacaacagcaatg

SEQ ID NO: 79333 - DNA, 897 bp, Heterodera glycines
  Genomic contig location: Contig_ID=SeqID_2363; Location=1336..2232; Strand=+
  SCN-specific regions: Sequence locations=1-351,373-897
atgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaaacgccactcgtggttgtacaaacagaggcatcagctcaaggacatgattgagaacaaaccacaaaaggtgattgtggaaaacgctacaggcacagcgccacaaaacattgccccgtatatgggcatacagaaaccaaacctcaacaagcttgaagaattgaacgggcaggatggcaaaaaaataaataaataaataggacgaaaatctgtgaaagcttccagaatccaaactcacaatggtgccagctttggtgaagaaacggatacgtctgcgcctgagacagatttgcggctaagcaaaaagagacaacaaaagtttcttgaacttaaaacaagcccagagcattacgataagctacaggaaatgattgaacgaaaccccgaaaagtacggagtagataaatcgtccggtgaaattttaactaacttcaaaaagccggtgattaggtccaactacattgattctttaatgtacctgacaggacagagagcagatgtgccgaaaggtcatcgattttttgttcaaaaaggcggcagtgacccggaaatggcgaaattttttcattcccaacggggagagggtgatagtaatcggagcaagcgcaaaaagttcgttcttgttaaagcaaaagctataaaaacggttggactcagccgaatggagcaaccaaataacacgaagcgtaaattctttaaaccgcttctatgggcaaagctgtag

SEQ ID NO: 79334 - DNA, 1092 bp, Heterodera glycines
  Genomic contig location: Contig_ID=SeqID_2364; Location=486..1577; Strand=-
  SCN-specific regions: Sequence locations=1-227,249-508,531-588,610 -621,650-1092
atgggatatgctgtaccattatttggcttttattatcgcctcattaacctctcaaaatcacaaatgagaaaaagactcaaaattacaattgataaaaatacattattgtcaaagtaatgtgaaccacaaaaatgaatcttaattatgtggcttgaacttgctataattttgaattcaaagaaaatccaaaaaaatatattttcaaatatacctcgagtgcaatattttgcattatcacttaaataataagcatgaatattttagccgaacaaatatcttattattaaagttcgactttcgaagcatatgctttttttctggcattagttccgaatataagcatgaaaaacgcattagcacttttttattatgctttttttgccctttaaggatttttatgccttaaatacctttttggcattttgccattttgccattttggtacctttttggcgtttttcgaaaaattccattaaaagggcaataaaattgggaaatacaccccctaaaactgaaaaaatttagaaaatatacccttaagaattgaaactcaaaaattgatctccaaatttcatttttcttgataaaatttttagatttaaaatttttccttcgaaaaacattataaaatttttaaaaacatttaaatgaggaaaattaagctttttgattaagttttaggtttttgctccctaactttttaaaaattaaatgccgtttttcatacttttcttttttgagattttcgtgccttccgatttttaattctattattaatgcattttccccgatttttgctgccctttttaaatttatactaaaacatttaactggattattttgaaattacacttttcaggtgtacccgctgcgagtgccctatggtacgtggaactgatgggactgatcgaatttcttttcaatacgggcgcccaaattcgctaactgctcacgtacttttcaaatttgttggaccacaaatttgacgaagtgtttccccatgttggttcaaatgagcaccaaagggctcgtcgagtctcacctattgttaccgtattaacaacgaatcgaacatattgataccatattaaa

SEQ ID NO: 79335 - DNA, 270 bp, Heterodera glycines
  Genomic contig location: Contig_ID=SeqID_2364; Location=2075..2344; Strand=+
  SCN-specific regions: Sequence locations=1-207,254-270
atggctttatactgccgtcctttttttgtggaagttcattcttttaactcaaaaaaaagtggtgtaaaatgcagcgtccaacggtttgtatttactccgtttgaattgcttgtggcaaaaaatacaatagacagtggaccaaaccaaatggttggttctggtcggcagcattcggcgaaggtgaaaggatacgggcatactgatttgttataattatttaaattattcatattttaaataacatttattttaaggtgatatctcaattta

SEQ ID NO: 79336 - DNA, 1659 bp, Heterodera glycines
  Genomic contig location: Contig_ID=SeqID_15145; Location=308..1966; Strand=+
  SCN-specific regions: Sequence locations=1-273,316-442,466-810,886 -914,951-1046,1075-1169,1191-1330,1354-1494,1516-1523,1545-1561,1584 -1659
atggatcccatttttgtcggccaacagttgtgcccagcaaattgttgatgcggtcctcaaagagaaggtgatcgcgttcatgccatggtggttagggctgattgcgctgcttcacaggtggcacaattaaaatatgaaaatgatcttctattcccaaagggatttgatcagttattgagatgacctaaatttcttatcagtgtagtctttgctcccaattttcttatcacaaaatgacatgaataattaattattgagaaatattccactataaaattatatgtattttcaatttattgttataaataagcaaaatctaagttgattttttgtgatgctttttccaaaaaaaaaacttttggggaacaaggggggtccggcggtgccgataggcgccgccgggggaaaaattaagaattttgaccatatttttagcagattttcattaaaaaattcttaattttatggattttcgaaaaaattggttattttcaggtttttatgaaaaatttaacaaatttttttggaaaatttggatgagattttcgttttgacgctcttttaaaaacccaaattattaaatgattgtcaaacattatgccaatttatcaaaattcatcataaaatttaacagattctgacgattttccccaaaagcctcaaaaatcctcaaaatttctcaaaaaaccgcaaaaaagctcaaagcctcatttgaaaatttagcctcattgacctatcaaaaaaccacaaaatgaggctaaagcctcagatctgggagccctggtttaaaagccctcccccctaaattttaaaaaaaggaaaataaaccaaaaaaaaaaaaattaaaaaaagaaaaaaaaagaaaaacttaaaaaaaaataaaaatattttcatgcaattttaaaaatatcagcattttaaataaattttcaatttttaattaaatttttcgatttgtttagcattctcccgttgaacatgcaacgagtggcgcgggacttcatcaattttcgctatgaagaacccgattatcccatggcagatgatgctcaaccaaaaacaacaacaactgccgttgaccaccaaattcaaaatggcgccaccgccaacacaaaattggcggttggcgaaatgcccatatccaatggacaaacggttgaggagagagtggcagagaagcaggcagaaaatggcggtgcaaatagcttccgccgaaaaccttcgccattgttgcgcctccaaaaacgccaaatgcgggagcacttcgaatttgccggattcatttggtggctgatcattgtgccggctatggcactgacatttgtaatccaattttaatttaaattttaattagtaacactttaataaccccctaattaactagactttataaccccacctttttaacaggtggtcttttatgatcctgcgcttgttaatgtgcattggcttggccctgttggtcaatttgtgtataaacttggtaaatttggatttaatttcaattttttgattgacttggttaattatgcttaaaaatttggcaatttaattgtttgccatattattttaattaaattccttttcattgagctcaatcgactaaatacaaaatttagcaaatgctaagtcaaagtcttggctgacattatttagaga

SEQ ID NO: 79337 - DNA, 553 bp, Heterodera glycines
  Genomic contig location: Contig_ID=SeqID_15146; Location=1283..1835; Strand=-
  SCN-specific regions: Sequence locations=1-130,154-402,480-511,533-553
atgccaaaaataaataaatttgttgaacggcaggaggaggaacaaaatttgttgcgggctggacgaaacattgaagaggtgactgctccaaaaatgtatgcgcgtcatcttggcgatttgggaggaacggtaaattttatatttatatattttctatttcattagtatgctatttttattcgtatacttaaataaacataattttaaaaaaaaacttagttttttggtatataaaaaagagtttcgagtcggggaggcttctaaaattaaattttttgttaattactcaatttaattatagttccaattcgggtttattattttatgattatacttttgccatagtttatctccgtttctgtgcgcaaagcattagaataattgggaaccgtttttatgaacttaaattttctataattttttttacaaattttgtaaaaaaatttaccataattttgaaatttttgaaattttttttagatgtttcgcttcggatgaattgttgttatatttttcatgttcaaaacaacacagcgcaacggtgaaaaataaa

SEQ ID NO: 79338 - DNA, 789 bp, Heterodera glycines
  Genomic contig location: Contig_ID=SeqID_15147; Location=52..840; Strand=+
  SCN-specific regions: Sequence locations=1-789
atgggagacgcagccattcaacgattgacggatattttgcagcaattgttggctgcgcaacagcaaaacgcgccaccggcacagaacgcctcccaattgccaacactcccggacgtgaaatgttttgatgctagtcagcatcgtggctgcgaaattgaggattggctcaagcgatttaagttcgctctggactgtgcagcgccgaacttccaggatgagctgaaggtgaagctgttgatgacgaaattgtgtggaccgacgttcagcgaatattgtaagtctgtcttaccgagagaagtgaccgacttcgactttgtggagacttcggagaagctgaaggcattgttcagccgacctcaatcagtttggattgaccggtatgaatgtctccgctcggtcaaagacgacgacgaggattttggcaccttcatcaaccggcaaaagaagcttctgcgggatttcaacttcaagaaattgaatgaggagcaattcaactgtatggttttgctcatttctttgaaatctccgaaggatgctactctgcggtcgagaattttggccaagttggcagcggatggtgacacggtcaagtacgacaccgtggtagacgacttgaagatctacatgtcgaccatcgccgaagccaaggcactggagcagccacatgtttcgaagcatttgttggcagcaaaattgaagggccaaaagaagaggaagaactcgtaccattcgtcgaatgcgagcagcgtgtctacaggaactcggagcagcaaccgatcgcagcgctaa

SEQ ID NO: 79339 - DNA, 722 bp, Heterodera glycines
  Genomic contig location: Contig_ID=SeqID_15147; Location=1324..2045; Strand=+
  SCN-specific regions: Sequence locations=1-86,109-556,579-722
atggacagacttggattgtcggactccatcagaaatggtctgaaggacaaattccgaattgagactgccaaagcgaacggagagatccagaacaagaagaaattcttcagaaaaaatcgacgcggcaaaaagcaaaacttcttcgccgttggagcgaatgtgatcgccagcttgggagatgaaccatggcgtgccggacgtgtgatcagccagaaaagaggcctttacaacgttcagttttcggacggcacgaccggagaattcccggcaaagagtgtacagccgtacatgccggacgaagacgaaaatttgaattttcttgacggatttggactgaagagatcctcatccggtggaactgtcaggaagcaccaaatcggcagtgacggccgacgagatcaattggaagatgatctccgagcttccgactgtgaacaagaggcataagaacgccgacctgaggatgcggatgatggacggaggcctggcactttttaaggggggagatgttagggttgggacccaattggccggtacccattttgaccctttgctttattgtatttcccttttcccttggttatgtcacgcccctttttccgcccataaatacccgcgatgttgaccctccccgttcacttcattcatttgtgttatttttccttcttgttatttaaaaattcctccccatttattttgtgtctttttcccctctgctccaa

SEQ ID NO: 79340 - DNA, 1701 bp, Heterodera glycines
  Genomic contig location: Contig_ID=SeqID_15149; Location=630..2330; Strand=+
  SCN-specific regions: Sequence locations=23-178,207-255,277-386,408 -423,445-452,474-493,527-553,577-676,708-740,798-1142,1164-1273,1297 -1335,1384-1516,1552-1701
atgaaaaataaatggcaatgggataaagaaaaaatgaaatgtttaagaaatgaaggagatgtttttgcctttgacaatttgtgagaaaagacggcgaaacaaactttacaccgcacaatcttatggccaatcatttgaacggcaaaaaggaaacattgctgtggtgctaatggaatgcaaaaaaaaaataattaaaaaaatttaatgatatacaataatcgtattgttttacattactgtattcccccccccccctctgctgtgtttatatttatttctcgtatttaattatcactaattaagctgacaatgagttaaaaaagcgggatatttatgttgattcataaacaaaaacagcttggatgactttaatggaatggaaagccattaaagctcattcaaaaagattcaaaaaatttatcaattaaaatatatccttatttttcaatacattttttgagctgtatttcattaacaccacagcaatgtttccttatttattttaataattaaaataataaattttcattttgattagctaattaataattacattaattcaaataaacaaaaatgaatcattttttgctgcccataaatctgacaaaaattggatggaaatgggattcatttaatggaaaaaatgaataaattaacagcaattaatcggcgtcaaattcagtcaatcattcagtcattcattcattatttttccattttgttaatgggaaaagcgttccattattacaaataaataaaataaaaataatatttcaattattgtttatttaaaaattcaaagcaaaatgcgtctttatttgaacatccctttaattttgggccacatttttgcgttgaatggcatccaatcttctgcagatgagcagataaccaaaccgtaaacaaaaagcattttaataattttggaatttaatttttcaatttttaattagcactcgactgacgggccacggcacaaaagtgacgaccatccaaattcaggactttgaccaatgctttcctcgtgatgcaaccaaaacttttgggctcgaatttcgtttgccacgagacgggggctgttgtgaagacgggtgaactattcaaatttatgttgttttaataatgtttggcgaaatgtcagggatttttataaaaatgaaagccgtagagaccggtaaagacaggcattaattattcagtaattaagtaaatttcgtactaaaattattgtcaacttcaccatcaaaattcgacaattaattaattttcagacccttttgaattttcaaaaaatttagcttgggttcaaagtttttcaaaatgttggcaattatcaaaaaaattttattttaattttaatagcaaatttttaataaataatttcagtctaatcatttgctacccgagcataatggccaccggagttttggacaacgatcattcagttgatactgtagacctaagcaacgaaatgttcaacattgacaacatcgataatgtgaaagaattttttggcattttaaattaaaaaaaattttttaaatttttttagaatccgattgccgaagaatgccaaaacagagccaaaaagcttggaaattcaatggcaaaactcacttggcatggcattagcataaaacttaacagacaaagtgctgggataagcacggcaattttggacacatcattctgcgagaaaag

SEQ ID NO: 79341 - DNA, 701 bp, Heterodera glycines
  Genomic contig location: Contig_ID=SeqID_15150; Location=584..1284; Strand=+
  SCN-specific regions: Sequence locations=1-176,210-246,274-344,366 -386,448-601,628-701
atgccaatccacatttcggacgtgaaccaagtgattaccatccgactgttaactgataaaatgaaaaatgacaattcgacgaataacacaatcgcgctgaaactttggcacacgaatcaaggaaaggaaggtgggtagaaaattgaaaatttttaggtaaaaccgaatttttcaagaaattaataagaatttttaatttttttttttttgcgatctccttattaaccttttttatcctaccattaggttgaagtttattttattaaaatctttttgaaagcccctgaaacaaagccatgttgaccaaaaaagacctaaatggtcgccctgttttttgcactaattttttcattaaattcttaatatctgctacatataaaccaatcaaaaatttaaaaaattgaaatgtaaaattaatttaaaagttagttttaaatttaaaaaaaagcaattttgcagatatcgaaatgcttagcattcacttttttcttgccaacaattccgtggaagtggtgattggaactgaaacacatttttgcgattacgaattttctaacgaaatattcgaaatgaatctgcaaatttggataaagcagtacggttacaaaattttgtttaaaaacaaacgattgggcaaaagggaatattatcccgcaaaatggtgggaaggattgaaattcaaggaccacaacaaattgacg

SEQ ID NO: 79342 - DNA, 973 bp, Heterodera glycines
  Genomic contig location: Contig_ID=SeqID_15151; Location=375..1347; Strand=+
  SCN-specific regions: Sequence locations=1-133,311-534,556-677,700-973
atgccgccggatgcatttgacgatggcagcatcaggacggcaccgacccctcgggtgcaacaaatggaagagttggagagagaaatagccggaagcattgtgccggaactgattgtgccacaagtgatcgtaggagggaaacggaaagaggaaaaaggggaggacgaagaggaaaagggagacggaaggcaaaaaggaaatggaaaacggaaagaggaaggaggaaaagggaaagaagaaaaaggggacaaagaagagcaaaaaggagaaggaggggaaaaagaaaacggaaaagggaaagaggaagaaggaaatggcagcaaaacatcggcatttttgcaagagaaaaccgacgaacacaacgccaatggcaatgataaggtattatcgtgttagaagaatgaatctgaacagaaattggttaagggaacaacaaattccaaggcgaaaaacgaaattcgaattgagccaattgggacaaaaggacggacaaatgccaaggcaaagcctacggaaattcccgcggaggaggcagaagagggccgagaagacgagcagaggcaacagcaagccgaagaagagccggaacagcacgagccggcgtcgtcgagtgccgtgccgccatctccgccacaaaggcaacggccgacgacccccgaggcgaagagaacggcacggccatcgacagaaatggcaacaacggaggaacagagggaaacaccaaaagggaaaattgacaaagaaaggccaacaactcaaggaacaacaccagcagaagtgagccgaacattcattctgatcacgaacagcacgaacaaagccaattcgccgtccccgtcaattaaacggacgaaggcaacgacaacggcaccgaaagtgaagccgaataaccccgacggggacgagccaatgctaatggaatttgacaacggcaacagcaacattctggcggagagtgccgtgaacgggaaca

SEQ ID NO: 79343 - DNA, 480 bp, Heterodera glycines
  Genomic contig location: Contig_ID=SeqID_15151; Location=928..1407; Strand=-
  SCN-specific regions: Sequence locations=1-19,41-334,357-480
agttctgttcaattgcatttccctttttctttgccctctctttcctttcccttcactcactgttcccgttcacggcactctccgccagaatgttgctgttgccgttgtcaaattccattagcattggctcgtccccgtcggggttattcggcttcactttcggtgccgttgtcgttgccttcgtccgtttaattgacggggacggcgaattggctttgttcgtgctgttcgtgatcagaatgaatgttcggctcacttctgctggtgttgttccttgagttgttggcctttctttgtcaattttcccttttggtgtttccctctgttcctccgttgttgccatttctgtcgatggccgtgccgttctcttcgcctcgggggtcgtcggccgttgcctttgtggcggagatggcggcacggcactcgacgacgccggctcgtgctgttccggctcttcttcggcttgctgttgcctctgct

SEQ ID NO: 79344 - DNA, 2109 bp, Heterodera glycines
  Genomic contig location: Contig_ID=SeqID_15152; Location=808..2916; Strand=+
  SCN-specific regions: Sequence locations=1-12,36-46,77-145,170 -203,280-393,419-561,583-1018,1040-1049,1071-1326,1349-1380,1403 -1627,1649-1786,1808-1919,1943-1990,2031-2109
atggacggatttgaggagaaaaacagaagagaagagatggtgaaaaaggaggacaaaaagaagaaaaagcaacttttagtgccattcattgttattttattccaaattccaaccgaacattttgcttaaaggacgcaaatgcctcagtttcataattttcatttttgaaaccatccattcacttttgtatgtaaatgaattacaatatttttgaataaatttataaattattaataacttttaattattttatttttataattttgattatatttttatgggggtaaaaactttaaataataataaattgcataattttttttttctttaggggtttaaaatctgaatttgtggggaacacccatcaatcagtaatttaccaacaaaaaagtatatcctatataataaagttgagtgtctgtatgtatccgccttgctttgaattggcgtggcgttttgtaattgttttgcgttaaaaaatgatttgaaaatgaaaatgtttttgttttgttttgcgttaaaaaagcatttgaaaaatggaaatgtttggttttgatttttcaatttgttctgattaattaatgcatttgcattgtattttatgtctatgattatagttagtctattattgtattttagtctttgtctattttttatgatttagccaaaaatgaattgtttacttaatttgaattttctacaggtttgatatattgactttctctctgccgcttcggcattttttttttcatcaacggccggtcggccatccatgtcttacccaatacttttgatgtgtgattttagttgaagtttgttttgtttggtttttatgcaaaattatgtttataaaatttagatatgacatgaagaactaaagttttatgatcgctcatggttttgtattcgttgtgaattcattcacaagtttgaaatctgccgtggccatcattcaacagcttgcgattgagtttaagtgcctcatcaaagtttattgggattaatttgtttcgaattatattttgctttgttatgttaattattatgtaaaatttagaaatgagaaccatcatattgaagaaatgctgttggcttacaattggttgtgatttcatctctgaagtgttgaacctgtcggtcggccactcaactttttgctcactttcgagaaattcactacttcaactttggcggccccttttgtaagtgggttgggaagagttgtggtaaatttgccaaatagccaaatatctgataaaacattagtgtttgttctgtgattttagtgtgacacaataatgtgtcttatgtctgataaaacaatagtgttttttctgtgactttagtgtgacccaataatgtgtgtcatgcttttgataaaacattagtgtttgttctatgaatttagtgtgacacaataatgtgtcttatgtcttttgataaaacattggtggtttgttctgtgattttagtgtgacacaataatgtgtcttatgtttttgataaaacaatagtgtttattctatgaatttagtgtgacacaataatgtgtcttatgtctttgataaaacaatagtgtttgttctgtgattttagtgtgacacaataatatgtgtcatgtttttgataaacattagtgtttattctatgaatttagtgtgacacaataatgtgtcttatgtctttgataaaacaatagtgtttgttctgtgactttagtgtgacacaataatgtgtgtcatttttttgataaacattagagtttgttctatgacttcattatgaaatttatttgcaatatgttaaaaattagaccaatataattattaagcaatgaagtgtgcactgggcttaccattggatctcttcaaaaaaatcatggatttgttagtgataaactgatcgtaaatcgtaaaaactttaaataaataataaatttaatgttatgaattcttcatttgattttcatttcaatacctacaactttttgttttattttaaataattaattttcagttatttaatattatggcttcaataaacgatttagattatgttcgagattatgattatgtttatgatttagattttgatgaagttgagaaatgt

SEQ ID NO: 79345 - DNA, 798 bp, Heterodera glycines
  Genomic contig location: Contig_ID=SeqID_15153; Location=1657..2454; Strand=-
  SCN-specific regions: Sequence locations=1-165,229-739,764-798
atgcttctctttgcctcttcgggccaacggagtgcgccacttttggccaaatttgacgcgctttttctccaatcgcttcgacttatccttgacgcgtcaccgacaattgggtgtcatgtgaatgggcttttcctcaggtggcaaatcgacacggccaatggcaaaagaaagtggaggaaggaattggatgcggaagcggaggagggggcgaagtgggaggaggagaagccgtgggatgtactcgacttaccaatcattggaaaattggaggtgggcaccagggactggacgctcccaggagttcggcttgggggggggggtaaccccacttttttagcttgcttttcgcaccactttttaacaaaaatatgtggtgatcaagggggtccgcggtgccgataggtgctgctaggagggaaaatatttacccgtgcctagaaggctttttgctgccaacctctaaataaatgtgtcataaatttcagatttggattaatgaccaaacgtccagaaaactgctgcaaaagtgtctgatcagtgccgtcaacaatttgatcaaaacagtggaaatcccttttaatgcgacgaaacaattcgccttccgcgtccgagtttatggcgatgaatattttgacaacaaatataccgcaagtctgaagatgtgcagcatcaaaacattcaaagcgcttaacctctaaattaatgaagaaaacattttgaacatttcgttatcattttcatattgaatttgtaattttattttagtaataatattattggctttgaatcataaataaa

SEQ ID NO: 79346 - DNA, 438 bp, Heterodera glycines
  Genomic contig location: Contig_ID=SeqID_15154; Location=1..438; Strand=-
  SCN-specific regions: Sequence locations=1-15
atgaataagagaaatgaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaa

SEQ ID NO: 79347 - DNA, 613 bp, Heterodera glycines
  Genomic contig location: Contig_ID=SeqID_15154; Location=445..1057; Strand=+
  SCN-specific regions: Sequence locations=1-39,62-150,172-436,460-613
ttggtctgccgtgtttcttctattggtcgattgtgccaccattcttttttggttctttttggacaatgcaaaaaaacgacgacgcccacacaaaaaagaaatgtaaatacaaaaaacaaaaatttggaaattgcaaaaaaaaatcttcatttttcagctttatctgcggcgattgttggcttttggtgttcgattttcttccgccttctcagctcggactcgaaattgcactggtcagccgccgctttgactgcatcgtcgatgaacacttcaagacacgcaaatggacattgggcgaaatgcgaatttcccacaaaattggagagaatggcaccaagcaaatgcaaattgtcaattccgatggaaaaccattgccaatcccgcaaaatccgttgccgaacaaagtcatcggattccgaggcattacgaacgagtaaaaattaattagattaaaattttcgtctacatttctgcttttcagttacatcgacctcaatgtcatcgcatttctccgccgttttcgtcgtattttggccacttgtgcaatcagcttgtacattagcactgaaaatgttcgcattttggagtgtgctttgctcaacatttggccaat

SEQ ID NO: 79348 - DNA, 154 bp, Heterodera glycines
  Genomic contig location: Contig_ID=SeqID_15155; Location=309..462; Strand=-
  SCN-specific regions: Sequence locations=1-154
atgtccgtctgtccgttgtgtgattcgccagtgccctttgggttggccatgctcgccccgtgtcaccacgttgggcatgccaattgcatcactaattttgtccgccacaatggcttctgctgggtttccaactgtgcaatgcctgtgctggaaa

SEQ ID NO: 79349 - DNA, 430 bp, Heterodera glycines
  Genomic contig location: Contig_ID=SeqID_15155; Location=1888..2317; Strand=+
  SCN-specific regions: Sequence locations=1-155,177-318,340-430
atgccaatgatttcagcatattgcctcctcccaaatgccgatgattgcattttaatttttcatcgaaggtctgctcgtccgtccgctccaacgcttcgtctctttgtctttgtactgctccaatttgtcgtccgacccttggtcattcattcaatgctttttcctcccttcgttttgctattggctcccattccattggctttttccatttggcccatcgttttggctgaacccgtttttgcgttggaccatttgtcactgcaaaaccgtgccaccgatgaaaagcattcgtccgcttccacctccccttcactgttatcgtctgtcgcgttgacaaagtgtcaaagcgactatttgtccgcactgatccatcgctgcatgataagaggagtgcccacagcgatggaggggcgcatttgctttgcggacg

SEQ ID NO: 79350 - DNA, 1109 bp, Heterodera glycines
  Genomic contig location: Contig_ID=SeqID_15156; Location=470..1578; Strand=-
  SCN-specific regions: Sequence locations=1-83,105-509,546-603,635 -814,836-1109
atgaaccgtaaaataactgcttgtggttttctttatgttgcaccgataaacttgggtaatttatcatgtaaaaatcccgatgatttttatttttgaagatttttcacaaccgtcacatgagaaaaagcgttggcaacgtcgctggttcacattgtacgacgatggcgaactcagttatgggttggactcaaatgtaagagaaaattggaccaattggcattcacccgtgggccatttcagtccgacactgtgccgcaattgaaaatggacatgaacaaatgcatcagagtatgcgaggcagatgcgatcacaaaccatgcccacagcattctgatcgcgttcaaaaatgatcggatggacggcttaggcgacggacttttgaagaaggtcaattggccatcggaaattgaatcggttgcgaagacggacgaacaccgacagcacccggttgtgtgctatgtgaaggccgactcaactgacgaaattcgatggtttgtttttggatgtgcataaataaatattctttaaataaaatttgaatatttggcttaaaaatgagcaaattgttttcaaaaggatgggtgtttcccatcaatttctaacaaattattttttatataaaattcattttttaggtggcaaaatttgttacaattttacgcgaaacaaaatgccattcatttgacgccaactcggcacttacaaccggacgaatattttattgaggatgactttcccccggatgctcaacaaaaggagtgtactattcaggtgagtgaatggcattttcgctcaaactttatgttcaccaaaagaagagggttttgtttttgttcgccctcatttaaaatgcgctgtttccttgacaatttttgagtaaaacaaaaaaatatccattttattgctttttttaggggtttttcgttaaatacagccaaaaacatgggtacccccaatgtttaaccgcgttagtgtctaatgggttttgatgggttcccttttttgtcattgggtaaacaatcgtagggacagcagggggaggggtgctccctcactcggagtcgaattctgtcgtgagaatggtctaattcggattttactaaaataaa

SEQ ID NO: 79351 - DNA, 1173 bp, Heterodera glycines
  Genomic contig location: Contig_ID=SeqID_15158; Location=755..1927; Strand=+
  SCN-specific regions: Sequence locations=1-251,367-437,459-1004,1026 -1029,1051-1173
  Gene Ontology: Mol. function=protein binding; Cellular component =axoneme; Biological process=eye photoreceptor cell development
atgaaaaactctcattttgttaactgtttttggctcgttttgatggtttatatcgctaaaacgaatggacaaaacgctgaagcgaccactgaagtgaattcggagcagaatggaacggcaaattttgacaatggcaatggcaatttaaaagaaaatgacaacggaacatccacacaaaagccatctctgagaaggaagccgctaatggaagaggccgagggcggcgtggcggacgaggaaattgagcgattggaggaggaggagaagcagatggagaaggacaaagctgaactgcaggaagagaaggaggaggagggaggggaggaggagaagcaacggaaagacgaggaagatgaggaggagaagcaacaggaaaacgacgaagaatcggaagcgcaaggggcggacgacgcagagcaaagcatgaaagcaaagctctttaaagaaaaggaattggcggaagaaatggaattgagtttggctgattctgaggaggaggcgaagcgagcgaagaagcaggggaagaaacaccacgggaagggcggcgggggccatcgccacaaacaccgaaacggaagggacggaccaacggcgttcattttgccgtcatttttccttcagcgtttgttcagccgcggcgcttttgggccgtcgggcgctccctttgacggttcatcatttccaatgattcttccgattataattaataataacatccgtggggggccgccggaggaagaacatcagctgatgagcagcagagccaatcaccacaatgggccaatgttccaagcggcgcatcactttacggcgccctttccgcccgacttcttcgcgcagcgtcagtcgcccctcggcaccccaattggcggacaacgcccgtcccaccaaaatgccaatgccaatttccccccgacttcgtttggctctctccgagcccaacaatcgcaaggagttcctcaaatgcacaaccaacagaacaacgcctttggcccgtctgccagtgatccgtttccccctttccttcactcaatgcaacaacaacagcagccgattttcccatttggctcttcctcttttgacgggggccgtggaccatcgtcgaccgaaactcagcaagaaaaccaattccaacagaagggccaaacaaaattcagtgaagcgagtgatagc

SEQ ID NO: 79352 - DNA, 844 bp, Heterodera glycines
  Genomic contig location: Contig_ID=SeqID_15159; Location=223..1066; Strand=+
  SCN-specific regions: Sequence locations=1-562,584-844
  Gene Ontology: Mol. function=protein binding; Cellular component =integral to membrane; Biological process=signal transduction
caataaattcccccaattcagccaacatccacaacgagtttggcatttgcggatggattctgaccattctgtcgtacgttttgatcatcctcactttgcccatctccgcttgtatgtccatcaaagtcgtccaggagtacgaaagggccgtcatcttcagattggtcagttggtcttcgaatcccttcaaatgcaaacatttgaccccccaggggcgtctcctccccggcggcgcgaaaggacccggttagatttgattgtcccgaaattacccgtatttctgagcaggcattttcttcattgtgccttgcatcgactcctatcggaaggtattcgccgttccgtccgtccctccgtcgttttcctccattgctccccccccccccaatttcaggtcgatcttcgcgtcctttcttttgaagtcagtccccctcctccttcgtctttatttgccattttaggttcctccccaggaaatcctttccaaggactccgtaagtttcgcctccgtccattggctttcgcttgcctttctcaccccccccctttcggttaggttaccgttgcggtggatgccgtcgtttattttcggtttgtcacctccctcaaaatggccataattactcactcagaatttcaaatgccaccatttccgtcaccaatgtcgaggatgcgtcccgctccacaaaactgcttgctcagacgacgctgcgcaatattctcgggacgaaaacattggcggaaatgctcagcgacagagaggcgatttctcttcaaatgcaagtgaggagcaataataataataataattgtcatcggttattgtcattgtcaaaaacatagg

SEQ ID NO: 79353 - DNA, 560 bp, Heterodera glycines
  Genomic contig location: Contig_ID=SeqID_2366; Location=1419..1978; Strand=-
  SCN-specific regions: Sequence locations=1-130,160-238,261-500,529-560
atggcgatgaagaagcgattgacgcgcatcaaaagcgaatggaaagtgagcggggcggacgtggtcacggtggagaagcggttgggctgcgatttggaggagaaggtgggggggcacagaaagatctggcaaaatttaatttattattaaattaaaattgcgctatttttgcacattttatgccactttttaagttgaaagaaatgtgcgaaccgtccgaaagcgttgaggacagtgtgctgctggtgctggacggcgaaatgtactacgacgtggagtttgacgacgacaagtgggcccgagtgttgttgcgccgcggggacctcattgccgtgccaaagggcacttactaccgtacaacgctgacgccacaggtgggggaagagtaccgtaattcatcgtcagccactaattgagggaaattgcataattaatacattccattctaatgaggcgacaaattaatctaatgttgcagaatttcgtgaaactccaacgcttcaacaaacaacaaaacccaaaaccaatcgcatgaaacagaagtggacagaaggaataaa

SEQ ID NO: 79354 - DNA, 2851 bp, Heterodera glycines
  Genomic contig location: Contig_ID=SeqID_2367; Location=1194..4044; Strand=-
  SCN-specific regions: Sequence locations=1-62,90-263,303-699,722 -937,964-1372,1394-1445,1467-1471,1502-1610,1635-1891,1941-2224,2255 -2374,2396-2401,2423-2851
atggacactttgtgggcaccgccacaacagccaacgctagaaatgcattcgatgtgccacaacactagcaacaacaacaacaatggcacagtatttgctgattattacggaaattgcgactcccattcctacggtagttcctaccgtaaccaacctcagcaacagcagcacgagttgactgtgctgtcgcccgccaatgacagttatgaaacgatggcggtgccgcagtcaatgattggcaaaaattcagcgacggattacggtataaaaattataaaataattattttttgtaattaaaatggaaataacttaaatatgacaaactatcgccacatgttcgatcagtaatcgcaccaaatggcctttcgtgcactgaacaacaacaccttgagccccagttttcgcagctttcgcctccgatgaaattggcacgccccgggccaattgggcgtctcgtggacacacaatgcctaggcgcgccgcagctaaaggagacccggcgccaaattcgaaaagcgcagccgatggcatttggaacaattgcaatggaaatgggcggcgaagcgatggcacaacaaacacaacgacaaatgtcgctaatgaacaacagcggaaacatttgcgaacagtcgccgagcgaatgccaattggtggtgttgagacaggtgagaaagaaattggggtggaaaagcgatggaaatttaaaaatttttaaaattcattttcatcgcttattagccggaggaacaacaccgtgcgcggtacgcgtcggagggcagtcgcggcgcgatcaaagaccgaagcgggacttccttttgcaccattcaggtcccgagaggggagtggaaaatttttggaaaaacatttttctcgattttacgcttcgttttttaccgggttatcggtcacacattggcatatctttttgatagcaatttaaataagaaatgggcaaaatgttaggaggccacgggtggaaattgatctcactcatccgccaaatccgtgagcagctctaccattgagctaccgaggcacattcgcccttttttgatcttatcaatcccagctttccgtttttaattgccctgacagcttcttcggcgttcagggaattgtcgggaagtcccgactttcaaaactccgccatgattggatttcgtctcgttgttgttttttatctgcaaatgctttcccctgcctttttcagctgttgggccattttcggcccactcacgtcgaactttttgccgcccaacggacggacggaaacacttttgttgagcacaatctgtacagattggtgcccgtgtcgggcaagtccgccacggtaacagaacaaataaaaattattccaaattaaaatgcacaaattaaatttttttttttttggacaactccgtgccgtcgcgtagtcactgagcacggcacagaacgattggtggggagagagaggaaaaaagggcaaatgccaaaatgaatttttgattttgcaggaagtcatgctaagacctgagaacggaatggtcgttgtgtaagtgaaacagcaaaaaccgtaataatattcccccggttgcttttccaaaaaacggccaatgaatcgccaagtttcttatttgatttttaaatgtataattgaaattaaaaaaaggaatcttttccgattttgtaatcgcatgagtaattttcataacaaccggtggaaatgggccgtggaatggactaatttgtaattgatgctcgagagtctcgaatattcatttgagcatcacttttgcgagatgtcttttctcgatccaaaaaacaaatggaaaatccctgccagtagaagtgtcccactcatttgtcagattggactgtgtgggcattatgaaaatatgcgcctacggagcagcagccaacagcaaaaacaacagcagcagcaagagcaaaagcagcgccaattccaattcagtgccgaactgctcgagaaacgcggcgaccgccgcaaacggtcggcacagacggcgcacaaagggacggacgacgaacgaagaaaaagcgaaaggaggcggcgacgaagaaacaatgcccatgagggaggagcagcaaaagcggacggagcaacgaaggtgccaaaacgacgtgcacattgtggcacaggcgcaactgccggaggggcgagtgctgcggacgcaaacggaagccatccgatgcggtcggaggggggggggagaaatgccaacaaatttatttatttatttttgccatttaattggagtgaaatttggaatggaattggcaaatccgacgagagtcgggggaattgagtggattttttggtttttatgaaagtcgattagagaatttaaagtgagtggtgttcagtaggcatctaaaaaatacaaaaatttccgatgttttatttttaaatttttgcaataaattggcattttatattcttttgatccccacaattgcagtgcaacagctcggctgtccggacgtgctgaaaatgtcgctgctcgaggcttcgtccagcggaggccaacaattatttatcattggccgaaatttcaaccccaaaaatttgcgggtgctctttcgcgagtacaacaacggtgcgcgacgggttttattgtgatgtctaaattttgcacaatttccaaatttatgtgaacaatttttcaacgaataattataggggaaaaataaattaacggcaaaattacgtaattactaattaggcatttaattaatgcttttcagacggattgctgggatggagtgcggaagcaaagctcgaccaacgacttgtgcatcaggcatttcatccgtttaaatacaatttagtgcttaatttcgccaaa

SEQ ID NO: 79355 - DNA, 750 bp, Heterodera glycines
  Genomic contig location: Contig_ID=SeqID_2367; Location=5295..6044; Strand=-
  SCN-specific regions: Sequence locations=1-229,251-324,365-750
tccgcttctggcgtcacttcgatggttagcagctgcaattcgcgccgcgaattggtgccccaatcgccactgatcaaagtcaaagctgacggatcaccgcaatcgaaccagctgccaacggcagaagtgatcagcgacgaggagggcactattgcaaattcattttgtgcatttgccagggcacaagtcgaaaattcaaaaaaaaaaactgagttcttgggtaatttcagcagaaattagcggagcacagggcacagctcgaccgcaaattggacgtggtcagttgccatcgaatggctgtcgaaatggtcagtgaccagcagcagaagagcagagaatatttaaaagaaaaattgcattttgagaatcataatttggcaacaatgcgaattaaactcgacgttagcgatgacaaaacttattgtaaaaagtcactcgttttagattgaccaactgcttgacagtttggaacgaaaatgccattcaccgcaaagtgacgaagaaaagggagcggcaaaggaaggcaaaagcgaattgacaattgctggtgccgaaaataaacaaataattttgccatataattaattaatcactctaatttgcccaattaaaagtaaaagtgaatctcatttgcccatttcagaggttcaaaaggacttcttccccttcatttacgcaaaggctgaacagttattggttgaccggcgaatggcaaattcattcacgcgaaaattatccgacaaaaagtga

SEQ ID NO: 79356 - DNA, 1243 bp, Heterodera glycines
  Genomic contig location: Contig_ID=SeqID_2368; Location=203..1445; Strand=-
  SCN-specific regions: Sequence locations=1-326,348-819,844-1073,1095 -1243
atgcgcaagcagcgctgcaagttggtggagacgttccgcgccgacctggacgcggatgacatcacggcgaaggcgctggcggagcgcgagttggacccgcgcaagcttttcgagcaggagatgcacaagcacgacgcgcagcgcgagctcatcgagcagaacctgcgcgcgcaggacaacatccttcgtgcgctgactgacgcgaacgcggattttgcagactttcggcgccaaattttggatgccaatgaaaagtacggacgcggtgccatggaaaacagatgccccaaagggtcggcgggaaacggcatttttaattgccatccaagagagagaaaaaatggaatgctatggccttggcaatcttgaggaaaaaccatgacaatttttggcattttcaacaccactaatcgctttggctacctagtcagtgaactcaaaattcctctcaaactgatcaaaaaattatccaatgccgaggctttgaccccaagattcaatacgagtcttgagaacacaagaaatctgccagaatcgtgcccaagactcgataagcattcacattaaaattcagtttttgcctcatttttcaattcttttttgcccaggcgcgccctgcacgcgctgacgttggtcaccgcctaccaagtgttcacggacattgtgcagaagagcgggcaggcggccgacttctacacgcagctgcacaaactgttggctgcgctggagcggggcattgtcaacattgaagcggccaacgcggagtttgcgcgtgaggagcagcgcaagcggcaggcggaggaggagcggcacagacgcgagacggaggcgcgcgaggcacgccgacggcaggaggaggcggcgcgcgaagcggcacgcgcggtcaatgaattccgctttgggtaacgaccgcgcacgcacccggctatgctgctgttactgctccatttccatgcgtgacggagcaattcttaccattttttcacaaatatgatacataaagatacaatatttaatttattacagtatattaccgtaagattggaatatcaaattaatcctctctcttatcactgtcattccggcactttgggggcacttaacggcttaatccacataaagtttatgtgtgcttcttgcacctgttgctgggatttgtttgtgtcaccttctcgaaatagcgaacgccgccatttcacccgccttaggcatttagcggtgtcaaaagtcggctaaaaataaa

SEQ ID NO: 79357 - DNA, 2424 bp, Heterodera glycines
  misc_feature (424)..(424): n is a, c, g, or t
  Genomic contig location: Contig_ID=SeqID_15160; Location=428..2851; Strand=+
  SCN-specific regions: Sequence locations=1-495,517-537,559-638,660 -866,888-1065,1087-1255,1277-2018,2040-2073,2095-2424
ccgatcgtcttgacctgttgagccgtctgaaccaaaaagcggttgaagggcagccgagaattgaagcggtcgaagccgctggcaaacagttggacgaagcgacggcacagaccgatgcccatcagcgattacaggtggtccccaaaaagtgtgccgccagaggcattttttggggacaaaaatggcttagattggcaaaaaatatacacattcttggtaattaaacaattttaaaatttggatatatggttgagtttaacaaaggaataagggccacatggacggacaaagtgactcaaaaattgccggattaccctaatctaaaaatgtcattgatctgaatctggcattggcagcaaaaattgctcgaatttttgagcccgagctggcaggaaaggcgtttcagtgatacagtatttttcanagtagagatacgataactgattaatgaatcttcagtttttaagcattaattgatatgagaagaaaattattgtatacttttctcttcattttatgaatttccatcattttcacaaaattttattaattttttatgctacagtatttttctttaaaaattcgctgtatcgctaccgtatttttcaaatgatccgtttccggtagccttttttttcttggacctttttatccattttctcctgagcatgactgtaacttggatgacgaccaaagatctttcatatgatttccgattgggcttaaggccgaacacgctgatcacctggcccaagtgcgcaaccgctttcgcacactaagcgaccggttgcgtgacagtgtggacggtgcgcgagcggagatcacgcgtcgcgaggggctggcacgcgggctccagcagatggaagaatggctgaacgtgcaggaacgcaagctggcacgcccgcgcgcaatcccgctgagcgcgggcaaactgagcgaattggtgagaggcctaaacaaaatgccgcatttgaagatctacttgcacttaagcttccggtctctttcagattttcaggttcaaaaaatgcacaaaaattgatcagtttgacaaaatgtgctattaacaaaggcaacaagcaaaagcgttaaaacacaaaaaaacactgtcaaaaaaagtcaattttggcattttttggttataattttttttttgagcgtgctgatagacgccgtcaataatttttgcaaattttaacgaaatttatttttacaaatttgctagaaatttcaagaaattttgtcgaaaattttttgttagtttgagctgatctgttcatgacagattgatctgaggtcgattgagctgttctggtttcgaatttactttatttaatcattatcaatgattagtcttagcattgggactttttcagaaatacgaagaccaattggagcgaggcgagttggacaatcgcgcaaaaacattggccgagttgggcgaactgttgggcacagaacggcacggcccccacgaacagttggggcgtcattttggcactgtcaccgaccgtttttggcgggttgaagcaatggcacgtgcacagagtgacaacctacgggatgcggtaagcatttttcgaaaaatatggaatttcgaaattattttttgaattttatacaggttgaagcctttgaacagtggcaacatgccgacgaagcgttggccgagcgaatggcggcactaagcgacgcgatagcccaactgagcgccgcggatgttgacggcgctgagcagttgggcgccgaattgaactcggtggaaaggcgcgaatgggccaagttggacgagttggccaatcagatagttcaaatgccgaatgtggaacagactgatcacctgactagaaaggtgaacaaactaagatggcgtaccattatcaaacaaataaaaagattacggtagagtgaaaatgatcaaatgaatagatatacgataagagggatataccagcagaaaaatgaagtaataagggtgaaactgatcagaatactgattggataaaattggtcaaaggtaataaataatatgagaaaatgaaaagatttgcttgtgctccccctctccgcatctttattaaaaatttttaaatagggcgttaaaaaatttttttaagctgatcaaaaaacatgattcatagacaaagtaatatttggagcagatcaacaccagaattgacagaaagtggtcattttttgtgattgattgaatgagaatgattaaattttgcttggatactgctgacaattatgatatttaacatggtataaatttaaacatcgttttagatgcgttccaatgagtcccaattggcccgaattcgtcgagatttggctgccaaactcgagagtggcgagaagaccagcgggctgcttcgcaaatttcgagaaaatgcacaaaaaattgagactgatctggcagag

SEQ ID NO: 79358 - DNA, 964 bp, Heterodera glycines
  Genomic contig location: Contig_ID=SeqID_15161; Location=1885..2848; Strand=-
  SCN-specific regions: Sequence locations=1-388,410-639,666-964
atgacacatgtgtttttcgatcccgagtcggtcgattggtcatcttttatcactccccaacatggaagaggacagaaacaatattttgtcggaagcaagtatcaacggggattcgggttccttggtaatgtggcacgtttcttgacccctattgcgaggaatattgcctcgagtgcaggacatgaggggctcgccgctgggcagagagttctgagtgacatcgctcagggccgtgatttaggggatgccgtcagggaacattcaagacaggggttgactaaccttaccgacaagttacaacaatgtgggaaaggaaaaagggctctgatcactaataagaatcggaaacgggtatttgatcagttaagtttcatttaaaggtataaatagaataaataacacaaataattaaaaaatgtcaactcttaagaaaatagacaaggcgagtgaggatggtctcgaggggggcctttcgctgtttgatatccccccgacgaacgttgcaattaataaatccagtattagggaattactccctctttcagcaataaatcaatctgggccatatatctttagacttttttcagataatcagttttgcgatctcaataaaacctttctctatctgtcaacttcaatagagagaaaagaaaaaagcaattggattccgattaccaaggacagtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatagtgcaaaatgtgaaacaatg

SEQ ID NO: 79359 - DNA, 489 bp, Heterodera glycines
  Genomic contig location: Contig_ID=SeqID_15161; Location=1047..1535; Strand=+
  SCN-specific regions: Sequence locations=1-154,177-291,313-489
caataaaggattccggagcaccgttgtgttaaaaaataaatgcaaaattgaccacacgcatctgagaattgatgttggacgatgcggtcgttaatgagaattcgttcaaataggttaagatatgaacttaaatcttcattgggataatcgcccaatgaatcaaaatattctatttctgttggcgaatttacaaaacaagcgacccagtgttcacctattgtgcccgcccggtcagtattcgccacaaaacagtacggaaaatgcctgtccttcaattttggcatcttgtcggaagcaaaaaccccgataaaatattttcgggttgtcggatgtttggatagaaatatttcaatctcatgagaattcatcatatgcttccgtcgctactgagcacacgattagcattaatagatagaattgaatcaaattcccccagaactatcatctcatacccgccgtcctttataggctcattaaactgcaccttga

SEQ ID NO: 79360 - DNA, 1108 bp, Heterodera glycines
  Genomic contig location: Contig_ID=SeqID_15162; Location=48..1155; Strand=-
  SCN-specific regions: Sequence locations=1-299,322-791,817-1108
atgctcaatcgaaggtctgcgatgtgtgcgcttactttgggagaaaacatttttgtgtgcggtggatacgacggaaaccacgcattgtgcgcatttcgaattggcttgtagagaatacatttccgttccgtttcaatttcagggattccgttgagtcatttgacatccgaaagaaccaatggttcgtccgtccgccgatgctaaccaaacgatgtgctgcggcaacggctgtcctcaaaggacagatttacggtgagcattttcaaatctttttttctaagtcagcagggacgaacccaagcttttgattttgtttgtatggggcaacgaccgtaaaaaaaacatgggtcgattgattttttgggtttgctgccttatgctcattccttgctgttcactatgcatacgctatctctgtttaagtcattggtgggcataatggtgtttcaattttcgacaccgtggagaggttcgaccccatctcgcagcgatgggaaagagttgcgcccatgcaacagccgagatgtgagctgatgacataaattcggacaaaaaataattgtcacttaatcgtaggtcgtctggcagccacaacataccaaaacaaaatttatgcggttggcgggtaaagaaaaaaacaacattaaataacagttgctttcaattagggctatttaattctaatccgattccggaaaagtgcttttgaaatttgttgttagtcagttttttgttcagctattacaacaccgaattcatgtcgacagcggaagtgtacgatccggagatggtgaattgaaattgttcatttgtctttgtttcacattatgtgctttatcgtaggatcaatggtcgtacattgcgccgatgggtgtgtgcagagctcgtgtttcattagtgaccaatggcgatttgctgcaagcaattggtggatacgacggagaggtggcaaatcatagactattagatatagtaacttaatataacatgaacatgatgaaatattctaaatgcatcttcactgtttttagaacaatttgagctctatggaaatttattacccgtcgcaaaacaaatgggaaaaggcagcgccaatgcgaatccatga

SEQ ID NO: 79361 - DNA, 911 bp, Heterodera glycines
  misc_feature (911)..(911): n is a, c, g, or t
  Genomic contig location: Contig_ID=SeqID_15163; Location=75..985; Strand=-
  SCN-specific regions: Sequence locations=1-362,385-911
  Gene Ontology: Mol. function=actin binding; Cellular component=actin cytoskeleton; Biological process=intracellular protein transport
gaaacagaatatgacttctatgcttgacatttcaatcgcttttgaagaccaagaggactctgatgttaatttggtggactgttcccgcgaacttgcaatttcagctcatggaaattttaacgaattgcgcttatccggcaaaatgtgtgacattaaaattgaaactgaaggcatcaaattcaaagcgcacaaagtcattttggcagcaacagtgccgtatttcatgaaaatgttcggctcggaaatggtcgaagcgcattccgattcagtccaaatgaatagtatgttgagagagactttcaaagcaaaattaattgactataatgccgttttttcagccattgacgcggaaataatgggattgattttggattttatttacactggtcggttgttttgatacccaataatatttctcatccaaattaaggtcgtataaaatttacctcaagaaacatggaaagactgcttaaggccgcagtaagttagcaacatttgcattatttgtctgacaatgtgtcactttaggattatttgcaactctccgtcctctccaatcgctgctccgaaattctaaaagcgcatatcactgaagaaaatgttttttctatccgaaagtttgccgtgctttacaatgcccaacagggttagttcaatcggtacaaattgtattgtaatcactcgtctctttagctgtgctcgacactgaaagttttattcagcgttttttcgagtcggtgtccaagtcggaagagtttctccaattggatttccaaacactcgtccaaaccctcgactgggacaatttgcatgtcggctcggaggagtgcgtgttcgaggccctcgcccgttggttggattttgacccaatgaatcgccacacttttgctccacggtcccacgtgcattan

SEQ ID NO: 79362 - DNA, 1779 bp, Heterodera glycines
  Genomic contig location: Contig_ID=SeqID_15164; Location=342..2120; Strand=+
  SCN-specific regions: Sequence locations=1-23,45-392,414-652,674 -1307,1329-1779
atgaagcaacaactcgattcaactgatgcaaagtcaacgtgtgcttttgatgagttgatggcaggtgtccgcagaaggaacggagaaagcattgacgatttggcggaccgagtctcatcgttagtgcgaagggcctaccccgggctcggcgaacattcatatgatgattattcgatccgacacctcatccgctcactcaaaaatccggatttggcactcactaaactcgacatgatctttgacgaattcgtggccatggcagctcgcgcggagatcacacaaaaatccgcaaaagcagccgagcaaaaaaacacaaattttcgccaaaattttgatcagcgtcggcaaataaattttcgaccaccgaatcagcccgaacatttttcaagacgaaccaacgaaaacgaaagacagaatacatcttttggcgttgtcaaatgctacaattgcggccagcaagggcatatttctcgcaattgtcatctcccacggcgcgatcaatctaattttgccccacaacaatacaattcatcggcaagaggtgccaaccgaacccccattgcaaatgattacaggaacccgccacaaagttttccgaaccgtacccaacaatcgcgtaactttttgcgccaaaactttttggtagaacaacctgatgattctcctgcagtgtccaattcaaatgtcttggttggtgcaattagcactgcaagtgaagaagtgtccaagttgtttgaccaatggacggaaaataagaattgtagaaacgcggaaaagaacggcagtgctgttggaaaaattatgttggtaaaggtctcaattttagagcaaaaggttgaagcccgatcgacaaattgcacgtgtcatagacataaatggaaaagaggtcaaatgttacggtgttgtaactttgcctgttaaaaggcaggaaaggacagtgcaagtgcgtcttcacgtagctcaaacatcgtttggatacgatttactattcggaaccaactcactttcggagttagggttcaaaatttttgacgagttgtcaaaaacgatggtagacttcaagcaaaacgtgaacacccaaaactcggttcatgtgattttcaaaacgactttaatgcgttagccactacacttgttgaaatgacaagttcaacgaagaaagacaaagaattggcaatttttccatcaaatgacagaaaaaaggtgatgagaattgaattgaatgattcaatgttgttcacattgacaggcaaaaatgatgaagaccaaaattcgtccaaatctaaaagtgaaatccaattaaattgtgcgaattcaaaagaattccagcaaatctggcacaaaaaaacggacaacttacgtggagaagaaaagcaaaaattgcaaattctgatcacggagtttgaagacatttttgctgtcagtgattgggagttaacacagactaatttggtccaacatgcgatcgatacaaaagacgcagaaccaatccgaagtcgaatgcgcccaatcccatacgcataccgcggaaaagtggctgaaatggtccaagattatatgggacgtggtctcattcgtccatccagctcaccttgggcaagtccaattgttcttgttccaaagcgtgatggtactttgcgtttttgcgttgattatagaggtttaaattcgatgacgatcaaagacgcatttcctcttccgaacattgatcacactcttcttgcactgggaggaaagaaaattttctcgactctcgatttcatgtcaggctactggcaa

SEQ ID NO: 79363 - DNA, 1623 bp, Heterodera glycines
  misc_feature (38)..(38): n is a, c, g, or t
  misc_feature (109)..(109): n is a, c, g, or t
  Genomic contig location: Contig_ID=SeqID_15165; Location=8..1630; Strand=+
  SCN-specific regions: Sequence locations=1-554,576-1032,1055-1623
atggaatcagaatctgtgaaaaagacaccatttgtacntgagttcggtcttcatgagttcactgttttacctttttgtctttgcaacgctgttgctactttcaacgatnttatgaacaaactttttgtcggaatgattaatgattttctgtttatttacatcgatgacatattggtggcttcagaaaattgggaacaacatatacatcacctacaaaaagtttttgagcggattcgaagcgccggactaaaacttaaaatcgaaaattccgaccacaaaaaagcaacttcagtctttccttgggtttgtgacctactacaggaaattcatccatggatttggaaccttagccgctccacttttccatcttcttaaaaagaattctccatttttaatgggcgaaaaagaaacgcaaattgtgtcggcattaaaagaaaaaatagtgcaggatgcgattttgtattttcccgacttcgcagcagcaatcgaagacccgaaaaggcgctttgtcattttaaccgacgcaagcaaacacggcgtttcggcagtcctttgccaaaatgatgaaatgaaacgcttacgtccaattttgttttgcctcgcgtcaatgcaacaaatacgagagcgattactgcccgacagagctagaagctttggccattcgctttggcaccgaaaatttacccaattcataacgggaattccgacgagagtgatcactgatcacaaagcacttgtccccatgttcgggacgaaaaagagacgggcaacgcaagaattgatcgttggcttatggaattaaattcccggtatcagttgaccgttgaatatcagcccggtaaatcgaatgtcgttgctgacttactttcccgttatggaataaattctgactccgaaaacgatcagcaactggaggaaaatcctaaagaaacaattttggttggaaaaatcgtcgagggcgaaaagtctcagaaagatggaagctttttagagttgggaggtcgaagtgattgggtagaagaagttaaaaacagtgaaatgaagactgtttatgaatttttggagaaaaagacgtgtccgcatagtcaacgagaattccaaagtctaattgacaaaattcatcactttacaatcgtcgacagacttttgtatttttgcgaccctaaaacttcgtcgcaacttttgtttgtccccgaaaagtttcgcaaagagctaattgcatcacggcatgaaggaaaatgtgctggccatttaagcggaaagaaaatccatcgccagctttcggagcactatttttggccgaatatgttgggagattgcgtccgattttgtttgagttgtcgaatctgtgcccacgcgcgcaaatcgcgtgcaaatgaacccccactacaaacggttaacaccgtcgaaccaatggaattggtttgcctcgacattctctcaattggtccatcggaatcaggaaatcgatatctcctcgttatgattgaccatttttccaaataccttgtagcagtcccaattcctgacaaaaacagtgaaacggttgctagggcatttgtcaaaaatttcgtgcttgttctgggttgtcctggtcggcttcacagcgacaaagggggataa

SEQ ID NO: 79364 - DNA, 874 bp, Heterodera glycines
  Genomic contig location: Contig_ID=SeqID_15166; Location=76..949; Strand=+
  SCN-specific regions: Sequence locations=1-74,158-158,180-231,254 -570,593-811,835-874
atgaacaggataagaagcattgaagcgataaagagcgttaagatacaaccgaagtataaacggggcattaagagcaattaaaatcaaattaaaaccaattgaataaaataaaataaaaattcaaatcaacaaaaaatttaaaaattaatcaaattaatcatttatttatattttttggggttggtctaaaacttccgaaaaaatcgattcgaaaaaatgtttgaaaagtcgatttaaaaaaaaatttttttttgcgaatttattaagaaacaacgaatggctgttgatggaagaaattgggaaacagttggaacaaagtctgggaaacctgatgaatgtgaagctttttaacgcattgtttgaccaaacttggccaaatttggcctttttttgcactaaagtagcgcaaaacattgagacagagtacggcacttttttcccttcatgggcatttgcgtgcgatgtaatggtcaggttcaagttggagcaggaaaagaccataaaaaacaacaaaaacaaaacgccaaaaaggggaaagggacaaattcaaaaagaaaacaaaaaggaagtaatccaatggacagaagaaggaggacaaagataggaagaaaaaatcgaagacaaaatgatcattgacaagaagaaaaaggaatgatttgaaaagttcgacaaaaagactagacctggatttttttgaaatttgtctcaaaatgcaaaaaaaagtaagagaaatcaattaattgctttcgaaaatcaaaaaggatctaattgacaataattaggggggcttcgttttagctttgcctatttcgggggggggggggggggggggggacagtgtcgatacgacagtctataatgatgtggacacaaa

SEQ ID NO: 79365 - DNA, 321 bp, Heterodera glycines
  Genomic contig location: Contig_ID=SeqID_15168; Location=135..455; Strand=-
  SCN-specific regions: Sequence locations=1-321
atggacgccacccaactgcagcaagtgcttgacgcagtttttgcacgatttgccggaaatgcggcacctgcaaacacggcctcatcctcactggcacacgcgactctggccagctccttggacaaccggatcaccaaattccactacgattcggaatgcggcaacacatttgaccggtggtttaatcgatttggagtgcttattgaagaggacggaaaggaactccccgaacagaccaaagttcggcttcttcttggcaagttgggagacgacgagtataacaaatacagagacagcattagcccgtcccaaccggaccag

SEQ ID NO: 79366 - DNA, 1113 bp, Heterodera glycines
  Genomic contig location: Contig_ID=SeqID_15169; Location=1204..2316; Strand=-
  SCN-specific regions: Sequence locations=1-3,26-34,139-532,556 -636,699-710,732-998,1037-1113
atgaaggaaaaggtgggaaaaaacagtcacaaataaatgaacataatgccaaacaaatataaaaataaaaataagggtcaaaagtccaacataacattaaaaaatatatattaaaaataaaaacaaaaaaaataaaaaaatcccatcacagttggcgcaaacggtggtcgtggtgttgtgattgaaaacgttggcaaaaatggcacagatcttcctttgtctgtatgtttttttcggatttttgtcactataacacccaaaaatgtaacatagttaattttaggcttgattaatttttcatccctttctcaaaaaaactgaattattacaaaatattcgggttcaaatgatgttttgctttaggctattccctcaattctcaagtgttcgcggctaccacctccgcccaagcctccagggcttcgtggcggtggcctgactcaaacatcaaaaaagaagtatctgtcagatgacactttgtcatctgacagtgacgttcatgcttcaacggggacaagacgtattttgtcttctgaagatgaaaaggaagaagaatagggcaaagaagcaaaaaaaatgttaaaagggggtgacggtcatgtgattttggagttgggaatttgtttttgttgaaggtttaaaataattttaattgtgattatttttaaatatgtgatattaatttaatattttttaatcacattaaacatgaaattaaatcgaattttattgcctcattaaataattgttcttgtagctattccggtggtttagtgttagtacgacgagttcgacagttagagctaaagttcaaactctcataatctaacttgttttgttttaatgaaagggaataatttagtgtgagctttatataaattatggtcatctgtaacaaagctaaatggtactttatgagggcgaatccctggaccccggcagctgagacaaaatcatgaagaacaaaaatgggtgtttttttaagcaggggcagtggtctggaccccggcccctgggaccttatactactattattttatatgagaatttgacttccgccttttttgtttatttttgaatttatattctgcatattttcttaatttgaataaa

SEQ ID NO: 79367 - DNA, 1903 bp, Heterodera glycines
  Genomic contig location: Contig_ID=SeqID_15171; Location=296..2198; Strand=-
  SCN-specific regions: Sequence locations=1-235,267-677,699-992,1014 -1095,1117-1903
atggcaagaacaaaacgaaaaccaaaattcgctagatatggaaaagttgacggccgtaggagatttggacggtacaagcgcaaatacaataaattgctcgggccggcattgcaaggagtgcaaaatttgttggtcacagcgtaccatgagtgcgctcacgcttatttaataaaatatgggcaaaacaacatcgacattttagacagagtaagtagttttcagtaatttaattaccaaaatttaaaattttttttaaaagaaattttctacgagaattctatttttcatgctgtaataagagtgaaatgccaaaataagcatgccctagtttagtggcaaaatccaaagtagatttctagggatgcatagggtgttaaaacgaagaactgtcggtttagttctagtcggttttatgcgttccatgtcatattatgcatcccatgacagattatgcgtcccatgaatgaccatacccagtttcttaggtcataattttttttcttacttggtcaatacctatattcttggtattaaacaaaagcttaaggtctatagaagcttctgtataactttatttttagctaaatgcaatagacaaaaaaattatgctcggaaaagttgaatttcgtttttttcattatcaattctttaataggtcacgattcgagcccaaggaggcaatttgggcgaaactttttggcattatgttgaaggattctacacagatgaagaactggtcgcgcaaattgtgcaatttatggctggacgtgcggtggaactattgatgtttgaaaacgcgcaaggacacgaggaagacgtcgaaagtgcgcgaaatgtggcaatacaagtaacgtacatattaaaattttcatttacattagacatttaaagtgaaatggcaccaacagacgaggcaatcacaaatttactccaacaagcaacagacgcgccgacccaagttttgatgaacaatgcgaggaggttgaaacgagtaagaactacatttaaaaattaagacttcataaaatacttaagctggtaatttaactgatcggaagaaaacactgacggacgaacaaattgacaagtaaattactaaacaaataaaacaaataacaattttttctcaggctctttcgccggtaccgggtccgccatcactgagaccacgcgcacgagggactaccgagaggttaaaactaaaactagtcgcatattaatgcttttttgctctgaaaatcttttattcggttgtcaggtgtcagaggatgggctgggtggacgtgttcaagaagcggcggcgccggaagacgcacaaattttcgaaaaataggagaaggaattgacccctcaggagaagtagcgcctcttttgatccattgactaccaagagagagtgaaaatggcaatttaaatgtataaattggcaaaaatctcagtaaaatatgccaccgacggaccatccgaaacattttgtggaaaacctgttcaaattgaacctgaaaccactcatgttgaagttggacgatgtgatggaagaattgcgtttttctcaactgtccgctaaattggaacaaaaacgacattaatccccgaacttggccaattgaaactgaacactttggacgagccgtccacaaaagcatacgaacatgtcagggaattgtttagggcatcattcaatttaagaaaatgataatatttgcagataaccgaccaaggagtgcgttcattggtggccaaggcatacgacaatttccaactttgcctctccaatctccgacttgtcttttccgactcatttgacaattgcatgaaagcccgggaggaccaatggtcggatgagcatttgctgaaacccacggggatgtgcatcgacatgctcagagccacccaccattga

SEQ ID NO: 79368 - DNA, 700 bp, Heterodera glycines
  Genomic contig location: Contig_ID=SeqID_15172; Location=220..919; Strand=+
  SCN-specific regions: Sequence locations=1-20,42-545,567-700
tttgatttgtcatttgcggccaaaaacaacgatggaaaaatactgggagttctgttgaatgcgcccttcaaattggaaaatattcacgaaagctacagagacattgggcgcatgccgaacaaaaaggaattcggagaaggttaggcaacgtaaggcggagattgaagatgaaagcaaattgttaagagattcgcaatggcccttttccatctcaaaatgccaatcgaatccacgccattctcactttcgtgaatagtcatatcgcactgttgccccccgaagaggatatcaaattagtcgaattgcaggccatggctgtaggtccaggacacgccaggtaacgttgtgttgaatgccaatcactcgctcgtcaaatgcggcactttccgctccttttcaggactggcttgggctccggtatgctccgtgcactcatccaaacggcttccgcaaaaggctattcccatttgttcacctgtgccaccgccatcgcctctcagacggggcttaaaaaagtgagttgtctgaccagcagtgatcactattttatttttccattttgaaatctttgactttacagtttggctttgacgagatcaaaactgtccctttcaactcttttctggaggacggagtgccaatcttttctggggttcacgacaacggagtgggcgcaaaacttgtggcattgcatatctga

SEQ ID NO: 79369 - DNA, 363 bp, Heterodera glycines
  Genomic contig location: Contig_ID=SeqID_15172; Location=1071..1433; Strand=-
  SCN-specific regions: Sequence locations=1-363
ttttcacatttttggtctaaaaatggctcaaatgatcttttattgaagcaatgttgaatttcagttcgtttccgtgtatttaaacaaagtttgaaccaaaaatgtgaaaatcgaaaatttaaattttcgactttttgttcgaattcgggtccgggattaggaattggtctaaatgggcgccggattcgtgatcagcgaccccgaaaaccccataaaaagtgtttttatgacttttgaaaacataaaaaaatttcgaaaaggggggggggacaaactgaactattaccaaaaaaacaaccgccattgctatttttagtatcatatttcgccagagtcatatttttaactttaattggctaatca

SEQ ID NO: 79370 - DNA, 756 bp, Heterodera glycines
  Genomic contig location: Contig_ID=SeqID_15173; Location=372..1127; Strand=-
  SCN-specific regions: Sequence locations=1-34,58-481,503-735
atgaatttcttcattttctttaataatttcattcttattattattactattttgttgatcagcgttaatgtacatggtaataacgacaaaaatggagacaattcaactcaatataaagctaatgacaacattaaaagttacattgatgatcttggcgatgaattttggaatactttgcccacgatcactgatttaccaaaattagacggagttgaatttgttggaaaccatattaaatacacagatgaatcgaaaaatgattccaatgaaagtaagcaataaaagataattaatctaggcatgtttaatggtgctagcgggttgcttaaattccgaaacccatacgcgtttcttaagtctgccagtggggttgaaaacaaaaaatgtgtaacacataaaaattcatctcatggctcaaattcaaccaaatttattattcgaaaatttagcattatattctgatagaacaatacttacatttattaaattataccatgaaaattaatttggtcgagtttgagccaagttatgaatttttatgttttacacattttttgttttcgaacccatttgcggaaattaggaaaccacctgcacgttaaatcattggttaaaggtaccgaatgaaaaaaaaatttgggtgccattgaacaaagctttgaaaattgttcaaaaggatgacaaagattttgaaatttatgagacctgttgtgttttgctaccacacgaacaagataaatttattaaatgaataaa

SEQ ID NO: 79371 - DNA, 87 bp, Heterodera glycines
  Genomic contig location: Contig_ID=SeqID_15173; Location=3088..3174; Strand=+
  SCN-specific regions: Sequence locations=1-87
atgggcaaaattcactactgcaagcgtccggacaacagcacaaagtcgtgcaaagctcgtggttcagatcttcgtgtccatttcaag

SEQ ID NO: 79372 - DNA, 225 bp, Heterodera glycines
  Genomic contig location: Contig_ID=SeqID_2369; Location=811..1035; Strand=+
  SCN-specific regions: Sequence locations=1-6,28-102,127-225
atggccggagttggccaagccgtcactctatcaaatctttgtcagtctcaatttgaatacattcaaattcaaaggcaaacagacgatccatctcgaggtgacttttttctatttttaaaaaataagtatcttcttagattacgaaaccaaccaattatttgaaactccatttcgaatggttttggaggtggagaagggtttctctgaagttagaggatggcaccg

SEQ ID NO: 79373 - DNA, 1278 bp, Heterodera glycines
  misc_feature (1275)..(1275): n is a, c, g, or t
  Genomic contig location: Contig_ID=SeqID_2371; Location=150..1427; Strand=-
  SCN-specific regions: Sequence locations=1-465,487-889,912-917,939 -1278
  Gene Ontology: Mol. function=structural molecule activity; Cellular component=clathrin coat; Biological process=intracellular protein transport
gctacaaagacccattcaaagcttttgaaagacatttcacattgagcaaccagccaattgtcaattaccgttctgatttccaaggcaaattccattttcttgttggaatttcggcaaaggtacttttggttgactaaataattgtttttatattagtatttttagtattaaatgttttaggagcaacaggtcattggctcgatacaattgtacaacaatgaaagcaaaaaatcgcaactgtttgaagggcacaccgcgtgctttacccaattcaaagcggagaacaattcgaaacccatcagccttttctgttacgcggtgcgcagcaaaaatggcgttggaaaagttggactttcaaatttaaaactcgcaaatattaaattgctgagtgaacataaatcagttgcacatagtccaactttcggaaacgcaaaagggtaatcaaccctatcagtcgaagactgacaacttccatttccacaccgatgaaacggacgattttcctgtcgcaattcaggtaaagaactaaaatatatctgataaatggaaatttatgtaaattatttgtcccatttaaattattttcctctagccttccaaatctggtcttttgtatttgttcaccaaacttgggtatgttcatttgttcgacatcgaaactggtacaaaagtttgcaacacgcgcatttcggacaaagccgtgcttttgtcgacagaactgaaagaggctgacgaagtgctctgcatcgatgggtcgggaaaggtccgtcccatttcaaaacggaaatgcatataaacatttacaatcataataggcaattttaaatctaaaaatgactacgaatttattatatttaatgacttaccaaattcaggtcattagtgtcggtcttgataagtcagcaattattccgttcatattgaaacaccataaaaacacggaattggcgcttaaatttgcttctcgttacaatcttgacactgatggggtcactgtaattgtgattaatttacttttaagacatattttccttcttcagtctgacagtaacaacaatgatcaacccgtggctattcaagctcatcaccaatgccaatctgtacaacaggtgcttcaaagaaattcatctgtaaatgcaatgggattacttatgtctgtttctaattgtttataaatttagtcgagcatttccaatggagcaaattctggcatttccaatgggacggcaccaatgccattgttcgagtcgaccccgagaaacgtgcttgttttcnaag

SEQ ID NO: 79374 - DNA, 82 bp, Heterodera glycines
  Genomic contig location: Contig_ID=SeqID_15174; Location=669..750; Strand=+
  SCN-specific regions: Sequence locations=1-16,38-82
gaaatgtatcattatattcttccctatctgaaaatggctcaaaagaagttagggagacgataaaaaatttttcatttattgg

SEQ ID NO: 79375 - DNA, 780 bp, Heterodera glycines; identical to SEQ ID NO: 77421
  Genomic contig location: Contig_ID=SeqID_15175; Location=347..1126; Strand=+
  SCN-specific regions: Sequence locations=1-282,331-588,610-690,712-780

SEQ ID NO: 79376 - DNA, 1494 bp, Heterodera glycines
  Genomic contig location: Contig_ID=SeqID_15176; Location=132..1625; Strand=+
  SCN-specific regions: Sequence locations=1-402,424-538,560-560,582 -1494
atgaaccaaccggatgtccaacatgctcggcccgcactcgtgaacgcaattttgaatcggcacacagaaacggctattttcttggtaaagtttccgccgacatttcgacgacagcaatttgatttccccacatttttcttcattcagttggagaagggtgctgatccgcatcagaccatgattggccaactgaacggcttgaacatgagtgagtagcaaacagcagcagaattggctatatgcactctttatgagttcaatcttcagtttctttgctcatacataaccttacttggtcaatgtgccaacattcttggcataatttttgtttctttgtgtcagtatttgttcttcctgtatttatgaattggccggactttagcctttttgttttatactaagaaagtaaattgaaaattttctttgaaaataatttcaggggggggtctcaaaacagaaaagtaccgaaaaaagttatgggcaaagaaaatgaagattggactgataaagaatgcaattgagccgttatttaaacgttgtcccccaaatttgcagatgtgacactgctttgggccgctgtcgtttttgtcaatttggagctgtgccgtgcgctgatcagccatggtgccaacattgaaatgggcacggactctggccactcgccactgctgtgcgcatgtttcaatggcaatttggagatcggtgagtcaatctcgaatggatgccgttttgccgctgcgtaattgccacaatgatttcccattttcagccacttttctcgtcgagaatggcgccaacgttaatctcgcggacactgacggaatgacgccattaattgccactacctttttgctgcgcctcacttcgccaacaattctctccgatctcaacatcaattcaagcaattccggcacactgtgtctcgatgtgtttgctgaagaaaatgattttgttgggccaaatgcgacgacggcttccactgggcaggcattggcaaatggttgcacacaccgagaaaagatggccaaccaaagcgattgttttgtctgaaaatgagtcacgggcccagcggacattggaagaaaaattgaatgaattattgggcgttgacaaatgatggatcgtatgaatggaaactgatctgaccattattgatgcccattttgttaattttcgatgattttccgacgaaaatattcattgtttcgctattctcatgcaaaaaaacttaaaagaattcacggcttttagagttattaaaaagtggtcataaaaaatagatgtatgtgttattgttagcattgggttcctaatcactaattaccttccatcacataatcagctttctcacctttgttgttgttgttgttccccaatagaaatatgtcttcaccatcgcagtcggatacttccaagccgaacacgcttgaactcagcgggtggataacttccaacccctgcggacatctgtcgacgaattggacggttacaaaa

SEQ ID NO: 79377 - DNA, 589 bp, Heterodera glycines
  Genomic contig location: Contig_ID=SeqID_15178; Location=221..809; Strand=+
  SCN-specific regions: Sequence locations=1-7,29-227,264-359,419 -560,582-589
atgtcacaatattttgtaaatgaaaaattgaaaaggtcagttgatcagatggttaaataataattgcgccaaaatcagtttataattggggcaaatgacagggggtccaacaagcaaattaagcaaatatttaatgaaagagcgtgggtttaattagtgtacaaaatcatgaattaaaacaatgtttgttctccatacagatttgcattacgattggtaaaagtgccaaattaattaattaaaggttaaaaatttattaaatagtgaaagaaaaacagactaaaatgatttatgagcctaaattcctatttaacctatcaaatttcgctttttattaaacattaaaatctttcaattgcattttattaaaaataaatgataataaaatcaaatatcaataaaaaaatattttaaaaatcaaattgtgttgaaagttgctaactttgatattttaatttccaggtccataattttcggtatttttattactattttcaattcaatatatcaattgatcgttcgtatcgctggtgatccttcactttctaatcaatttgttaaaaatctttttaaaataattttcatttta

SEQ ID NO: 79378 - DNA, 402 bp, Heterodera glycines
  Genomic contig location: Contig_ID=SeqID_15178; Location=971..1372; Strand=+
  SCN-specific regions: Sequence locations=1-140,162-356,379-402
atggcattaaaaaggacgaaaagcgatcagctttaccattttgatacacaaaaaatggaatacattaatttaatttcaacaattagtattcttattttttctttttcattgtttggcccaaatttttatactccaaggtgattattattattattattatttaattttactaaatttatcaccataaattttatataattatagtgatgccaccgaagaggaacaattggcaatgaaatgcaggcagagatgcggcatacggaatttgaattttgttgtgaacgacgatgatgatgccacggcaagggtaaaaatcataaatttaatcacaaattgaagccgtaaagctgttataaggggaggggaggtgagggagggtgttatagccaaaaaaccgaaaaa

SEQ ID NO: 79379 - DNA, 521 bp, Heterodera glycines
  Genomic contig location: Contig_ID=SeqID_15180; Location=351..871; Strand=+
  SCN-specific regions: Sequence locations=1-70,93-521
atggagaaggctccccaaaacgacacgattgatgttgttgtgcacgaagtgggtacggaacacagttccaaggacaaaaacaacatcaacaagtcacctttgaaaaaaaatgcacatcattcaatcgagggttcgcggaaaatggctaacaaaacggtctttttggcaaaagccgtaagctatgtgagcgctcttctgatgaaaaacggagaaactgatgtttcggagaaagaaatggatcgtgttcatcagcggcttttagatgtttgtttgtgattggcggtctattcaagcaataataatttttggcattaatttagatgcgttgttcaagttacagtgggtacgacactcataatctttggcgtgcttggatcaatgtgcgaaatacgcatccaaatacatatcaagaagccatggaggggaagtttcacattctcaaaaatgcaccaaactatgggggtccgccaaaccgtgcatgggacattctgcgccgcaaagaggaggcgaagacaagactg

SEQ ID NO: 79380 - DNA, 991 bp, Heterodera glycines
  Genomic contig location: Contig_ID=SeqID_15181; Location=218..1208; Strand=+
  SCN-specific regions: Sequence locations=1-198,221-328,352-365,390-991
atggcaatggcacagcagctgtggggtctgcgtggggtgaaacgtttcagagatgctgtaaatgcatcgaggtaaacttcttttgattattttgctagcctttttatattaattataggatagagcgcgtgaggaagatgaaggggcttcggatgatagtgctgatgatagcaaaataattcggagccaatctacacgaagtgaagagagtgaaaatgaatacgacaaaaatgtttgatgtgggtacgatacttttggtgtttttgtacattatgcgatgcatttttattctttatttgttctgattaaatgcttcgcaataattagctgatcattttcctttaataatgtaaatttccacaaaagtaaccccgaccccaaaccccaaaaggaccattcatacggtagaagctctttgagcgacaaatgcaaaaaaatggaattaatttgcatactgatccgcccatctattgcagcagaagtcagggaataattatttggaatcgtttgccgtgctcggcacgtcagtttatcaccgttccaccaaagtactgcttgcccatgttgggcaccatgctttttttcggcatttatcgggcactggtttggtggaaatgcaattaaatgcagaaattgttgataaataatgatcagctaattatttgccaatttcctatcacgagtaagatagatatcataattaaaataatttgaatttttggaaaacggccaaaataggtgctaatgttcgaaaatgccaataggtgctaactgtaaacccctgcttttaagttttatatgccaactcatcattctttttgcttagtttgaaaaattttttaaacctaaaatgggaaacgttctgaaaaatatgcctttttaaagaatatgaaaaatcggcgaaaatttgaaattttcgatgcggtgccgattagggggtatattttcgtggtctcaacgtgtaattgggttgaggatgacaaatatcaaa

SEQ ID NO: 79381 - DNA, 1095 bp, Heterodera glycines
  Genomic contig location: Contig_ID=SeqID_15183; Location=581..1675; Strand=+
  SCN-specific regions: Sequence locations=1-631,653-717,740-1095
atggtccgcgccgaagtgaccccgaccccccatcgaagcctctattgcacttttacgtgtccaatcaatgacaatcatcagtttattaggtcgatattcttacacattctgcctacattcttggtatgaagttaatttttcgcctaactttaagaaataagcacgtcgtataatttcttggcaagtgagaccaaagttcaattctatttaagcaagtccacttttaagctacaaactatgtaagtaccaaaaagtcagtagaagataaaagacaaaaacaattaattgacagccaagggatttgaccccgaagacagccgccttaagtgaccaacattaaatttcgaaaaattgaaattatatttaatagcctgattctaaaaccacctatgagttttacaccattcaggatttggattttaccataaatcatttttagaaaaaattaaaaaacttggacaatcatgagtgaaattcgtcgacaaaatcagattttaaatttgaactccgattcatgatcagcgcaattttttaccatagaaaaagcgcagagacagacccgggactgaactggtcaaatacctatgggactgaaccgtcactacttaaaacgcatggaataccgacaaaatattcctctcagtatataaatcacgaatccgaaagaattattaagcgcaaaaaaattgaaaaaattattggtcagcaaacctccgaaaatgactttaaaaaataatttaagtgagccaaaaacgaaaacgttttcaggtttctgaattacgcaaaaaggagcatgcgaacacggagcaagcagtgggcgcccgagcgagcgaagggttgcgtgcgcctggttaaggccgggccgaagtcttcacttggtttttttaataatcggaacccgtttttcccatggtttgatcactgatcagaatctgtggtttcgattactggtttgaacacttttgtcatagtggttttgttgttcgtgatcagaatccacagtttgttactaatgattggaacccatcttgaccggatcattgaccaatagggctttgtttttaggcaaatgtctaaaatttctgcgaaaaacca

SEQ ID NO: 79382 - DNA, 121 bp, Heterodera glycines
  misc_feature (83)..(83): n is a, c, g, or t
  Genomic contig location: Contig_ID=SeqID_15183; Location=162..282; Strand=-
  SCN-specific regions: Sequence locations=1-121
aaattagtaaaaatacatgtcagattcgtgattagcgacctttaaaaccccggataacaaattatcatggttttttatcttanaaaaattttgcaaaacaaaagggtccctcccccctttt

SEQ ID NO: 79383 - DNA, 1570 bp, Heterodera glycines
  Genomic contig location: Contig_ID=SeqID_15184; Location=837..2406; Strand=+
  SCN-specific regions: Sequence locations=1-124,146-169,203-245,268 -325,347-435,464-816,838-1570
atgcgaagggccaacagcacaccgaaaaaacgacgaaacccctcaaaaaaccgggccaattctgctgatcatcccccggcactgtccagaaatctctcggcaagaaagcaatattttgatggtaaaaaggaataaataaaaaattgcacagttttaatgttataattagtgtttgtttaattttatttttaaacggaaattttttctgttccgcgacaaaatttctttttttttgttgctcttaatttttataaaatttttgaaaaacgagcgtccctttgatgcggtaaggcgccgttgaggagaggaaaaatcttagtgaaattttgaaacatttttattcaaaaagtggacaattttgaggattttgccttatatgtaaaataaaaggaatggcggcccgtgtgccaaagaaacgatgggaaaaattattggaaaataataaattaattattattttttagataccgtcgattttctaaataatcagtcgtcatcaaaaggacggaaaagtgacgtaaatggcacattatgggaagaatttgaagcgggaagagtaacgcaacttccattgaaagaataccatagttcaatccctgattactttgagcgggaacgggcaaaaacagcccgcaaaaaaactgtcgagaagagcttcacaggtattgtaagcgcaaaccagggaaaaaacatcggaacgccaaatccgaagacctagctttttctccaagaattttttttttgctgtaatttttcaaaaaattataggtgctttgcgcaaagatatcatttaaaggcgtttcgcaaaaaatgactactttttggttttgtttaaaatttcgaaaaatttaaggaaattattcgtcttgcgatgccaataagtgttggcggacaaaattggttgaaggaatatgaaattaattttcaaaaaactttggaatttttttgttctttttcgtgagagaggaattcccgtcccttcctttaagacaggtcttcagatgtgtccccaattttcaacaatttttacttttttcacgattttaagagggttcggtaggcattttagagaaaatatgttaatttagtcgaaaatcataaaaatcattttcaaataacgataaattttcaaattcactgctatgtataggaagtattttgttcattttaaataatcttttccatgcccaaataattattacatatttgaagaatgattaccgtatattgccaaatcactgtttgaaataatttaagctaaacaatttttgcacttcattggcatattgtaaaaaccaaagtgacgctgaattcaaagttaaaaaaacgaaaattttcaattttttttattatgcacagaaattttggtatgataatatgcacaaattactacgatagcattgaatttaagactcagcgctgaagaaaaatcggagtcagaaacggaaatcgctcaagaatcatttggagcaagaaagaactaatgattaccgagaaatggcacccaattggcaatcagcgggttaccgtgactcatatggaagtgacagttactacagaacgtcatacg

SEQ ID NO: 79384 - DNA, 1738 bp, Heterodera glycines
  Genomic contig location: Contig_ID=SeqID_15185; Location=173..1910; Strand=+
  SCN-specific regions: Sequence locations=1-261,349-366,388-452,560 -612,647-663,708-948,1050-1110,1142-1171,1296-1347,1369-1461,1483 -1491,1521-1619,1641-1738
atgccacattttgtgccacaacgctccgccgttcgttccaccacaattcacgtgccctcctcctccacttcctcaactggtgaacgaaaaatcactggcgacggtggaaatggcactgcttccgctcggctggaactaattcaacaactgcaattccgacgtcagcacagctcgccagccgttgttgaggaggactatgagcgaagtgtacagtttgaagactgtgtatcaatgaggtgctaaagaagaattaattgttcgatttaattcaaaaaaaaaattactttatttcaaaaagtttatttaaatttcatttatttttaaaaatttttcaaattttaaataattgtttttgtatatccgttttgaatattttaaataattttcattctatgagaaaagggtacacatattatgcgccttaatgaggtggaaatgattttttgtgttccaatttatattaaaaaaaaaatttgaattgttttataaaacattattaaatttaaaaaaattgagtttattatccttctatataataaaataattattaaataatttacaaagtttaaaagaatacgattctgggctaattcttatttaataaaccaaacgaattaattaacaaattttaaaatattatattttaggcatattttttcccccaaaaatttttgaatcttttataaaattaaattcataatatttttcatcatcaattaatgtattttgttaaaaaatatagcaaaaaagagttttttcaggtccgtttctgcgtggtccgcatttgacgacattgacacagagttggagcccaagcatgaattccaagttaaaactaataaattaaacgaccatcataatcgccaccatgacaatcaaaatgtgtcaaaaactgttcatcaattaatgggaaatttgttcaaaacaggtaagccaattaaacagatgaattaaataaatattatattaatttaatcgcattgttttttagtctacattataattaagaatatcatgattatttttttaaataatattattataattaagtattaccaaatgttttaaacataatataagcttcgtaaaatggcatctttgatatcttggttaaattaaataaaattatttctaatttaatgaattttctgcttttttttgccgattctagatatatatatatatatatatatatatttttttttaaattttttcattttttaaaaacatttttatataaattattttttatttttccatttcttaaaatattatttattattttcaaaataaaactttccacaatccgtcattcgtaaattgaattttccattcattattcgtgtgtccaacatttggaattttctatgttcatcttcgtctgttggttgtgtaatttaatataacgctgactttcatacatatatcaaagtctcacatgtcaattccaaattaattcaatttcatagcataacagaaaaagtacacccgtaaatattatttacaaattttttttttttggcatttttgatggcattttattcatcggcactaaaatggcgcattgccctcaaaacaaataattttttgagtctcggcgctgccagaatggcatagttatcccaaagaagaaaaaggcaccagcgggggacgctcgtgggaatatttacttggttttcatggaggaatttttgtgccacaatttcttcccaccctcaccaccacaacgccaaaataa

SEQ ID NO: 79385 - DNA, 453 bp, Heterodera glycines
  Genomic contig location: Contig_ID=SeqID_15186; Location=42..494; Strand=+
  SCN-specific regions: Sequence locations=1-228,307-331,356-412,434-453
ttacaaacggtttcggcaccgcgctgaagcacttgcaaaacggaatatgcacaatcgaaggcccaaaatttgttgatgcgttacacgcacatgcagaaaatgatccacgaggtgatcatcacggaacgccaacaacattggcaacatcaacaaattattgctgatctgccggtgcaagcaatctccgaaacaccacaagcatatgtgctccggtccaattgattatagatatatttattataaaattgataattttaattgtctttgcatttaaattttaacaatttttttaaataataattttttgcttaatataatagaaggaattattaatggttaaaatttaaaaagaaacaaataattacaatattgtgttcattgaatttatgaatattcttttttattgaaaaggaattttcttaaattatatattaattgtacaaaactttttca

SEQ ID NO: 79386 - DNA, 1294 bp, Heterodera glycines
  Genomic contig location: Contig_ID=SeqID_15188; Location=287..1580; Strand=+
  SCN-specific regions: Sequence locations=1-351,373-593,624-630,660 -778,800-1294
atggccaccgttttttgtcgtgacagattcgcagtgccccgcgagcatctgagtaccgtaaggtggtgcaccatttggttacagtacattttatgacttaattgtacagtaattgccatcgtggatttgacttgttcatggcatttggtttttatttagtacattcgcgacagttggaagccggcggtggagcggctgaatgggccggtggttttcgtgtcgggcagagatgggactgaactggcagaggagaatggccaacatggggacattttgcagttggattttgaggactcctaccgcaatttaacgcttaaaatgatgggtaagtgaaagggaagggtcaattaaaagtaattaaataattaattaggcatttatcgcttcttcacggagaacacaccggtgcagcaaattgtggtgataaatgacgacacaattgtaaatgcgactgcactggaccaactcttacgagcgcaagtggtaataaaatgaaatgacaattacaaaccaacacattaatgagaatcaattacaaaatgacataaaaaacgtggaaatttccaatttgcgcatcggtgtaaaaatatgccaatttttattttttaattttctaaaaatatcacgttgaactttattttaaaaaacatttttcaaatgctttagtatttttatgaccgaattcgcgagaatttctttcttcacagaaaagggcaaaaattaaaaaaaaacccaacaaaaaacattttaaaattgatgcgttcattgtcagatgcgatagattaaattaaactaaaaatacatttgtgaatttcagccctcacaagtacaaaagggcgaaaatcggtatatgatcggcaaagtgtcgcgagcttatccccgaattgtattcgtaagttcagagtaatttttagtgaattccaagggcgtagccaaacccttggcttcgagagggggggggggggggggctacgccctttctgtatccctttttcttttttcatttattttaattaactaaatccaattttgctcctttccttctccctttagccgtggttgccatggcacgtcggctcggagctgtacccgcacaagtgctatcccccatttgtgcaggtcaccttagcaattagcaaaatctgttcaataaccattttaatattcccaatttttcagggctccagtttcgtaatttcgcgtgccgctgctgcggaagtgcttcggcacgtgtgcgcttttcccggctttgccattcatctcgacgacattctgatgggactactcaccaact

SEQ ID NO: 79387 - DNA, 321 bp, Heterodera glycines
  Genomic contig location: Contig_ID=SeqID_15189; Location=1395..1715; Strand=-
  SCN-specific regions: Sequence locations=1-70,120-281
atgtttccaatgttcattgagtggattgcattcaaaaatatgaccagcaagcctaatgtgtcagtttttgattaaatttaattttgaaaaatttgaaatttaaattttatcaaattaaagtgagcgctgttgtacgcttggcgaaatggtgggcggaggatgggcatcaattgttggacagtgttgcctgatttgcattgtgatttcggtctccttctacctgattgtttgggctcgtctcaaattggacatcagcagaagtgggcaaagtgaaagtaaacattttaaaattatttaaaaataattaaaatgaaaaataaa

SEQ ID NO: 79388 - DNA, 907 bp, Heterodera glycines
  Genomic contig location: Contig_ID=SeqID_15190; Location=451..1357; Strand=-
  SCN-specific regions: Sequence locations=1-669,692-907
atgagccgactggatctggaagaaaaaaacagagctctgtcacacgaactgcgtgaatttggacaacggcatcatgcgttgcaagttcgcagtgatttcgagcaacaggcagcagctcgagaaattacagtcttgagaaaagcagtaggcgacgtacatgacattcaagatcaaaacgactcgttgcttcatcaaaacgactcgttgcttcaaacaaatgaaaaattaaacaaagaaatcgtcatgctcaaaaaatggctgcgagtgtttttttggctccttgcagttttactaccggtatgtatgcttgtagtgcttttacactcacattactaaatcgggactatagcccatcgccgtttttattcgtggaatcatgagtggtttacgttgttctgccattggacttcggtgcattaaatgctgcctcctttggttcctattaatttaaatagcaaaatactgaaagtcgttcagtttttgtggctggttcccgggcatttggtatgccttaaacatcgtacgagagcaagaaacaaacgaaagcaatttctccaatcacttctttctcacttgattttttgattcttcactgtcaggcggaaatgttttgtcatctgtcattcatttttaaaaaatcatgaaaagattacctaactcaggaaagacgttataaattttattttacaattcatccaattttataatcactagggcatccaaaaatatgcacataaaatcgcaaaatatgcgcataaaatatgcatcaaaaatggcaaaatatgcacataaaaagtgaaaaatatgcacataaatttttccaaattgagggtataatttttcaaaatttctttaaattcgccaaacgcaaagtaaaatttcataaatggttaaatatggcattaaa

SEQ ID NO: 79389 - DNA, 1012 bp, Heterodera glycines
  Genomic contig location: Contig_ID=SeqID_15191; Location=103..1114; Strand=-
  SCN-specific regions: Sequence locations=1-606,628-1012
atggcggagctgaagtcgcgtcttgaaaatgccaccgattgtacgtccattgacgcgctcttccacaatttgtccgtctctgccgcttcggcaggcgaagcacagccaccgcacgtcggcactcggccgtgctgtttcattgtggacgcggtggaacaggcgtcgccggaaatggttgttgaccgggccggacagtgccatcaatttgagcgacaatttctaccctgtacaggttcaattcctttgttcatgggttcgtcgttcccgcgcttcatccgtcgtccgtcgacgtcccgtcatttgcacttgcgcctccttttggcatgcgcccgcgctgcgtgagttgcgcgccaactgcttgcccgtgcgcgtgcagcggtgcaatcgccagcggatgcagcgacggcttgaagaggtggggacaaaagctagcattttgaatggaccagagatagaattttgaattgtcagatttgccattatgaaggcgtgcgaattggccgtgatcagctggacgaactgttcctttcccacggcagtgacattcgcctctgtctgaacaccctccaattcaacacgctgaaaacgcacacttccgaccgaatccaagccaacagaacgaccaccgggacgacaacgacgacaaatgccaattttgtgagacttttcctttcgtccggcagaaaaccttttttataccgaataatttttccataattaggcctttgtgagcggtgtttcaatcgaccaaaaagtgtcctcctcacatgctgtgccgtccccactaaacacggccgtcaccgtgtcactgttcgacactttgtccgccattttcacgttggacttccacgccgacaagtttgtcacaaaatcaggcactgcatgtgcagttgtctgtgtgccgtcgtgcttccaccggttccgtcacgttgttcagccgtggcatcgtccgtccgttgcccgttcgctcgcgtacgctccaggcactgtttggccaaatgtcctccgaaga

SEQ ID NO: 79390 - DNA, 2073 bp, Heterodera glycines
  Genomic contig location: Contig_ID=SeqID_237; Location=609..2681; Strand=+
  SCN-specific regions: Sequence locations=1-432,454-682,705-922,946 -1529,1551-1577,1600-1604,1635-1822,1845-2052
atgacctcagggtcaattggtgcgcttggagaaagtggttgggccatggcccaaaatcataatgatgatgaaatggtagcagtgcgggtggtaaataagaatgtattcaatggaaagacttcgggttcagtccgtttcgaggacgttgataaagtcttgggtgagatagtccgcctagaggaaggcataaatcgtgtccttcggcatgtcaatcgcaaagccaaccgtgctttgagcaacattagtctattgtctggtgaagttaatactggatttaggactctcacaactcaaattgagacatgtgctgaaagggttgacacagtagcacaagtcaatcatgccgatcgtcaacggagggattcgtccctggattcaaatcgtagcgatgatattcctgctcaggacaaccaagctgagaatgaagatggtttggatgatggccacaacattaatgatcaaactcttcaatgggatgaaacaccttttcaacgtgtcaacatgctgactgatggtcctccaattccgttggaagtctacagggatgattgtgtcatcacatatgacaggtgggccaaacgttttcgtgaacacatggaagcctatggtcggaagttggatgaaaaagaaaagttggccaggctggtcatttatttggatgggataccaaagcgtttgattgagaagatggaagatgcaaagaaaacgacgattggtatggccttaacgaatcttcgtgctgagctggattcgccgcagagcaagagtttatcaagacaagccctgttagcatgccgccaatctgatggagaatcggtaaaggatttcttaaatcgattccgtgaagtcgaaattatgatgtcagctcaatcaagcggtatgccgtttctgcagaatgaaagagttattcatgccgttgaacaagagtcaatgcagaatccatcaacgccaagcggtaggttccaaactttgactccaaccagacaggatagattctcttccaacaattatgaaccaaaccgaagaagaaatcaaacgccaggccctcaacaacgtttcaggcagaaattcgacaatcgaaaccagcagagccaatatagaaatcaacgcccgccaaatgacaggagatggaataatcgtccggtttgcaattattgtaagaaagttggacatgttgctaatgcttgccgtaccagactagcagactttcaaaacaatcagcggcctcaatcttttaatcaacgtgccaaatcggacagatggtcgacaactccttttgcctctggtgccaatgctgtccatcaggatcaaacattgtcgctgcttcatgaaattgcacgaacaatgaacaaattgaccgtcaatactgatcagcctggacgcagagatgatgtcaacaccattgccacttcgacagagcagtgccatgtcaagaaagtacacatcaaggataagtcagacatcagtaaatcagagcctttacaagtctcgtcatgggaaaaagcgactttgggtcccaaaattcaccctttcattttcattgtggctatattttgtacttgtggccctgtcttttcaaatacagcaatgattccacaaggaccaatgctatgccaaactgaaacccaacccactctttggaaattaccagaaattcctgaatgccctattccaaaagtgacagtgggacacgtcccaatttctcaaatcagggaattgtatattcctaatgctatcgagcacaatactaaagcatgggcgtgtaggaaaatcatcaaaagagcaagaaagttcacttcactttcgggagtgccaatcacggaggctttaagttctgttatgctggacgtctctgttgatgagtgcaagcagatgattgaacacaggtcatgcatttttggcatccttacagaaattgatggtctgtggggaacctcaaacccaattgacctgactccgagattctggtttattggctccttctcttggtatgaggttaacagcaaaaattgttttgcatttgagacagtaatctcatctcattttttcaataatcaaagcatctgtatctga

SEQ ID NO: 79391 - DNA, 4976 bp, Heterodera glycines
  Genomic contig location: Contig_ID=SeqID_238; Location=511..5486; Strand=+
  SCN-specific regions: Sequence locations=1-564,587-1299,1322 -1549,1579-1791,1815-2071,2093-2820,2843-3702,3724-3760,3782-4976
gccaaggcctcatatctcacttggaatgaagttgtgtcagaagtaaatacacttcatccatatatggcaactgtgcgtgcctttgtcaataataagcctgtttgtagtctcatggacacgggtgctagtgtaacgctcgctcccatttctttggctcaggacttaaattgccatctttaccctactaatgaaagagtcatttcagcctctggtcatttgattgatgtgagggccaaggccctaatgcacattgaagttgcaaattgtaaaatttatacagaagttaaactggtgaatgatgatggagccgccaaacgcaaaaattacaaactcattattggctgtgatgcgatgaagaaaatgccgccggttacatttgacattgcgaatgccaaactacatattctaaatgggtcaacggacataggcgcagaacgagattggctgttctcagacgtcaaagtggtctgcaatgtctccactgacttgcttccaggacattgcaaagtcattgaaggtaaactcctgtcattttgtgacttaaatcaggtgcttgttcatgacttggacagaagattgaaacaacaaaacattggattcattccaactgtttcagtgtcaaacaatggacacataaaattggtattgacaaatccaacatttgctcctgttcggttgtacaaaggtatgcaaatcgcttcggtgaatcaattgcgattgagtgatgaaggtccatggttaactgaacaaactgaccattcagtatgcgctgtagtcaactccgtcggtgaggtagacccctcattttgcatcgacttttcaaaaagctcggccactggtgataatttaacaaaactgaggaaattatgtgatgaattttcggacatattttcaaaatctcagtatgatttaggttcatgccttgtgggtgagcacgacatcgtcaccaaaacagaagagccagtcgcttctaaaccgcgccgaacaccattcagatttcgtgaagaagttaagagtcatctcgataaatggatcaaagcaggcgtgatggtaaagtctgacactccatgggtctcaaacttagttctggtacagaagaaagatggagggttaaggccctgtattgattttcggaagttgaatgaagttacaattccggatcactaccctcttcccagattggaaatgattcttgaaaagataggaaaatgccattggtattcatctttggacttgtcctcaggttatcttcaaattcgtctcacggacagagcaagcagaaaatgtggcatcatcacggaagatgaaatcttccaaatgacacacatgccatttggccttcgcaatgccacaagtgcatttgctcgagtaatggctcatgttcttacaggtcttgaagatacagtgattgcctatgtggatgactttctgatttacacgcggtctcctaatttggatgatcatttgtctgctctcagacaggtatttttgcgccttcggcaatacaatctcaaagtaagtcctaagaaatgtgttcttgcctcatctcaaatggaatttttgggttttgtaataaatgagcatggctacacaccaagcttaggcaaagtggaaataatcaaagaacttccagccccaacgtcggtgaaagaggtgagaagaataattggaatggcctcatttttcagaaagcacattcttggattctcaacactggttgagccactgactagactcaccagaaaagaggtaccatttgtgtgggaggctgaacaacaggatgtctttaacaaaataaaaagcattctttgtgataaaccagtgctaagattcccagattatcagaagccctttcatattttcactgacgcctcaaatgttggacaaggaggtgcgctgatgcagaaggacaatgataaggctccatttcatgctgttgcatactgcagtcgcactctctcaacagccgaacgaaaatggccaacagtccaaattgaattgggttcaataatttttgcattaagacaatttcgaccattcatttatatgggaaatgttgagctgcacactgaccacaagccattggcttatcttcttcagaaagcagacgctcatccaaatttggcaagatggctcattgaacttcagaactacaacataaaaatcgtccatgtggctggaaaacagaactcactggctgatgcactctcacgagctgcacatgagaacttatccgaagaagaggtaaagaatttaagtgaattaaaggatgtagccgaatttcctgcgtgtcttgtactatcatctgagtcacgcttggtcctcgatgagtcaatcaatgcactcacacttcgttccgatgacggtaagtcttatgtaattaatatgaggcatgaacaacaaatcgatattgaagcctctgcattcattgagtttctaaaatcaggagaaattcctgatgggttatctgacttagaaaaagaaaaattcgctgccacggcctcaaaaatgttaattgattctgaattgcttgttcatcaagaaagtgggctaaggcctaggattttcgttcctgtgtctttgagggcacttgtttttgattcgtttcattcatcacctcttggaggaggccacatgaatcttaaaaagacgctaaagaaatgccgaaaatatttttggccaagaatgcatgcagatatagttaattggactcgtacatgcatcacttgtcagctgaggcactctcctgttcctgcttacagagcagagatgaaaatgccaccagtaaacactctctttgcaaaggtgggattggatttagcaggtccattcccagttacaaaaagaggtaacaaacacataatgaacgtggtttgctggttcacgaaatttgttatatcagttccagttccagatgccaaatcaacaacattagtcaatgcctttctaacaaattgctatctcaaatttggtggatgcactgagttgataactgacaatgccactgccttcacatcagaatttttccgtgaattttgtgcgatgctctacatcagcaaacgctatgcaattcctcattggtctcaaggaacgcctccacagaaaggacctttcgtacttttcacaacatattgtcaaagtacatctcaaaagaccaaccggactttgatgaacacttagaagcggcaaccttctgttataacactgctgttcatcaatcaacgggagaaacacctttctttctgatgtatggtagggacccaatattttgcgttgatcaaattttagacccaaggacagcagacccagttgcttttactgatttaacagaattcaaatatcgtctaatcatttctttaagaatggcatgggcggccactgctgaggaaatccgggagtcccaaatgagggctaaggcccaatatgataaacaaaaccgagttctggatatccaagtgggtgacagagttcttttgaagaattatatctctaaagtaggcacatcaaagaaattccacctaccatggagaggaatttttagagtagtgaacattgatggtgtaaaggtaacaataacaagctgtaatgccccgcaagcaaaccctagggttgtgcatatcaaccaattgaagaaatccttcgatggattaggttgttaggaaaagaagagaagtgggtcacggcccaaaattctgagaatgaggtggaaggagaggaaaagaagaaggatgagggcgaagaagctgagttaaatgaggacgttgagaagaagaaaaaggagtgggctacggcccagaactctaagaacaatgaaaaggaagttgagaagagtggagagaaagagtttaaaaaaagtgaaaagaaaatgaagtgggttacggcccaaaatcattctgaaggcttcggaaacggtggttttggagaacaaaccaaaaaagttgttgaagtgcttcttttggatccggagacatcggcgcagataagagaatatgtggtctgccaactccaaagcaaaggagttgtgttggtatacccaaatccttcgggaaaaaacaactttccgtacttcatctttcttccggatgtgtttgatggcaaatttgaacgtccattgttgcctggtgaccgtgtctttgttgaagattacgcttgggtggaaggaaaagagcatttggacaagtcaagatggatttatgccgaacaaattcgctgtcaagcgacggtcacaaaaattgacaacgtcatttatgccaaacaccacaaagaatttgggttgatcactgccaaatcgctcagaggaaataaagaagtcggtgccatttcggtggttgcgtttggaatgaagagggctatggccctgtatgaacgccaatgtatgcctggacttgagctgaagcaagccattgtgtcggatgtgattgaagtgcaattggcgaaagttgctgaaggttggatgatcggttcgagctacattctgcctcagaagacacccgtgaggcaagggacggaatttaatgctggagcacatggcaagataccggctatggccgggctgtttgaaaaaaattggccaaggaagactgagtctggaattccaatcatcttcccgtttgtgtcagaatataccgaagatgagctcgtaatagctgagaaagtcgtcgcagcagctttaacagtcgcagccgaaacggaagaaatgctgagacttcagacgcagttcaaaggagtagttgggcctgtctgggacaacgtcgacacggagcaggaagaatttcctcgcttcttttggctgcgctttgaaacatcggatcggaagcacgtgaaaaagctggttgatcaatggaccatcgattcacctgttgctgcaagaaaggactacgattccgatgcgtttgctcaaggacaagtcctgctgctgaaaagaagtgccgagttcaaaaacgatgacgctttcttcgtggtacgaatcaaaatca

SEQ ID NO: 79392 - DNA, 2207 bp, Heterodera glycines
  Genomic contig location: Contig_ID=SeqID_238; Location=7771..9977; Strand=+
  SCN-specific regions: Sequence locations=1-270,292-706,729-1064,1087 -1660,1683-1884,1906-2039,2073-2207
atggaaaatcacttaattcctggaatcccttttcttcttgacggccaaatcgccataaaattcttcactttgcgatatttcactagcaatcatcatccagcaccgtttgagatggatttcgacgactggggagtgagacacatgcactcgtccgagcaaggatatttcgccttgcgtgcggttgagttcggtgaccgacaacagttcgaacatgttcttaatttggcttcggccagagatgtgaagaaccgaggaaaaagggtacgcggctacagttatgggcattggcagacggtcaagagagaacacatgctgcgcgtggttttggaaaaatttcggcagaatgaaccgctgtgtgaagctttgctccggacgggctttgtccgcctcgtggaagccagcactgaccgatattgggccgccggattgctgataactgatgaagctatacgcagttcaaataattggacgggtcggaatgagcttggctgggtgttgatgcacgtcagagaccaacttcgaccattgccgcaacaagtccacctgatccacaagcactacgtcgtttgccaggcggcagcgcctgactacgttgtggcactcgcagctgagccacatgttcagccgtatgctgttcggattaacaacgaaactgtcaatgctgcccgacaactgcaaattggcgatactctggtgataggaagtgtggagtggagagaaggttttgagcagcttggggccgaaggaatgaacgacagaccgtgttgggtacaccaggccagattcaactggcaagctacggcttcggccgtgtacagtgtgtgtatgcaccagtgggttcctgccagagcaaagatccttcgttgtgttcgtggggggccaagacacaaccgaactatctgctcaatacgcatccagttggacggcatcgaatttgtattgacacagcgaaatgtcaatggcaacatcaacttggcacaacagggccaatgggttgacgtgtcggcaattgtggtggcagagcattggcacgcagattggggattcattttgcccccggacgctgtgtttagagggagacaccagattgtgtcggatgggcgtgtcagaatcccggtgtttgtggggtgatgcggggacgaagagaagagagtacgttgactaaaagtgtattaaacgggctagactagaccgcttgagaaatagccattttagtgagctaggttcgagaaacaaatagaaaatgacatgcaggcttcggcctgaaccataaaattgcagaaaaagagtcggcaggccacggcctgaatttaattggaaatgatgagagaaatgtatgactgtcaaatatattacggtatcaaaatttaggagcgcagaaggaagttgtttgggttgcggaggacgccgtagggtccgcgaagtcgaagaatcgtgagcgaaaaaataatcggacaatttatgtacaaataaattttctaatcctttcagctgttctccgttcccatcctcaacaacctcgccctgtcatggaagactacacgaccaacgccgctgatcaccgtctctcgacaacttttcaatcacaatttgcatccacttcaggtggatatttaataagatggaaatattattgatttatttagttgaataattaattaaaaacatcaaaattcaaaattaatggaaccatgggacggttcccggttaaggagggaggtgtaaggcgtaaaagggatcagctaatcggagggaagggccgcccctcccgttcactcccggggcccctccttataagcccgggaattccttcccaggcagttgagtcgcgacgatcagctatatcctattcaattccccatccatcgatctcgtcccccttctccagcccagggagagctcagcgcgcgggctacggcccgggatggacaagaggggatccgtgggaccggcacaactctaactgatttttgcggcaaccaattcctgaatatttttgtcgaaaattcaaaatattctatcaaagcacttttatgtggtatttttaaaatgtaaaaataatttttaaatttctcttaaatgtagcaaatatctttttgagtaaaattaaagaaaaatacttttggccccgagtttggcactttttgccaaacttttgtggaatatttcaattttctaatgacagagaaaaggaatgtatcttttta

SEQ ID NO: 79393 - DNA, 1360 bp, Heterodera glycines
  Genomic contig location: Contig_ID=SeqID_238; Location=10359..11718; Strand=-
  SCN-specific regions: Sequence locations=1-79,104-201,223-299,321 -603,626-660,683-836,858-1245,1268-1360
  Gene Ontology: Mol. function=transcriptional repressor activity; Cellular component=nucleus; Biological process=brain development
atgtggaatgatgcgcattatcagcaggcggaacaaatgtgggggaagaggtgaaattaggggggggggtagattttggaaatttaaatttaaaaataaaattcttaagcccacttggcccagtggacaagtacagagtgcgcaagaagcatccattgcctccggcaaacccggaaaagcattgctttaatgataatacggtaaaatttaatggactaaatgcatttgatggaatgcaattttacagcggaaaatactcatggagaattacctgactgatgcctacccgagcccggcaaaggagcagcagctggcgcaagagacaggccttacggagatgcagggtgatgggttaattaattagtgccgggtgattagttaataaataagtgcaggataattagtgaattaatcaatgcatggcaattcgttaatgagtcaaagcagggtaattagttgaggccgaaaatttcctgagacttgacgcgagaccgagatgccaaaaacgggatttaagaatagggactctggtactcaatgaataattaactaaataaatggcatttttgagtcaatgcaatttgttttgactaaaacttgaacaaaaaatatttattaaaaatttcagttggcaattggttcgtaaatcggcaacaaagggacaaaaagaaacagcaaaaagtgcctgatcatccggaagtaaaacaaatttatttcgtgggagacggaagttttgttttttaagcgaattggcgaggagatcaaagcacaaaaacggattatggctgatgcgaaaaaaattttcgatgctgcgagtgctcgtctcgaacaattggagcagcaacagcaggcacagaatgtaccgtatccactagcattttccattttgggcggtggttttgtactgtaaggcataaaaaattaaatttctgtctttgaaaaaatcaattttcgctttcagcagagtttaaattttgcataaatttcaagagtataccgtatttccaaattctcccgccccctaaatagagcctcctcatagtttgaaaggaagaatcataaatactggaacaatcgttttaaaaatgtcaaacctttgaaattttgtaaaatgtatttgtttttttatagaatcgcaagagctcagaatttttgggaaaatccacatcgggccaggcttgacttggaccaaaaaaaaaccgagattgtgattgggatatcaggattttcaatcggattcacctgatttttcccaaagaaaaaacccaagctattttagcgctcttccacgaaaatgccacctgctgatgaattggagaaagagtacgaatttgtggagctgaaagaaatggacgaatga

SEQ ID NO: 79394 - DNA, 651 bp, Heterodera glycines
  misc_feature (599)..(599): n is a, c, g, or t
  Genomic contig location: Contig_ID=SeqID_238; Location=12316..12966; Strand=+
  SCN-specific regions: Sequence locations=1-25,47-651
atgggaaatgttgagctgcacactgaccacaagccattggcttatcttcttcagaaagcagacgctcatccaaatttggcaagatggctcattgaacttcagaactacaacataaaaatcgtccatgtggctggaaaacagaactcactggctgatgcactctcacgagctgcacatgagaacttatccgaagaagaggtaaagaatttaagtgaattaaaggatgtagccgaatttcctgcgtgtcttgtactatcatctgagtcacgcttggtcctcgatgagtcaatcaatgcactcacacttcgttccgatgacggtaagtcttatgtaattaatatgaggcatgaacaacaaatcgatattgaagcctctgcattcattgagtttctaaaatcaggagaaattcctgatgggttatctgacttagaaaaagaaaaattcgctgccacggcctcaaaaatgttaattgattctgaattgcttgttcatcaagaaagtgagctaaggcctaggattttcgttcctgtgtctttgagggcacttgtttttgattcgtttcattcatcacctcttggaggaggccacatgaatcttanaaagacgctaaagaatgccgaaatatttttggcaagatgcatgcagatatag

SEQ ID NO: 79395 - DNA, 2484 bp, Heterodera glycines
  Genomic contig location: Contig_ID=SeqID_2372; Location=1755..4238; Strand=-
  SCN-specific regions: Sequence locations=1-367,391-1354,1492 -1647,1669-1675,1697-1704,1830-2032,2054-2484
atgatgggaatattccattgcgccgaggtcatttcccccaatttcagcgcaatgcttcagggcgtacatggccaagcgcacatgtgcaaagcgttttattctcttcgttctgcattccgttgcggacagcagacaatgcgcgaacgatgcgcaaaagagacggaaacggcaaaaaaaatggacgaacatttgactgaaatgcaatggacggtgagttttataggcgaggaaggggatagctaattgagttaattaggcgtaaatgaatttggatgcaccgcccttccgggattttacattggcaatgtcccccactccacacccttttccctccatgcgtttacattttgccgggctctccttttctgcttctcctccctcccccttttgtgccatcgttttgtgccgtttctcagttggaatccctgggccgtgaggagggctgtcccgccgaggagccgtccaatttggaagagcttctctcccgccgcgtcctccccgccggccgtccgccagtgggggcggcgcctcttctgacactccgcgggccaaccgcgccccaagcgcgtcctttgccaacggcggacgcactgacgccgaaggacaaccaatgcgacgagcaacagcagcaactgttcaacgagtgcgtgcagccgttgaccgcctttcagcccgtaagcattgattggccaattccccgtggattggcatggcatttccccccccccccccctcagcaccctttggccgtcattaaacagccgaagctgatcgaccaagcttgccaagcatttcgcaacttctccgagtgccgtcttcgtgcccaatgctttcccctgtgggctcgcggaatgtccgccatgttcgacttcgcctgtggcccacggggcagcgcgctttactcggaagtaaaaaacacttttgccggatcaaaagctgacaaatgtggcaaatttggcaattaatggccaaacgatgcgaattgccattgttcactttgtttttaaggtacgccaatgcatccgtcgcaacatcgcgcgaccgaatatgaaggtcattttcatttccattcactgtcttttcccttagaaattcttttgctattttccactgatatcccccccccccccgaatttccatttgcttttatcccccggcactttttaggaatgcgtcgtcgccttttcccacggcgcccccaaagacgcgtgtccatccgcgcgcactcttttgagctgtgccgtgccagaactcagtgaacgatgtggcgagaaagcagtgcaatttgtgcacgaatatgtggcggtatttgcaaaagcggtggacccaaattgcgcactgatggggggacgacgagaagaagagagagataacggtggacagagagacaaaggggaaatgagagaaaaggtagaaatgagagaaaacgcaggacagagcgataaagaggagcaaaacatcgaagtggggatggagagcggaagaaagggacgtaagtaaaagcgaaagggcagacggaatgccaaaaataattgttcagctattgccgctttgaactgctccgatgagcagaagcagttggtccgtcactgtgctgcgccgctcgaagcgctgcacgcgcagttgggcgaactgttcgagggcggtctccaaaatgtgctgaagaatctgaacggattggcacctctttttgctcaaggtgcgtcccccgtcttccttattttccctttttcttcccttcccgtccgttggtatccatccctcttccctttccttccctcccactcaatccctccctttttgatcatttcctcctcccccttctcctcagggtgtatgcttggtgccgagttccgtcagtgtctgtctttgttgtcgtcctcctccgctgctgacaatgaatccaatcgttgcgttgtctcaagttgtctcgtggcagccggcgccggcatttgcgatcagccggacgcaacgcaagccatcgacacgcacttgggctgcgtgttcaaacaagtgagcagaaaagacgaagcagcaaagcactgtctgtctgttcaggtgtctgatcctgagttcggcaaatgcctgcgcaccactctcgtgcccatcaagcagttcagcttggcctcccttcgccaagcactgccccaattcgtcgattgtgtccacgaaattgtccagcgcacgtgcggacccattccgttgaatgtgttgcacgtgttggcctcaaaggacaatatttgcccagtgaatgggccaaaagcgacggaacaatcggtgggcggaggaaaaagggcggaagagaatggcaatggaaaatcattggttaaaggaagggaaaatggcatctccggcactccttgcgccaacgacatgcacagcggagatgaagtcggttcttggagaaatttaatgattgaatacatagccattttgcaatatttccaagtgccattaattggccataattggccgatgatttaa

SEQ ID NO: 79396 - DNA, 939 bp, Heterodera glycines
  misc_feature (924)..(924): n is a, c, g, or t
  misc_feature (929)..(929): n is a, c, g, or t
  Genomic contig location: Contig_ID=SeqID_2373; Location=579..1517; Strand=+
  SCN-specific regions: Sequence locations=1-49,71-561,584-657,680-939
atggattcatacgaagttgagagaacaacgacatcaccagtcgagctaagacatcattttcacattccttctgcattgactgcaaacggcggcgataaatctgaggttaataatcagagcattagaaatttattcggaagttttcaaggctgttcgtttttcactaacacagaaaaaacacaaaagtcggctgaatgagcacacgaatttgacatcattcattccatcgcccggcacttatgtcaatgctgcgtttgaactcgacttggcagaaattccgcatcaaaccaataattcaagagagaactcgtggcaagaagatgacggactcgtttacgcaaatttgtcagaaattacacgacggaaggtctcggcgaaacgattgtaaaatttaattgttatttctctttccaggaaatcgaggagatcgatcgtcagccctttccaccttatcccgatgcatctgcacagcctatgtgagttttggaaaagcaaaattaaaaaaccaatgaaaatttagacggataagtaccaatggttggcgcgaatacagaacattgggaggaaggtgaatttttgaaggatgaatttaaaaaagaccttccttcaggacatattactttcatccggaacaaggcatttgccagtggaaagtttgttcctctctttcgcttttcattgtttatttgttgggtttagccaccaagaagtacggacaattacaaacttggcagaagcagtgcaactaacaaccaacaccacgattgtgtgccttccacttccactgacattgcatcgaccgcattcttcgcggaaattccattgcaccaggaaatgagaaaatccgacaatgaagccacactgaacgaggtcgaaattgaggcgaatgaacagcacaaaaaggcaaataaggttgtcctttanattanagcgttaatt

SEQ ID NO: 79397 - DNA, 576 bp, Heterodera glycines
  Genomic contig location: Contig_ID=SeqID_2374; Location=1025..1600; Strand=-
  SCN-specific regions: Sequence locations=1-241,263-494,516-576
  Gene Ontology: Mol. function=Rho GTPase activator activity; Biological process=signal transduction
cactctgagagtttcgcgattgatatgcggcaaacggatgagcaaatcgtcgattatacgcagccttttaatgcccgtttcccctgtttagttaaagacacggccctaatattgcatttttattagaaatgctcactcatggcggacataaaatctttgtgcattgaaacgggaaaagttggttcggacagctcacgaagaaataatttaagagccccggtgagcacgtgaatgtcctcttcgtgatacaaagagtcataggaatctattaaaagtcaaaatcacgactaattgtaatcaccaccttggtcaatttggcatcggattctttggacggccgacaaatttccgttgacgcggtaaagcccatcggactcaagccctttctgttcaataagccgagtcacttcgcagatgaatttgggaacaaatgctttctcccgtgtgcaaatatccgcgagagtgctgccaaagacgggctccgctaaacaaaaagaaaatggcagaaattaaaaaacgcaataataaactttacgtttgtaaattccacgctctcgcagggattccatggaagga

SEQ ID NO: 79398 - DNA, 1644 bp, Heterodera glycines
  Genomic contig location: Contig_ID=SeqID_2374; Location=1693..3336; Strand=+
  SCN-specific regions: Sequence locations=1-12,34-150,172-568,590 -638,660-1644
atgcaaattcacaatttggccataatttttggaccatccttgttttgttccgaggaaaggccgaaccatcaacgcaaggccagccaagacaaagggaagagcgggcgacgcaaatcatccgacaaacggtcacagaacgaagaccaagtgcagacagagccaacacagaacttggcctaccgaatgattgtctatggacagattgttgaattcattcttaacgagacggacaggtaattcaaatggaaatggtgccgaaaatccgaaatttgtttcgaactttcgccttttagacttgctatcttcaggccctctctgtagctgccgtctccaacttcggcttggcatttgcttatcacaggcattcaatcaatgtgattacagtaaatagttgctttttgcacactttcgttctttcatcgttcgcattcattttcctattcgttcattcatttgtcatcgtttttactgaacccatttccggctcaacaaattactgatccgtttttctcattaattatgtgagttcatccattttcctgcttcactataattatctctaccgctttccacggccaaactccaaatgttttgcatctctttgtgtgtagtatttcatgtgtattttttctattgttaatgaagattttttaaataatattagtaaaaacagacggggaatttcatttacggtttaattgaatatcaacatgtcctattccattttatattatttaatgatggggaataattgctttttgagaatgttcctccgatggatgaatttctgactttcggccggtcaattgctgacccatggaggagagtgggctgcctggcggagcccgtccttttggtcgtcgaattctgtcaagttcaagggcccaggtgtgttgacaagggtatttcgttttcatgtgaaaaaatgcttttcctacatttatgtcccaacaggccgctttactggttccccgatgatgggactgtccctatgcatttgcttgaagaaattgccggttggttaaacccattttactgccttaaaccgtactccagtttggcttatgagttcggagaacgtgcatgcgaatttgtgctgcatgttcaaccagcaactcgccgtccatctgcttgttcagtacagcacaatgttggacatcaccgccagggcttttcaggtcgacccttttaaggccttggcccttcgcacggattgcatttcattttattttagcgtcctttcgccattgcttttctgatgccttctcaacccactgcaaaaaatgtcgaagcgttccaacaagcggcggctgaactgcttatgccaatcatcgcctgcaacaaacgttacgtccattcgattttgcgtcaagcgatgctaatgctttcggaacgggaccagcagaatgtgcagtcatactattccacttcagggaacgcacagcaaattgtgatcgtgtcgaacaaactcaagtccgtggttcaaaaggtaatcaaccgacaattcattcgcaaaaatcttggttcaatatttcatttgcagacaaatgcgtggtttgagcgtgtttcagaccaattgtgtgaaagtgacgggtcggcggatgaatgcttttgcgaatgcgctggccccgaagagtttcgccg

SEQ ID NO: 79399 - DNA, 504 bp, Heterodera glycines
  Genomic contig location: Contig_ID=SeqID_2375; Location=469..972; Strand=+
  SCN-specific regions: Sequence locations=1-404,426-449,471-504
atgtccgacaacaacacacattgtcaattgtttggtatttctcgtgaggcgaacgcgacttcgcagtggattaatggcgagaagtgcgaacattgtactgtcgttgacttgggcaaccaaaaaatgcgggcccatgaatactcgggccgtttgcttgcccaattgcatggcaagcgcaacttcccatcagactctgctgttgcggccttcgttgtatccgttatcactgatttaaatcagctgttggtgctggcgcattacgtcaccccggaggctgtcttcaaacacctaagcctgtccatctccgatcagctgattctcttaaatggtctggccgaattcaacgtcaccaaatattccgtaagaatttcttaaaaggaactatctatcaatattatataatttagcaaatgaataagaagaaattcgatagacaaaagtgcataccatataaaaagatgaaattttgatcaaattgtttattgtataaatttatattatcta

SEQ ID NO: 79400 - DNA, 1291 bp, Heterodera glycines
  misc_feature (27)..(27): n is a, c, g, or t
  Genomic contig location: Contig_ID=SeqID_2375; Location=413..1703; Strand=-
  SCN-specific regions: Sequence locations=1-660,682-694,751-765,787 -810,832-1252,1274-1291
ttttaatctttttttacaaaatttttncggttatattgcgtatattttatctgtagttgcgctgcttcaacacgttaatgacttaatcagcttggatgaatgtgccgtggctgacttgggctgtggcacgggaatgcttcttctcggaagtactttactcggagcaaagtggattttcgtaaaatttttttaactaaggaaatttattttaaaggtttgctgttggcgtcgattgttgtcagaatgctctgtcagttgcaaaaaataatatcgataaatttgaattcgaaggatcgacaactacaaatctcgttttggctgatgttacaaaatttgtaccattcattggaaaatttgatgttgtcctgacaaacccaccattcggtacaaaaaacaatcagggtgtgaattttgtaagattatttcacctttgtgaatttacggcttttcaggcaccgatgtcgcttttgtactcgccgggttacgtatgcttaggccaggaggaaaattattctccttgcataaaagcacaactcgaaatttcctcactaaaatggccaaaaactgggacactgtgaacggaatggaatgtgttgctgagctcaaatggaatttggagccgacgtataaatttcataaaaaaacaaatgtcgacataaatgttatcctatgttcttttgaaaaaagataactctaaaattttgtttttctattaaaaattatttatttattagataatataaatttatacaataaacaatttgatcaaaatttcatctttttatatggtatgcacttttgtctatcgaatttcttcttattcatttgctaaattatataatattgatagatagttccttttaagaaattcttacggaatatttggtgacgttgaattcggccagaccatttaagagaatcagctgatcggagatggacaggcttaggtgtttgaagacagcctccggggtgacgtaatgcgccagcaccaacagctgatttaaatcagtgataacggatacaacgaaggccgcaacagcagagtctgatgggaagttgcgcttgccatgcaattgggcaagcaaacggcccgagtattcatgggcccgcattttttggttgcccaagtcaacgacagtacaatgttcgcacttctcgccattaatccactgcgaagtcgcgttcgcctcacgagaaataccaaacaattgacaatgtgtgttgttgtcggacatggtatttgattcagtgctaaaaaagtaaaattaaaagggagaagcagtcgaaggaa

SEQ ID NO: 79401 - DNA, 2099 bp, Heterodera glycines
  misc_feature (1222)..(1222): n is a, c, g, or t
  misc_feature (1427)..(1427): n is a, c, g, or t
  Genomic contig location: Contig_ID=SeqID_15195; Location=812..2910; Strand=+
  SCN-specific regions: Sequence locations=1-55,115-159,181-188,220 -246,268-283,306-395,417-429,451-533,607-675,698-707,757-939,961 -1062,1090-1112,1135-1165,1196-1876,1899-1968,1992-2099
atgaaaggtccctctcttcgaatttattatgattttgttaataatttggacggcgtatatttttaattatttatttttattttttgtaaaatttaattatttttttcattaattctttattgtctttctgtccatcaattcgttcattagaatgtttaattgttttggtttttcatttttaaatgatcaattaattatttactaaaaataataaatattcattcatttttttggaataaaccttggtataattaaaaattaattatacaattatcattttctctatttgttactttcttattgttagcttggcaatgtaaaaagcctattgaattcaattaataatttatctttgttaaacttagttgccaaaatcattccaattgacataattatactattatctttttctttttatgtattatttgcaattaattttaattttattttcgattttgttcagtttcattataaattttttttaattcactatgaagacttaccgtgctgagacgaacctaaaaaagtatcagttataataaaaataattaaatttaaatgttataaagtgagtaaatcttataaaattatatattatgtaataatcaattatgaattacatactcattttatgtcacataaataaataatgattttgcaatttaagaaccgaataaatgtaatttttgaaggaaaattcgttgatgataatatttaaaataataaacacttgtttattatttttttacatatattcattcatttttaagtttctagctagctaatactttctctgatatcgatgtttgaattgaaatacgaaaagaaatgttgcgtaaacataatgctaaaatggctgcaaaaaacgctaaaaatactttttttaatattgacggcattaaatttgatgagataaaagctgcggaggaacggcatgaaatttaagaaaataaaaatattcggaaaagcgtggggattttgaatgccaaaaacatttgatcctttcgttccattaatgagaaagcgagaaccacccattcacttccttcattagtttcatactaaaatttaataatatttttataattagggcccggattttgaagcatttgcttaaattttttgctaacttatgacgccctacggagcacaaaaaaatccggccctctttataatttgtgttttcatttttaaggtccatgaataagccatttctgtctanaccctcttggagataattcaagcgttgcatctactaccacattattttacaatttttgccgcttccagttgtatttttgacgcacaaaggagaattccgagttctctatttttgtatagcatccattctgttcccacaattgttttccccattacaagcttaatcgcccctatttttgttaactgtaatctttcaggcacatcanacggatcgtttgagtctgaacctgtatctgttttctttttctgttgtaagcccggcgaacttttattcaggatggataattgcttgtcaatgaatgttcatcaataggatttgtgactttttccaagtcatatttctcagaatccgtcttttaatttttctagttgtaatggttcacactcagaattatgattggaacgcaacataacaagattttttccttgtcgtatcactgctgtcgaaacaatagattggttattttttccttttcacgcaaatacaaacaacttgaacatgaaatatagatgtcctctttattttcattagtttgaatgtattttctccagtttgtttcgtttccaattataaacatattgttggtcagattcctggcaaaacatttttcaactttaagttcaggtgttaattcaacattttttttactggtgcaaaaaatatttttaattttcccaagtaacgttttagtgtgcatatagaaatctgtatgccttttagttgcagttgttgaagcagctcattaattgtttttatttccttgttttcatagcttttgacaagtgttattgcttcggagttttgtagaaattcttcaaatcctgatttggtgcttgccgaataatcgagtagaaatgagaacaaaataagtttaaaa

SEQ ID NO: 79402 - DNA, 144 bp, Heterodera glycines
  Genomic contig location: Contig_ID=SeqID_15196; Location=545..688; Strand=+
  SCN-specific regions: Sequence locations=1-144
ctaaaaatggtcttgacacgcaaaaaaagcgaaaatttaaagaatatgagcaactcaggtgttgaagcaagacaaaagcggaaggaatggcgccgggagcatgcaaaaaaagctggatcaacaccaaaaaatgacgaaaattga

SEQ ID NO: 79403 - DNA, 322 bp, Heterodera glycines
  Genomic contig location: Contig_ID=SeqID_15198; Location=1725..2046; Strand=-
  SCN-specific regions: Sequence locations=1-206,228-322
acgcagtaagcgaagtattgagacggctacccgacttttggagatttgcaacttggggacccgacattgtggtcccaacttttggggatcccgacattttgggacccgacttttggggatcccgacatttggagtcccgacttttgggtataccgagatttggggaccgaacgacatttggtgagctgacacttagggaacacaacatacgggaacccgacttttggggatcccgacatttggagtcccgacttttgggtataccgagatttggagtcccgacttttgggtataccgagatttggggaccgaacgacatttg

SEQ ID NO: 79404 - DNA, 419 bp, Heterodera glycines
  Genomic contig location: Contig_ID=SeqID_15201; Location=396..814; Strand=+
  SCN-specific regions: Sequence locations=1-419
atgtactcgaccgggtcccagacactacccggactcggttttttgaaaatccaatacccggtacccgacccggtaggtccgggtccaaaagtacactggtaagaaaaatggtttattgtttttttgggaaaaataaaaaaattcaaaaaaccgaaaccgaaacggtataccgaaaatttttcttcggttttttaaccgaaaccgttcgaccgaccctcttgtccggtctctagtttttatacaatatcaaaataataaaatttgaaggaaaaatagtattttttgcaaaataaatattttttggattttttcaggacgcgatacccggattaaaatcttggacccggcttttcaggaccccatcaataccgggacccggtttttgcccaaatacccggacccgtgtaaccctactttaa

SEQ ID NO: 79405 - DNA, 451 bp, Heterodera glycines
  Genomic contig location: Contig_ID=SeqID_15201; Location=1067..1517; Strand=-
  SCN-specific regions: Sequence locations=1-451
gtacgttgatcattccgtcatcgcttttcttcgttccaatcaccaaattttcgacaaaagaggcaccgatttatatttgtggattccatcatcacactctacgaatggccaaccaatttgggatgtttttgcccgtgaaatttggccaattttttcggcaaacatttaccaattgggcttatcccgtggtgataatttcgaccatttgcttcgtcgcatttcgccaacaattctcaccgatctcaacaaattgaattcaatcaaatcatttggtcggttgcccgctgcgtttggtgatgattttgatgtgccaaatgcaacaatttcttctggccaagcgttgtccaaatggttgcactctccgagaaaagatggccaaccaaagcgattgcgttttcgcagaaatttgaacgcacaagcggacttagattgggtcaacaacttcaaggag

SEQ ID NO: 79406 - DNA, 191 bp, Heterodera glycines
  Genomic contig location: Contig_ID=SeqID_15202; Location=1034..1224; Strand=+
  SCN-specific regions: Sequence locations=1-191
atggctcatacaaaatttttttgccttctcagaagccttacgtggatgtgctggacgtggataactgcacaaacatggtcaaagaactgtgcaactgcgggtatgcaaattatgcatattgtgtgcttcgcgttggctacgcgcgcaccccctgctgccccagcgattacgacttggtctgctgcgcgaaa

SEQ ID NO: 79407 - DNA, 1544 bp, Heterodera glycines
  Genomic contig location: Contig_ID=SeqID_15204; Location=991..2534; Strand=-
  SCN-specific regions: Sequence locations=1-79,131-298,320-608,650 -1025,1047-1465,1497-1544
  Gene Ontology: Mol. function=3-oxoacid CoA-transferase activity; Biological process=succinyl-CoA metabolism
ccccaactatttgcgcgccggcacccatgtgcatctgcagtccgagaatggcattcttggcgtcgtccgttattcgacgaattaaatttcaaaaaaaaaaattttgttttgacaattttaaaaaaaatttctccagggtccttatccgtaccctggtgaagaggacccggattggatcaatgccggcaaggaatccatcacttttttgcccggtgcctccacttttggctccgatgaatcatttggcatgatcagagggtatttatttattacatttaaatctttttaattggaaaaagtaaattcaattttcaattttcgtggccatattgatctgacactgttgggtgctctacaagtatccaaatacggtgatctggcaaactggatgattccagtaagttttgactattgctatccattaacaggccccgaatttatatgggctcaaaatccggagataaaatagaaaattaaaaattttcaagaaaaaaggctaattttttgcaaatttttaatcaattttcttaaaaaaaaatcgtttaaatttccaaaaattttcctgatctttaccatatttacgaaaatttttgaccccacaaaatggcaatatttaaatttacttatttattaaaatatatttaattttgtgtcttttcatggtaaaatggtcaaaggaatgggcggagcgatggatttggtcggtgctcccggctctcgagttgtgatcacaatggaggtaaacaaataaagtttaaaacaaattcaattacatagaacaatgctttttctgttttagcattgtgcaaagggtggaaagccaaaaatcctggacaactgtacacttccgttgaccggcaaaaatgttgttcgtcgtatcatcaccgaaatggtcagcagaatgccgtagcaaaaaatgcccctcccccctccctccccaaaaaattctcgatttttcgaaattctgaaatttgttgaagcgacggaattcaaatttcaaaattttattaagcctcgagaccaagaaatttataaaaattaacatagcaactttttgttgtaatgccgtaaatttttgtggtttaccaacagagaccgggatacagggggtgatcctttcaggatcttctcgataccttatccgagtaattaaaagcacctggatcaagaatcccgaaattgtaaacaagatctaatcttgaaatccgatccgggtcgatttctcgattcctcctaatccggaatttttctaaaattcagttctcaattggccaaattaaacactttaattactaacaaattatgtcttttatttcaaaaaaaaacaataatattttcacatcaggctgtgtttgatgttcacccaacggacgggttgagcttggtggaggtgtacgaaacgttctcagtggaagatgttgtgcgggccaccggctgtcaatttaaggtccttcccgatcccctcatattttttcattttatttaataaaaattttcagatttccgaaaatttgaaaccgatgttacaggcttgattgatcaca

SEQ ID NO: 79408 - DNA, 345 bp, Heterodera glycines
  Genomic contig location: Contig_ID=SeqID_2376; Location=1477..1821; Strand=-
  SCN-specific regions: Sequence locations=1-124,154-243,265-345
atgagaggaagagagacgatgagagtgagcggtgaaaagagtgttgtcgctgcttttgtgtacttcccccccccctcttcaccggtgactctcccctcttttaaaccggccccctacgacgaacgaggagagagggggcggggtgggcaggagcacctcgtctctcgtgctacagccggatccctccctttaaacaaaaaaattttgaacgcaaaaaaaaatttttttattcagctgaccgaaacgagccccagatgggcacgaatgcgccgcacgccggaaaattacgcgctgctccaacaaggctacatcaacacggcactgaaaaaggccaaaaaacactga

SEQ ID NO: 79409 - DNA, 999 bp, Heterodera glycines
  Genomic contig location: Contig_ID=SeqID_2377; Location=1816..2814; Strand=+
  SCN-specific regions: Sequence locations=1-293,316-379,418-567,589 -826,850-999
atggctgcaaacactagaactcttctccaagttgtaactatgttacaggcccaaaaatccgcaggattaatggcggcaaacaatgaggtgcttgatgcattaaaccatgccacttgggaattacgttctgcacttgatgcacttaaagagcaaattatagcgcaaaataaagggtcagatgctcaagaaatggacgaagatgagaacctgccacaaataaattatgaaaaccaaccacaccctctcgatgaattatcccacggtcatttgccgaccctcttttgtgagaaacaaacattttattctaaaacaaaatttatttacgtaaatgaaatatgtggaaaagtatgcatataaacattttgatcataaatttcagtaataataaataaaaatacaataaattaagtttaaaatcaaaacatagccaccactgatcgcatgtaagagcacaaattgcagtcaaagatgccctattccgacatggtcaatctgttttaaaaggacaaataacatgcgtcagatttttaaaccgagtacgttttcatcatcaaacggacttgtcgtcagaatattataaattttaaagaattttatggcaattgacatagacaccaaaaggacaaattaatttcatgtatagtggtattggatcccataaattgacccaacttacaacaaaattaagcctttaattattaaattcttatcccatgcacgagtttacacggggaataattcaaacacttagcccgtgtgtttggaagatactggtatctaagtgtgacataattgttaaaaccagtgccatacgggcattgaaaataaagaattttaattattcttaattggaatttcacccatatttttatatatactaacaaaaatgtatcttacagacgaaagctttatgttgttaaaaatgtcctatcgaaatccgctgtataaaaactttcgacagccataactatcaaacaaacattacataaaatagttgta

SEQ ID NO: 79410 - DNA, 919 bp, Heterodera glycines
  misc_feature (67)..(67): n is a, c, g, or t
  Genomic contig location: Contig_ID=SeqID_15209; Location=1034..1952; Strand=-
  SCN-specific regions: Sequence locations=1-23,48-227,274-473,527 -651,674-677,700-919
cacaatttgccaaacccaacttactgctgctggtgctgcttctgctggaattgttccgttgaacacnagtcaatggatcagccacattcttgatcagcaacaaggcgacaacactgattatgagcagcagcagagggaagcaacacagctgctggtgggccgtcggttgtcttcaatgcgatcaatgtgggaggagcggatcagtgaggagagcgaacaaaaagaagtaaaaaaattttgtaaaatttttaaaaaatttcatatattttttttgagtacgaggaacaggtcaacgcagcgctgtttgctcggcgccaatttttgttcccgaaatggcgctcagtagatccgcttactgcttcacttgtaagcattggatgattaaaatggatcattaactaattagagccaatgtggtaaataaagttatatattccacttcaattataaatgattggctaattaggaaattgaaataaattgtattaaagaaaataaaataaaatgaaattttaattttttttttctcataaatttatcatggcctggatcaaggcatgggactgtgtttttttgttgaatttggtttttaaaagctaacatgaaaaaatcaattgattgcttggaacatttaaaaattgtctaattttcaatgataataaaatgtttttaatcctttttgaaaactttaaattaaaacttttggtcgcaaatacatcattcaaattttcaggtggcatcacataaaacgccagagatgattccagtggtgaacaacttatccaaaaaactgatatttgcctaatttaatttacctttaatttaggacagccgaattccgcaatatcggcatcaatcactgatggagaccgagcggatggcaccgtatgccaaagttataaaactttgaaaaaataaa

SEQ ID NO: 79411 - DNA, 424 bp, Heterodera glycines
  Genomic contig location: Contig_ID=SeqID_15211; Location=41..464; Strand=-
  SCN-specific regions: Sequence locations=1-12,34-369,416-424
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggaggagatgaaaatgaaaatgagactgatcaaaatgcaaattttcatcaaaatgatcaaaatgaatcaactgatcagaacgatcagttggatgttcaacaaaaaatcgaaattattcacaaatttcacgcaattagagaaggaattaagaaaaagggaaaatattcggcaaaaatttggaataaaattgagcaaaaaattgcgaaaaaattgggaattagtcgacagaaaatttataaattgaaaagagaattaaaattaaataaaaataaaagaaactcaa

SEQ ID NO: 79412 - DNA, 1052 bp, Heterodera glycines
  Genomic contig location: Contig_ID=SeqID_15211; Location=1602..2653; Strand=-
  SCN-specific regions: Sequence locations=1-6,28-534,562-581,623 -983,1005-1052
atgctttttctcatttttatatttgtgttcttaatcataaacaattcaactgacaaaacattgtcagttaatctgcgtaaaaaatgtcgaccaacttttgctgaaatatttggcgaagaatggcaaaatgaaataagaattggaggagatgaaaatgaaaatgagactgatcaaaatgcaaattttcatcaaaatgatcaaaatgaatcaactgatcagacagatcaattggatgttcaacaaaaaatcgaaattattcacaaatttcacgcaattagagaaggaattaagaaaaaggggaaatattcggcaaaaatttggaataaatttgagttaaaaatagcgaaaaaattgggaattagtcgacagaaaatttacaaatggaaaaaagaaattggattaaatataaaaaatgaccaaaattattacgaaatgaaaaagaaggaatttattgcacgaattgacgagattaaaagaacgtccgaaaatggaaaacagaagcaatttgcgaaagaattgggcattcacaaagaaacattcattaaatggaaaaaagaatttggcattgaaatgggcaaaagtatatttttaattaaatttttaatattttttatttatttatgttagatggaattcgatactccaatgaagaaaaaatgcgcaaaatgaatgtttattataaaatgaagcgagaaaatccgtctttaagtgacaaagaaattgctggcattttgaaaattggatttgccaccctaaagaaatggaaaaaggaaaataattcgtaatttttcgtttttcttatttgtattggtttcaaatgatgctttttattctaatttttgttttttataatttttccctcttttatatgtttgttttttaattgaccaatacaaattaaaattgtcaatttcttttttttactgttttcggtgtagaaaaacccctaaaaaaaaaattcccaattttcttttccgccaccatataaatttcgatttgacaaaacatcgaccaaaaaaacatgattgagtaattaaatgcaaccaaataaa

SEQ ID NO: 79413 - DNA, 1385 bp, Heterodera glycines
  Genomic contig location: Contig_ID=SeqID_15212; Location=758..2142; Strand=-
  SCN-specific regions: Sequence locations=1-157,180-431,453-1291,1313 -1385
atgggaaagcatcaaaaagcgatcagatcagccgtttggaatagggagggcaccgtttttgtgctcgcgtcggaggacactgcgattacgatgaacaacgccgagggcgaaacgctgaacactttcacatgcaacggcgaaatcgcggagttgaaactcaccaccttccgcagtttttccggcgaacgcgaggaagactttgtgagagggcggagagcaattagtgggggtaattagcaaatggaatgccaatcgcaagagaaaatgccggagaatgtttgatcaacctatgaaaaggtaataaaatatcccaccgatcagatcagtgccatcatctctcgtcgcaatttgatgatcgttcggctgaacaatcccagcctaccgaccaatttgcaattccaagagcgatacggcaatttggtgcgcacagaatggtgagagagggcgtggcactgacagaagattggattcgattgttttcaaatttaggtttggcagtggaaatttgttggttggctttggtttgtcaattttttcatttccattggcatttcttttgatcagaccaaggctttatcgtctgtttgtcagctgagcggtcggctgagtctattagccaggaattgttctccatccaggaatacaaaaccaatttggcctccattacggttaatgagccgctgggcaaaatgttttccatcggcgacaatttgtaagaatttgccaccacgaaatgcctgagtaagatctctttttaggctcaaaggacgcgacttggtggatttgggagagatttccgacttggtcaacgtcgactcggacgacagcggactggtcgaagtcgcgtgctcggaggatggttccatgacggcggtttcggcacggtcgggtgccgtttgtgtatatctgaccaaattgccaatgctcgccgccgcttcgtccactcatatcgccgttttggcgtcgttgacggagattagcatttaccaagacggagaaattgtaagggaaaatcaaattgcaaaaaccaatgccaaatcgaaaactgatcatttccaaactgattaactcatctggccaaaggctaagactgatcaatgccaaactgatcagctcatctattcccccttcagcaacccagtcagaatttgaacatcaaaattgagccttcgctaatcgccgtcggtgccaaacacattgccattgtgctgaacagcaaagcatggttttatgaaatcaagcgcaatggcacttcatttatgtacgaacatgactatatgacgaccattgtgaagatgaagctgaaccgcgattttgtaatggcgcagttggacaatcgcgtgcatttgcacaaagttaataccatcctaatcaatcgcttttga

SEQ ID NO: 79414 - DNA, 370 bp, Heterodera glycines
  Genomic contig location: Contig_ID=SeqID_15213; Location=113..482; Strand=+
  SCN-specific regions: Sequence locations=1-96,124-127,149-165,189 -256,293-370
atgaaaaagagtgaattcattgaacgatttgatgaatttaaagaattatatggccaaggcaaacagaaagaatttgcgaaggaattgggcatttgtgaagaaacatttttaaaatggaaaaaagaattggcaccaaaataccacaaaagtaagcgaatttctaactttttaaaattatttattattttcagcgctaattaaaccttcaaattatgacaaattaaaaaaagatgaagcaatattttgaaattaaaggaaaattttaattttatttgtttaattaattaaaaaagcaatttacaacatttgttggatatgaagccaattatggtcaattaattattttttttgaattatgtgcccaaaaaaa

SEQ ID NO: 79415 - DNA, 576 bp, Heterodera glycines
  Genomic contig location: Contig_ID=SeqID_15214; Location=27..602; Strand=+
  SCN-specific regions: Sequence locations=1-39,61-64,96-267,310 -498,520-576
atggagagaaaaattgtaaaattattaggagcaaatctgcaattaatacaaaaatggaaaaatgaattaaatttaaataaaaacaaaattaaaaagcgaatttatgaggagaaaaagcgcaaattcattgaacgatttgatgaatttaaagaattatatggccaaggcaaacagaaagaatttgtgaaggaattgggcatttctgaagcaacattttggaaatggaaaaaagaattggcaccaaattaccataaaagtaaaagaaagaatataattttagtgaaattaaaaatgtaattttttatttaagaacaccataccaatgatgacaaagtgaaaaagatgaagcaatattttgaaattaaagaagcaaacccaaaagtgagtgacgcaataattgccgaaaaattggcaattggattttcaacgatgagaaaatggaaaaaggaatgttcatgaaccatttgatcagtgattttatttgatcatgattttgatgaattatataaggataatttgaaaatttacaaaaatttatggttataaaaatcagccaaaaaaagataaaaagcccaa

SEQ ID NO: 79416 - DNA, 695 bp, Heterodera glycines
  Genomic contig location: Contig_ID=SeqID_15214; Location=1388..2082; Strand=+
  SCN-specific regions: Sequence locations=1-13,49-102,125-254,277 -400,432-608,644-695
atgaatttgtggcttttaatatttattatattttgtatttataaaattgagtccagcaaaatcctaccagattttgatgaaatattcggcaaccggtgggacaaaaatgaaacagaagaaaaagcgataaaaattgaacaaaatgagaacacacaatcagcagaagttggtcaaatggatgaagaaatggaaaatgatcaaaaaaatgtcaaaattaatcacaaaattaatgatgaagcaactgatcagcaaaagagagaaattgtcaaaaaatttgatgcaattagagaaaagttgagggaaaaaagaaaatttgattggaaaatccgaaacaaaattgagacaaaaattgcgaaattattaggaacaaatattaattcaatatggaaatggaaaaatgaattaaatttaaataaaaacaaaattaaaaagcgaatttataaggagaaaaagcgcaaattcattgaacgatttgatgaatttaaaggattatatgcccaaggcaaacagaaagaatttgcaaaggaattgggcatttctaaagaaacatttcgaaaatggaaaaaagaattggtgccaaaatatcataaaagtcaaagtaagaatataattttagtgaaattaaaaatgtaatttttatttaagaaaaccctaagaatgatgaaaaattataaaagatgaagcaatattttaaa

SEQ ID NO: 79417 - DNA, 644 bp, Heterodera glycines
  Genomic contig location: Contig_ID=SeqID_15214; Location=2354..2997; Strand=-
  SCN-specific regions: Sequence locations=1-13,46-182,204-249,271 -405,430-644
atgaatttgtggcatttaattttatttattatatcttttatttttgtaattgaatccggcaaaatccgaccgaattttgatgaaatatttggcgacggatgggagaaaaaagaaagcaaagaaaaattgatgataaaaattgaacataatgaacaaaacgagcaaagtcaaaacgcagcgattgatcaaaagagaaatgaccagaaaagtagcaaaattaatcacaatattaatgatgaagcaactgatctgcaaaagagagaaataatcgaaaaatttgaggcaatcaaaaaaagattgagagaaaaaaggaaatacgaaaggaaacacctaagcaaaattgagacaaaaattgcaaaattattaggaacaaatcgaaaattaatacaaaaatggaaaaaagaattgctgccaaattattttaaaagtcaaatccttttgtatttccctttcaaaaccatgacaatgaatgccctcggcttactgtagactcctttatatcccattattaccatttcaatacagtatgcaacagtaacgactttattccgggaaaggaatgatacaattcttaggctctctacctacaataattcggctcgggaacagatactgcccggggggagaggcccgatgtgaataaa

SEQ ID NO: 79418 - DNA, 316 bp, Heterodera glycines
  Genomic contig location: Contig_ID=SeqID_15215; Location=26..341; Strand=-
  SCN-specific regions: Sequence locations=1-53,76-198,259-316
atgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgaccaagagaatgaatcaattgatgaagagcaagaaaacgatgatgaagaagccggagaagaagaagatgaagatgaaaaagaatatgatagtgatcaagaggacgaatcacaagaaatgcattcaagagaacaaacacatc

SEQ ID NO: 79419 - DNA, 248 bp, Heterodera glycines
  Genomic contig location: Contig_ID=SeqID_15217; Location=311..558; Strand=-
  SCN-specific regions: Sequence locations=1-248
  Gene Ontology: Mol. function=oxidoreductase activity; Biological process=epoxygenase P450 pathway
cttcgacacaagcgcaaatacgctgagtttggtttgccacgcgttggcccttcacgcggaagtgcaagagaaagtccaagaggaaattgactcggtgtgcttcgacgaggtgtcgtccttgagaagtgtagaaatttgaataaataaattcccgttttcaaggacccaacttatgagcagctgagccaattgaaatacaccgaagcggtggtcaaagaaacgctgcgccttttgcccattgcgacgaa

SEQ ID NO: 79420 - DNA, 989 bp, Heterodera glycines
  Genomic contig location: Contig_ID=SeqID_15218; Location=191..1179; Strand=-
  SCN-specific regions: Sequence locations=1-267,294-406,431-573,599 -686,708-786,820-876,898-989
atgagtttcgatgtgatcgcccgcgtggcgttggggcagcgcgagtcgcgacagtttgagactgaaatggcacacctggcgattgagtcgatgcaaaaatacaataacactccgttcgattacgtcggcttcgctttcccgtggttcggcattcattttttggaaccgttcatcagttggagcggaatattgcgcaaagacccgctaattatactgaggaagcagctaatggacgaattaaaggcacgcaaaaagctgagggaaagcggagaacaacagcagcagcagagagcgaaagtcgacttcattgacctgtttttggagacggaacagaacgaacagcagcagctgacggagcaatgccaaaacgagggcgaagcaatgctaagcaaaacggcacttcaggtggggagagagaggaagggggaaggggttggcgctagtagtcaagttcgagagtcttggtctcgaaccttctcgactcgagcaaaatacttttcgggatgaacgtttcaattctaaattcgatacagaaaagttcggctctattgcactttatgagtccaatcgaccaaacaacaattaattaattaatcaaatctttttggcaattgcctaaacgctgagattttatatatttttgcttctttatcctttgtgctttcgaatgataccaaaaacatagggtttgttcgaacatcaacaaagttattgtataaaaagaaggtattaatgccaaaacgagggtgaagcaatgccaagtaaaagggcacttcagcaggtgggaaaagagaggaagggggaaggggttggtggcggtagtgaagtcgagagtcttggtctcgaaccttctcgactcgagcaaaatactggggcttccaaggatccgggtttcaattctctaatttgatacagaaaaatataaatgaatgatttagtctttaatatgtataatgttctagatggaaattcacgagaaaaagacttga

SEQ ID NO: 79421 - DNA, 383 bp, Heterodera glycines; identical to SEQ ID NO: 51114
  Genomic contig location: Contig_ID=SeqID_15219; Location=522..904; Strand=+
  SCN-specific regions: Sequence locations=1-20,42-275,297-383

SEQ ID NO: 79422 - DNA, 1582 bp, Heterodera glycines
  Genomic contig location: Contig_ID=SeqID_15220; Location=163..1744; Strand=-
  SCN-specific regions: Sequence locations=1-90,112-125,147-183,205 -254,306-319,342-354,376-391,435-444,508-698,739-803,825-1072,1185 -1198,1220-1417,1469-1582
  Gene Ontology: Mol. function=protein kinase activity; Cellular component=membrane fraction; Biological process=signal transduction
cgtggccaatgattgcgctcaaaaagttgaaccgtacctccgaggtggacatcaaacggttgtgcagccttgagcatgccaatgtcatcaaaactttgtttggcattttgtttgggaaaggcgccaaaaaataaatttaaattgttgttccagaggaatttgtacgaaagagcatttcccgtgcattgtgatggaatactgtgaaaagggcagcttatttgagcacttacggcgaaatccgaacatttcgaaggtaaaattttaaaataattaaaaatttattatttaaataaaaattttaaattgtttgattgttgagagaatgtcactttataaaaaggaattataatttttgatattgaattaaagtaataattattaggtgataacctaaaaataattaatttttcataaagttaaaaatttaaatttttgttcgttagcaatttattgaattaattcattaaaattaattgcaatttttatgatttaacaaaaaaaaaatttggaactggattttctgggttttttccggaaaattcaggtccagctctaacatggaatccgaccgaggccatgacaagcctggatttttcctgaacctagtttttcttgcatctttttccaaaaatccaggccaaggttaagcatggaattcagttccagcctttttttcaaaaaatcgaaccctaaaaagcaaaaattatttttaaaaaatatttcaatttttcattttttcagtcgatgttcatcaattgttccgttcaaattgctgaaggtatgtgctacttgcactccttgaaaattgtgcaccgtgatctcaaatcgcccaacattctcatcgacaaaaataacaccgtcaaaatttgcgattttggctccctgtacagctgggatcagaggtgggcttggcttttattttagggggatttcaaagaaattttttgaaaatttttttaaggcttaactcgcaaacccaaaatttgcaaggcatggccagcgttgtgatgagcgtttgcggcacctcacaatgggtaaaatttgaagtgaataattacagaaaatgaaattgtaatatttttttaatttttaaaaattaaaaaaaataaacatttaaaatatttattcattaatagcgttagttttttaattaataaataatttttttaattaactaattaattttctgtttctattcattaaataaaaataattatttgttgagattgaaacacgggactgggttttgtcaatttccgctttttgatcctgtgattcgagtaattttgagaggatcatacgaatttttttacccatacaaatattatttttgaatttactttttcatttttctattttggtccagaacatgatactgatctgatcttttctgattttccaaaatttcgggtctaatatttattttatttttatttattttattttttaaattaatttaatttaatttttcacaccacagatgtcgcccgaaatgttgaccaacaagccatgcaatgaacgcgtcgatgtatggagttacggtgtcgtactgtgggagttgctgaccgggtgagtaactgac

SEQ ID NO: 79423 - DNA, 553 bp, Heterodera glycines
  Genomic contig location: Contig_ID=SeqID_15221; Location=390..942; Strand=-
  SCN-specific regions: Sequence locations=1-56,89-553
atggccgtcacgggtaacgcaccatctctcgtcacgggcacaaatagcagtagtggcaacaacagcaacagtaacaataacaacaacaccgaaattgacagtaacaacactaccgtaatccacaacagtaatcacaacaccaccagcgaggacggcgactgggtgaagtcgccgccgccgccgccgtcggtggaggaggcgactgttgtggactcggcggctgggctgaactgctcgccatcgttgtctaccatttccctgtccagcgcatcgccggcgagcgtcacctatttgggcgacagtggcgatgacaatacgacggtgcggcgagtgccaaactcgttcgatagacggaggacaaactctgtggacctaaggactgatatctaaggcgtgctaaaaactgccaaaataggtaagttttaggttctaaaaaacccccaaaataggtgccaaaaagttccgaatttaggggtgtaaaagacaaaatttattcaaaaaagtaaaaaaattaggtcaaatcagtattgagctaaaaaaattttaaaataaa

SEQ ID NO: 79424 - DNA, 836 bp, Heterodera glycines
  Genomic contig location: Contig_ID=SeqID_2378; Location=7808..8643; Strand=+
  SCN-specific regions: Sequence locations=1-420,442-466,488-717,780-836
atggcctaccctcctccgcaatatattcctctttatcccctctccggtgcaccaaattacgtcatggctcggccgctcgccgatggaaatttcatggcgcccatccaggccccaatggcccgtgatgcaacgacgcagcaacagcgccttggaccgccacacacaacgccaactgctccaccggcggcggcacaatctgccgcaccggcacactccgttcctcccccccttaatcccccagcacactccgcagcaccgccccttaatcctccttcaaccggtgcggggccggacatggtaagtcgccgtcttttaggaaatgtgaatcgttctctactggagctggtccaagtcgcccattcgcaacgaattgttttggagcgtttgttaatgacggcttccgtcaaccagatgagcagccgcggtgtcgatggtagacgagggaatgggcggtaccgaaagaaggccaagggctcgggccattccttcccgagccaaaagcagggaacagttgggggggcccgtccctctcgttttcaggaagcgacggagaaccccggcccaatagggcttgtggaaaagcccacccttgggaatggaaatgagccggccgttgctgctgttctcccagaatcggattcaaacgccgcatcgtctttggcttcgtcgacgtgatgcacatctgcaccgcaaggggggcgggggagactgtctccgacagaaattaaaacaaaaaataataacaaaaaaatatataaaataacaaaatcaaaacaaaattctttttacacattttttggtcggggattagcccaattgtcccacttttcacataa

SEQ ID NO: 79425 - DNA, 575 bp, Heterodera glycines
  Genomic contig location: Contig_ID=SeqID_2378; Location=813..1387; Strand=-
  SCN-specific regions: Sequence locations=1-324,348-575
cagactgcgaaagcaacatttcggctcaacacgattttgattatcgatacgtatgtgatcaaaataattataaatgttacctttttaaaaagtgtggaggaggtgaaaagcgctcccaactcttaaggtaacttccacaaataccaaagaagttgttttggttgtggagggtggagagtttcttatcggtgcttcgttcaacaagtaatttacttaattttcaattactaataagatttcaccattagaaagaattgtacggcgaaagattactttttgcatttgcccaccattaattccctgcttttcaatgcttacaatgcctataaacttcattatggatatttttcatatcgtttccgtgcagaatcgaatgaatttaaagaaatattggacagattttttactccttttttgcatttgtatcgagttaataaggcaagttcactaattaattattcacttcaaaagagaataaatctcagactgaaaaactaattaaacaatgcatcgtttgaatgtttaagattccccttgtcgatctcttcaatggagtggatttcctttccattggc

SEQ ID NO: 79426 - DNA, 1081 bp, Heterodera glycines
  Genomic contig location: Contig_ID=SeqID_2378; Location=8793..9873; Strand=+
  SCN-specific regions: Sequence locations=1-304,327-683,728-1081
atggtgcccaactctcgccgttgcccgtccatctgttgcccgttgctcctcccaacactgtcgcccacccaccgcttggccccaccaatcaccactgcccgcccaccaacaatcacccgaacactgtggacccgcccatcccgtttggccgtataaaaagaatgaaggatgctcgacaattacttactcttctgggcgattacttttctcgcctttttctcgatttcgccctttttgctctacctactcgccagcaatcttggctttccccttttgctcttgccctttgctttacctttctcactttggctttaccattttcaccttgcttatccatttcaattttgccttcgctttaaaaataaaaacaaaaaaaaccttttctcttttggctttgcattaaatttttccgcgtttttggcccctgatcatttctggggcatttctcattttttgtgcccttttgaccattgcgtgggcattcccccgtttttggcccttttcatcaccggctactcctgcccgtggtgcctattttgcctttgctttagccattgcccggccattttgtcgccgctttagtcctcgttcgtttccgttgcctttggccagcattccactgactcaggcccctttgtcccttttctggccccccttttttttccctgtgtttaccacagtttgattaagagtcttttgctcttaccagactgaggtctaaccgggcccttttttcgggctaaacttgtaaaacaaacgggactaagtactgtaaaggggcaaaaccgtcactccttttttactcaactttttcgctttatctttttttctctcaactatgtcggccataatccggcagcaactccgcgctcttttgaccgccatttcttctgactcattacagggggccgattccgatttattgccaaacgaccccacttctctggagtccattagccttaccgccgagaagctctcgcggaaactaagcaaggcccaagccctcctgaaagattggacgattatcctttcctcgtcgagtaaagaagtcagagagcaggaaaatgctttgtttgactag

SEQ ID NO: 79427 - DNA, 141 bp, Heterodera glycines
  Genomic contig location: Contig_ID=SeqID_15222; Location=1120..1260; Strand=-
  SCN-specific regions: Sequence locations=1-141
ctcaaattcgcgctgtttaccacggcaatgatttgactgtccgacttggccaacaatttggggccaaagtgcacaaaaaggccatccaatcactgcttcggtccgttctttcgtgcttttcccgtctttccagcccccccc

SEQ ID NO: 79428 - DNA, 786 bp, Heterodera glycines
  Genomic contig location: Contig_ID=SeqID_15224; Location=1431..2216; Strand=-
  SCN-specific regions: Sequence locations=1-316,343-372,410-447,488 -493,516-786
gatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgttttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatgatgacgttgatgagattgctaccaaaaaaacaaagaaaagttgagagagagagagagatagatagatagatagatagataacggattcattttgttgtgagcttcaaaaaaaaaggatttaatgtgtcctttacttttttaaaaatccattaaaaatgcattttattgttgaagatgatgagacacaaactccaaaatggtcttgatgtgattgcaattttgttttttcttcgtgaattcaccatgagacaggattgcacgttgacaatttttcgtaatgagcacagagagatttgcagttggctctatccgagtggtggatcgtcaactctcctcataacaatccaattaacgttgttggaaaagcttggcccatatgcgtttgtcacgtaaccctaatttttcaaaagaaggaaaaagcactcctaaatttagttttgatcttcatcaaggctga

SEQ ID NO: 79429 - DNA, 385 bp, Heterodera glycines
  Genomic contig location: Contig_ID=SeqID_15225; Location=528..912; Strand=+
  SCN-specific regions: Sequence locations=1-160,183-261,283-385
atgatcagtcgaaagcaaaacaacaaatggacaaattgcttgggaaaatttttaaacgaaaacaaaattgaaagaggtaaattgaaattgaaattaggtacatatgtgtcatttattctttttttttattggtaatgcattttcaattacctaataaagtaatgcattaattttagtcattttttcgcatttttatatgttttcgttattcccgtctgctctttttttgcttctccaccacattgacatttattcgactgaccaaattgaggataagaaaaatagccacaaggaattggataccgaaatccgtacgctcttcaacgaaacaaaagtacggattttgattctttgggtttctttgaaatacaaaacaatcaattag

SEQ ID NO: 79430 - DNA, 282 bp, Heterodera glycines
  Genomic contig location: Contig_ID=SeqID_15225; Location=74..355; Strand=-
  SCN-specific regions: Sequence locations=1-131,155-282
  Gene Ontology: Biological process=locomotory behavior
tttaggtcgtacatttatttttgttgcttcgatgtcgccaaaatcgtctcatgtcaattacgatcttctgccggaaatttctcacaccttccgcagccctgaaccccgaccatctgttctagtttctgacatgttttctgttttgtgtgcttcgccgcttatcatccttttccttttggtaaatgtttaaatttggatgttttttctacataatttttactttttagtggcttcgtattggcatcaattttggaaaattcaagttttcgctcagtgctcttg

SEQ ID NO: 79431 - DNA, 744 bp, Heterodera glycines
  misc_feature (93)..(93): n is a, c, g, or t
  misc_feature (163)..(163): n is a, c, g, or t
  misc_feature (188)..(188): n is a, c, g, or t
  misc_feature (244)..(244): n is a, c, g, or t
  Genomic contig location: Contig_ID=SeqID_15225; Location=1131..1874; Strand=+
  SCN-specific regions: Sequence locations=1-57,110-273,295-318,344 -500,529-556,584-625,671-678,706-744
atgacgacgaattgctgtgcaaatgcaatcattttgcgacctgcggtaaggtaacaattttttttttgcttgttttatttttattttccttanatttctttttcttgttgtcaggaaggtgtggcgagttatgttggtgaacagtacatggacgtgtgccggnctggtcgaggcggatactgtagtcnggtagtgtttttgaacgcggatggcacatttcggggagtcatcacattcgtgagtntcctaaaaagtttttatataggtatttttgaagagcgattgaaaatttaacaaccaagttttcccagtttatttatgatgaaaaatttgcagaaggagggaccaactccaattaacaactaattttaaatttttggttgaaccaaaaaaaaattgactaattttttgggggaagtggttggggaatttggtttttggggtttaaaatttaaatttccgggcctttttttttcgaattttgcaattcaaaaaggcccaaaaaaaaaattttaaaaacaaaaaaaaccttaaattggggccttaaacagggggattttttcttttttttttttttttttttatattttgttaaaaaagaaaaaaacccggcccccgggaagatatcccttttccctccccaaaaattccccccccccccccccgggggaaaaaaaaggggggggggggggggggggggcggggcaattttttttttcaccacccccacccaaaaaaaaaaaa

SEQ ID NO: 79432 - DNA, 201 bp, Heterodera glycines
  Genomic contig location: Contig_ID=SeqID_15225; Location=4807..5007; Strand=-
  SCN-specific regions: Sequence locations=1-201
acttttcgaacacccgatcaaaagcctcaatcatcgtcctcactcttctttgacttggctcggtgcactgaagatcattcgactcagcacgtcgatgcataccaacagatatttgtaaccgtcgttatgctttttcaactggtcaaatatgcacaaatcgcactgccaatcggtatggaagccgctcggtatcgtctttag

SEQ ID NO: 79433 - DNA, 627 bp, Heterodera glycines
  Genomic contig location: Contig_ID=SeqID_15225; Location=2699..3325; Strand=+
  SCN-specific regions: Sequence locations=1-355,380-408,430-606
atgagtagatgtctacggatgcttggaagtggtgtttatgaaatgatcaagtaagtgtgtgagtgatcgtgtgattagggacgagtgagtgattaggaacgagtgtgtgatcaaagagagacatagagagatcggtgtgagtgagtgttaacagagagtaagtgatcagaaaatgatcagagtaagagttagaggtcagatagtgattgggaactaataaatgatcaaagagaaaaaataagtgatcacaagttagtgtgaaagggtatgtgagtaagtgattgcgtgatcagaaaaataatcagtgtgtgagtgttcacatgtgagagagagtgatcgggatgagtgtgatcataaagaatgaatgattagaaaatgatcagagtgagtgaatgtagattagagtatgattaaaagtgagaatgagtcattataaagtgaaagagtgattacaagtgagagtatgatcaaagagagatagaagagttatcagtgtgcgagtgagagtgtgattgaagtagtgagggattacaaataaatgattgcagaaagagagagagtaattggggtgatcagagtaagaagtgtgtgatattgagtgatcagaagctgccagagtgggagtga

SEQ ID NO: 79434 - DNA, 1758 bp, Heterodera glycines
  Genomic contig location: Contig_ID=SeqID_15227; Location=293..2050; Strand=+
  SCN-specific regions: Sequence locations=1-334,356-443,465-487,510 -692,714-1212,1234-1387,1412-1758
  Gene Ontology: Mol. function=protein tyrosine kinase activity; Cellular component=mitochondrial inner membrane; Biological process =transport
atgattattcttatttacagagagaatgagaccagcaatttggtggacaatctgctgaaacgcatggaacaatatgcgaccaacttggaagggctggtggaagaacggacccaagaatatttgggtgagaagaaaaaggtaagaaattaaattaatgagatatatttggtatttattcattcgggttcggatttgattgcactgaaaattccattgaagcaccaatcaattgctaaatttaatagaaagatttggtttttccaagcatgagtctatttcaattctggttaagtcctcaatttgatgacttaattatgatgacaccgaaactgcaaaaaataaaagttctattacaattaaacgagtgccgcactcgattcgattttggcatcgagtcgagaacttgatcttcaagaagagtataaaatcgactgcggcactcgatttttaaaagtttttctttcaattcaaaaacgaattaaatcgaggattccaagtttcaaaagggcactaatatgacggagcaggacaaaactccgtcggccgaaactccgccaaaaaaaatttttcaaacaaaaatttttcatgaaaaaaaaatcttaggaaaattttttctaagaaaattcgaaggaaaaaaatttcgaaaaattttaacgatggaatttcggcggcggaattttggggtgcaccgctaatataacattcaatttattcgtgaattgtaagaaatggtgttggggcttaaagttggcgtctacgtatttaaaaaccgtgacacttatcttggccggctctgctgcatgcacactaattggtaccaaatccttgataggtggaagatctgcttcatcaactgttgccaccgtccattgctgatcagctaattgatggcaatccggtccaagcggagtcgtacgattgtgtaaccatctatttctctgacattgtcggcttcacctcactctccgctttgtcctcaccgatgcaggtggaccggaccattatgattgacagattttttttgaaaaatttgaaaacccttttctctgccatcaatgtgaccagctttattttcatgcctctgcagttttctctttccgaaaagtttcaaaaaaactgaaaataaactaaaaaatagttggatgcttttttggcatttatactaataattttcaaaaataaaaggggaaaatcacaataaaaataataagcaatttttgaaaattaaattttaggccgaaagtgggggattattttataatcctcatcccaaaaaaatgttttccattttttgatcaacatatctgatcgctctccattctcatttttttttcatttttctttgaggttgtcacactgctcaacgacttgtatttggcgtttgacggtgttgtggacaatttccaagtgtacaaggttgaaaccatcggtgatgcttacatggttgtttctgggctgcccgaacggaccacggaccatgcgtcacaaattgctcaggtcccaaaaatttgataatttacggttttgaacttcctaatcctcaattttgttttaattcatcaaatcccgcttgtacaatttcattggttcaaaagcttacaaaaacaagcggaatgcgtattttatgaaatttgattcagattatggcatttatgcatctataaaatagggttagccgacatttgcggaccgacttttgcggaccgacatttgcggaccgacatttgcggaccactatttctcgatagaactgtctaa

SEQ ID NO: 79435 - DNA, 220 bp, Heterodera glycines
  Genomic contig location: Contig_ID=SeqID_15229; Location=150..369; Strand=+
  SCN-specific regions: Sequence locations=63-63,103-113,135-220
caggtcattgtgcgtctgctgcaattggtgtgcgacatcaatccggaactgcacacgaaccttcaactccaagtcaaactgttcggcaaagcggcataaactgaacggacggaggagggagttgggaaagaatgttttttgatgtgatcgtttatttaaaagacaacaattagttttatattccatcaaatataagaggttattaaaagtatcgtaaaat

SEQ ID NO: 79436 - DNA, 1882 bp, Heterodera glycines
  Genomic contig location: Contig_ID=SeqID_15229; Location=895..2776; Strand=-
  SCN-specific regions: Sequence locations=1-1046,1068-1084,1106-1882
  Gene Ontology: Mol. function=organic anion transporter activity; Biological process=embryogenesis and morphogenesis
cgacgtgttcgctttcaagtgaccggaatcttaccaattaggagcttaaaaactaatttcagggcttttacattttcatgccgaaatatttggaattgcaattcggcattccccaatacgaagtcaatcggctaatgggtctgtacaaacgcaaatggactgattgatacttcttataattaagcgataattggagtggccacatttgccgtcggagtaatggtgggcagtttggtgatgcgagtggccaaattgcagggacgaaaagcagccgcttgggtaggcactaattaactcattttaaaattgaatgatcaattgtctgggtttctgatcatttgttagccaattatcacatgtaattattcctcagggtttttgaggtttataccattatgctcattgaatcccgtggctttacttattttatagctaattaattaattccctcgcccgcccctgctgaaggtggcaatgaccggtgccattgcggcatgtttttctttgctcaattcgctggtcggctgcacttccacaatgactgcgttgggcgattcgctgtgagcaatggcagggattgaagtgcctaagcattttgacatttaattggctgtttaagtgttgctaacgcgaatagcaccagcagttgtgccgtggggtgccattgcgaattggcaccgctttacccggtctgtgaccccaacggagccgtgtgagtgatattaaaagaattaattccttaaaaatccgattggatcatgccaattgttaatttgacttgccttctcagctactattctccgtgccatgccggctgtcaacttggtgaaagtgcctttagcattttggaaacgcaaaaaacgcctttgttcgaatcgtgtctatgttcaccgactgaacgcgtgtcgcgagagttttgtcgggaggaaaattgccgatcaaaaatgtacatatccattggatcaaaatgaatgagaatttaaatgaaagcagcattttgtcaggtattggtacttcactaacgtggccatcggcggggtttgtttagcttttcggcattattatattattgtgcccagacttttgtcatttctgatcattttcacagattatcggcggaatgggcgttgtccccggtgtactgatcatgttgaggtaatcacccaatttaaatggcaattcaaaaggttaattaatcataaagatcagtgccaccaaagcatcggagcatttcgctcggcttcaacggatttttggtctctctgctcgcgactttgccgtcgcccatcgcatggggcacaatcattgataacttctgcctgttttggacccaaaagtgcggcgagaaaggcgcctgtgctttgtacgcgacggacggacttcgattttggtaaatgttgttggaaagtgatcggaaggatgccgaatgagttgacagctcaatttgtatgactaaatgagagcacaggttgatcagagaattaacgatcaggctaatcaaattatgccatttcgatcatttaattgaacggcagggatgggatgagagcaatttgagcaatgttccgatagagaagcaagggctgatcagaaacagattctgatcatctgatcactcattcttacataacataagtgctgccctttcctaggcttcactttgcgtacggtgggcttcgcattgtctctctgatcaccgatctgttcgtcatttaccacgcggttggactgaaactgaccgattcggactcacaaaatgccaacgacggagagggaaacggcgaaggcgacgaagaagcgacaaagggcaaaaagagaagcggagggacgacaacgaacaacgaattggagagggaacagacaaaggcatttttggaggaag

SEQ ID NO: 79437 - DNA, 491 bp, Heterodera glycines
  Genomic contig location: Contig_ID=SeqID_15233; Location=624..1114; Strand=+
  SCN-specific regions: Sequence locations=1-491
atgagtgagggtgtcctcactgggccaattgactttgcaggccttcaaaacgacttgaaaatggcttataacatcacgtgtcttctggtaagaaattcaattacaacatcgtgatcaagtcactcctttagggtagtattcgtcttccacgaaagaaattttgcagccccataggaatttttttctgaaaattatttcagaaaaccctaaaggagtgatctgatcacggtggtaaaattgacgttttagtcagcattaaaagctatgctcatttatttttttcagaatttttcttgcattacaaaaaaagtatatttggtcttataattatgaaacgccgtttggggccactttaggaaaaatttttagatttttttcttttaattgttcaaattttttcatggggctcataacattaatggggcaggaatttaccgtgttcggtcattttgtcaaattctaaaactttgctcaaaatgagaagtatttga

SEQ ID NO: 79438 - DNA, 2775 bp, Heterodera glycines
  Genomic contig location: Contig_ID=SeqID_15234; Location=621..3395; Strand=+
  SCN-specific regions: Sequence locations=1-204,226-252,275-282,313 -690,712-776,798-862,886-1569,1594-1875,1897-1985,2007-2059,2088 -2140,2169-2221,2250-2302,2331-2383,2412-2625,2655-2706,2736-2775
  Gene Ontology: Mol. function=general RNA polymerase II transcription factor activity; Cellular component=extracellular space; Biological process=chromatin modeling
atggccattggccataatgaattggtgcgggttgccaagaatcggaaactatacaatcactttgacgaggttcaaattgggaacaaccatgacgagttcggcaaatacattgtgttcttgccgaattggttcaatgtctatcagtttatttttgcggatgacaacggcatgccgtttggccgcgagttcaaaagtgccataaagcaaatgaaaaagtaatcatttccataaattcttacacttatctatttcatgaaaaattaattgcaattaaatagcaaatttaaaatgttttaaaattttggcatgcatgaccaatctttgccttaatttctatcaaaatcaaaaacttaatttttcggattcatttaagataaacaccaaaaatttaatttcttccgagaaaggccagcaaaattccgtcattaatatccacaacaaaatattttcagtgccaaaaattgccgaataatcatccccgcaaaacatttttagtgtttttttagaaatcaaaccctattaattagttaattgattaattcttccatatacccatttttaatcttaaacataatgctacttgattaagatgtttggacgaaattgtagaggagcaagaatctccaacacatcgtggcataaaaacaatttgcatattgccaagaaaagtggacagacgatatgattacaagaattgggcaaataaaattgaccaattaaggaatggacaaaacatattcaaatgcaagaaatggacaaaacgccaggaagtggacaaattgaacaaaatattcaaagcaatttttgagggaaaggcaatccccgaaataatatgcgatcaaatcactctaagaaaagggtataaaagaaacaaaaatgggaagacaaacaatgcagaagctacaaagaatggttctgatgcggaaagtgaaaaatcggactcggatactgtacatatgaccccaaaagtggcgactacggctacggtaccgaaatcactgccaccgagaagcgggccaagtccaaaagcaatgattggatttcaatcaagtccaaaaatgccgagaaaattaaatgcgagtgccatcccatcgcatagttccaatgacaattattacggtatgcttggaccactcaaatcaactccaaaatcgtcggcaaaattaaatacaaatgcaaagccatcacaataccgtaacatcaatggtacagttgacgattattattacggtggaaataaggaggacagtgaaactgatatggaagaggctgacccacgcaataagagaacacctccaaaaaagcatagaaaacaagagaagctaagtgattcgcgcagactggcgcaatttcaaagtataaaaggatacggtatccatgatggaagtaataatggaggaaacagtattccaacaaaatctggtagttcttcgacacctatacacaaatcatcaggcaacaatagcccaaaaaaaagtcatagtccaaaccagcacagtctaagcaactcactaaaatacagtagcccaaaaaaggcggcctacagtacagtaaatttacctgtgaatccaccacacaaaaacaacacaaattataatagcctaacaagcgaacaaagaggtcgaaatcttcataacgcaaacaacggagggcatcatagtcataaaaatgaaggttatggtagcccagctggaagtacgaatatgaattcgctgtccaaaagtcgttctgccaacaatagtccaaaagaggcggcctacagtaaccctacatcaaatatacatatgaacaccagtcataaaagcccaaaaagcgagcaaaaaggccgaaatcttcataatccaaacaactcagggcacagtaatcacaacaatgaagggtacattagccctgctatgaaaaaaaatgttaatttaattccaaaatttttctttgacaacaatagccaagaaaaggcggataacagtaaccctgcagcaaatgtacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaactcaatgtccaaaagtttatcagcaaacaatagcccgaaaaaaatggcctacagtaaccctgcagaaaatatacctgtgaactcaatgtcgaaaagtttatcagcaaacaatagcccgaaaaaaatggcctacagtaaccctgcagaaaatatacctgtgaacttgaagtccaaaagtttatctgcaaacaatagcccgaaaaaaatggcctacagtaaccctgcagaaaatatacctgtgaacttgaagtccaaaagtttatcagcaaacaatagcccgaaaaaggcggcctaca

SEQ ID NO: 79439 - DNA, 931 bp, Heterodera glycines
  Genomic contig location: Contig_ID=SeqID_2379; Location=162..1092; Strand=-
  SCN-specific regions: Sequence locations=1-567,589-717,751-931
atgggccatttgaatttggacgaagtgttacaattcggaggttcaaaagaggtggtcatttgggataccacttgcattcagcagaaagtgcgccattcaatgaggggtaattttgtcacatcgattagggacttaaaacaaatgtttagaattgcatgctgggaaaatcgaagtttcgaattgttacacaaagcctgccgaattgacgggcgaaccgtgcggaacatcgggtcgacaacgcattgtgactacggtaaatgagaaagagccaatgatactcagcgaggaagacccggaagagttctcgtcagccgacgacagcgaatcggacatggaattcacaccgaggacgacgacagacgaccacggcacggccgaataccttggacggaggcggaaaaagtttttgaagcagcgcaatataaagcagagagtgattgccctgctgcggaagttcaaaccggatgaggtggggtgggcgatagcattcccccaaaattttttgtttttcaaattttactcgaattttcatttaattctttcatctgtttcccgtccatgccaggtaatggcggaagaggaagagggaccgcacacttccggctccattgtgcagccgactgaattggaattgcaagaaatttttgaagaattggagaacatcagcgattcaggacccgaaattgaggatgacaaattaaggtaaacatattttcttgtgatttatttttaaattagaattttcagcatagtaagcaatccccgcccgaagatacgcccttttttcggttcaaaatcggacattatgcctccgataatcgacttgcaaactgaggagggtctgttcctgtctgacgaacttagtgctgatagtgaggcgagtgaatgccgaccgattgcctcacttttggaaacccttttcagattgtga

SEQ ID NO: 79440 - DNA, 1908 bp, Heterodera glycines
  Genomic contig location: Contig_ID=SeqID_2379; Location=1651..3558; Strand=-
  SCN-specific regions: Sequence locations=1-1170,1192-1504,1624 -1834,1858-1908
atgcaatccgtattaatcttcagcaaaatccgtcgtcttttgactgcgagtttggccacactccgtggaaatgcaccttttacagccgcgtttttactccgtctttttgcttatgcaaattcggatgcagtcggaaaacgcgagaaatctgaaacaagcgatccgaatactgagaaatcgaaggctatacttggaaaaaaacagcaattagtggacacaaacgatgttcgaagtgaagtggttcgaaggaaggtcgtttagtttatccattgtttttttacaattggatgtccgtttaggctgcacttaccttattaaaagctccgtttgtattgaaaaccaaacacaaaaatattcaaacacctgaggaacaatcatccgatgatacgcttgtgttcatgcgaattctcaaaagccttacattttttaatgttcaacttcttagacgtcttcaaatgctcgacgaaaaggtaaccatttttctgtttttcattttacttgcatttggttttagtgctttttgcacggttttgcccaattcgctcttcatttgagccaacgcgaacccggcaatttgcttttcgttagtttgttgcaagaaggcattttccatcggtactttgctaaacatggcgatctttttcatcatgacaatctgagtcgagcaaaggttcatcttgagtttttgtctcattttttaccatattttttaggatgattggatttgtattttggcgcacatttttacggctaaaatattgccattttacgtcaatttacaagggacaaatgagtcaatggtataattaaaaaaatgattgcttttctcatgtattattcataaacagcctgtcttgcctcctcttgacgagtcaatcgaagcacacattgagaagcataatcgggaagtaaatgaactgttattggcatgtcttcagtttgcttccaatgaccgacgattggaagtaccggaagaactttaacatacaaaatttgcgagatgccaaacaccattcattttcagaaccccgttttcgcattgggtggcctttcagcggaatgtctgagcagaagccaaattgactttgtgccggctttcaaaagtgaattcatcttggacgagtgtttgtttcctcttacgcatttgtcacggaaagaccaccgaggagtcaaagtgctaattagaaaggactcccatttaatcataaccaaaatgccattgttgacagattcattacaactcctatgcatatgacttttggaaaaaccccgatgttgacgcattgggtacaagaaacaaactcaccaagggcgaacagtggtatttgatcaacgatttcaacgttagtcgaacattcatgtaacaaaaaaaacagcgcctttttagaaaatgttgactgaaatctcatctggtttggactacatcgcccagtccaaggattcattgtgcaaagtggcgaaggaagtggccgatgagtttgacgtgaaattccgggaggcgtttaagatgaagcgaaggaaggaaaaggaggataaagagaaggaaggcgtaaaggaggaggaggcaggaacacagccaacagctcaggagaagccgaaggaatgaggaaaaagcgaaagagagcgaccgatggacacatttcgcgttaaatgtactcattcaaaaccccaatcaattcatctcttcaatattggcttatttttcgggaaagacttcatctttattctgcggtattattgtgtgtcattgtcttcagaaaatgtgttccttttgttcccagttttgttgtgatgtggtattattattgttgctcgttgaatacattttacgtaagaaattaaaaacatttaaatgcttaattcggtgcagtattttcttttgtccattttactactatgtataataaa

SEQ ID NO: 79441 - DNA, 2242 bp, Heterodera glycines
  Genomic contig location: Contig_ID=SeqID_2380; Location=195..2436; Strand=-
  SCN-specific regions: Sequence locations=1-112,147-220,242-709,731 -799,821-961,983-1290,1312-1720,1759-2242
  Gene Ontology: Biological process=nucleobase, nucleoside, nucleotide and nucleic acid metabolism
gtaccaacttttctccgattcgctcgaaggtcaaatgttggtcgacttcacaagagtgccaaaagctaatgtttctgaaacaaaagaaacgacagttcaaaaagaaactgtgaagaaggaaaaggatgctggggtcaagaaaaaggccggaaaaccgggagcaggaggaggaaagggagggtcacaactgagcaaaaaggaccaaattctgaaagaaagtcgcgagaagaaaaacaaagagcaaattgagagcgacagacaaaaaattgaatatgccacaggaataaaggccaatgtgagagaagtgaattcccctttatttggtactgacaaacaaaataactaatttattttattaaggcaatttttgcactcgatgatttgttgcgccgcttggagttggacgagtccaaagcattgtgcatgtatcaaaagatgttgcggtacaacgaaatattttcagaacggttggagaatttcgaaaacatcgacaacaaacggatcgcggctttgggtattggaatttgttaaccgtgtcatattattgtacagtaatttctctgctcttcagaacttgtcgagtcaataaaagtgattctgaccaaatattatgaccatttggacagtcagcagaaggacaaagtttgcgtgcccaatttccttgttaatcttttttctcgttagattcaaaccctttggctttcgttgggttttggagttgctgattcgtcaaaacgacgtgcggataaggcgtacaacttggacattgatcttgtttattaccaactccaatacgggggaagaatgttggaaattttgtcagaccctaaaaaggacgaaagagtcaccggatttttgcccgatgcttggcagcggaaaatgttggatgcggtggaccaaggttgacctaattctaaccaggggcatttattactatgaaaattgtttatcttacaagtgcaaattttttaaatcattttttacctatttaaaaaaggactcacttccgttaagacaaatccgctttgattgttgcgccaacttcggccggtaaaacattcatttcgtactattgcatcgagaaagtgttgcgaaaaagcaacgatgaggtcgttgtttacatttgcccgtcaaaggcacttaccaatcagtacgttggctcagtttatgcgcgttttcgggtaatttctctaaatttacttgggtatttcattttattatataatatttacagtcaaagaacatgtccggtggaaaagttctctatggaatttacaccaacgaaattcgtgggttttatgaaaactggcaaattgactccgcttactttgttcagttaacaacccattgaattgccaagtgctggtcaccaaccccgattgttttgagcaaattctcctttccacaagcgaaagatgccgagaattcgtttcccgaattcgatacgtcattcttgacgaagttcactgtattaagttagtcacataattactgtaattgtattcatttgagttcgtttctttagtcaaaaagacacccaaggcctttctcttggccatatttgggaacacattttcctgttgatccgttgcccttttcttgctctttcggctacgattggtaacatcgaagaattgcgcgattggcttcaagaggccgaacaactcaaaccaattgatggagcaccggcacgaacagtggaattggtaaattataaagcataaaattaattaaattaattttaaaaattttttaaaagataacttatgacgagagatggtcggaattggaaattgcgctacataaaattcgagtaagatttctcaatttttattaaaagttattttgcattaatttttaggagtgtccaaaaggcgtgcaattcgagacggacgaaaccaaatttttcaggggatcgagcgtgacatccaatgaaattgaagacggaaccggtgaggatgcggcaaatgaccgggcgagtgtcgcaagtcgggcgtccaataacaattcgccagtaccaagcgaaatttcgcaacagtcaaagtgacttatgaaaattgagattgggaaactgtgttttatccagagccacttggaatgacgtggttcagtttttcaacccgttctccgtatataaattggaaaaattgcgtatgtttggaattccggctgaccaacgtctcactgctcgtcaagtgcttgaactttaccaaatgatgagcgatgtcgacaaaacagttcg

SEQ ID NO: 79442 - DNA, 805 bp, Heterodera glycines
  Genomic contig location: Contig_ID=SeqID_2381; Location=2385..3189; Strand=+
  SCN-specific regions: Sequence locations=1-533,555-805
  Gene Ontology: Cellular component=integral to plasma membrane; Biological process=ER to Golgi transport
atgctgagccgcacttggatcgtcgcaatttgtttttatattttctttggcacgattttaccattctctgaagcaattcgtttttatgtggcttctaacgataagaaatgtctgaaggaagaaattcacaaaaatatcgtgttgacgggcgaatatgaattaagcgattctgttgggcacacaacgacagttcatgtcagtgatttaagcagattataacaaattgatattggaatttcaggtcactgatactcgtggtcacactctgtacaagcgtgaaaacttcccagaggcccgtggaaaatttgcatttactgcggacgaatacgacattttcgaaatttgcttccaaatgcatggcccgactcgtaattctttgactgttgctattttcaagtgatgcttttaatttccagaccaacaaaagttaaacagagaagtccatttggtgctaaaacatggagtggaggccaaaaactacgaagacttggccaaagcagaaaaactgaaacccctcgaggtggagctccgtcgtctggaggatttgtcggattcgattgtgcaggactttgcttacatgcgtcagcgggaggaagaaatgcgggacaccaatggtatttacttttcctcccaacataaaaccatcttatttgtctgacaataaacaccattaacattgtcagaatcaaccaacagtcgtgtgctctacctcagcatcttctcaatgttgtgtcttctcgggctcgccacgtggcaggtgatctacctgagaagttacttcaagtcgaagaaactcattgactga

SEQ ID NO: 79443 - DNA, 2773 bp, Heterodera glycines
  Genomic contig location: Contig_ID=SeqID_2381; Location=147..2919; Strand=-
  SCN-specific regions: Sequence locations=1-578,606-711,733-911,933 -998,1020-1542,1564-1879,1901-2773
acgacggagctccacctcgaggggtttcagtttttctgctttggccaagtcttcgtagtttttggcctccactccatgttttagcaccaaatggacttctctgtttaacttttgttggtctggaaattaaaagcatcacttgaaaatagcaacagtcaaagaattacgagtcgggccatgcatttggaagcaaatttcgaaaatgtcgtattcgtccgcagtaaatgcaaattttccacgggcctctgggaagttttcacgcttgtacagagtgtgaccacgagtatcagtgacctgaaattccaatatcaatttgttataatctgcttaaatcactgacatgaactgtcgttgtgtgcccaacagaatcgcttaattcatattcgcccgtcaacacgatatttttgtgaatttcttccttcagacatttcttatcgttagaagccacataaaaacgaattgcttcagagaatggtaaaatcgtgccaaagaaaatataaaaacaaattgcgacgatccaagtgcggctcagcattctgacagaattggaaagacacatgaactagaagaaaaaagtcaaatatctgtgaataaaaaagagaaatgaaaaaggttgtattaaaaaaaatacctacctaatttgttttgtgcaatgctaattgcattatttcagatgcaacgttaacaaaaaaaaattatggaaacgaaatgcaaaagaaaaataaattcaaattttcgagactgtctttactttgagtttggttttcgagaatgcctttactattagtttgagtcccaactcccaacaaacttactttgcatatcaaaaaatcacgccgaaaaattttgatggaattccggctcggataaaatcaaatttaaaagagtaacttggaatggaaatattgaaaatctgttaaagtaaattttcaaaaactttctctgggcgtgctcctttccgcatcgccgatcccagatccttaatttaaatcaaaattaacaacaaaaatctccataaaaattaacgagcagttttccataaaaaagctgaaaacagaacccacgttgccgaaaaatggcctgtggacctgaatgattatgtttttgaaaccacctgattaaccgaaactgaaagtaattggtaaactcatttagcagaatttagaaattgccaaagccacatatgaaaattgatggaagagccgacagaaacgaatgaaaacgctgcgattgatggtgctagcaaaatacttcatttttgtgattttttttaaggtgacctaccgcttgatttggatacaatacgactcattccttgcccttacaccgacattataacaggctttagaataacatcctttattacatcatcagttcgacatttcagaatttgctgatgttgaaattttcctcatctctctcgattcgcttttgcttgagttgtgtgcccatcgttaccacaaatgggtgttgggtggacagaccatcgttctctgtgaacaggttctttctattcgagtattactaataaaaaaaatgtctttgaagattaaacaattcctcggcggattggaagaactcaacgcaaagttcaaattggtgacattcactgaattgacgcctttgttcaaaagcgacacttttctcgccttccttcacccgtttattctttgttggattaccaagagcaaatgggctgaaaatttggagtttttcacttctcctcttgacgagaaatggaatgactatctgcatcagcttacgccatcctttatgcttttgtcattggagaatgccccggacataatcaaagagcccattaattttgctgaccgtttcatttcattaggtccattttttgtctctttaaatcgattgctttctttttagcattttccctgataaacgaagcaataccggtagttttgttcaatggcttcaccatcaactttatatctgttaatgcataccgtttatcaactgttccgctgaatatcgaaggatttagtcagaaaatcagagaaaaatggccagaaacccgaggccgtaagttgctgagtatgcgtaaacttgtctatatttttgtctgttacctttaagttgcttatcagacacaaaattctgatttggtttcatgtcaaaatatcaccgacttttgggctgttgttctgcgcgacgaactcaaagaggccgaaaagaataaagaaaaattggacgaatttcaaaaattctgcaacgctgttcttttgtcggcattaatctgcgaagaattgggagtaaaacgccgttatttggacacggaagaagattataataaggggccttcgccatcggtgaacagttttcgtcgcggattgttggaacgagcccagaaacttttgtcgggcgctgttgaaaaggttgaacaataatccaattccttattttaaaacagtttggtttagcaaatccttttctcacttgacgacatttgggatggccgaatggttttcacttgtttcaagaaaataatgtccggcgaaaaggtgttcgaaatatttttaattaattggttgacattttgttaaagattcttccattacgtcgacaagagaaatttgcacaattgcacaaaagtgtgggacttaccgtggcaattccaactgatcttgaggacaaattacttgacccaatttctccacaaaatttcgaacagcaaagtacaactggtcaatgtattttctacaaagtcgaaaacgaattgcttcgtcaatttattcctgattttctggag

SEQ ID NO: 79444 - DNA, 1428 bp, Heterodera glycines
  Genomic contig location: Contig_ID=SeqID_2381; Location=3269..4696; Strand=-
  SCN-specific regions: Sequence locations=1-929,951-1067,1089 -1120,1142-1158,1181-1428
atgaatttaaacgggccgccgatggtatctgaacaacgcttctcagaacagttcagaaaaatcgcgacgcctctgaacgattttgcttatgaaatttctgccatctcaaagattttgctggatctccagagggatttgacactgagacggtgtgtcgtcagtccggaagaccttttatcaaaaattaccaagtatggacagattttgtctcaataattaagagaataaattattccaatttatttctggattttttttagctgtgaagacgcctggaaacgactcgagacacacaatagacaggtggaaagcatcgtcaaccaaagtctgaaacagttttggcgacgagaaattgaacggattcaaaatcagcaactggcggttcgtgacaaggcacgagaattgattcagcttcggagtttggccaaacgggcattcaaagtctgtccatcgccacctttaaacaaaaaaacacttctttaggtggcacaacaattgaagccgttcgccacgcaaatggcttctcttatttctgttatcgatattcgacgaagctccgactcagtgcttccatcaccgatggaacagatttgcatgcaaatcacaaaaatggaaccggacagtgaaagtcgagtggcagcgatcgagaaagaagaaacattgcggagggaggccaaattggaggaagaaatcgcacaaacggaagaaagggaggcgttaaaagcaagaaaggccctaagggaagtacggcctgcgacgcccaaaatgcgtacttccaatcaacgtgtgaaggagacaaacagagaccgtggagcggacgcactcatcagagaaggcactcattcgtgcctttcctccccttgtccgtcaacaaagagacatcagccgcaagtgaatcggtactcgaggattgaaatataattttctccaaaaaaaaaattttttttttagccatgtgcatcgtaattcggaaagcaaagtttatgaaccattacaaatggacaatatagtcaactcggtaattgcgactctttgtgaaaaggaggaactgccgcgtcagaataccatccaaaagcaaaccaaaacaagcgaaaacactattccatctgaacgagaggacaacataaaaagggaaatggaaactgaaataaccgcggagaaagaaacaaacagtcaaaatgtggaatcagtcaacgcagtggtcacagcgcaaatgacaagggggagggacccggagctgttgcaagcgagggaaaagctgctcgaggcaatcagagagaaagtgaagagaattgaatgacctcgcccattttcactaattatttcgattattctagtcacttttttaaccaaattgttagtttttatagctcaggaagtcacttactcattgctcaagaaataatctgttacatatgcataaataaa

SEQ ID NO: 79445 - DNA, 204 bp, Heterodera glycines
  Genomic contig location: Contig_ID=SeqID_2381; Location=5021..5224; Strand=-
  SCN-specific regions: Sequence locations=1-204
gtttcccgctctttttttagcaatttctctcctcatatggcctggaactgatccaaaaagtgaaattcgattgcaattttaacatcgacttcccttccgaatttgccctctccgtttgtcaaccgttgggcctttccacactgtcattcgccgataattcgagctctcatggcatttttctgaattgtgacccaaattcgcgga

SEQ ID NO: 79446 - DNA, 743 bp, Heterodera glycines
  Genomic contig location: Contig_ID=SeqID_15237; Location=31..773; Strand=-
  SCN-specific regions: Sequence locations=1-145,167-192,214-352,382 -383,405-622,699-743
atggaccagcaaagatgcacgcgagcagcagttgttggacaacgaacgttatcatcggcacactcggatgaacacactccgacggcacagccggtaagggagccgagcaggcgcaaaaaaagtgccatccgaacgcggcattttgtgagtgatgaaaaattaatggaaggggtcaagtcgaacatccaaagaaatatgaaaatgccagggggtcgaaaacagaaaaataatgcggatttttctaaaaagaaaaaattaaagtaaaatctaggaatttttgccatattttcgggttttgttgagttaggctaattacctcgagaatttcaaagggaatttaaatttgttggacaaaattaaataacattattattaaaaaaagaatctatgcaaatttaaaaagttttttgacaaattcgtttttcttattgcaaaaaatcaaaaaattcttttaaagaaatttttaccacaaaattttttttgttattctaaaataagtgttttgttccaacatttttttggcagaagcattcccatcgaagagattcagcaaatgaatggcggcacaatagcaaaacattccaacgcctctcttctgacattgtccgtgccgggcacggtgattaaaaaaatcaaaaaatgaattaataaaatatttattacataaaatttacaatatttgaaaatttttattttttcagagttcaatcgtgctgaacgcattcgacatgaacccaaattga

SEQ ID NO: 79447 - DNA, 2184 bp, Heterodera glycines
  Genomic contig location: Contig_ID=SeqID_15237; Location=885..3068; Strand=-
  SCN-specific regions: Sequence locations=1-6,102-223,262-496,518 -714,736-884,906-1327,1350-1415,1443-1552,1593-1754,2020-2075,2106 -2184
gttgggttaattttttaatttaaaaacataaataaatttttatttatttttgttgaattaaaataaaaaattaatttcgaaattttcatttttttaattttgaaagctgtcaacacaaacaattggctcaacaccagagaagtgctcaaatattacgtgtacccgaaccgaaccattgacaatgaggacaagctttaccctcccacctattacaaggcattggaaaattaaaataaaatgaaaattaacatatttaaaatagcaaaactttgaattttcggcgacgaaaattttgacgctttctgtctaattacttaattacttctattatcctggactcaatattttttttacttggattttactattgtatttttttttgtctttttggggtttcaattgggaaattctaatattgtttttttagaattcaacccttggaccatggcgattttgttggtcagaccgtaagttttggaaaatttacaaatcaaaattattagatattttttatttagcggtcaccgattttcattgtacatcagtggacccattcaaccatgaagaggacacttcggatgtgaccacatcggtggaacgtaatttggaattttaaattgaaattattaagaaaatttaccgatttttagaaatttttgctgtttttggagtgatatttaattaaaataagaagaaatccgtttcaatttttcatattttgccaaaaagttaaatcgacaaaaattggactaaccagaaaaccagaaaaagtttattacgcaaaatttctacgttttttgaaaatcgcttaattttttactagtaattccacttcgaagtttattcaattttttttgccatttaaaaactgtatccctccaagaaagtttcttcaaagtgtcaggtattggttatctttctacataccttaataaaaatggcatttcccaaatttccatttaaatttttcacattttttcaaaattttttgccatttaaaaatcgttccccctcccgaaaaaaagtttctgttcgtcgtgcggtcccatttatgctgtgcggctgcgcgttggacgtgctcggcctgctgtgcaacacgctgtgccttctgcggtccaacccgtaccaatctctgtttgtcaccgcgttggccaacatttttgccggtaaaaacaataggtttaatttcaatttttgtattctttcttggttactgtaatgaagggcctggtcgacttcaactgtatcatactgtacatggcatcggtgggttgcatttactgaaggattttttctgagcatgaaccgaactaaaaaaattgccaagtctttgaaaattccattgcttatttttcagaaattttttggttcgacccattgagtttgactttaggaggcatcggtcgtattaattgatttttaagggattttttaaaaaattttgatgcattttggcgccaatttcaatgagaaaagctttaccaaattggggtttattgttaggagattttggaatttttgaacgaaggaatatacctattgccttgtaaagtataaaattatttttctattttttgctaacattaattaagctaatgccaaggtaattaaaataaaaattgccttcccaaaaatttcatttttcggtgtccaaagaagttggaaataagctgtacaaagcttctgagttggacaactcattgtttgattacacatatggcttttcattcattttgctgaaggtaaacaaaaactttttttaaaaacaaaattattttaaatgaaatcattttcatgtttttactttatattgtaaaatatttaaatatgtttaaatatataaattttattctattctcttaaatttttccaaataattaaattattttatttttggcaattattttaattttttctataattattatattaatttttttattaattattacaataaataataaaattcattttaaacattttttgaatatttactttaaattgattttgtttttttttcaagatcagctttttgtgcactgaattggctgctcttctgattgtcattgttggaatttcaaagattttaaaacaaaaattaaatgattttcggcaaaaaggtttacatgtcaaagcgtgacgaacgcacatacaatgctcatcggatgaggtcaatgttgcgca

SEQ ID NO: 79448 - DNA, 1827 bp, Heterodera glycines
  Genomic contig location: Contig_ID=SeqID_15238; Location=832..2658; Strand=-
  SCN-specific regions: Sequence locations=1-521,543-666,689-994,1017 -1356,1456-1827
atgcggagcatcaaagatcaaaatgaaatgataaaatttgatgaatcagtccatattatccaaaacgagaaggtattattgagtaccacggagcgacgaagtctgaagaaacggatcaccgaggcattgaatcgcgggtcttccctttggtatcgattggatgaaggatacatcggaaatttaaacggcttgaatttgatggtgactccggacaggccctttcttgggttaagaccccgagtctcccatcaccaatttgcctttcaaattttgagaatcaaacggacgcagggaagtgcccttggaccaatgttgttagccggtgaattcttttatcctctgggcggagttttttttgatcattaccgggacgaattcaatgattttggcgacttttttgcgggatttatgaaagagaaggaagaaaaggcgggtaatggaattgagagtgcgggcgagcgcggtgcaaatgatagcagtgggctgataaatagaaatgtaagcggaacgggtaaaaggattgaaattctgagccaaaatttgggtttgattataacggaaaaggatgggggtttaaaattaaattatgaaagcaaattgggttcacaaaatgaggaaggaaaggctgtgattaaggttaaaggtcgcggcacaataaagggaagcatttttcttttggtcttgtacctgtgggggtcgatgctaatgagtaacggaggatgggccatggggccagaaaaagaaaggccggtttgtgaaagtgatgagaatagtgagttcgacttctccgaagaaatgcagcagtggcaaagagagttggtgggccatgtggtggacaatgtgagggccaacaatactcaaaacagtgaaagggcatgccaattagagttggaagcaggtccatcaacttcgacggcacattccacaccggcgggtcagcaaataatatgtttgaacactcaaaattcgggttcagaaaagggctttggaggtacagtaattggtgtggaaactgtggcaccaaaggagaatggtacggtagatcagagagtgggtttggttaaaattcgaggtgaaaatgattcaggatcagcaaaggcagtaaaaaggtcacacactgatttgcagccaaaggcaaaggcacaaacgggtttgcctcaaaatgggtttcgatttgatgcccttaaatgggcccaggtgcatcaactcatacccccgcccactgtcttgtaccccaatccacagatattgcgtactgcggtggtggtgctctttaaccagcagagttgttcgagcagttcagttaatggtgtacaattgatgccaaccaatggagaaatgatcgtaactccatgccaacagcagcagccgcaacatcaaagccaaccacaacaccaaaatcatcagcaacagccgcaacaccaaattcaacagcaacaccaccaaatgcatcagaatcaacgccaaagggcaattgaaggggaaagccgattcacaccgcggcgttttggcccgaatcgctctcatccttatggaggccgaacaactgcttcccatccattcattagggaacaacaggaaacacaactccctatcaattggccatggaatccccttccccgaattcaaattccagtcgaacttcgtcgtgtcctcttgcgccgattagcacaggagcgggagcatgcctttggtcttgctggagtcatgcgccaatggaatccaccaatggcccttttgttgctgtcaatggaagctttctacagtactcttttggcatttgtagtgaacgaaggcgagccggggccatcacttccccaactttaa

SEQ ID NO: 79449 - DNA, 117 bp, Heterodera glycines
  Genomic contig location: Contig_ID=SeqID_15239; Location=96..212; Strand=-
  SCN-specific regions: Sequence locations=1-117
tttttgttgcattgtggcagccaatttgtgccgtttgccccacggattttgcacaaaacgacggcgccggcgcgaatcgtcttcccacacatcgagtttccagaagatgttcctttt

SEQ ID NO: 79450 - DNA, 1697 bp, Heterodera glycines
  Genomic contig location: Contig_ID=SeqID_15239; Location=1387..3083; Strand=-
  SCN-specific regions: Sequence locations=1-208,230-263,285-415,439 -765,787-911,959-1276,1298-1323,1345-1697
  Gene Ontology: Cellular component=nucleus; Biological process=cell fate commitment
accaacagcaacagaagcaattttgaaatgcaattcatttccacccaacaaattaatcagttttatgcggagaaagtgcagatgagaagacacaaaatacagaaagtgatcaattcaattggggagatcgttaaggaagtgctgaaaagcgttgaacaaacggagccgcggttcatttgcacgtttgcgcaaaattcaaacggcaattatgatggggttggtgcaaaagcagataaatataatgatgctaactggctaatgccaaataaatatttaattaattagtcatcaagacagtaacaacccaacactacagttgctggtccattctccgtacgaatttgaggtcattctgtacctcaatcagatgggcgttttcaattttgttgatgacggctcaattcctggctgtgctgtgctgaagctgagcgacggccgtaagcggtccatgtccctgtgggttgagttcataacagcaagcggctatttgtcggcacgaaaaattcgcgcgcgcttccagtcgcttgtggcacaaacggtggaaaaagcgccgttcaacgacaaatgccaagtcgtgcaggacagcagcgatgttaagctgatcatctacggcaaatatttcgttcaggtgaacagataaagtcaaaggagtgatttgtcgagccgagagcgagtcccgaaaaatttctcgaacttatgacaacatacaaactcgagcattataacagatcacatgcgcctttcgttgcagcggcatatggccacggtcggcaagccattggccaagccagcacgtgcaatggccaagcattgaaatggccaaagaaatacgacaggagggcttcgatttgctaagcaaagatttgtgcgccagcagcccatccacaagcagtgcagcaaatgctgctgttcaacaccatcaaaacaacaacaattataacaacagtaacaacaacaaagcacaacagtaccaacagcagcagacaccgcaacagcagacaaatactgtaaatacagtaacaacagcggtgacaacgactacgatgatggagggcgacgcgtggttgatgagcacagtgcaagcggaggacaaactgttacaagcgcacacgaacagggaaaaagtgttttccattctgaaaacattgcgcgacagacacttggacttcagtggatcagcaacaacaaaacagctggtcaaagtgagcagagaagggaagggtcagatcaggtcaaaaagagatgagcaacaatgaatgataggcaaaagattaccaatacaaaccaaagggggaaaggaatgaaccaattttgggtcgagaatttaaattgaaattattggcacaaagcaaataattaataaccattattatgcattatttaacataattgtcaggtgctcgtgctgtatgagtgcgaaaaacattatgccaaccatgaatggaacggtaacatttttaaaccttttgaaaacgtacaggcaaatggtattttcagatttctgtcttggcgaccgaatcattggcattcttctgcaaatggtcaactgtttgcagtgccggcggtgcccccatttttttctgcctcagatggacctgttgaaaaaccggtcgcccaaatcgctagacgaaagtgctcgagccgtgtgggcattggtccggcaactgatgctgaatggcaaagcattggaacagctt

SEQ ID NO: 79451 - DNA, 1952 bp, Heterodera glycines
  Genomic contig location: Contig_ID=SeqID_15240; Location=189..2140; Strand=+
  SCN-specific regions: Sequence locations=1-353,382-682,704-847,880 -1761,1784-1952
atgaatcgacggtaaggaatttttttttaattacaaaattttcatttacccatacatttttttacgaatctcagttggctttgtaacgacgtgtggatggacattctcccatcttttaactatgccaaactcggcctcaaaatggcattgctttccgaccgtttcgatgttttggttgacacgcattttgatggaaaaagcgaattgacaatttggagacgtatcagaattcgcaaggacaaaggaccaaaagcgaaactgtctgtacggatcgatggcaaaagggtggaatttccattgccggaccatccgttgcccaacaaaatccgttttaaggaccttcagatttagtaaatcaaaaaatatacagaaaaccaatcttcattttttcactttatcagctacattgaccattctgtgctcgcatttctccgttccaacaagcaaatttgggacagaagtggcatcaaattggatttggttgtgcctttatatatgaccgacgtcaagctcatttgggatgtttttacccgcgaaatttggtcactttttgcgaccaacattcggcatttgagctttcataatgccgatgctttggacaattggcgtcgtcgcacttcgccaacatttctcactgatcttgatgaattggtttcattcacttcctatggactgttacccgatggaattgctgatgatgggccaaatgcaactgctggccaagcgttgtccaaatggttacacactccgagcaaaaatggccaaccgaagcgattgtatcgctataatttgttgggtccacagaatctcgaatgggtcaacaacttcaaagaggtgtgtctagccatattttctataaattgtttttgtttttccaaatttgtttagacatttatcagtgccaccacttctgtcagttacaatattcaattttatcttcgtgtggaaccaatgccaattgaaccatttgaattggtgaacgaagtgacaaatgagaagctgacactgacgaaggatggcactggtgaattcaattggcttttggagagatgcccaattattggggagactgcggcggcggttcagaaacagcagcagaagaaggacgaaaattcggatgccaatttgaacaaagtgttcttccgcctttacgatgacattgggtgagcagaaaggaggcctttttgtatgaaacacggatagggaacggtatcccatgtacagtactttcccagaatcttggcagggccatgggttctgttaagacagaacttcagtccttgttttgtcttttttgctcttgtccatcccgaaaaccctgctggtccgggtttttccaataattacgggctgtactttcgaaaaagttatccgattcaaattgcgcttaatttaggccgctgtctccgccgtcaaagcgacgaaaaattgttctcgattcccggaccaagtgatcagcggaagaagaaaaagtgatcattttgggaaatggccgatcattatcgagttatgatgaattggattgattgatgatgttttgtttgctctttgaattgttcaatttgacgctgacattttttgctattaaaaaaatggaaaatttggcactttttttttactttagataatccgatgttttttctttaggcaactgattttttggtcgtgttttttgtttgtgttcaagtttcaaaaataatttttttagagtaactaaacttgttttgggtctcggttttaaagtctcgggattttatagaggcaagaaaagaacaaataccaagcattcataaaaaaattacaatgaaaaaacacgaaattcaactttgttttccgagtgtatttgagaattattttttccaatagccttaggtaaaaatttaaaaaaaacaattcttagactttaagcttatcaattggtaccaagaaattctcacttgaaaaagaagcaa

SEQ ID NO: 79452 - DNA, 1344 bp, Heterodera glycines
  Genomic contig location: Contig_ID=SeqID_15242; Location=114..1457; Strand=-
  SCN-specific regions: Sequence locations=1-29,52-567,590-831,853 -922,964-1115,1137-1344
gtgataaaaagcaaaaagcaattaaagaatcatcgtcctcatcttcatcaacaagtattgaaattgaacacattggtctaagcaatcggcaatttgggtgtcaaaacagttcacaaggttgttcaacaagtagagatcctgttatttaccaagcggaaacaagcagggctgataaatcggccgatagtcgacgacgaccaacaaatcaatctgacagccggtataaagaaaatcctggaaaaattcttaccgaaaagcatcgatatagcagccgtcatactgtagggatgcgtgaaaataagccattggtgattcgttctgacagccaggatacagtagcaaatcggcagggacaacaagtgagacaatcaagcagacgcaataatgtaagaattcgtgaaaatgaaagaattccgacaaggcagggcagtgaagatacagtagcaaaccgaacaaatgccggacaccaatcagtacaatctagctaccgtcacagtgtaggaaatatgggaaaacaagtatatgaaaaacggtctgacagtagcgatactgtaacgactccggcaaatgtaagagctggaacaaaatcaaacaggcgtgacaaaattttaaaacaattaaatgaagaaggattcgatagtgaatatgagagccgacctactgtaggaattcgtcaaaataataccgtagataatcatgcgaattttggtgaaagaagtcaatcttctgacaatcggcatccaataggaaatgaattgaacgaacagagcgaagtgttagcagaaatccaaagactagcaattcgatcaggcatttctgatactgtaataaagaaaacaaagacagaaacacggtctggcaggaatttgccaaatgatcgagattctgaaaaaagccgttcgaaaattgaacaaagtgcaccaattaatcattaattactaataataattttaattttaattaggagttaaaaaacaaaaaccaaaagaatgttgttcaatttgcttatcaaaaattggttctaaagcgaaacaaataaaatgccaagttagtttttgaagtaataaataaaatttcaaacaaaaaaactttagcacatctttcatgaaaaatgcattaatagatggtaattaattatttgaattatttgcataattaactttttaattacacacaaggcttcaagaaaatacaacatgcccaatctgccgacaatcattaactgatgatgcgcaatctgtgccaactgtaatttgataaattttaatggaaataaaatctaatcatttcaggatgaaccttcaaatgagtttgatgttgactctttctcatttagttttggtg

SEQ ID NO: 79453 - DNA, 776 bp, Heterodera glycines
  Genomic contig location: Contig_ID=SeqID_15243; Location=1382..2157; Strand=-
  SCN-specific regions: Sequence locations=1-33,55-157,192-269,291 -418,441-588,615-659,682-776
atgaaggagagtgggagccatatgaacacttgctaaatggtcttaaaaatattagtttttccaattttatcaccctcagaaaatttaagtttctggaattgatgctcccaatacttctccggaagacatattgaatggtttgggaaattttacgaagattttttaacattaaattttaaatataaattaatcattaggtgaagccacagagaatgaaagaaacggaatattttatggtaattcaaaatttttatcccataaagtaattgttaaaatttaattattaaaatccgtttagctggtgcaccacctctatctaccctgccagctgaccagcgtaaaattaattattagaatatgaatttagaaattgacatgtttttttattttagtacgcctcttggaagcaggtatggtaattaataaaacaattaattaatgcaggtatcaattaagctagcgttggaacgagcgttactgtgcgtgacaataatggacgctttcatactgtacaagttcgacaagtctagaatttcctatttttcctagaattattttgcaaaagatagtttatgattttatatgaccaaatgtttttattgaaaatctagcactgataaacgaaattttgttaattaattcactaattaatgaaaaggctataaattatttgaaatttttcttatgtgtatatcaattaaattgcaaatgaagaacgatgattatcttaaaatgtaattttacattaaactttttttaaatggtctatgaataaa

SEQ ID NO: 79454 - DNA, 533 bp, Heterodera glycines
  Genomic contig location: Contig_ID=SeqID_15247; Location=425..957; Strand=-
  SCN-specific regions: Sequence locations=1-262,284-402,444-457,487-533
atgcaaaagggcggcggtgggagcagtaacaatttggaggacattctttcctcggtgttcggcttcacctcctccacaaaggcgtccaatcggtcgttggccgacatggtcaaagagaacgacgcactgctgatggacccactgagtgtgcaggtggagcgttttgggagggaatctgtaaatggaaatttgcatataaattttttgaaaaatgactacttacaaaaatttagtcgtcgaagagtaagaaaaaatatataagtaagtttttggtttcctttttgaaactcaacgcaatttttaaaaatttcccagcaaataaagaacactcagtgctatcaaatgaatagaattcatacaattcgggctactatgaaaggcagagcaggacgttttcccccgaaaataatttttataaaatttgaaaaaaatgaataatttttcagcggttttttggaaaaattcataaaaaataaaaaaaattttcaggaattttcttataaaaattgtttttaagttctttttttattaaa

SEQ ID NO: 79455 - DNA, 309 bp, Heterodera glycines
  Genomic contig location: Contig_ID=SeqID_15248; Location=281..589; Strand=-
  SCN-specific regions: Sequence locations=1-309
atgctacagcccgacccctactcccggccgtccatccaggacctctgtgaacaaattgagcaccttgcgctggcgttggacgtgcggctggacgagccggtgctgacttttaccgcggcgccgaccacgacgaccactacgacaagcagtagcagcaacaatggcagaagcaaagttggcgaaagtgcggcggcgaagacggcacggcaaaaaccgccgcaacaacggcacgaccagccgagacagaaacagcatcaaaagcagcaaggcacgaaaaaagatgttgcaaataacacaggcatatattag

SEQ ID NO: 79456 - DNA, 865 bp, Heterodera glycines
  Genomic contig location: Contig_ID=SeqID_15249; Location=78..942; Strand=+
  SCN-specific regions: Sequence locations=1-141,163-397,427-442,464 -636,658-865
atggaattggacggagttttcatggaaaggcacggataccgtgaaccaaacgatgaagacgatggtggggcgagaattgatgaccatccgccacagagttgtcgagaggaaaatcccttccaattattggaatgccaaacagaaaaatatgagagaataaatggagaccaactagtattccgacaacatcaaaaaagggaggaagaaaaagcaccgaaaaacaccgaaaaaacacagcagaaaactgaaaaaattgagagaaggaggtgagaatattggggataaaacagaaaataaactgaaaacgaaggcaccacggacggggttcggaggcacggcacactttgggtgttgacgtgagttggctgaagcgtttggtgaccagcaaacatgagcaaaaagagcaacaacaacaacaaatgggcataaatgaagtcaatgggagcggatgtggagaaggtattgataatatgaatccacatccttacagtacccaactaattaatttgtacattccttttttagttctgttgaatgggcagccccaagcgaattgcaacgggaagtgtccaaaggggtggccatcggcaaatggtggtcttatggtttgtcaacagacaaaccaaaagccactacccatgtacaaattcagaaaaatggcgataactacagcatgaatttctcattacgaaagttgcgattgtttggacgacctcagcaacagcctattgcatcggttgacaatgagttgcaacatcaaagacatacacatgaaaaggaggagacagatcaagaacagttggacgaccaaatcactgcttgtacggaccagcagaatcgacaacatttggcatcaaatggcgcc

SEQ ID NO: 79457 - DNA, 478 bp, Heterodera glycines
  Genomic contig location: Contig_ID=SeqID_15251; Location=550..1027; Strand=+
  SCN-specific regions: Sequence locations=1-28,50-324,349-478
atggcggatacgacgaccggtgaacaatttaaaatgcttaatgattttatgagtctaatcgtcgacaattgcttttactttgtgttttcaattcgtatccaaaaatatacgatttgttttgaaatggacagaattatggtgcaaaaaattaaggatggttagttgattggactcataaatgccattgaactcataaaatgccaatgacttataatttgcaacggaattcggtttttcagtcttctcgacgccgcttctcccgggccggcaacagcagaagaaatgaatgaatcaattaattgatgcgattatgtgaccgaaatgatgtttgtggcactttgccatttaaatattgccttgcctaattgtttgtttgtatttgacctttgcttgctcccaaatgtgtccatttccattgtattttatgtatatatgtgaaattgtttgaggtaattaatcgttgataaaatggctaata

SEQ ID NO: 79458 - DNA, 498 bp, Heterodera glycines
  Genomic contig location: Contig_ID=SeqID_15252; Location=1457..1954; Strand=+
  SCN-specific regions: Sequence locations=93-95,126-312,402-402
atgggaaatgttcagacttcctcaattgccaaccaattgttgccatttgagtcgtatattgtcgagattcccgagctcaaatatgtggcaaggtcgagtaaaacggaaaaacatttatttaatttagccacttcagtgacttactttttaaggtaaagataaaatcaaataaaaaattttcggattcaagccaaggacaaattattggtcgaaataatagctatgatgtgcgaaatttttaacaaaaattcaagaacgggaagaaatgtgtcgaataatgaaacgaaaagtgccaattttccaatttttttcagtttgggcgccacgcggttcatgaaagtggcccgggttgagcacttcagcaagggcccactggtggtcaaagtgttcgtcatcattgaccaacaagtggcggtggagccgtaccgggaccaactgttgcagatcagccgacggctcatcaaacacccaaattttgcaccggtcaaccgagtgttt

SEQ ID NO: 79459 - DNA, 434 bp, Heterodera glycines
  Genomic contig location: Contig_ID=SeqID_2383; Location=5587..6020; Strand=-
  SCN-specific regions: Sequence locations=1-169,194-353,375-434
atggatttcctggatcttcctgggcctagattcttctggatttttgtccagaaatctcctgacccaggtctaggctttgttaaaaatgttaagcaaattttccaggacccaaatcttacattttcttggcccatcaaaaagcataataatttggcaattttatttgctaatgatgatgatgatgatgatgatggggtttcccaacaacataagaaaaggatgatggttcaaccaataattacattcgtaattactacagcccgtcttcttctttcttccccctataaatttgtgttatcaaatctccgccgtcgtcttcatctttttgataatcatcacacatcaaatcaaatcatcatctttcttaattacaaattcattattctcccctaattacccttacttatctttttgcttaattacatccaattaaa

SEQ ID NO: 79460 - DNA, 257 bp, Heterodera glycines
  Genomic contig location: Contig_ID=SeqID_2383; Location=7926..8182; Strand=-
  SCN-specific regions: Sequence locations=1-257
atgggctacgattatatgaaagttcgccgtcggaacattcgcgcggcgactaacactttgctgctgatcatttccatttacctaatctccaatttgctcagccttttcctttccgtctttgcttttctcaatcccggtccgtcttttcttttttgtctcttcccattgttttgtccctttctttttcaggttttctgcaaaagaattatccgcatcagtacaggtccgttcaagaaatctacaacaaacaaatataa

SEQ ID NO: 79461 - DNA, 420 bp, Heterodera glycines
  Genomic contig location: Contig_ID=SeqID_2383; Location=6545..6964; Strand=-
  SCN-specific regions: Sequence locations=1-111,172-180,202-298,320-420
atgcaatttttgagtatagaatacggtaagtaagatttttggtaagcgctaccgttagaatttttgaattttgggttctattgttaagagatttatgtattatgtatatgaaaaataaaagcggatcacaaaaaataaaattaattaaaaaaaataataaataaataaaattggttacggtaaaaacaaatttaaaacattacagttcaaaggcacgcatcatatcggcagcgggaataattaattaattcggaaaagaaaaaagaggaaaaaagttggacgcagaaatttggactctgaaatttgaatttgaatttcaattaaaatttataatttggcctttgaaattgattttcaaattgatggctttatagaaaaaaaaacggggcagttttttgtcgtaaggaaaatgagaataaa

SEQ ID NO: 79462 - DNA, 340 bp, Heterodera glycines
  Genomic contig location: Contig_ID=SeqID_2383; Location=7762..8101; Strand=+
  SCN-specific regions: Sequence locations=1-24,46-151,173-299,322-340
atgatttctatttttattgttgttgaagaagaagaagaagaagaacacttttttggaggagcagcgccggggggtgagagactgatttttgggaggaaccagttttttgtctttttaatggatcattagtgggcagaggggggggggggggaaattaattaattttatatttgtttgttgtagatttcttgaacggacctgtactgatgcggataattcttttgcagaaaacctgaaaaagaaagggacaaaacaatgggaagagacaaaaaagaaaagacggaccgggattgagaaaagcaaagacggaaaggaaaaggctgagcaaattggagattag

SEQ ID NO: 79463 - DNA, 90 bp, Heterodera glycines
  Genomic contig location: Contig_ID=SeqID_2383; Location=8299..8388; Strand=+
  SCN-specific regions: Sequence locations=1-90
atgagcacaattccgccgttaaaaaacaccaatgtgccgaatggaatgataacaatgagcaaaattgaagaagttgggaagccattcccg

SEQ ID NO: 79464 - DNA, 319 bp, Heterodera glycines
  Genomic contig location: Contig_ID=SeqID_2384; Location=1..319; Strand=-
  SCN-specific regions: Sequence locations=1-319
gggtactcaaacaattatggggagcaaaaatccaacgcataattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatacggaagctattccggaaggattccgactccccataaatctgggcgcatcggctcggcgggactgccccgaaaacaaaaaaatcgactttttcaag

SEQ ID NO: 79465 - DNA, 847 bp, Heterodera glycines
  Genomic contig location: Contig_ID=SeqID_2385; Location=723..1569; Strand=+
  SCN-specific regions: Sequence locations=1-14,51-182,228-365,391 -565,587-606,665-772,806-847
atgtcatcgtttagccatcatcaccaccagcagcagctgcagcagcaccggggctcggccctgtcccttggccatgccatcgccgctccgtcctccgccgaactgatcgtgctcgactcaccaccgccggctcccccaaaaacgccaacgaccacggtgatgatgttcgacagcactgatcatggtggtggtggtgggggcggtcaacgacaacaacagcaacaacagtttgatgtcgttgccagtggttgttgtactgctagcagcgcatcatcttcattcataatcggatcgatggtaagaagcgggagcagtccctttctccgtatcacttatcaccccctccccccccccgccctcctccgaaaaatttttaaaagaaattttctatgttaaaaagttttcacacacacacacaaaattcagcttttgtatcattttcggccgtttaaaaaaatttaaatttagcgagtttgagaaatttactagtcgaaattttaccattgattttgaaaaaaaattatgcatttttacaattatgtgcatagtagtgttttagaaattattttatggtataataaaattttagaaattaccaaatcaaacaataaatagtaatattcaaatcattaaaaaaatttatttatttctttttgataaaaaactatccattgaatggttaattgatacaaaaaaaagtgaaggtcacccattcatcattttgaattccaattcttaattatagaacaaatattacattatttcggtaatgtaattttttaattaatgaattattatattattacattcacaaaaatttttttttgaaaagtggcaaattgaaaaa

SEQ ID NO: 79466 - DNA, 269 bp, Heterodera glycines
  Genomic contig location: Contig_ID=SeqID_2385; Location=2051..2319; Strand=+
  SCN-specific regions: Sequence locations=1-269
atgcaaccgacgaatatgagcaatgttagtgccgcatctgctgcagtgtccaccacgtcggcatcattaaagaccgcctattcggcaataattgatgtgcttgaacttgacgacgtgctaattgacgaaattagcgccgctccaacaagctttggcggtggcacggacggagcgacaaggacggcgttggcaacgccagccggcggtggcacctgcacgacatcggctgatgagcagtcatcgagcagcggcaccaagcaggcccatga

SEQ ID NO: 79467 - DNA, 1863 bp, Heterodera glycines
  Genomic contig location: Contig_ID=SeqID_15253; Location=186..2048; Strand=-
  SCN-specific regions: Sequence locations=1-175,197-1563,1586 -1701,1723-1863
atggaccaattggcagccggaattcctggtgttgttggctatatggacgacttcatcattgcttcaagcacagtgaacgagcatttttcaacaatttttaaattttttaaacgaattcaagaattcgggttccgaattcaaatggacaaatgcaaatttttagttaaggaaatcaaatttttgggtcaaattgtttcgtccgatggtatccgtcctgatcaaaacagaacacgagcactgcaggaaatgccagcaccgacggacatcacaacactccgatcattcctcggcgcaatcaattactatggaaagtacatcaaaaacatccatcaaatcagagcaccactggatgaattgctcaaacagggagtggaatggcaatggaatgaaaagcaccgcgaagctttcgatcaagcaaaagcaatccttttatccgatttagcattaacgcattatgacccgcatttgccaattattgtcacagctgacgccagcaacaaaggaatcggcgcaacaatttctcaccgttttccggacggaaaagaaaaagtttttcaacatgctgcccgaacattgtcaaagacggaacagaattattcgcaaattgagaaagaaggactgggactcattttcgcaattcaaaaatttcaccaatacatttttggtcgaaaattcattttacgcactgatcaccgtccactgctggggatttttgggtccaaaaacggaatcccgattttttcagcgtctcgtctacagagatgggcactgattctactgaattacgacttcagcttggaattcgttcgcaccgacaacactggacaggcggatgcactgagtcgtttgatcagtgaacagcgcaattccgcagcaagcgaagacatggtcatcgctcagttgtgtgcagaaactgagtcggaagttgagcatcttttgaatgtgcagttggaacatcttccggtgacagtagacgaaattcaaacagcacaacaggacgacgaattgatcagggaagtgatcaaatttactcaaaacaaatggccaaaccatggcattaatcccgaaatcaaaccatttttctcgggaaggcacaaactatcaattgtttcaggatgtttggtgtttaatggtcgatcggttatacccccatcactcaggcaccgcgttttgaaggcacttcacttagcacatccaggaatcgttcgcatgaaaaatctcgcgcgaactcttgtgtactggccttcgatcgattccgacatcgaagaaatcgtgcgaaaatgccgccaatgtcaagaagcagcaaaacaaccgcaaaaacaaccgctacaaccatggccaacaacaacacaagttttccaacgtgttcacattgacttggcaggaccttgtagtgatggaaacacgtatttggtaattgtagactcattttcgaggtggcccgaagtgtttatgcttcgccacacgtcatcacaacatgttattgagcaattacaatggctttttgatcgattcggccttccgaaaacactagtttcggataatggtcctcaattcagttcatcccattttaaagatttttgtgacagtaacggcatttgtcacctcttttcgccaccataccacgcacagtcaaacggagcagccgaaaagtttgttgatttcttcaaaagacagttgaagaaatgcagtggggataaaaattggttgaaacaatcacttttgtcttatcgctccatcccaattgcagttttaaacaatcgatcaccagcagaactgtttctcggccgaccactccggaccaaactttctcttatgaaaccggaacggccgagtccattcttccgaggcccgtatcaataa

SEQ ID NO: 79468 - DNA, 924 bp, Heterodera glycines
  Genomic contig location: Contig_ID=SeqID_15255; Location=153..1076; Strand=-
  SCN-specific regions: Sequence locations=1-297,320-418,440-609,639 -643,665-924
atggccatcaatcagcaatttgccgaggctgcgaatgcggcggagcatttgcaaaaacggaatgaagcattggaggagagccttaaatcagccgagaaacggtgtgtgaagggaaagtgaagcaatagcaatacatgacaacaatttaagggcatttgacctagaggaggagaatggaaaagtcaagcaagcaaacaaaagtatgggatatgaattggagcagagccaagcacttgttgtcgaacttaagacatccgttgagacaaaacttgcggaattgaaggtatgacgaattgcaaaataaatactttaatttaaattcaattaatcggtctttctttccagaaaatggattccgtccagcaaagagtcgaaactgaacttagtgacgcactcaacaaattggcacagtcgcaaaacaaagagaagtatttggagcaggacctgaaggaggcgcaattgcaattggaacgtgtaaaagcggaattgggcgaagcgcagaaagaaataacagctaagaaaaacgaatgtactgagaaagcggcggaaatcgacgaacttttgggggttgtggctgagttgaacaaagacaaaattggcgaaaagatcaaagagagagaggaggggaggaggaaaagccagcaaaaaacaaagacagatgaaaagcagcaggacatggaccattctggcagttcagcggcttcttcacctggccaaaacgcctctctgctggaggttgtcgaaatgatcagcaaccataaactctctacaactgaacctttattattgaggaccctgacaatggtgccggatctggcgggagcgcgggatggtcagacttgggcgatgggatggaaatacagggaacagaagcggaaacaaagggaggaaaactgctcgacattttggagttggccaaactga

SEQ ID NO: 79469 - DNA, 134 bp, Heterodera glycines
  Genomic contig location: Contig_ID=SeqID_15256; Location=325..458; Strand=-
  SCN-specific regions: Sequence locations=1-134
atggtcggcggtgtgttctgcgcgctgtgcgtcctcgtcgttgtgctgatgcatttctttgtcagcaaattggtcgccacacttgccctgctgttctccgtctcgcacttctccgacgcgttcgcctttaaacg

SEQ ID NO: 79470 - DNA, 2463 bp, Heterodera glycines
  Genomic contig location: Contig_ID=SeqID_15257; Location=291..2753; Strand=-
  SCN-specific regions: Sequence locations=1-65,88-187,210-348,370 -560,593-660,682-750,773-893,915-968,1002-1002,1024-1070,1100 -1184,1206-1224,1269-1512,1534-1607,1629-1719,1765-1861,1888 -2051,2073-2090,2118-2153,2183-2272,2332-2463
atgcattcttcggaattcggaagcgatgtcgacaatcgcacgggccctggtacgcggaagaaatttttcaacaaaaagaacttaggaaatcttataaaaaagttttttgaaaatttttctaaagtttttgatgaattactaagtttttcccaaaaactttcttaaaattcgctaaaaaattatcaatcattatttttgttttcttgaaatttccttataaaaagatttcctagtttttttttgggtcgcaaaattccacaaaattttggaccacaaatgtccgaatatggttcttaaaaaaatatactttttacactgtaacacacaattttccccatcttcagcagttgttgctgttggcactggtccgggttggcagaagcatcaaattgtggtcaacggtgccaaggagaacgcgcggttgacaaccaccggtgccgtcgccgcggtgccgtcggaggacagcagcaacaatgacgacaatggcggtggttttgtggtggtcaactgttcttccggcgttgctgctccgcctgttggcgatgctccgcagcagcgggtaaaaaattaaaaaacaaatttttaaataattcatattgggttttcctaatttaaaaaacaaaaaaattttacaatttttcaacttaaccccccccccccaaaaaaaattaaattttttttctgtgggcgtggaaaaaaaattcttcggcgaaattttggggtgcacccaggaatgtagcgtacccattcggggggagaccccctctgtgtactgattgtgagatatttttttccatgtcgtcccgaaaccgccttgtttattcgtcccaaatttaaagcgccgcattttctctctctctaattgtccactgagaatcttttcttgtcccgaattgatgatgatgatgaatgattgaaccaaaacaaaacataattaggtgattttgttttccgtttctttttttgccaaaataattttaattattaatttttatttttttgctctctctctcctctttttctgtcgctgtttatacaaagaggagtgcaacaaatacaatgcatgttgttcacaaatcatcatcatcatcacaatttgtcttacctgcccatttttggtgtgtggtgaatgaaaaaaaagcacaaatagcgaaaattcattgcattttttctggcatcattgatttaaaaatttgtttgtttattgggtcacgggaatcgtccaaaaaaaaaaaaattttttttctaaaaatttatttgtttttttagcgtcggcgtaacagcaattccgtcctgcgcacttcgcagtcggccgaccgattgtctcgcaccgcacgacgcgcttcgcgtccccggaacacggtaaaaacagttttttttttaaatttttcaattcgattcactgtggatgaagcctgccccgcaagagaaatggtggctgaaagcgggattttttatatacaaatttgtcaaaaattgtcacacttaattggccgactttttttacctagccttaattctaggggaaaaaatgaaatttcaaaaaaaaaaacaaaaaaattttcaaggatcttttcgttttctgcacatggattaaccggaaaacataaaaattgttttttgtgtttttataaattgaacataggcaaatttagcaacaaaaaaaaatgcgtttgatttttattttttgaaaaatcatcatcatcatcattttccagactgttgctgctgctagtggtggtgctgctgctagtgctggtggtggccatcgtcgtcatacgcaaagtgtcgcttcctttgtcaacgcggcgtacgccgccgctgcacaggcggcgaacaacaacacaaacggcacaagtgcaggtggcggcggcagcagcggcaacaataacgcaaacgccaacaacaaccgggacagcatcagcaccacgacggcatcgacggactgtgagtagtatgtcagaaaaggggaacagttttcgaattttgagtttttaggcttgtcttttgttaagttttataaaaaaaatatcttttggtggaattttaagaaccataaaaaatttccttttcttgttgaaaaactaagatttttaccatttttcttaaaaaatattaaaaactataacataactaaattttcgtgaagctactattaaattttatgaaaatttttttttttctaagccttcgagcttttgtttttaggtgggtgggtttgtcaatttgaatttggcacaaaaaataatcgaaaaattgtctcataaaacacaattaaattcaaaaaatatttttttctgaattttatttttaattttttttaatttaaaagttttcgcgggctcacatatttcttttgatgaataacataatggattttcatcatattattcaaaattgtaaatgaaaagttacgaaagacaaccaaacaattggccttgtaaaagaatactacacaataaa

SEQ ID NO: 79471 - DNA, 3181 bp, Heterodera glycines
  Genomic contig location: Contig_ID=SeqID_15258; Location=327..3507; Strand=+
  SCN-specific regions: Sequence locations=1-238,261-280,313-718,740 -754,776-1649,1672-1865,1888-2674,2697-2757,2789-2806,2828-3181
atgaaaatccgcatttcagagcaaacaaatatcggcaattcgtcaaacgatgtttctggatttgatcaacgcttgaaaaagattgaacaaatgcttggcacaatgttgcaatttgaacgtgccgtgctcgacgttggacaactcgagaaacgcattgaacatattgagaatggtgtggaggcatttgagtcaagaatcaaagcgtgggacttggaaagacaaataatggaacataacccacgacaacaacaacaaatgcatgacaatccaacttttggtcaaattttgtaaaaaaatttatttatttattttgaacagccatatggccttgggcaaaccgaaccaggaaaaaatgtcgccagccgaaatgtcgacggacgaattttttgaccataacttttcgtactcaaccaaataaaatattcttggtttgttcgaaagcatttgaaaaactctatcaacctgcaaattttcaaaattttttattcatgtacaaaaaaatcagagcaaaaagaattcgaaaaactaggtttttgagttccttctggccataacttttttgaaacttcacgaaaattttgaaattgttcggggcactgccgacgaagtttgaatgacatgacataatgccaatcgatttctgttccatttcatgttccttccctcgcccataaatatgctcccattccctcttattaggtcttcctttcattcttttgcatttatatatttgttccccaaatttgttgtgactttcttttccttctccaataaataatatttaattggacttaaacaaatccctcggaccgaacaattggcgcagtcagctaaaaagcaaacgacataaagcgcatttgttattcatttattacatctccaggcgagagtaatattttggatttcgacattcagccgccggtcttcaagtggacgaacacaaatcgtccacatttcgaccgtcaactttcatcgcgtctaaaaaaccaatagaccctaaaagggtgaggttccgctaggcgcggttttcaaacgctgaaaaaactatagaccctaggcgggttgaggttccgcaatacgcggttttcagcgtccattcaacagtcaacgagagcaaccgataaccaccgaccatggcacaacaggcaacattcaacaattgctggacgcaattggtcaactcgtcaccgcacagcagcagcaacaaatcaacaaaccgaatccgaacaataatgttccgattccggtgctgcctgacatttcggtcttcgaaccgaccgacgaaaagggacgtattaccgaatggatcgaaaggttttcatttgctgtggacttttcggcaccaaacgcaaccgacgcagtgaaagtcaaggcattaatgaataaattgtcggaaacggcattcagcgagtattcaaaatcgtgtttgccaggaaaagtgacggacttcgacttcaaccaatcagttgaaaggcttcaaaagctttttgcaaagcctcaatctatattcatcgacagatatgagtgcttaatggccacgaaaaccgaaggagaagattttcgtcaattcgtcaacatacacaaaaggctgttgaacgatttcaagttcacatcacttaaggaggaacaattcaaggttttgatgctcttgacagctctaaagtcgccaaaagacgcaactttacgacagcgaattttgtcaaagctcggcgccgatggagataacgtcagatggcgatgtggatggacaaatcacagccactgggagtgtaagcataagtcagcaaagtgccaaaaatgttcccaaaatggacatttggaaggccaatgcgacaaggtgcaggaatggagacggagaaacaaattgccaattccaaaaaggaaaattggaaatttacgaattggaacgtccatgaaagtgaactccgcttcgcttttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcatcggaaagggagtcgcaaatttcaaattccgcaatatttgcattaaaggcgaatattatgtggcaaaaaggggatcgctaaatttgctaagtgtgcaaatgatggacgcttttggactcctgaacgaactcaaggccaaaattaatgcgccagtgaatttgtgccgagtcggagaagagacaagaggtttcacaaaaactccaaaagcgccactaaattcgacagtcaaagggcacatcgaccatcccaaagcgttattccccgacattttcaaaaacgaattgggccgatgtataaagttcaaggcgcatctgactttaaaagcagacgccgcaccggtctaccgaaaggctcgcccagtcccatacaacgcacaagaagcgattgatggagaattgaagcgatgggagaaaatgggggtgattggaaaagtcgaatacaccgaatgggcagctccgaatgatgaatcgagaaaaatctggtcgatttcaacacatcatggcaattatgaagttaaaagacttcctttttgcgtgaaatcagcgccagccatcttccaatcggtaatggaccaaattttggcagaatttgaattcgccacagcttacttggatgatgtgatcatcgtaagcaaaagcgtcaaagagcacactgatcacttgaagaaagttttggaaaaattccaagaatggggattccggatcaaattggaaaagtgttcgtttttccgagaagagatcaaatatctcggacaaatcatcgacagaaacggacggagaccggacccggagaaaatctcagcaattagcgaaatgcccgcacccacaaatgtgccatcgttgcgttcatacctcggaatggtgaaccactaccagcaattcgtcaaaaacatgcgttttgtacgaaaaccgctagacgatctgctgaagcatgacagcgaatggaagtggagtgagaaatgcaaacaggcattcgacaaaattaaggaaattttgtcatccgatcttctgctaacgcattacgatccaacgaaagaaatcgtggttgcagcagatgcatccgaactcgggattggagcg

SEQ ID NO: 79472 - DNA, 343 bp, Heterodera glycines
  Genomic contig location: Contig_ID=SeqID_15262; Location=141..483; Strand=+
  SCN-specific regions: Sequence locations=1-55,84-343
aacaacgatgccaagctgactttggatgagttcaaagaaggtaaaaatcggaataaaatttttaaattgaaattttcaatttacaggagccaaggctgatccgagcattgttcatgcgttgagcttatatgaaggcctggccacataaaaaaaacaatctttttttcccatttattgtaattaccaatttttttttacaacccaaaactgatcagaggcaatgaatttttacaaaattttcaaggtattgattggcaaaaaaattcatttgagagagatcattttgtgttgcaaaagcataattaatgtccattcatttacttatataacaattttaatgcga

SEQ ID NO: 79473 - DNA, 2609 bp, Heterodera glycines
  Genomic contig location: Contig_ID=SeqID_15262; Location=1401..4009; Strand=+
  SCN-specific regions: Sequence locations=1-303,341-348,370-385,428 -554,576-713,745-1078,1114-1344,1445-1731,1841-1995,2030-2352,2401 -2435,2461-2565,2602-2609
  Gene Ontology: Mol. function=electron donor activity; Cellular component=peroxisome; Biological process=energy pathways
atggcttcctccactcattattataaaatggatccatctcgagacaatccggacctgaccgaggagcgtcggaaggccaaatttgacccggaaaaactaggcaattttttctggcaaggccaactgaaacggcggcgccaaatttgtgactatgtgcaggcccagggcactgagttggcaccggcacagcccgtgccgttcatgacccgcatggagaagctggaggacgtggcccgattggttagtgtctctcagaatacttgggcaatgatttgccaaggacaatccttgaaaatcagtaacaaattccaatgaagtccttggaaagatgtttaatccatttttgcaaaaataactaactataaaaaatgattaaatttcgaacaaataaaatttaaattgttttttattcaatttttaaaattttcagtctgttgggatgagaaagcatgccgaaaatgtgatcgatgttggcagtccacaggaacaattttatttcaacaggtaggaaatgagtactggaaaaaattaattaaaaaatcagatttaatcagattttgagaattatttcaattgtgaaatgatatttcaaatgataaaaatgatatagagaattattcaaattgataaaatgataaatcttgggatattatttgaccaaaagatttatttattaatgagtgagtgaattaattattttcgctcatttgctgttaattaattaatttaattatatctttttttcttttgcatatctaatttttgccaatttttgtccataggcataaattttaaggactgctgatcactcaagcaaggacaatccctataaataaggacaaacattcctgatataattcatatttattaaaccattttaagcctgatctgcggttatgacggctctccattccatttgcatttcattatggcactgccagcaatgatcaacaactgtgatgaagaacaggcggccgaatggttgcccaagctgttcaactgtgagatcattgccacttatgtgcagacagaaatgggccatggtaagtggcactgatcagctgagtgatcggcaatcaaaaatttaattttttaatgatttttaaataataagttaacaatgcaatgtttaattgtgattttaaatttacggaacattttatgtcaacaaaatatactgtagcaaatgatcagagttgaaggcaaattagcctgatcattattcagcattctaatttaatttgattagaaaggtccggcttttttatgcgttaaacaattaatattcaaagccgaatagttgatcagaatgtataatatgatcataaaataatattgatcatcttttattaaaaatatatgttttttaataaattttttaataataaatttttaaataactttttttaatataattttaattaaaatactaaaaataaaaaatggtttcaaggcacaaatctgaaggcattggaaacaacagcaacttacgatgcttctcgtcaagaatttgtgttcaattcaccgacaatcacatcaacaaaatggtggccaggcaatcttggcaaaacgtaaacttttgaaatttaaatttaaaactgcctatttttaaaaatttagtgccaattttgctgtcgtaatggcacaactgtacacaaacggtaaatgctacggtgcacatccattctgggtacaattgcgagacattgagacacataaaccattacctggtaaattataattaaaaaaaatattgatttttaaaatttaaaatttttgagtgtaaatttgtatgaaatttaaattaaaataaattaagaataataattatataattaaaggcattactgtgggcgacattgggcccaaatttggcattggttcaaatgataacggttttctacggttcaacaactaccgtataccgcgtatgcacatgttaatgaaacatgccaaggtgcgattttacatatatctgatctgatagttaaaaccaaaaaattcttttataaaaatttaattaaaaaaagtaaatctaagatataatgtaaaccagggatggcattccgaggccacaaaaaatttggtaagtcggaatccaggacccaaaaatttttcggaaatcctaaatctgaagccggaaatcggaattccatgtcatccctgatgtaaccgtatcttttttctcattgtactgttctttttctgccacttgatcttctggtttccgaaaattatttattttcagaattagagttttagaaaaattcattaaagtacattttataggttcttccatctggtgaatatttgccgccaatgcactccaaagttggctatacgtcaatgatgtaaaaaaatttcttaaatttatatttatttattttttaaattttttaaggtacgttcgctcagtgatggtaaggagcttaatcaatttttaaaatatttattttttttgtgcttttttttttgatatttggcaacgcaatttacttggcatgtgccatcacaattgcagttcgttattcatgcattcgacgacagggcgaaattcggccggggtgatttttgaaaaaattaaaatgtttaacttcaaaaattttaaa

SEQ ID NO: 79474 - DNA, 2284 bp, Heterodera glycines
  Genomic contig location: Contig_ID=SeqID_15263; Location=269..2552; Strand=+
  SCN-specific regions: Sequence locations=1-57,86-113,135-744,766 -1015,1039-1302,1324-2180,2220-2245,2268-2284
atgggcacaaatgaggggcaagagcagcagcagaaacgggtgggaagaacaaaatttggaagaatatttgtttaaaatgtggcgattcaaattccaaaaaaaaaaacatttggaaaatcaataaacattttcctaataaaaagtgactttattgaaaaaaaattgttgaagaaatcctcaatttggctaaacatttttcgaatgtgttatgccttctaagctcatttcattcagaaagaggctgacgacgccttaccgcactttccaatttcggccgagctgaaggcactgtttggccaaattgaagattatgtggcagaacgtgttgagattgtgccctgctggaagcccttccaaattgactatatccccgcggtcggagaggtcgacccgttcatcaaagtgccaaggcccgaccaagtgagtggcatcagctgaaaagataaaaagattatctggtcagcagcgatcacaattggtctgccgctgacttgagatgggtgcggggcggagatcctgcgccgtcagattttgcgggataaacaatccgcaactgaatttttggaaaaacttatcatatgaatctgctcttttttgaatggctgtgtgttatttaaaaccgggacatagtcaaatgatctgattgtttccgaatttcatgaataaaaatatatccctaagaatatgattacggctatcctaattggacatctgggcaatggacatttcaacagtggacacgccgaaagtgaactcatttggacaaaagtggacaattgggcaatggaaattacgacaaattttgcaataaaaatgatttaataagaagttcaaaatatttaaataaagagaaaagcataattaaactcagaaattctccgaagggattgctcgtaattaatggaaattaaatttaatttgtaataattgggccagaaatccatacaaaaactttttttagtttgcaaattatttttttctcattgtaagtccattgcttagttttcacttctgttcaaataaattcacaataaatgtgcggctccatttgaattgatccattttcaaaaaaatgagtttaaaaaattacgctttctaaagaagaaattttaaaatttttcctaaagtacgaatttttttaatcaaaatttggagttctaagataattgcattctttatggtttttcagtgggataaatactgaaaaccgaaaatttacctatttatcacttcttaatctggaatttttgttgatattccctttttaacttttggctttttattgccaaaaaatagagtccaagtttctaaggttttgatttttagaatgacgaacttttgctgggcttggccgtgctcgatgagcccgccacgcaacagtccgactcggccatcgtcgacctccgactgcaccaaatggcggggaacagtgcggcggacgcgccagtgaaaaagctgtcacgggcagacagaaacgcacatcaaattgtaaatggaaaactcacctaaataattacaaattgggttgctcacgaccttcggggaataaattctcgggaaattgagagggcaagtcgggatcgaggatccgacccgatcaggggatagtcaaaattttacggctctattaattaatttctttttttttctagtccatataattatttattttcccgggaaagataaatgaacaaatcaacaatcatttccaactttatttttcaggatcgctgggtccaaaatgtgaaggaactgaggaggacgaaggcaccaacgcgggtggtctacggaaagccaatgccatccatcgagtcgctgatgcaagaatggccagccgaactggagcaaaagctgaaggagatgaaggtgcaaatagatgccaaatcgtcgttttataaatttattcagctgctcataaatgccaatttggacgccgatttggaggattttgtcgacctttgccttggcctcgtcgacattccgttgcacaaaagtcgactcgagtcgctgcacgttttgttctcgctgtacgccgagttccgcgcctcccaacacttccgcaacatggcaatggacagagacgaagcgggcggagcgaactcagcaaacattgaccaatttgtgatgccggattagagaaggcactgttgagacacatatcaataatgacattgaaattatttactgcaaatcactttaatatttattgtaattattttgcttttaaatcaggaatttcttgggttttttgtccctggtttgactttgcccgttttcgttcaaa

SEQ ID NO: 79475 - DNA, 568 bp, Heterodera glycines
  Genomic contig location: Contig_ID=SeqID_15264; Location=270..837; Strand=+
  SCN-specific regions: Sequence locations=1-431,453-568
gatcgctgggtccaaaatgtgaaggaactgaggaggacgaaggcaccaacgcgggtggtctacggaaagccaatgccatccatcgagtcgctgatgcaagaatggccagccgaactggagcaaaagctgaaggagatgaaggtgcaaatagatgccaaatcgtcgttttataaatttattcagctgctcataaatgccaatttggacgccgatttggaggattttgtcgacctttgccttggcctcgtcgacattccgttgcacaaaagtcgactcgagtcgctgcacgttttgttctcgctgtacgccgagttccgcgcctcccaacacttccgcaacatggcaatggacagagacgaagcgggcggagcgaactcagcaaacattgaccaatttgtgatgccggattagagaaggcactgttgcgacacatatcaataatgacattaaattatttactgcataaaaatcactttaatatttattgtcttttttaattattttgcttttaaatcaggaatttcttgggttttttgtcccggtttgactttgcccgttttcgttcaaa

SEQ ID NO: 79476 - DNA, 2810 bp, Heterodera glycines
  Genomic contig location: Contig_ID=SeqID_15265; Location=384..3193; Strand=-
  SCN-specific regions: Sequence locations=1-146,169-280,302-384,406 -548,570-796,818-1038,1060-1192,1215-1236,1259-1325,1377-1395,1418 -1424,1447-1540,1571-1794,1845-1894,1916-2033,2058-2116,2139-2810
  Gene Ontology: Biological process=embryogenesis and morphogenesis
atgatcaacaaccggttgatggtcgcacatgagttggccctgtatcgctttgcgcaccaaattccggtggacgacccggaaagggaggcgaccgtgctgaaacacgtgggtaaccaggccaacgcggccggcatcgacgcggaatttgctgtgaacttcctcctggcacagatggaggccaacaaaatgattcaggtgcacaaatgcatggcaaaagggaatctcgagaaacgtcccacctccgtcgtaacagaaataaacaatggccacagatggaacggaaatattgtttaaaaaggggcattttgcatattttagtgcgtgacccaaccgtaagcagatatttctaggggagaaaattgaatggttttttagagaaaatgaaaaatttcacttcaactgaaaagttaaacaatgcactttttcgttgttttgtatcaaatttgcttaataagttcaaagctttcaaacttttcagcgaggatatatcgaccggtggaattcggatcactctttcgagtcaaaatatgtgccggattttgagaaagaaattcaacctaaattttcttacgcaacgaatgcattgattttggcactgattccattggtcgatgcgggccaccaaatgcacaacgaccaaaactgtgttgagcatgtggaagacgtgttggaatcgatggagcatttgcgagccagcgaattggagccgaacggaaaggaagccatggaaaaagccgtcaaagcaatttgtgacaaaatatcgacacatgagggacaaagcaacgcagaaggcgggatttgttttttgataaaactgatacaagaccagtagagtggtgaagtgccacctttagttcgccgtcgcgatttgcgacagtgcaaatttaaattcgcgaccgcgagatttttctgtctgcgctccattagctatattgaatcaatttttcatttttgtctaaattatcctcatttaggaaaaattcctcaactgggagaatggaaaatttttctcgaaaagcgaaagggccaaaaataaaacccaattaattatttaaaaaattctttggtccattcattcatttagtttagttaagccatttatgtcagcttaattaaatgttctttctattggtgttttaatttagatcaatcaaaatcgaaaaaacggaaacattctgacaatcacaaaatggaagagggaaagcatggggaagaaaaagaaattcgacccacaaaaagaacacggaaagcgaacacagaagaaagcaaatcaccagcagcaggggaaaataggagaaatcatcgcagagaaaactatggttttgtttaattattacatattattttttatttatttaaaaaaatatatttttattcagtggatagtcaaacaacaaaagaacaaacgaagaaagaatcaccgcgaagaagggaaaatgccaaaaacttcgaacataaaaagagtgcccaaaacagaaatgtgaggaaagggaagaagcagtcggaagagagttgggaaggtaagaaaatcgacgaaccgaaattaaatttatttgaaaattatttttatgagaaatgtgaggaaataaatgacaattaaatttaaaatccagatgacatcgaaaaggtaacgaagaaatcaccgcgaaagattgaggaggtttccgacacgagcataatgataacacggggagaaaaaagtcggggaacaaatggcaaggacaaaattacccacgaaaataagaaaaccggaaaagaaagtgacacaaagggtaaagtgtccttttaatttcgattttaattaaattgtataaagtattatttttaatttatcattaatttaagtgaaaagtccgaaaaaatcgccaagaagaatcgaagtttctgatcgtagtgttctgataaaaatggaagatttaataagcgatgaaaaggaacacttaacaagcagagaacgaaatggtaaatcattccagtccgtccgtcaaataacgttaattaagattaattagcccatttttggcatttcaatcaaaaaataataaattttaaattaagtttttggacaaattctcttagaaatttcactcgattattcctcaataaaacatccgtttttaaaatttgtggtttaataactgaacatttcaattaagaaactgatgcctattccaaaacacaagtcaaaaaatcaccattcaaaaacaaagtgacgactgaaaatgaaccacagaacaaatcgaaatcacaagcagaggagcaaaaaagaagtgctgttgctgctattgacaaatcatttgacgtccgatttgattccgaagaagaaaatcctcgaaaagcttccagcaccgaaacgatccgaaatccttcgctgatttcccgggacgcgtcgattccgatgaattcgagaaatctctccgctgttgagcacgaaaatgagcggaaagattcactggttgtccaccgaaataggcgtataaatgacaatgaacgcgcaaaaagcatcggatcggaggaaaatttgcaaaaccttggcctttctcgcgacgataaatccacggcggatgaagcaaatgatcagtcaatgaatgggagttggtcagtggagaaaacgaataaccaaagaaaccgtcatgtgcaacaaaatggagaaagtcggcaaaactcgaacataagcttgcatagtccatcacgactcttgactgggatcagcactgaacacggggaagagcaccggcaggagagcgaagaaaaagcgatggaaagcacgcggaagagcagatttttaatgccaaatgcgagcggagagg

SEQ ID NO: 79477 - DNA, 278 bp, Heterodera glycines
  Genomic contig location: Contig_ID=SeqID_15265; Location=3261..3538; Strand=+
  SCN-specific regions: Sequence locations=1-278
atgatcacactacgaccccgaatttctaaaggctccggaatgcgggaccacccctggaacgaatcgggagacttggtacgaattggctaatttgttattacgattcgcccttcttccgttgtttggctatcattttttttaataaaccatgcactgttaatttatcaatccgaactggtgaggagaatggccttagcttggctacagtaagttgctaccgtaaccaatcatatttcagaattaattttttgttgatttaaaattacaattttatcaaa

SEQ ID NO: 79478 - DNA, 1402 bp, Heterodera glycines
  Genomic contig location: Contig_ID=SeqID_15266; Location=854..2255; Strand=-
  SCN-specific regions: Sequence locations=1-13,39-121,143-308,330 -449,491-892,915-971,1002-1125,1148-1241,1289-1402
atgagctcaacacaatatttaatattttttcttttgttgtgctgcttaaaaaatatcagtggaattggtttcgatgaatttgcaaaaaatgctggtgcgataaatttagctgatcagtatcttaaaaaagaaataaagacaaaaggagaattattggaaaagcttgcccaaattggagttgaaataagtctaaggacgctggagagacatctttcaaaaataaaaagcaagcgtaaatcagaagacagccaagtcaacaatgaggaagacatggaaaatgcagaaatttcgcaatgtttttcaaaatttgacaataaatttctttttattattggccatggagacgaatatagaaaataccaaaaaacgaacgaaaatgcaaatactgtctatgcctattgtattaagtgtgaaagtttgaagaaatcaaattcggggaggtttttgtgtaatatttttcaatatttaatattttcttaaacagtacaaattattcgaacaatgacacgagttactaagaattttatgtttaaccctcttaatgaagaccaacgccaagaattatgcgaaacgtggttttatacatttagtaaggcgttagtttggtgaaaattattgaataactatagatgaagaccatatagactactcagaaccgtttgaatttgtttcttctgaatatggaccgggtgaggtaacagaaattttaggggatggaaattgtggttggagaagcatctctcttgccttaactggcactgtgtcaaatcactccgagataagaaaggatgtaattgaatatttggaagaaactgtttaccaacattctttttctaatcatcacgataatgaatggtggtgtaagtctgctattttagtttttaacatgtagccaacattttagtgctttttgatagtattgaaaatataagaaaacacatagagaatgctattgctcctgcaataggcgcccatgaaattgaaaaatggatgaataatttggatctagcagcagtcaccaaaatgtttcgaataaatataattgtgtgtgaacgtatacaagaacgaattttccgttggcaagtgtactcaccagatttagaaacatcggttagaaatatttccaatatgcaaattcatataatttttagctttcgaacctccaacaaaaggaatcgactgcatcaatatttttatactttcatgacggtcattatgaactaataagaaaaccacaaaagataaattaattatttttttattttttttcttattataattaaaatttccctttgaaagttgcaaagaaatattgtggcacttattgtggcacttcattttttgactcatgctttatagcaccagtaatatggttttgcaactttaaaaaaggtttaataaa

SEQ ID NO: 79479 - DNA, 1411 bp, Heterodera glycines
  Genomic contig location: Contig_ID=SeqID_2387; Location=236..1646; Strand=-
  SCN-specific regions: Sequence locations=1-179,207-381,404-536,558 -574,652-653,675-733,755-765,803-951,976-1297,1321-1336,1362-1411
tgtccatttgacggatagcggtggtggattcaagaaagtgcaatttagtccattggcacaattccatgccaacaatggatcaaatgaaaccgtagtgaacccttacagaattgaatttcgtctgatggctcgcgatggcggaaattgcgaggatgggtaaaaaaataaactaagaattggataaaatttgaattttttaataaactgagaatctgaattgacagcattctcatctgttacacggccttgcttcaacgaggcaatcatttggagaaaagcggaaattcaaaagtcaaaagaaaatctattattggcgctaaaatggtaaatttgggtaatacctaattaaaattacatattaattccccagggaaattcgattgaaaaagaatgtgtgcaaaagatgccaaaagatggcaacaaaaatgtcacaataatttggcgcgccattaaaattcgcacagtgccaaagcaaaccaaaaatgacaaaggaaaagccatcattttggagtcatcaatttcctcacaaaaacagtgaatatttttaattattttaagcaaaagtgggaaaatgaaaatttttaaatttttgattttcaaaaaaataaatttgtattaagataattttttaaatattttaagatataatttgaatgcaggacaactcaaaatttctgtgctttttgcatcaaatcaaactgctgttcgattcactcgtttttctttggaagaaaatggtgaaaatgaaaaatgttttggtatcagaatttaaaaaaatcattattttatatatataaaatttggcattctcggctttcccaaaatgccattctcagacttcggtggccgtgccatgcaaaatgatttcctccgttcaaatggtctgtcgtttttggcggattatgccgacctttggcttcttggacttgacatgctgccgatggcacaccaaacagaagagcaaagagaacagctgaagatggagctgttcatcagccgcagctccaaatgcctcattgaagcatgggtaaaaagaaaggcaaatcagacaaaaaggacacaatttttggggatttacctatttatctttttatggctatatggaaatagcaactatttttccattttggctatttggtccaattttatgctttgaagtttgtccaaccatcgcattcccttgagccatccgatccgaatttgcaattcgccttttcgttgtgcaaaccaaatcctacggaagaagaatatgaacggtatttgaatatgacattttttgtgacggtctcaatttaagtcttttaaaattatattttatcgttttcaaaattattccaggcttttccccaaaaatgttgacaaatatgtgttcccgactggcggttcatgtgcaggattgagcaatcaaatg

SEQ ID NO: 79480 - DNA, 936 bp, Heterodera glycines
  Genomic contig location: Contig_ID=SeqID_2387; Location=1380..2315; Strand=+
  SCN-specific regions: Sequence locations=1-61,89-268,349-470,493 -493,573-851,893-936
atgattgcctcgttgaagcaaggccgtgtaacagatgagaatgctgtcaattcagattctcagtttattaaaaaattcaaattttatccaattcttagtttatttttttacccatcctcgcaatttccgccatcgcgagccatcagacgaaattcaattctgtaagggttcactacggtttcatttgatccattgttggcatggaattgtgccaatggactaaattgcactttcttgaatccaccaccgctatccgtcaaatggacacttaaattataatttgaaaatgaaattaagaaaaaaatttataatttaaatttaaaaatgaaagtaagaaaaaaatttttacgcatgatcagcagttgttggcaattgacaaatgatgcacattaagagaacgattaaaagagaaattactttgacaattaaaaaagtcatttttagtctaaaacaccaaagaacatagacagaaattaaattaaattaaattaagaataatatttatgtatattttttcctttttataataatatttaatgattaatttttatttatttattttacatttttaagagtttttccgtgtgatatagaaaattgttttggaatatttttatggattctgtcgaacatcagtgaaaaggatggggagaatggaaaacggatgaggatgaatcagcagtttaataaatcgtaagtccccatttgcgcctctacatttgcgcctcgcagtattttacactttttcgcccatttgcaaaaaaaaaataataataatcagaaaatattaaagacattccctacaaacgcttaacaaaaaattatttatcaaactgcctccgaataaactcttttaatttaagtaaatttataaaaattttaacaatttttagcgctttcacgcttttcggtggtgccaataggtgccgccggtga

SEQ ID NO: 79481 - DNA, 440 bp, Heterodera glycines
  Genomic contig location: Contig_ID=SeqID_2388; Location=4..443; Strand=-
  SCN-specific regions: Sequence locations=1-440
atgggacggagtaaatgggaaacgccgtgcaattgtaaagccgttcatattcgtcatgacggacaggaacagctccatcaatcagtcaaatttgaccctatcaaacatagtatttggccaattaaattatatttcagttctcgaatggaatggcctggtagctcagatggaaagagaaattttaaattaacaaattttttgaattggatttgaaaaggtcaaagactgtattaagcttcaaagaatttagcatcaaaaattcttatatcatttattgcattttagttgacatatttgggccttttcttatgagtgtattttgtagacgcacgtaacattcttttatttgtctcactttcatactggcaattaattcagttttgtacaaattaatgaggctacttccatatcctttctcattaggaaggcataacattaaa

SEQ ID NO: 79482 - DNA, 798 bp, Heterodera glycines
  Genomic contig location: Contig_ID=SeqID_2391; Location=1026..1823; Strand=-
  SCN-specific regions: Sequence locations=1-326,360-473,495-798
gaccaggttttcccccgggtcccatcaccggacgtggaggttgtcgtcgacggcgcagccattgttgatgaggaggagcagcaacatgtcgaggaggaggaggagcagcagcaacatgtcgaggaggatcagcaccagcaacaccaacaattgacacattgcgtcccggcaacacagcaccagcaacaaccatcgccgatgctttcagctgccgtccaacaggcgatcagcactttgcaaatgcgcatgccaccactgcccgtcttcccaccattcgcaatgcctttggtacttcctccgctacagttcactttccaaccgtatctgcaacaccggcagcagcagcagcaacagcatcaatttgcgtctccggcactccaaattgtcccgctcgatgatgccccggcgcctcaaccgttgtgcgatgttttgcaaacggtagcctaaacccacttttacctataaatgtaaacccccacccaataagacgccaacgtgttcacgtcgcattcctagagaatgtgtgcgcactgcctacaagcgcctctcggccgaacagatcgcgaccgcccgagcaattctgtttgacaatagaccggacactgccttcagctcggtgtcctcctcctcttccgcttcttcgtccaccacttcgtcccgtcgaagcgaccgtgacaaaaggatgaggcaaattgttgagtattggaagcagaagtgccgcagtgattgccctcattgctgatccctttgttttatcattttcattttttatttatttttcacatttcatataataaa

SEQ ID NO: 79483 - DNA, 1324 bp, Heterodera glycines
  Genomic contig location: Contig_ID=SeqID_15267; Location=1087..2410; Strand=-
  SCN-specific regions: Sequence locations=1-61,83-97,119-137,159 -277,300-309,331-616,638-641,663-1052,1075-1192,1236-1324
gatttgccggtgataaagactttgtaatgatgacaatcaaaaataaatttccgagaacaattattctagaagggttaaaagcagagaaagatagtggaattgaatggaatgttgaacaattaattaagggattagaagagataataaccatgagggaagaagcaatgagatgtacaaaaataacaagagcaattggtggacaacatgaaaactgggatagtgacaaagacaattcaataggccaaaaagcaattggcaaaataatcggtacagaaacaataacagagaatataataaaagagaagaaagaaatcctcaaaataatcaaagagtttttttaacacaagaaataagaaataaacagagcaataggacaaatttgccaaatccaaaatgcgtcttatgtgatggaccacattgggcatctctttgcaggcaaatattaaacagagactctcgaataaaaattatggatgagcaagggagatgccatcgctgtttgaaaaaagggcacgaaattagaaattgtacgggaaaaatgtgctataattgtgaagggaatcacaataagttaatttgtccaagacccattcaaaaagtatcagcaaaccaatacacaagaaaacaaaactcgagaaacgaagggcaaattcaaatttcaaatttagtagcaactgccattagaggaataaatgaaagagaagcattacttatgactatacgcgttaaaatcatagaaggcacaaaatatataaaagttttggtattttttgacaacggaagtcaagtgtctctaattacagatgagctaatcaggaaaatcaacccagcgaaactttgtgaaggaaatttagacattttacccattcgaaaagataacccagtgcgcctaaactcacctaaatatatcataaaacttgaaactttggatggaaaaattgaagaaattgttgtgagccgtatcgattttataacaaagaaaattagaagagcgaataatttctggggaaattgaacttgtcgaggaaaaacctgacattttaatcggaagaagagagttttggagattcttccaaaaagttgaaccattcagagaaggacttgttaaagttcaaacagtttttggaacaataatctgtggggaaatgatttcatcagggccaaaattatgcccgctcacagcaatgatcatagaaaacgaagacaaagagccagaaaaatattgggatttagaaatgattggtgttaaagataatcccgtagaaaaagatgatgatgtagcactaaaaatgttccaagactcagtataccgaaaagatggacg

SEQ ID NO: 79484 - DNA, 319 bp, Heterodera glycines
  Genomic contig location: Contig_ID=SeqID_15269; Location=127..445; Strand=-
  SCN-specific regions: Sequence locations=1-35,57-85,118-174,217-319
atgaccgagaaatatttgtatttgattgtagcccaaaaaattgaaagcttcaaaaagtgatatatttcgcagattcactttttactaaaaaaaaaaaatttttttttctaattttatcgagtgggggccgttccgggtacaccccaaaaggtcgccgggacataacgtagccacaaaaaaaaattaaaaattttaagaaaattaaaaattattttagcttttttgaaaatctatgtgttaataaaaactaatttgcttatttttaggaaaaattttaaaaaacttgaaaaagaattttttctttaaatttcttaataaa

SEQ ID NO: 79485 - DNA, 2136 bp, Heterodera glycines
  Genomic contig location: Contig_ID=SeqID_15272; Location=16..2151; Strand=-
  SCN-specific regions: Sequence locations=1-93,159-163,204-214,309 -440,489-501,533-622,682-762,786-1047,1069-1491,1527-1640,1699 -1782,1805-2136
atgattgtacctcttctaatcacttttgttcaaattttaatcactgttgcacctcttctaatcacagttgtacctcttctaatcactgttgtaagaaagagggagagaggagagagagagggaggagagagagagagagaaaaacagagagggagggatggcacaataccaagggaaaaaggaaattttcacataaaaaattttcgcataaaagttttatttaaaaaaatcatcaatttatttttattgcattaataaaaagcatagaaacattttttttaaatttcaaatttaaatatattttttttctgttaggccatgacccatttccctgtttgtgcaccaaatacatgtgcgttggcgtgcccgccgttctgtccatgcttttggcaaatatcaacgcgcactaagcccacgcgacagcaaccgtaaaaaatgggaaattttaatttaaattaaccgtaaaaatgaaaatttatttaatttatgcgtaaaaacgaaatttttatttttaattgaaatgatgaaagaatctcttgaattaatgtgtttaatttggtagcttataatatatcaaaaaatcgtttgacttactcttaaaaattaatcattttatgccattttaattgattgcaattaattcattaattaattagtctgaactaattagcaaactcattaggcggccgtttctgcgcctgaccgtttcaacgccaccaacgccggacaacagccgaggccgaggacaacgagcagtgcaattggtggtggtggtggtactgctgacgaactgcaacaggaggcggaggacaacgaaagtgttttgctgaacggcgccgaatcgccgacccccggcggcggcactttgggctacgcaattttggcggaggactccaaaacgccggccccattctatgaaatgatgagcgaaagtgagctgaatgtaagcgacgggtgccacgttttgtttaaaaacagaacatttgtgcattttagtttacaaaaaaaaaatttttttttgaaaaactaaggagtggggaggggctgttgatttgcattttattggcaaagtttagtgtattttgtggtcaaattattgtaaatattcaatgaaattttaagaccaaacaaaaatttgctgtgaaaatgacaaaattttgagccgaatttcgcaaatagctaatgaacatctgaaatttaatgcaattttcagtgaaaatttgcatcaacttccaaattttgcctatttttttcactttattccgatttttaatgcctttttttggttggaattccaatttgaaattctaattactcaaacttaatattattttgttcaatttaaggccgaacttgcaaagtatggccatggtccgatgggaaaacgtgcggctatccgacttttgaaccgaatttatgaggcaacacacccaggtttagcaaaatttaaaaatggggtacaattttttaatacttttaaatgccactgacaatttttacaatttttttataaaaaagtataaattccataaaaatcgaaaattttttgaaatatttggaaaattttgtaatttttcgaaaatcattttaaatttctctcagaaattgggatttacttcatttcttcgttttctccaccgaaatttttaaaaaacttaaaattttcaaagatttttttttaaaaatatctaaaaaattgtaagaaaattgggaggaattggattttccaaatatttttttaaatttccgttttaggcctaccctctccctaaaaaagttcccattttatttatttttcagtgatttcaagcgacacgccaattccgcggaaagtgcggcgcgcattggcgacggacgacgtcggcggtgacaaaaatggggcggctgaacggcaacgggaacggaggaccaagcaaaaaattggccaaatgttgcggttggccaacaaaaatgccgagacggagacgacagggaattatgccaagcaaaacgacgacggtggcggcgatggatttgccaacaatgccaaagaaaacggtgccggacaaatggcggcggcaacaatatctaaacaacaacaacggcacggacagcagcaacagcggggggcaatggacgcgacggcaacgacggatg

SEQ ID NO: 79486 - DNA, 857 bp, Heterodera glycines
  Genomic contig location: Contig_ID=SeqID_15273; Location=631..1487; Strand=+
  SCN-specific regions: Sequence locations=1-72,122-521,545-704,728-857
atgatgtttattttctttatttctttttttattattggttttcatcaatttttaattacattttcaattgcaaatccattagtgagttaattaattataattaattaatgaaaaattaattttaataatctatttttattaaccaggacgaggaccaaaggctaattgcagttatgaaaggcgacccgaaaatgcgactaagtgaatattcaacgcaaaaatatgaggcataccttggcattgtgtatttaatgagaaaaaattggaaatgtgacaaaattgcggatgaatttgaagaatatgaacggaaagaatgccaaaaatatcgcaaatatttggacattttgcataaatatttgttcatgggatatgccggaattcccacagtcaagccaaaatttgtttttaaacataaatttgaaattgaaggcccactaatttttgtggtgaattgtttgaccgaaatttcgaaattttattttacaaaagagacaggacaaaattttagatataaattgaacgaatttttcaatggttttcttgaaccaaaattgttgaatgagaagcgattgaattatgagccaaaattgccaatgaatgaaacgattttgcaattggcaattgacacagcgaatgaacggcaaacaaatgaaagtttggatggcattattcaacaaaattgtggagaacaatttgatgaaaatttggaggaaatgttcaaaaaagcggtagaacaggcaaaaaaggacaacccaaagaaagcaaatcaaataaataatgaaaaaaaacaaaaaagaattttgtgttcaaaattagatgatcaatccatatgggtgacacttttaacattcaattaa

SEQ ID NO: 79487 - DNA, 1659 bp, Heterodera glycines
  Genomic contig location: Contig_ID=SeqID_15273; Location=1581..3239; Strand=+
  SCN-specific regions: Sequence locations=1-200,222-288,328-852,998 -1146,1169-1295,1327-1364,1402-1659
atggcagaagaatattcaaatgctttatttcgagctaaaaaaaaaggaaatattaattgggatgataaaaaaatgatttcttttgggttattcgaaaaagaggaaatgaaaaaatatttgaaaaaaaaatatgaagcccaacttggcgttgtgtatttaatgcgaaagtattggaaatgtgacaaaattgaggagaaatttaaagaaaaatgcaaaacaaatcgaaaacatttgcacattttgtacaattatttattccatctttatgttgaaggtttttattcaatcattatttataaaattaataaatttttaaataatatttaaggtaaaagtggtgaatttgtcaataaattttcggcagttaagccaatgtttttttattattccggagataatcaaaaggagttaatttccgtcgtcgaaactctgagtaaaacttcgcagtgtttttggggaatacacaaattgagcatttccaattcccatgaaatggctttgaaaaacgaggacgatttgatagacgagaaaaattgggaggaacaaaaaaatgttgtggaaaaaattgacggaccaaaaaatgtgcaaaataagcaacagaaaattttaaatttaccaaaagaaaatgaaaaaaatctttggaaagaatttgagcaaaaaatggaagaaatgtcaaaaaatgcaaaagcaaatgtcaaaaaagaaagggcaaatttgaacgacaaagcagcagaattattaaaaaaaggcaaatatgatagcgaaaacgaaaaagtagatctattatatgatgaatataatgccaaatttgaaactttcaaatcgtcgccattttactaaaaaaaatccacgtttttcttgattttcttttcttttcatttcattttcatatttttcaattcattttcatttttctcgcatcaacctttctgtccttttttttcattttacatttttacaatttttctctttttatacatacatacatacatattttgttgcttggtcaaacttttggaaaatatttttgcatttttgtaatttattaattttacaatttttgacccagttaccccgaccgatttgttgatccccagagtactgacaaatgagaaggacgagaaagagaagagagaaagaaaaaatataaaatttgtaactgaaaaaagttaggacactttttaaacttgcaaggactcagttggcccgctcgttggaatttttttttaaagtaaccaaaacgaaaaaaatcttcgaaaaaaatgtatttttataggaaattttttaattacgcctaaaaatctaaaaaaaaatttttttttaaaactctgaaactaaaaagtctaaaatttttatgaattctctttttaacgatttttaaaaaattttctggggggaaaactccgtggggaatgtggagcgtatattctttcgttcatttgggcttataattgaattgatatactattgcgcaaacggtaccattaagccactgcctgtgccaccagtcattaatgttgaagcgggcggaagacgaaatttgaccaaaatgtcttccgcctcggattgccaaccaccgccggcggtggacaacggacgcgcggagacggcatcgaaaaatccaagcggaaattggacaggacgcggctcttaaaatta

SEQ ID NO: 79488 - DNA, 610 bp, Heterodera glycines
  Genomic contig location: Contig_ID=SeqID_15274; Location=845..1454; Strand=+
  SCN-specific regions: Sequence locations=1-106,131-229,260-308,352-610
aaatcaagtctcaaagccagaatacaagccaaggcaaagccttgcaaaaatcaccacccggactcacattcgttgacccaaaagaattgtaaagaattaaaacctcaaaaataatttatttaaaattaaaggaccctgtcgcaatacaaacgcacagagtttcccgccgcagaacgcccaaaaggattttcccaatactcgtcccaaccagatgaaaaagtcaaatcactaataaataaattataaaattcaataatttcagaagaagcaaccaaagccttggtctaaggcagcgttgggaatgagagtaataaaaaaaattaaaaaataattattaacaaaataaatataggattcattcgatgagtgcgacgatagcgcattcgttggaattgaccaaaaggagcaggtgcaatagcaatatatcctgtaaaaaataataaactatttaggacgaagtccaatttcaatacgaatgcaaatcttggtctaaacgttcgcgtggccaaagagtaaattaccaattaaaatgaattagttaacattaatttaggattcgtttgacgagggtgacgactccgctttttatggtccatcgaccagtaaatga

SEQ ID NO: 79489 - DNA, 699 bp, Heterodera glycines
  Genomic contig location: Contig_ID=SeqID_15274; Location=959..1657; Strand=-
  SCN-specific regions: Sequence locations=1-168,205-462,506-554,585-699
atgaccatatcaacatacgcttggaattcatgtcacaaaaaagtttttttccgtggaggtatctcactccagttcaatacaatgcgcattttgttcaagtattttggaataattttgataaatattggttttcaaaagggaaatttttttacggatttttttcaaattttataacaatgttttgtgaaatagcccatttgaaatcatttactggtcgatggaccataaaaagcggagtcgtcaccctcgtcaaacgaatcctaaattaatgttaactaattcattttaattggtaatttactctttggccacgcgaacgtttagaccaagatttgcattcgtattgaaattggacttcgtcctaaatagtttattattttttacaggatatattgctattgcacctgctccttttggtcaattccaacgaatgcgctatcgtcgcactcatcgaatgaatcctatatttattttgttaataattattttttaattttttttattactctcattcccaacgctgccttagaccaaggctttggttgcttcttctgaaattattgaattttataatttatttattagtgatttgactttttcatctggttgggacgagtattgggaaaatccttttgggcgttctgcggcgggaaactctgtgcgtttgtattgcgacagggtcctttaattttaaataaa

SEQ ID NO: 79490 - DNA, 120 bp, Heterodera glycines
  Genomic contig location: Contig_ID=SeqID_15275; Location=342..461; Strand=-
  SCN-specific regions: Sequence locations=1-120
atgtcgcaatatgttttcaacataggcgatttgtggttcaattcatcaataatctggtattcgctttttttggcgacattttctttgcttggcttcgtaacgatagttgtctgtgttatg

SEQ ID NO: 79491 - DNA, 215 bp, Heterodera glycines
  Genomic contig location: Contig_ID=SeqID_15276; Location=170..384; Strand=-
  SCN-specific regions: Sequence locations=1-144,166-215
atgacaacagaattagtagacaaggttagttgtttttaatccaatgttttgatttaaaaataaaaaattgaatgccttttcagttttacgacctttataaaaatgccggattggttcccaccgaaattgccatcaatggcattttggctttggtggctttggtgggcgtttgtttgaactcatgcctcatttatgtgacaattaaatcgaagtaa

SEQ ID NO: 79492 - DNA, 764 bp, Heterodera glycines
  Genomic contig location: Contig_ID=SeqID_15276; Location=706..1469; Strand=-
  SCN-specific regions: Sequence locations=1-44,66-235,270-351,373 -494,530-678,702-718,741-764
atgacgttttcattgctggcatattccttttttaatgtgagttattgtttaaaaaagtgtttgtgattaaatagatgtgaatgtgtttttaagttagtttgaaacttctaggaagcttttttatttctccatatttaaaattcgaccctccgatattttttccctatttcggcattcaccgaaaacttcgaaatacagccccaaagatgtttacaaaaatacaccgctaaagatcaaatttaaaaaaaaatattttatatttaaaaaatcggtgctgggtcgttacttaaaaaccatcattatgaaaaattttgtcgaaaaattatttataattttgctcgaaagcaaccaaatttttaattcttgatatcatttgatagccctaagtgttctctatcagtctgcaaaatttcaaaaaatttcgttaagtttcaaaaaagttatagctcggggaactcaaaaaaacgtgattttcgaacatttttggccataactttttttaaacataataaaattttttgaaattttacaggctcataaagaacatttagatctatcgaatgatagcaaggattaaaaatttgggctttttagagcaaagttataagcaaaaattttaattatgatggttttttaagtaacgcccattatgatggtttttaagtaatgacatagcaccaatctgatgagaattaatgaaaggctattaatttgtttaatagataattttatatcaaaaagcatcatgtgggcttttcattaaa

SEQ ID NO: 79493 - DNA, 736 bp, Heterodera glycines
  Genomic contig location: Contig_ID=SeqID_15276; Location=1882..2617; Strand=-
  SCN-specific regions: Sequence locations=1-185,240-263,286-374,397 -685,719-736
atgttgactccgcatgagttggacgaaaggttgggttgggctccatttgccatgcttggccaaaaaaaagtaaaaagtcatcttcgcccccttatgctaagagcataggttaatccgaaaggcatgacacgccgacgcatcatttaagtgacagctggaacatttgtatatgaatgagcgtaaacatatattattttacttttaataaatttaaagtttcatttatttatttaaattttgaaatagaatcttcaaatgtttatgaaaatcagtgcatttttatgaccattttgaataatgcttttgtggcattaagtggtgtttaattgagttaaatttgcctgttacattatttgaaattgtcaattgtcccacctttcttaagaaatttcagaatttgtatttgtgtaaattctttggcttcgtattttcaccgctgccggcgatgattagtgaacgaattaagcagcactgtgttgacctgaacacctttatgagttcgttcggcgattggactctgaggacggaagtgcaggcaatggaggaaatggaaataattaggaataaaaatttagagagggcctgaaatgttcacgaaaatcatatattaactattaggtttaaagttcttatgatgggagtcttattttggaattttgtaaaaaaaatctcaattagaacaaccctctataaaagtttaaaaatcattattttgatattttcgtaattaaataaa

SEQ ID NO: 79494 - DNA, 1565 bp, Heterodera glycines
  Genomic contig location: Contig_ID=SeqID_15279; Location=636..2200; Strand=-
  SCN-specific regions: Sequence locations=1-235,258-521,680-733,826 -1565
  Gene Ontology: Mol. function=thioredoxin peroxidase activity; Cellular component=mitochondrion; Biological process=phospholipid catabolism
ttgtcagttgggccattctcttctcccaccccgccgattttacgcccgtttgcaccaccgaattggcacgtgccgcgcaactcaccgccgaattcgcgcggcgccatgtcaaagtgatcgcactcagttgcgattcgtccggtaaaattcatagacaatttttgaattgtgagtgattaattgcgctgaaaaatgcaaaattagtggttttgagaccgaattaaacgttttaataaaaaggcattcccaaaaagaatcgcatcgcaattggactgaagacatagccgcgtatggcaattcgaaagggaacggaagtgagaagatttcgtcggcaggtcattcatggacgaaacccaactcgtactattatgtagtaaatatagaaacagaaaaaagcgagacagcgttaagtcatcagagaacagagaaaaaaagatactctaaaatagtacgagttgggtttttaccgtcattcaccccccccccccccctcctctcatccatttctccactttcatcaactctctctctctctcttgctctacgtctctctctttcctctctctctctctctccctccctctcccttccctctctctcttccctctctctcttccctctctctctctctccctctcccttccctctctctcttccctctctctctctctactctctcatctcatattccctctcatccactcgcttttcccgctcggccttctttcacccactctctctttctgcttttctcccgctctctccctcgctcattctctctcccctctcctctcgatccttctctcatctattctctcactctcttccccttccctcacatttttatttctgtctaccgttgtccgtctactttaagccgattttccctttccaatcattgctgatcagcagcgtcttttggcaattaaattcggcatgattgacccactaaattccgatttgtccggtgtgcctttaacggtcagagcagtgagttttgaaattgtccaatttggcctttaacgtgccaaattttttatgtttttatcgtcgaccccaaaaagcgtcttcgtctgtctttgctttatccggcaagtaccggacgaaattttgagtaatgaatccctttttacgtcaccactgaaactttatacaaatttagcgaaattttgcgagtgcttgactctcttcagctttctgacaaatttatggtggcaacgccggagggatggaaggtgggcaaaagggttgtaaagcatcaatcagtggcgtcacttttcccttcgcttctttgcgcgtcaattctcctttgtttggcaatttctcttctccttttattcgtcttcgatttgtctttccaatttcggcattattcaaaattggcatttttcccgtcctccgctgattttgccttccttccctttgagccgggctccgcttgtatggtcgaaccacgggtgacggatgcgaaggccaaggaaatgttcgccggcgttgggggcggagtccgaccggtggaattgccctcgggcaaacggtacttacgcgaagtgaacgacccatcg

SEQ ID NO: 79495 - DNA, 442 bp, Heterodera glycines
  Genomic contig location: Contig_ID=SeqID_15281; Location=330..771; Strand=-
  SCN-specific regions: Sequence locations=1-111,133-269,305-442
atgaaacagacgaaggagaaggagcggacaatgagtgacgaagaagacgaagatgaagcatccttttcggaggaggacgaagaaatggacggaccatcgaaacagtcgaaagggaaggaaattgacgatgagacaatggcggagattgagaaatggttgaaggatttggacgtggagaaattaatgagagaatcgtcgacatcaaaaggcacaacgcaatattcaacgccgatgaagcgaaaaaggggcggcaaaaaggtggtgacgacggatgaggacgaagaggaggaacacggcctcaactcgggggaaatggacttcagccaatcgtcgtcggaagaggaaaagtcaaccaaaaggggaaaacgaattttgaaagggaagggaaaagcgaaggacgaggagcagtcatccgccggaaatgaaaagccgaaagcaaaga

SEQ ID NO: 79496 - DNA, 759 bp, Heterodera glycines
  Genomic contig location: Contig_ID=SeqID_15282; Location=10..768; Strand=-
  SCN-specific regions: Sequence locations=1-378,412-554,576-632,659-759
atgcgccgaataattgttgatgtgcttttcacaatgatttttctgctgatcagcggactgggcacattaaatgcggttaacccagcagaattggcagcggatgagcacgcagagacgcactcgcccaccactttaggtgagaagcatcagcagcaaatggacatcccccctcttttaaaagtgccaaaagtggaaccaattgagacggcaccggcacaacagtcgagggaatggggaggagaggaacagtgggagcagaaggagcggataccgaaagtggaagtgccaaaagtggagccaagtgatacggcaccggcgcaaccaaagcgaaaagtaccaaaaatggagccatttgatacggcaccggcgcaacagctgagggaaggaagaggggaggggcagtgggagcagcagaaggaacaatcacttggactagcggaagtgccattgacagcgaaaaggcagagaacgccttctgcaaggtatcacagaccagagtttgagttgtcatctgaagaggaaccggacaattcatcggacgaagattggaaggatgcggaggaggaagagtcggacgaattggcatcgctgtcgaaatcgtctgcatcgtatgggttgggagaggacattggcgagggggaggaggaagagaacgaggcgatggaatccaagaaaaaaaggatggcacagacaaagggcaaacaaacggcgccgattgaagtgccatcaaagaccgattcatcgttcgattctgagcaa

SEQ ID NO: 79497 - DNA, 1679 bp, Heterodera glycines
  Genomic contig location: Contig_ID=SeqID_2392; Location=1..1679; Strand=-
  SCN-specific regions: Sequence locations=1-732,755-1424,1446-1679
accacaaggacaattggccactaaggacaccagcccgttaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacaccagcaaggacaattggccaactaaggacacgagcaaggacaattggccaactaaggacaagggcaaggacaattggccaactaaggacaagggaaaggacaattggccaactaaggacacctgcaaggacaattggccaactaaggggggggggcttttaacgcggaacaggacgtttcggtgccagcccaagttttggactacaacttttttcattgttgaccaaatctaacaatcttggtatcattcgaaagcccttcacaagctctattagccttacaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaacatgttaagctttcgaataataccaagattattggatttggttaacaaataaaaaagttatagtccgaaaacttgggctggcgccaaaacggcggcgccaaaacgatacagaccccaaaaatgtgtatgtaaatgtttttatttattcaagggggtagccacagccaaggcactcatccttggcataaaaaataaaattggcatttgaatgaagaaaaattctaagaaaaaacccaggaaaattcttgaaaatctgcaaattagcgctttttcgggttttaattaaatttcaaaaaaaaaaatgaatacggtactaaaatgctatggccagaaaaaaatcattttggtcccgactttttttatagatgaacgaaaatgaattacctaattagcaagttaatagaatttttcaagcgcttttgaacctacaaaaattgttaattgagttcagaaagcaaaatttgtggtcctaccgcccccgcccccttacaaattagctacgcccttgtgttttaattttaatgatcagtgaacgccaaaatggcagaccgatatcggcgcgcgagcccaaaatcgatcagatatagggtgctctctttaccatgcaggcccatcagaaaattttctgaaattaatacacaaatcattgttaattaattctatgttaaaacttgcatatattgaataaaaagtaaagaaaattaaaaaatatcatcagca

SEQ ID NO: 79498 - DNA, 511 bp, Heterodera glycines
  Genomic contig location: Contig_ID=SeqID_2393; Location=95..605; Strand=+
  SCN-specific regions: Sequence locations=1-105,128-321,343-459,481 -481,503-511
atggcccgagtctttgcgagtcgaattggtaagcgaagaaagaggcataaaagtggagcctcgagagtcacaagtctctctcttttcgatttgactccgagagaataaatttcttgaaccaaattaacccaatattgaattaaattaggactgtaattgccaaatggcagaaaaaggaatttaatttgccagtttattaaattaaattttgatttaggattatttgcgtcgaaaattgtcatggacagagagggaggcatgcgaacagatccgcaaacagcttgttcttgacccagcaacaaaacggggaggcgagaaagacaatcggaggaggaggagaaaatgatcagtaaattgatcagcctcaattaaatgtgattcactcgatgatcacctcgacctctgttgttgatcgaagaatcgcattagggaaagcaattaacgggtggatggaggcgggggtttgtattttataaaaaatttccttgtccaaaattttttgaaatggaaa

SEQ ID NO: 79499 - DNA, 275 bp, Heterodera glycines
  Genomic contig location: Contig_ID=SeqID_2393; Location=1659..1933; Strand=+
  SCN-specific regions: Sequence locations=1-275
atgtccctggggaaagcgtcaacaaaaccaaaagacgaaggacttggaaaaaattttaataccacgaagaacagaaatcggtgtggccgtacacccgtaaccaatggcagaagacgcaccacttcggcacggggaagcagtctcgcggcctacatgccgttgagaagcacctgggctccgctttcctccaaagttgtgaagaaaaaaaggcacccgtcgagggcagccaaaagtgcgacttaatagcgaagaattcgtcagtgtcttttccaaaa

SEQ ID NO: 79500 - DNA, 356 bp, Heterodera glycines
  Genomic contig location: Contig_ID=SeqID_2393; Location=2031..2386; Strand=+
  SCN-specific regions: Sequence locations=1-356
atgactgtattaaaaattaatttaatgatttcccttccgttcgtgcttgcgttcgaattgatccccgaacgacatgttcgttgtggatttacgctcatagtaaagcatgcacccgatggtttggctgactttttcggatactccacgagggtgtacgttggactaacagaaaacgaacaataaatttccagaaagctgctcgcgttcgcattgatccccgaacgacatgatcgtcgtggatttgcgtgggaactttcaagcatatacaaagtactatttcataaaaattattaattgtttttaaagttcatggcgttgctgcgcatgttccacgttttttttataaaggaaacaca

SEQ ID NO: 79501 - DNA, 1147 bp, Heterodera glycines
  Genomic contig location: Contig_ID=SeqID_2393; Location=2698..3844; Strand=-
  SCN-specific regions: Sequence locations=1-146,174-178,200-401,423 -672,717-749,780-888,930-1020,1043-1147
atgaatttagaactccatcctagaaggttcaaacaaagctaaaaacatatatttttttgaacgtttcagcttccatagtcaggaaaaaaatacggatttacatttatttagaacattagttttaacttcaccatttaaatgccataatttcaaaaaacaaacaaacaaaggttctgctgactctgtccaccgagtcggccggcgcacgcgagcatttgcccagcgtgtcctatctgaaggccatcgacctgtggttcggctacatcacaggctttgtgttccttacactgttacaaacgctggtggtgatcgggctggacaagcgggccaatcagttgcgcaagtgggcgacgaagaagcgcattggcaaggcggagctgagccgagaggcacgcgacgcgatggccgaccgggcggcacgttaccacaagctgggacggtacctggacaattggtgggtgggccgactcatgcaaagagtattatgggaaacatccaatagtggtcaatcttttttttcaaattaagcccaattatgaatataccctcactctctcatggccaagaggtcatttcggcacgaaatgagtccgaaaaaatcgacaactaaattttcgcactttattgccataagttttatattgaaacgttttgaaattttttaggctaatattaataaacattttttcttcatttctaccaggaattttaaatatgccagaatttaaaaatgaaaccactgactgtggaataattttgttaattttttaaaataatttcattgtttttcagttgtcgcgtcttctacccgctcagtttttcactgtttttgattttttattattttgtgtttaccgaaggccaacaagatgattgtattgccgacagataataacaataataatcataaattggaattaaatttcaagtgaattaaatgataaatttctcttaaatgacgagagacattttattatttgttttttaattttttgtaatgcgaaatgcaagtaatataacaaattatttttgctcaattttttgcttaaaattatgtcactattcgcgcagatcaggggtggagcgcgaccgtgatctgtggccgcgatccgctgcaatctgggactccgcggcaattttaaataaa

SEQ ID NO: 79502 - DNA, 837 bp, Heterodera glycines
  Genomic contig location: Contig_ID=SeqID_2394; Location=474..1310; Strand=-
  SCN-specific regions: Sequence locations=1-291,313-449,471-837
  Gene Ontology: Mol. function=GABA-A receptor activity; Cellular component=integral to plasma membrane; Biological process=synaptic transmission
gactacgacatggacatctatttgatcatgggctggcgtgacccgcggctggtgaacaactttggcaagccggtgctggtcaaggaggaggacattctggagaagatttggcgccctgacccattttttgacgcgaaggaggccgaatttcacgaggtcaccttcctgaacttcctgatgcgcatctacaggtccgtcagttacagcagttggcattattacaatcagaaagatatatttatttctaaaattaaaatcaaaatagcaatcaaaaaaaaaggctgttaaacattattaaataagtaaaatgaatttaaaaaatggataatggttcagtgacggactaattttgtacgaaacgcgcatcaaattgaagccggcctgcaatttggtgctatgcaagtacccacatgacaagcagacgtgcgagctgcagataaaatcttgtaattgaaattttctaaattctgaccagttccgacagggtttgaataattttccaacaatgctaagatcttgtcccccctattccactcattctcgaccaatgccaattttagcaaaactctgatcactcctgatcagtctagacgggtgtcaatctttttcaatcagtcccaagatcacagtcaattccaatcagtctcgattattgccaaccttagcttttctaatcacttttgatcagtctcgggtggactaaatgttgttattcaagttgcttatgccgctgaaacggtacgctttgaatggttcacgaatcgactggacgcaattgataaaaacccggacgtgcgacttcccgagctgtacattgaccagtacgagccggcaaaa

SEQ ID NO: 79503 - DNA, 1302 bp, Heterodera glycines
  Genomic contig location: Contig_ID=SeqID_2395; Location=159..1460; Strand=-
  SCN-specific regions: Sequence locations=1-110,133-284,309-456,478 -641,663-763,799-940,962-1087,1113-1203,1275-1302
atgttcttatttttaaagatttctgatcgaagctctgccttaattgcgttgatggcccggtaaaatacaaaggtcacctaatatgaaccgtcaattatcgacttcctcaataaaaatgtatttggtaaattcttaccgcttacatctcttatccccttccttcatgtttcatccgactaatcttctacatcttcatagctgagcaaaagtattctccgcgccataggcttgtttaaaaaaaacaaaatttgttagggaaagcatcaaaaaatgactttttacttataatttatttttaccaaattaattgcataataaaaattttggaaaactcttggctcgagaaaaatctgtgatttgtttgactctatctcgaatctcggactgagtcttgggaaagaaacaatttcgttttatattcttcaaaatttattttgtccttaaactctaactaaaacatttatgggaaaaacaaaatttaaaattttggccctgtattttttaccccgttgcattttatatatgtatatggaagtccccattcaaatggaacagagttatttgggactgaattggcgggagggagttttccgttttggcgctgattgtgtggtgccctttacgctgcattggtttttcccttttgctaattgatttattttgcgcagtgattgtaccaaaacaatttactgaatgattacatttgactgatcagccgtcattttgtcacacaattttgtgcacttttctgaaacaattagtgtattttataaatttattcaacaaaaaaaaaaaattcgacgaccatttcatttttgtatcaatcggactttgagtttttcgagtatcataaatgtcagaatcggagcgagttgttttcaatctcagaatcggggttccaagcctaaagaaagtgatatcgtcatccttttggcttttggcacagtttaaaatggcacattttttgttgacactctgtctcactttcgcattgttggcacattgtgtctccgcaaaacggcggcccggcttgcgcacttgggactttgaggcgaagccgggcatggacaattcggtcggcaaagcgaaggaagaacaggatgaagatgaggaaaaggaacgaaaagcggatgatggagtaggggataaagcagtaacagaacagattccgccatccaaaatcagcagcacaacgaggcaagcaaaaatatgaaatattttatttttaaaattatttttttaattttaaatttatttctagtataaaattaaatgagcaactattggaatccatttaataaa

SEQ ID NO: 79504 - DNA, 76 bp, Heterodera glycines
  Genomic contig location: Contig_ID=SeqID_15283; Location=1..76; Strand=+
  SCN-specific regions: Sequence locations=1-76
caagcccagtgttagacaaaattgctcataacgccaaatagcgtaattggcgtaaattattgcgcgctaattcaaa

SEQ ID NO: 79505 - DNA, 341 bp, Heterodera glycines
  Genomic contig location: Contig_ID=SeqID_15283; Location=93..433; Strand=-
  SCN-specific regions: Sequence locations=1-341
agtcaatataactcttgaaattattgaccgaatcaaacaatcttgatatcattcgaaagctcttcacaggctctattagcctactaaaaattagagaaaatttcgaactataaaaaaagatagaaataaaaaactttgaaaattctgcctttttttgcggttttaaactgacaacttttttgagagctgattaatcactgagaaatagcttataaatatcttctaaacatctagggctttcgaatgataccatgattgtgaagtttggccaacaaagaaaaaagttatagctttttgtacattgctgagacggagttggccagacggagttgacccctacc

SEQ ID NO: 79506 - DNA, 762 bp, Heterodera glycines
  Genomic contig location: Contig_ID=SeqID_15284; Location=721..1482; Strand=+
  SCN-specific regions: Sequence locations=1-411,433-568,590-762
taggaatttaaccaattcgattttttcttctttaaagtttctgaacaaacaccaagaagtattcaatttggcgaactttggccaactcaaccaccaaagtgtcgattttgtgctgattgttcaggtttgttcgttgatgattgctattttcatttttttggtgttaggttcacaacagaattgactatttgaattatttggtcggctctctgtcgcgtgccaagggaatcgaacgtgttctgttgattttcagttacgataaacattcagaaccgataaacaaactgatcagaagcattgacttttgcagagtaaaattcaacttaattcgtaaaaaaaattctttgtttttaggtcacgcaaattttctttccttacaatatccaactttttccaaattcgtttcccggccttgggccaaaggattgtccggaaggaaccaaaaagtacttcgatttttaatgattagttgtttatatttggattaagaagggaaggtctcgaatgtgcaaatgcggcatatcccgacacacatggcaattttagactgccgagatttacgcagattaaacaccattggtggtggaaggtcagcgaaagggagttaattcagtaccgaaaaattaacaattaggcgaattacgcatttgatgaaataatgccgaagtatggtttggagaataagacgttgcttttccttgaggaagatcatattgtggcgcctggactttctcctttcgctgaaactgatgacgaagagcg

SEQ ID NO: 79507 - DNA, 952 bp, Heterodera glycines
  Genomic contig location: Contig_ID=SeqID_15285; Location=102..1053; Strand=-
  SCN-specific regions: Sequence locations=1-96,196-398,487-589,611 -791,814-885,933-952
atgacaaatttaattgaaatgacacttaattttgaatggaaaaaattgctacatgaacaaaataatgggtttatagaaaaggcacgaagaaaacacaaatatttattatttaataattacttgataaaaaaatgttcaaaattaaaaaaaataattaaaataaatttttaataattaatttagtataaatattttgtgttgatcaattgtgtggctgagcaacaaacgcaaatttttgataaattttgtcagttcgttgacgggcgaatccgtcggcaaattgtgtacgatttggacccaaaaagtgggccaaacattggcacacatttgtaccccgacatttaccagcacaactgcgaaatggcaaatgaatttttggcattggcatttatgtaaagaattttatgaatttgataaattattaaatatatctacatataattatttcgatttattttatttttgaaaattatttaataaatttaaggcccaatttttgcaaagtttggcttattggcataagttcgaacgtaaacagtgcacaaatgaacccattgttggcacaatttgacgccacaatcagaaaagattttttgaaattcaatccattggaaaatgccgaggagaatggaggcaaaaataaaagtaacaaaaaattcaaaatgccaaaaatggaagaaataagcgctaaatttgacgaattcaaattggcattcaaatccattctggtcaacaaatgggaaatgtttgaagcgatgtaaaattaatttacataaaacctttttttttgcaaatttttaatgcaaaaattttagagagcccaaagaataagaaaaagccgatgtaaaaatgtgaaagaatcttatttattacaatcattttcactataaaaaattgtaatattttatttttttatgtataaaaattttaatggatattttaacaaattaaa

SEQ ID NO: 79508 - DNA, 1631 bp, Heterodera glycines
  misc_feature (4)..(4): n is a, c, g, or t
  Genomic contig location: Contig_ID=SeqID_15286; Location=130..1760; Strand=-
  SCN-specific regions: Sequence locations=1-10,56-170,252-519,544 -544,566-581,880-1095,1135-1322,1434-1631
atgntaaatgtaattttatattaaatatatttaccttttaattaaacaataaaatgttcagttggaaaattatctggcagaaaaaacatttaaaggcttcgctgaatatgaggagaaaatgaaaaattcattaataaaaattcgtaaaattttcgatgactgggtttgtgaaattaaaaaatatttttaatggaataaaatttattaaatttaattaattaaaaataaatttaatttttgaatttttttttcagtccgaagggcatgccaaactgcttgtttcgggctcatttttgcttggcactcatacaattcgttctgacattgatctgttgtgtattgtgccgggcaaagtgatcaaaaaagtgcatatttttggctatgatacaacaatttgccaacatatggaacacgcgtgttccgatggcacaaattggtcattgtattgtgaactttgttcggttatattttcaataaataaaaaaaaacatttaagttctcaaatagatttctggtcaatttaatattttcttttaaattcagtaaaaagaataataaacaaacaataatttacgtttaagtaatttattaataaaaaaatataaagttaaatattttttagctaactaatttttaacaaaaatactaaaatttttaatgtttcaaaaaataagattcgtagattttttaacaataataaatacatataatgaaatataaattataatttcaaaaataataattttagcttgtatattcttaataaaaagaaacgaaatgaaataatatttataaagttaaataaattgaattaattaatttttaattcaaaaataatttttaaatttgaaagaaatgaaaaaaaaattcaattttttagaatgaatttgtgactgaccttgtcaaatttccacatgctccaattttgttgatcaaattcatctttgatcaagtgccgtacgatgtgacttttgtgattattcccgaacgcaaaatgttgccagcaaaaattgatgacaaaacaatggacgaactgatggcaaaattcaaaaagccaaccgaaaataacacaaaaatgctccgtgtactttcgggtaatatattaattaacttataaaaaaaatgaaaaaaattctcaaaaaatttaccatagagttcattaagggttacgggctgaacatctatctatatctttacggggtacggacatacgggctaaagaacccgtaaaagccgtagctcataaaaactcggaaaaaatatgggctataggtccctaaaatacctccgtatacggaaagatccggtccataatcgatctctaaaatatttttaaaaataattgttttataaaataaaaaaaaattatatttaaaagtaaaatataatatataaattaataaattttaaattttttatttaaatttttttttcactaattatgtatatacttattttaggttatcacgcaacattttacatttttaatttgattttggatggacaaaataaacaagaaatgctgcaaatggatgacggagaaggagaacgccaaaaaattcatcaaaaatttaataaaaatgcaaaaaatttccgaatgctccttttagtgatgaaattatgggcaaaaa

SEQ ID NO: 79509 - DNA, 349 bp, Heterodera glycines
  Genomic contig location: Contig_ID=SeqID_15287; Location=356..704; Strand=-
  SCN-specific regions: Sequence locations=1-133,155-349
tataacaatgtggatgttgtatgcgatttgccgtggcaattccatcaaattttgtggaaaattctgaatttgaacaacgaagccaatttaatgttggctgaagcagcaaatgaaattgttattgaaaattttgaaaatgaatttaaaaatgtgaaggcccaaattcatttgcaaaattttgcaatggcacttttgactaatggggcaacaattagcggcaaatgggaacaaaatgagtccaaaaagagacaaaaattgttggaagaaataacgggaatgcgttgtggccacatccgttttgacaatttgaaattgcgttggcaaaagatggaagcacaaattcaattgg

SEQ ID NO: 79510 - DNA, 394 bp, Heterodera glycines
  Genomic contig location: Contig_ID=SeqID_15288; Location=155..548; Strand=-
  SCN-specific regions: Sequence locations=1-76,98-158,183-262,290 -321,351-394
atgtctaaaataaatcaatggtcagctgattgcacttttaaaggacatactcatggccaacggatttctttacataaacattttgaaaagtaacatttaaattaatatttcgccaaatgacttctgctgcaattttttcttttctgttccaattctggttaaaaatataattaaaaataatagcggaaatattttcatttttgttgccccaaaatgctttataaattttttttccaattaaatagcaatatttttttgaggcatttaaatgaataaaaaattttcttattcaaaactgacatctatcataattctatgaatttattcaaagaaataataataataatttatcctactgaccaaaacaattgccaattggtaatgattaaataaa

SEQ ID NO: 79511 - DNA, 3171 bp, Heterodera glycines
  Genomic contig location: Contig_ID=SeqID_15288; Location=189..3359; Strand=+
  SCN-specific regions: Sequence locations=1-10,40-71,99-178,203 -263,285-365,413-553,597-645,667-681,705-741,774-893,916-920,1063 -1152,1174-1399,1433-1763,1785-2111,2143-3171
gtcagtaggataaattattattattatttctttgaataaattcatagaattatgatagatgtcagttttgaataagaaaattttttattcatttaaatgcctcaaaaaaatattgctatttaattggaaaaaaaatttataaagcattttggggcaacaaaaatgaaaatatttccgctattatttttaattatatttttaaccagaattggaacagaaaagaaaaaattgcagcagaagtcatttggcgaaatattaatttaaatgttacttttcaaaatgtttatgtaaagaaatccgttggccatgagtatgtcctttaaaagtgcaatcagctgaccattgatttattttagacattctagaattaaaaataattgttaaaataataactatattaatctaataaattgttgcaataattttggggcctgtctatttttattctcgacgtaagtgccactttctgatgaaaattttcttggaatcaacaaaattaactgatcaagatattattattcaatagctcatagaaatatctttacaagcctgcaaaattttaaaaattttacaaatatgttaaaagtatattttatgtaaaagttttccttcattttatttccggtacagtatatgctgtcctgagagaatatgttaaaacaaaaattttaaatcgacatctaaataaaaaaaaaattttatttgtggattttaatttgtctattcattttcaacaaaatttgttggacttattttctaatatattttcctttaaaagaatggaggaagaaaaaatgtgaagaaaataatgataaaataaaattatgcctctctttcactattcgtgcctataattatttatttattcgacaaaatttagcataaatttttgaaaatatttctgtgctatttaaagaatgatttttttttaaattttattataaataaatatactcccaatattattatttttaaatcatttcaaatataaattgcattttataataaaaagcgaaaaaacatataaataaaatttattttaaacaaattatgtaattattagttgagcataataattttggcaaaaacgatttgggcataaatttgaaaaaaatcattgaccatcaaaattgaagttgttgaacaaattccgaattgatcaatttaaatttattggaaaataaaagtaaaaaaccaaaaaacgacattaaataaagaaaagccattcatttctaaaattctcaaaaatacaatgtttttttgtggcatttttgtcaccttttttgaaatttatgacaattttacaatgtccttttttccgtttatatccaattaaaaagcaataaatttaacaacaaaaaaaacagtgcaaatattgcaaaaaatagaaaaaacttcgataaattattatacaaaattaataattataattctaaacttgagttgcacgggccgggaattttgacaaaaactgggaccggaacttaccgggaccagaaaagtcgggaccgggacctcgattttggtccgggaccgcgagaaaagccgggaccgggaccaaccgggaattttcccaagagaaaaattttttgaaaaaatttgaaaatttgagtacactttgttacgaaaatttctaaattcaaaaatgtacccataaaaatgaaaaaaaactttaaatgaatacaaatccatttttgtaattaaaaactatttttcaaacaaatacatttttttgtttatattaaatttggtccttttttctgataaaattatttttataaattgaaagttccagcatggaatcaacttccaaatttaatcatgtatgtattatatattaattaagacagcacaaatgggttaaaatcggagtaattaaggagaaagtggaaaaattttgaaaaataattaactcattagagaaaaaggctaactccgatttttttgcaaatttcggcataattttgtcgccattctttggttgaatattttgttatttgcctgaattgattattcgctttaatgaattttcgtattcaattttctgtttatcagtttttaatttatttatttctccaaaagcctctcttagaattctctcggaaaattcgattttttgatttaaatatttatttaataattcggtatatttacgacatttgaaaaaaatagcaaacctaaatgattttataaaatttatcaaaaaagttttcatgttaattctaaaaatcgaatgattttattcagccacaaattgttttttccaattggaaatattctgttgagaagtgttcacaatttttgcaatttctttgtcagtcatttttgggttttctttttttgtttgccaataaattttcattttttccattttttcgttctccgttatttgtttcttgctaattccaaattgtttcttccataacatgccttgcgacgcgcgctgtctaccttgaggcaacattggacctcacatcggaatcattcatcaatgttctccgtcgattcataagtcgacgaggaaaacccgacatcatttggagcgacaacgccacgaccttcaaactcgctcagaaaaccctggagcttctcagtgctccgggtccggatcaggaagtacaaaacttcctgactcagaacagaatccagtggcgattcattgcccaaataagtccttgggcaggaggcttttacgagcgcctcgtgaagctagtcaaggactgcttcaaacgaaccttgggtcgaaggatcctttccttcgaccaactcaacacattcgtggcagaagtggaggccaccctcaactacagaccgattaccgcggtctcagacgcagtggatggaccagttccactgcgtcccatcaatctcttacaaccagagattcagatcaattgggaaacaacaacagacccaattgattcagaggaacagttttcctccacacacgaacgtttagcttcccgaatacaagcacttcgggaagccaacgacgttttctgggccaaatggcactctgagtatttgacattactcagagaaagagcccagtgggaccacaaaggcccacgactccaacacttcggagaaccgaaggaagggatggtggtcctaatctctcaggacctcgtccctcgcaatcaatggccaatgggacgaattgttgaaaca

SEQ ID NO: 79512 - DNA, 1626 bp, Heterodera glycines
  Genomic contig location: Contig_ID=SeqID_15289; Location=395..2020; Strand=-
  SCN-specific regions: Sequence locations=1-335,358-518,540-659,681 -790,821-1626
  Gene Ontology: Mol. function=ligand-dependent nuclear receptor activity; Cellular component=nucleus; Biological process=blood coagulation
ccggcgcccactccgtccccgcagcgaaaagtgtccgccgcggccgggacaaatggcggacaaacgcagacgaattgtctgatttgtgccgacaaagccacgggtgggcaaaaatgttctcatttgggtaaaactgccttaaggaaagcattacgggagcatttcttgcgatggatgcaaaggttttgtcctttgcttttcactttctgtcgcttcactttttgcttctcttttttatgtttcttccggcgaaccattcgaaaaaagcacaattacttgtgccgttttagcaaaaattgcgtcgtggacaaaagtgagcatttgcaacataaatcaacatttattagctttttccattctcagaccaacgcaatgcgtgccgacgctgtcgcttcgacaaatgtctgagcaacggaatgcgtccggaagccgtccaattggagagggatcgaattgcggcaacacgacggaatggcaaaattggcaaccaaaacgggcaaaacccaacaacgacagcgacaacagcaaaaacatcaacggtggcgagtgccattggctgttgttttgttgccgacgacgaatttggcacttcgtctgcaattgacaatgaacaaattgtgcaacgattaatggaggcggaacgaatgctaaagggaacgaaagtgacgacaatgagaagggaaaagcagccgcaggggacgacgacgagcagagaaagtggcggggagacgaagtcaaaggacagccaaaggacggcgacgacgggcgacgtgacggattcggtaaggaaagaaagaacggagagagggaatggaaagaacggaccgtttgttggccaagatgcaccagcaactgattttgctcgtccaatgggccaaacatttgcccgaattccgtcgtttgcccctccgttcccaaattgcgctgcttcggcatttctctgcccagcatctcatcctttgtgccgccttccgttcgctcgtccgtgtcgctgcctctgacgccgtttggttggccaacgatcgctgcgttccgcgcgacgcgcccaaaatccctgacataaagtgcgcaatgtttcaaactgtgctcgatcttttgtcttttctgttcagccgagtggtcgcccgcattctcgaccatttgacgagcccaatgcgacggctacgattggaggagtgcgaatttgtggcactcaaagcggtggcctttttcgatccgagttagtcagtcgctcagtgtttacatttgccactcatttcctttcagtggccaaaggcattgatgagtcagcggtcggagcggtggagggaatgcgtcaccacattttggccgccttggagcaccaagtgcagcgcagaagcgaatgtcgggcggcgccgcttcggctgggcaaccttttgctgcttttgcctccgctggtggccatcgcgcgcgatttggtggaggaggcgcagttggccaaactctttggtgagtcattgcggacagacggagggaaacaatcaatggcacttggcattggttgaaggactggccaacgtggacgaattgatggtggaactgttgctgccggaggacgcagagacgcgcagctactcacggctaaggacgagcgtcacctccacc

SEQ ID NO: 79513 - DNA, 258 bp, Heterodera glycines
  Genomic contig location: Contig_ID=SeqID_15291; Location=402..659; Strand=-
  SCN-specific regions: Sequence locations=1-135,182-258
ccaatggaatgaatcgaacagccgttccggaagagaatggcaaaatggagcacacttttgaacgcatgggcaacattcagtggggcgttggagaattggagtgggaggcatggatgcgccagttggacggagccgtaattaattattatctaataattaaatttaattttttaaattttttccaattccaagggctaccaaactggacacaagtccagattaccgattctgctcgaaccaatgacgaaaaagaaatga

SEQ ID NO: 79514 - DNA, 58 bp, Heterodera glycines; identical to SEQ ID NO: 76953
  Genomic contig location: Contig_ID=SeqID_15291; Location=251..308; Strand=+
  SCN-specific regions: Sequence locations=1-58

SEQ ID NO: 79515 - DNA, 1070 bp, Heterodera glycines
  Genomic contig location: Contig_ID=SeqID_15292; Location=230..1299; Strand=-
  SCN-specific regions: Sequence locations=1-500,523-578,629-647,669 -1070
  Gene Ontology: Mol. function=calmodulin binding; Cellular component =membrane; Biological process=actin cytoskeleton organization and biogenesis
atgccattggtgccaattgctgatttgaatggcaccaaaaagtacacggcggaggaggtggaatgccgtaacaaattggccgctctttatcgcctcatcgaccatttccgctggagccagtcaatatacaatcacattacggtaatatttggtgaaatttaaaagttgcgaaaacactaaaaagtttcgtctgcctgggagcgacaatgaaatcctgatcaacccgcttggcatgctatatcgcgagatcactgcgagctcatttgccaagatcagtgttgacggatgcgttattgatccgggatcaacacctttgggtattcaatttttttttcatggactgtgtggagggagcgagggttttagcattagttacatattttacattccattttttggcattttcacaaaatcctgattagaggggcacctagttaaattgcttttttgtggcccctaaagatcagaattcaaaaaatgttttagttacttttcccgagaattttgttaaattttaaatttcaccaaaattgattaatttgaatcaatgaaatttcgatttttatgcatttttccgctaaaaattaataattttttatttttttcttgtaaaataatttttttttatcacatttaaccattatagttttcatattatttaaatttaatgcatttgaagaaaatttggcctcagtttggaaatttcttttaagtctattttcgggattttagtccacttaccttacttacaaatttattatcgagtttcataatatttaaagttacttgagactctcgggttaataaccggtgttttgggggactacattcttagtacattatcatgagaaaattcacttttatcggttttcgattgtttcaaaatttcggcttttaactgcctcaaattatagtgacaaattttgtctcaggcatcaaccaggctggctacgtcctgcacagtgccatccatgcggcgcgtcatgacgtgaactgtgtgctgcacttgcacaccgcgtccgcagccgcagtttcggcaatgaaatgcggacttttgcccatcatccaag

SEQ ID NO: 79516 - DNA, 916 bp, Heterodera glycines
  Genomic contig location: Contig_ID=SeqID_15293; Location=169..1084; Strand=-
  SCN-specific regions: Sequence locations=1-17,53-236,304-423,446 -461,509-621,696-714,756-891
atgatccggtaaaagtgattaattaattcataatttttaatcaattaattaaggtaaaagaagaccattttaatctttatgatttcagctttttttggcctttcgtttcgccggtccgtcggccgatttgattgtgcccgccattgcgctttatttggtttcgttggttggcattctgttgaacggcacagttatggtggtcactgtcaaatccaggcaaatgtcatggcattttcttattttatttataatgatttaaatgataaattaaattaaactttccatttttaattaatttaatttcccatttttcagttccctccgcggctccgccaattttctgatggcattgatttgtatttgtgaattggtccaccaaaatgggaacacttttttcctggttgttgtcatttcgggcactaattttgtcagtgttctcactgctgacttaattatggcggtaaattttgaatttttgaaatttaattttaaatttttcaaaatttaagccttcaatttttgctataaattgtggcttaatggcaatgctttgttctgcggttgatcgacttttatctgttatttcacctctaaagttaggaaagtttataggtttgactcaaaattttaaacataaaaataattaagaaaaaataataaaaattgagaatttatttaataaaaaaagtattatacttcgaaaaaatatgagtgtttttttttaatttttattatttatatttatttttatgtttttagacacatggacattttattacagttcaaatatgtgtatctgttcagttatctgctaatttgcataatttatgcggcatattctttaaattatgtgctcgcaaatgcatttgaaaatgcgggaaagtatggcgcaattaaatttaaataattaattaaa

SEQ ID NO: 79517 - DNA, 510 bp, Heterodera glycines
  Genomic contig location: Contig_ID=SeqID_15293; Location=1413..1922; Strand=+
  SCN-specific regions: Sequence locations=1-165,187-193,237-510
atgcgagaaggaagtcggatggagtgtgggacaaatttggaaaaaaagctttatgagaagctcaaaagtggggaaatgcccatagctcagtcggtttgagtattttcccacgctgtaagggaaggccgtgggttcgagtcccaccgggcgattaaacttttatgttttttactcttcattttaaggagtttccaaaaaataaaataaattaaatctctaaattaattaatttttatcaattcttttcccttttgggttttacgcatataatcattttcttattgctgtttgaaagagattataatgcgaaaaaattgagaagaaatcattttatttgagagctgaaaagatgttgcttaaatttcacatcacaatgaaaaaaccatttaattaaacaatttgagcgcaatgctttcgaaagtgtcaaatctaatttggcattggcatttttagggctataattaaccaattataggcattcatcactaaattaatgtaatgtctggccaa

SEQ ID NO: 79518 - DNA, 1246 bp, Heterodera glycines
  Genomic contig location: Contig_ID=SeqID_15294; Location=298..1543; Strand=+
  SCN-specific regions: Sequence locations=1-576,598-612,634-1033,1057 -1187,1209-1246
atgttggacggcggatcccaaatttctctgatctcagccaaattcttctcacaaatcatggataaggtaagccaaaaagacgtcatatcccgctttgaaaacaggattatcgccataaatggaaaggaagtgaagtgttttggagttgttgccttacctattcgacgtggaaccttagaaacgaaaatccttatgttcgtcgcacaatcagcttttggatacgatttgcttttcggcacgaatgccttgaaacaattaggctttaaaatgatcgatgaagttagcaacaacatcgtagacttctcacccgcttcaatgctcgagaattctccaatgatcgttttcaaaacatttgttgttgatggccaaaacttggacaagacaccgagaaattttggagggaagagaaagaacacgtcggaatctaaaaacggcactgggaccaagaaaggtaataagggacggcgacaacaaaagcagccagagacggagaagtcatcagttcgaaatgccggagaaagaaggcccttattcaccaaaacatttgtgccccaactgaaacccaaggaaattccaatcaaaaattctgaaaattttggagaaattgaggcgaacaaacagcgagtgagttcggttcaaatgaaagtggcggttccaaacgacaaggcaaagtgcgtatggagaaggaaaaatttgggccagtttcagttagggacaactgaaaatttgggtagggggaaggtgagcccaaaaatggcttcgtcggcaaatgggaggttggatctatgcgatcgccgccctgactcttggtcccaatcgtccttccatcgaggcgatactgacgtcaaatttggccaaagaattttttgtcgcggaggaaagcgccgaaaagaacccgaccgtggaatgttcaaagacggatgctggcacaggcttaactcgcccaccacctatcggatgccgaatgagcataaaaggcaggggacgcctttttcttggagggtcgggatgtgttaatatttgatttttggcgtttaaatttattttaattatattgtcccttcataattttgtctctttgtctgtgattgtactctctcgcctatcgatatttgccactcccttcccagcagaatatgttcccccatcttgccttcagttcattctgttggcagtgcactttcatatttgtattttgttcttattttcctccgactcttctcccattttattgttgcggttttaa

SEQ ID NO: 79519 - DNA, 1293 bp, Heterodera glycines
  Genomic contig location: Contig_ID=SeqID_15294; Location=1938..3230; Strand=+
  SCN-specific regions: Sequence locations=1-785,807-1014,1036-1293
atgcaaactgatcgatcgccgtctgaagtcgacgagaacgaaattaggcggcgtcttcttcaagtaatgatgagacaaaatggaaatgcagaattgacgagacacggcgaacaggacattggccgcagagaaaacggaaggccaatctctgatgagacccaacgaccaccaattccgcgaatagcacagccatacgccgactcattgcaaatgccaaatgaattccgagagaatgaccgatctcttcaccctgggcttgtatttgatggcatgatggcgcaggcgattcgaagcctggacggattttcatataccatgactctcaacacaattccgactttggatggcagcaaaggctctgattcagtgaacgcctttttcaagcaatttgatattgcgactgaagaatggcctgaggcaaagcgattgcgggcactgcgttcgaaatgttatggcaaagctgagagagctttcaattccgccgttgctgaaaatcgccatgattatcagctgatcagaagagcgatcatccgacaattggacgacacggacgccaaacaattgacggcgtttgaccaactgatgaaaggagtttggcttcggccgaatgaaggcattgatcagcttggcgaacgtgtttcgcgcttggtccgttgtgcatatccggggctcagcgaacagctctacgacgaatattcggccatgcatttcattagggcactccctaactcagaattggcaatgactttggagatgactcgtaaaccgggtgcaacattcgatgagttcatcgcacaagcagcacgagccgaggcagttcaaaatgccgcacgaaattcttggcgacgcagccaaaataacggtttttcttcgacttattggccaagacatggaacatcccaaaatcaacgaatgcacgtcacctgctacaattgcggccgagtcggacacatttctcggaattgtgcgtcggaaccaatgcaaaggatgtaccatcaaaatgatgaaccgccgaaaagggaaaatttatttattggtgccgtaaatttagaacaccggtctgaaatagaacaattcttcggaaaaacaacgaatttgtcggaaaagggtcgatttttggaagaaagcccggcggttggtaaaattttggcgaccaaagtttcggtgtttggacgtaagttggatgccatgctggacggtggatcccaaatttcactgatttcggccaaatttttctctcaaatcatggataaagttagcaaaaaggatgtgatctcccgctacgaaagttaa

SEQ ID NO: 79520 - DNA, 947 bp, Heterodera glycines
  Genomic contig location: Contig_ID=SeqID_15294; Location=3393..4339; Strand=+
  SCN-specific regions: Sequence locations=1-262,284-888,928-947
atgctcgatgtagtgaacaacaacatcgtacacttcacaccagcttcaaagcccgaaaattcgcctttaatcgttttcaaaacatttgtgtcccatgacaagatcagatacgatagaaaagatgtgatcaaaagtcaaattgttgttgatggccaaaatttggacaaaacaccgcgaaactttggagggaagagaaaggacgagtcgggcccaaaaaatggcactaagacgaagaaacataataagaaacatcggcaacagaagcacacaactgtggagaaaacgacaattcaaaatgccacagagaatttaggagagcggaagaagcagcgacagcggaaggaaaacggcgaaattgcttgggcgataaagcgcgtttggagacggaaaagtttggaccaatttcagttggggacaactgaaaatttggatagggggaaggtgagcccaaaaatggcttcgtcggcaaatgggaggttggatctatgcgatcgccgccctaactcttggtcccaatcgtccttccatcgaggcgagactgacgtaaaatttggccaaagaattttttgtcgcggaggaaagcgccgaaaagaacccgaccgtggaatgttcaaagacggatgctggcacaggcttaactcgcccaccacctatcggatgccgaatgagcataaaaggcaggggacgcctttttcttggagggtcgggatgtgttaatgtttgattattggcattttatttagtaattattttgtcccttcttaatttttgtctcattgtctgtcattgtagtctctcgtctaatctatattttggcactcccttcccagcagaaaatgttccccccgtcttcccatcagttcattctgttggcagtgcgctttcatatttgtattttgttcttattttcctccgactcttcccccattttattgttgcggttttaa

SEQ ID NO: 79521 - DNA, 583 bp, Heterodera glycines
  Genomic contig location: Contig_ID=SeqID_15294; Location=4754..5336; Strand=+
  SCN-specific regions: Sequence locations=1-275,297-583
atgaccgaacgcaatttcgagcagattcgcagtcggacaaattcatcgattgtccatgaaggaaatgtccaattcgccaacgaaaacaacggaattgaaatggatgaaaatgaaattagacgccttctgcttcaagtcaagatgcgacaagatggaaatgcagaattggcgagacacggcgaacaggacattggccatagagaaaacggaaggccaatctttaatgaggttcaacaaccactaattccgcggacacagccaaatccccactcactgatacagagtggccaccaaattcaccaacgacaaaactgcagccaaaatattgccacaattaaccatcggccaaacggattcgaagacaacgagcgacccgttccaaatccagggcttatatttgacggcatgatggcacaggccattcgaagcctggatggtttttcatacacaatgacgctgaacacaattccgaatttggacggcagtagaggctctgattcggtgaacgcctttttcaagcaatttgatattgcgactgaagaatggcctgaacagaagcgagttcgggcgctgcgttccaaat

SEQ ID NO: 79522 - DNA, 205 bp, Heterodera glycines
  Genomic contig location: Contig_ID=SeqID_15295; Location=886..1090; Strand=-
  SCN-specific regions: Sequence locations=1-205
atggccgcagttccacaagcaaatgttgaagatgatggacctgctgctgatgattttggtaaagccgtcaaaacaacaaaaaccaattataattgctttcattttagcagatgaaaacgcagcaccaccacacaacttgttaccatggaatgctggtcaagcagttttactggaagctgaaggcggcggctttataccactctga

SEQ ID NO: 79523 - DNA, 879 bp, Heterodera glycines
  Genomic contig location: Contig_ID=SeqID_15297; Location=629..1507; Strand=-
  SCN-specific regions: Sequence locations=1-666,688-758,780-879
atgtcggacacattacagcagaacatggcggagaaaatgcaaggtgggtgggcccagcaacattgacacacccacaaacggacagagaaacaacccgttttttaccctccctcatttttttgggggcggggcggcggggaggggactgatcggactctcaaaacaatggacccctccctaatcgactggttgatcggcacataattaatgaggattatgactgatcggagttagtcaatcgcaaaacaatggacccttccgccgaccgattgatcggcgatttgtatgactgatcggagttaaaaaatctaaacaatggctcttcaattgatcggcgatttgtatgacgactgatcagagtcagtccctaaacaatggacttctcccccccccccccctcgccaaccgattgatcgcggtacaatttaatgattgattgttgttgtccgttttgtgtcttctcgtcttcgccagaccctccctccctccgacacatttgctttgtgtgtgaccatcgcgcttcaatgagaaaacgggtcccccgttgcgcctccgtatccattttcagtattttttgagccgtttagggtaattattggcttaatttgtcgccgatcccccgcccaaatccatctgaacacattgctcggctcggggcattggagggacaattaaaattgtttaattggtttttcctatttgtttttatcgtcccaattctctccttctctcgacgaattttgtccttatcaaagttcaaatttatgaataaaatttttaattgcctataatgccagacaaaaatttattggcttgagccctcattaagagctttcaattatgccaacttttttttcaaaatttttgtcagctaataaa

SEQ ID NO: 79524 - DNA, 1386 bp, Heterodera glycines
  misc_feature (457)..(457): n is a, c, g, or t
  misc_feature (498)..(498): n is a, c, g, or t
  Genomic contig location: Contig_ID=SeqID_2396; Location=171..1556; Strand=-
  SCN-specific regions: Sequence locations=1-39,76-84,106-174,196 -274,300-417,440-458,498-661,721-807,829-848,870-973,1000-1000,1027 -1244,1266-1386
  Gene Ontology: Mol. function=DNA binding; Cellular component=nucleus; Biological process=protein targeting
atgtctgacaacaaagaagaactcgttcagcgggctaagttggctgagcaagctgagcgctacgatgacatggctcagtcgatgaaaaaggtgggggaaagaaaactaaggaatttctataattttttggttcgcattttgaaggtgacggaattgggtgcggagttgagtaatgaggagcgcaacctgttgtcggttgcatacaaaaatgtggtcggtgcgcgtcgttcctcgtggcgcgttatctcgtccattgaacagaagactgagggctcggagaagaagcagcagatggccaaggagtatcgggagaaggtggagcaggagttgcgagagatctgtcacgacgtgctggtgtgtcgaaaattttataagaaacttggatggtaaattcaccaaattttcaaggatttgctcgacaaatatctgatcccgaagggctggcaacccggaatcnaaaggtgttctacctgaagatgaagggtgactactaccgcntacctggctgaggttgccaccggtgacgaccgaaacgggtgcgtgtgtcgaattgctttatcgcattttaagttacaaattttttttagctgttgtcgagaagtcgcagcagtcgtaccaggaagcgtttgacattgccaaggacaaaatgcagcccacccatcccattcgtcttggtctggcgctgaacttctctgtgttctactatgaaattctgaactcaccggacaaggcgtgccaactcgccaaacaggttgggaagcatcaactttttgcatcgattggcaaaagaaaaaaatcaatgggtttaattaaaaccttaatttgttggatcggttgatttttgggtcattggttcatgttaggtacaacgtatttgttcaaattatttggaatattaataaattcccccaaaaaaagaatattttcgttacgtttttcatttttttgtcaggcgttcgatgatgcgattgctgagctggacacgctcaacgaggactcgtacaaggactccactctgatcatgcaactgttgcgtgacaacttgacgctttggacatccgacacggctggcgatgagcaggaggctggtggtgaggcgggcgaagctggtggcaactgatcgggcggacagacgttgaagaccaagaaaatgccccacgaaattttttccaccgaatcatttaatgacaattatgcttttctcaatatggcacttttgattgggtaaatttttttgaaaaatcgttcaattaaaattaaaattgtcgtttaccagtcactctgaacattaaaaattggcgtttcccagttactccgaaccatcagaaaaccgttgacgttacggtaatactgacttttactggtcccataaaaaaaggaaataaa

SEQ ID NO: 79525 - DNA, 204 bp, Heterodera glycines
  Genomic contig location: Contig_ID=SeqID_2396; Location=2496..2699; Strand=+
  SCN-specific regions: Sequence locations=1-204
atgaaaggaagaaaagagcacagagaaagaggacgtttgtgtaagcaagaagacgcacgaattcccggggagagcgtcgagattggcacacagcagaagcaagcccttcgagcagcggaagtcgtttatgctatgcttatttgcggtaacgaaggcgagaatgttcaactaggggccgtctctcatttaacaccagtgacaagt

SEQ ID NO: 79526 - DNA, 718 bp, Heterodera glycines
  Genomic contig location: Contig_ID=SeqID_2397; Location=1294..2011; Strand=+
  SCN-specific regions: Sequence locations=1-289,369-718
atgctaacccttctgttggccatttgtctttctttgggcccatttttggcctatttgtccattgcacttttctctcaccgttttttgatcgtcgatcgttctcgcaatcggccaatttgcacttcgcccggctgtgtccgatgtaatcggaatgcaaatgtgagttttttggctctattgcgctttaggcattcaatcaatgattgtttttaggccatcttggaatattcgaaaaaaagagaatttaatgtttctcattgtaattttttaaaggggtttttagtttacctaatttattttctaatttctaatttaactttatttttagtttctaatttaatttaaaagtttttccccaggaactcgcttccgccatggaccgctttcaaaaggctcgtttcgccgcccgcgcgcaattcgcacgcgttcggagtgcgctcgagcgcgcgcgttgcgcgtcggtcgacgacgcgcacgaacttttctttcgcatgaaatttgagggtgtgcaacgacccgtttggacgcgttcgcaactgccgatggcttttgtcgcaaaaatggaattatttgaacgccaacacgcggccattgcgaaggaatgcgaaagggtcggcatttggcaagccattttcaatggaaattaaaaatagacttgaaattggcgcctatcgaaaccaccagacgccctatgtttagggttttcaattattgaaca

SEQ ID NO: 79527 - DNA, 55 bp, Heterodera glycines
  Genomic contig location: Contig_ID=SeqID_2398; Location=195..249; Strand=+
  SCN-specific regions: Sequence locations=1-55
gtttctgctgtgtctgactgttcctctgcttctctgctcactgactgtctgttcg

SEQ ID NO: 79528 - DNA, 418 bp, Heterodera glycines
  Genomic contig location: Contig_ID=SeqID_2398; Location=1994..2411; Strand=+
  SCN-specific regions: Sequence locations=1-125,147-248,270-337,365-418
attacattgcctattagttaataattgtccatcaattaacccaccgatgccttcccccatccgccttttcactcttttctctcttttcctgtttctgcttcttctcctcccatttttgtccttcgccgctttgtccccccgagagaagcgccaattcagcttcaccgatggcttctcaagtggcacaattttgcagccgggcggcggcggacttttgagttggtggcggagatgagccaacggcggaagtgaagcaaaacaatgggaaagattttgggttgtgatttgatttatgacgaatgaatgacccaccgataaaccgacttaccagaccataattcattcattcattcattcattcattatgccgtgccaatatcccccacccatcctttttttgtaaataaaaaatttaatt

SEQ ID NO: 79529 - DNA, 1070 bp, Heterodera glycines
  Genomic contig location: Contig_ID=SeqID_2399; Location=1144..2213; Strand=-
  SCN-specific regions: Sequence locations=1-95,118-608,630-855,877-1070
atgctgcagattttgtcacaatttacgctttttctgttattttttaatttaagcgagcaaaataattcggaaacaaagtgtcaaaatggtattagaaaaatttataaaattaaaaaacaaatcagaattttaagactttttccaaatggcacagaaattgcgtgcctcggcaccaccgattgcttatgaaaaaggggcaaattgtgaaacgaaaaatggactctcagcttttgaacaaatgcaatggttcgaaatgaatgtttttggcattttatgctgccaaaatgacaatggaaatggaattttggacgaagaaaaggcagagaaaatttcaaaaattaaaaagaaattttgccgagaaatggaaaatggaaaaagcattggcctaatgatgggaaatattggcgaaccctcgctaaaattggatgagattttggaaattgagccgaaaatttacgaaaagttatgtgattttgctgcaattagcaaaatcgaaggcacaaaaaaagagaatatggaaaatcatattggaaaagttattgagaagatcaaagcttttttcgaagcaattaaaggtaaataagaaatgccgaaacattcatggcactgtttttactccgatgtatccactgattctgtcagatcacttgctaagtctttttgtttttagccaatgccatcgctttttccttcgattcgtccgttggcactgcccattccatcgcttttaaagcgtacgggcgaagaaagcgccgacgcaatcctcgcctcggctgtgtgctgctttatctttgctctgtcattagcctcgtcgttggccttttggatctaatggagctttttcccgtcgccagttgggcgccgggcgccgccttcggcgtcgctgctttgtgtttccttttgatgtgctgcgtatgcgatttgcgaccgaatgaatgagtgaaagagtcgaaagcaaagaaacgcatcattatcattagggtaattagcaaaaaataataatggaataattacgatgcaaaacccaattagtggtatattctcatttcatatgcttatttgggaataaa

SEQ ID NO: 79530 - DNA, 429 bp, Heterodera glycines
  Genomic contig location: Contig_ID=SeqID_2399; Location=3358..3786; Strand=+
  SCN-specific regions: Sequence locations=1-25,68-79,101-202,224 -291,323-336,359-429
atgccttcccccatccgccttttcactcttttctctcttttcctgtttctgcttcttctcctcccatttttgtccttcgccgctttgtccccccgagagaagcgccaattcagcttcaccgatggcttctcaagtggcacaattttgcagccgggcggcggcggacttttgagttggtggcggagatgagccaacggcggaagtgaagcaaaacaatgggaaagattttgggttgtgatttgatttatgacgaatgaatgacccaccgataaaccgacttaccagaccataattcattcattcattcattcattcattcattatgcccccgctccttttattgtaaataaaataaattcagaagcgatcggccttaacgtctctagcagactttgggctcaattttactaatttttaagttcgactcga

SEQ ID NO: 79531 - DNA, 548 bp, Heterodera glycines
  Genomic contig location: Contig_ID=SeqID_2400; Location=560..1107; Strand=+
  SCN-specific regions: Sequence locations=1-106,129-548
  Gene Ontology: Mol. function=protein binding; Cellular component =Golgi apparatus
acgaatttggaaccgaatgtgccagtcaaacgtgcaaaagaaggagaagccgttgcaaagacgcattttgcacgtggccatgtcaaggggggctgtccaccgggtcccccgggggagcctggcactcccgggcctccgggccctcccggagacccggcgccatgcccgaagcacatgaaaagcgaagcgcaaagcgtcgatggcaaacaactggctaacagaaacaaacgtggggagacggtgctgaatgctgcaaaggaggggaccgaagtgaaacgccaaattgtgcgccatgggttcgtttttgggcaaatcgccgtgggcgaaacagtgccgaaagtgcaaaattgagaccattgttttgtatttggcaacactattttcaaactcattgatgagttaattaatcggtcgggttgaggggtacctaacaaaaatattggaatttaagcattggaccgcccggccccgccggaccgccgggagaagcgggcgaagacggagagccgggcccttgcgaatgttacaaagaccaaaaaagtcaatga

SEQ ID NO: 79532 - DNA, 1648 bp, Heterodera glycines
  Genomic contig location: Contig_ID=SeqID_15300; Location=1567..3214; Strand=+
  SCN-specific regions: Sequence locations=1-320,342-368,394-1074,1111 -1648
atggctaatttgctatacattcgcatgaaagccaacgactgtccgttgatcgcttttatccgatccggtgggtgggttttccattgttgaagaagtgctgggttcagtttacaaaaatgcattttgtaaatatgttgttgggtatactgtcggacctactgtatgccggcaaaaaccatagccaggaaaaacatttcggaggggggaccatagatttttttcaaaaatgtcagcacaggagaagcaaaaaaaaaaaaacagggatttgtagtcttttcgtcaaaaaaaaagtgattaatttttgcggttttggtgtcaaaatttcagaaaataaagtaaaatcggcgttgccgataggcgccgcctggaaaaaatttttattttaaatttaatgcattttttatggaaattttgggaggggattagtccccccggcccagggtcagccaccggtcggtctctttgtttttatttttattttccccgctacatattttacaggttgtaccacctcattcatctccgagtcgttcgcccggaaggccaaccttttgggcaacattgaccgttccaattgcgagacaattcccatacctggcaaagtgcttggctggtgagtggtggccaaaaaaaacaaaagttttatgatgcactactacgttttttcaaaaattttccctaaaaatcgctggaaaattttcaaataatttttttttcttgaatttttcatatggaaaagacatttgcgcctttgtccaaagtcgggttcaaattttctttttttcaagccatgatagcctaaacagctttaagcgatagaaagtgattataaaaattaacgttgaatggcgcaaatattggggctcttatttttaagtttttcaaacaaaaaaaatttttttcgaaggcatggcttaaaaaattgggcaattaattctcttattttttgacttaatttctttgcatgttttgcagggccaacgatgttcaaattcgaattgatgagctcaatttgcaatttgtgcaccgtttgggggtgatggcggacaaacatttgccaatgtatgtttggcgtttttttaattttattaaaatcaataattaaaaaatgcccttttttattttttgtttttgaaattcattttttaagatattgcaagaagaagttcgacatgctgtaagttcagacaacaattaatgaatttaacccccaaatttttttttcattttttaattttccaagatttttttttgaaaatttaatgtttttaagacgttttagctcgtcacttcgccatgtctctctcgatgacggcattctccctgaatttccggtcgatgacagtgccatggcgtcggatggccaagcagtggccaaatggctgttcacgcctcatccagacaatgtgccgaactttctctactgcgatgtgaatttgtcgatggatcaatggtggtcaacaatggaacagttcaaagcggtgtggttttcacgcggtgtttttaattcaattttctgtgtattttttgtcccattttcaggcattttccaatgcttcttctccgattgctttccgcattttggttcactttcagccgtcttttccgattgactctattgtgccatttgatcggatcaacgaagtga

SEQ ID NO: 79533 - DNA, 183 bp, Heterodera glycines
  Genomic contig location: Contig_ID=SeqID_15300; Location=1076..1258; Strand=-
  SCN-specific regions: Sequence locations=1-183
attgatttgaagaaaggagctcaaaaaacgcatttctgcattaaaaattttcgattctgatgtcactatcggtcactagaaatcactattttggcgacttcgtcactaaaatagttaaaaatcactattttggcgttttgtcactattttttcactatttcgacattttttggaaaattcctt

SEQ ID NO: 79534 - DNA, 844 bp, Heterodera glycines
  Genomic contig location: Contig_ID=SeqID_15301; Location=90..933; Strand=+
  SCN-specific regions: Sequence locations=1-77,258-302,534-599,786-844
  Gene Ontology: Biological process=N-linked glycosylation
atgcaaattgatgaattaattgtgttagaaagcgatgatgaagagaaggaaaagcaaggggaagagagggagatgccggaggaagagagcgcaatgcaagggaaggtgaaggaaaaacaagcggaagagaaggagacacaaggggaaaaggagaagcagcaggaagaaaaggaaacgcaagtggaggagaagaaaatgcagttggatgaggaggaaaagcagcaggaagagaaggaaaagaagcagacagagaaggatgttgaagaaataattatgttggacagcaacgatgatgaagaaatagaaaaggaaggggaagacaaggaaaggcaagaggaagagaaggagacgcaaggagaggagaaggaaaagcgagaggaagagaaggtaacgcaaggcgaggagaaggaaaagcgagaggaagagaaggtaacgcaaggcgaggagaaggaaaagcgagcggaagagaaggagaagcaatcggaagaggaggaaaaaacggataaaatggaaaagcagcaggaagagaaggaaatgcaagttgaagaagtaattatgttggatagcaacgacgatgaagcgatgaaaaagcaaggggaggaaaaggagaagcagttgggagatgaggataagacggaggaagacaaggaaacgcaaggggatgagaagaaaaagcaattagaaaatgacgaaaagcgggacaaagagaaggaaacgcaattggaagataagcaaaagccggaggaggagaaggaaacgcaaggagaggagaaggaaaaggaaaaataattttgttttactgattcatggaattttgatttttcatctgattttttttttcaaa

SEQ ID NO: 79535 - DNA, 2033 bp, Heterodera glycines
  Genomic contig location: Contig_ID=SeqID_15301; Location=1358..3390; Strand=-
  SCN-specific regions: Sequence locations=1-58,121-236,286-459,529 -648,676-691,821-1342,1364-1651,1673-1874,1896-1988,2026-2033
atggaaacaactgcactgaatccacggcaatcgtatgttttttttttcaaatttgtggatttaaaattattttaaatttaatttgaattgattttaaatattttgttcattttatatatagcttaatgaatcgtacaataatcatcacgaagaaaagcgtgcgaaggccaatactattgcctgaagcattgactgtgccgccgaacaatagccaaatgatcgatcaaaatgtggagaaaaatttgtaaatttaatttttttaaattaattaaattaattatttaaggcattcaaaaaatggcaaattcatagagaattgcccagattttgttgaatttgaacgcattttgcgtgaaaatttggtggccgatgaaatttcagaacaaattttggagttggccaatcagaaggccaaacaatggaatgaattggtcgaaaaggtaatcaaatttttaggggaaaattaatttttaaaaaattaataaaaataatattttttttaatattaatttttatttttttaattaagtatgagaaagacaaattaatggaacgtcaattttttgaattaaaattgaatgtagcaaatcaaaacagtgaaaaagcaacggaactgttcaaaatatgggccgaaatggaattgttcagtttataatttaaaaaaatatattttttctccatcatttcctcgttaaattaaaaacaataataatttcaaaaattctaaccaaatataaatatttattccaaagatgaatattcataattatttttaattaattatgcgtaattatttttatattttcatttaattaattatgcataatttactttttctatttgcgcattttgttgtcaaaaattgccacccctctccctgccccactgatcagatattgatgccatactcaacgaccgttcggccgattccattcgacagcatttgcaattcccgaattcgccactgtgcgcgaatgatgaagatttgacaaattcggcaaatcacagcgaaactgagtccaaattagtgcgggaaaattacgcgcttaatggagaggttgttggcacttcattcagttcataagctaacaaataagcatggactcattagtatccaaacccattaattcgacttcaacttttttgccaaaggaatgtgttttatttattttaaaaaagcaaaagtttaaaaaagacaaatgtggccaattttaattaaatggacaaaaacgcaagtgggatcagggacaggcgaaacttcgagttcggcaacgaaaatttcggcctttttgtgtttaaaagggaagtacaaaatccggaatatagcaaagtcggggatttacgatttcaatttcgacccaaatgccccccaaaattcaaacagcacatccaatgtttagattaattcgctggaggacaactattccaatttgttcaaattgtacgagaaaatgagactgaactgcgtcgatttgaaggaggtgctcctcgattttgagtccggtgcgggatttttcgggatctcggtcctctataagtttttgggattaatcccgcgggattccatcacgaaaatttgttgaattcccatcccgtccagtgggatctgcaaatttcagatttccgggattcatatccattaaaattaagcattttattttttcaggttcaacaatcgcttaacacccaattggaacaggcggagagaaaatacggcgcattgcataaaatgtacatggaattgttggttgaagcgcagaaaaagttgaaagagtacgcgcatgaattcaattgaaaaatagggctgctgtcaattaatggatatataaaatcgcaaaaaagaatccgtgtgagcaaaaatcccgaaatacgggcattgggacacaagttcccacaaattgagggtcaaaaattttaaaaatctcataaaagcctgtaaatttattatgtgagaaaacaaccgaaaaaaggaagtacatttttttgtctatattataattttttttttaatttgaaaaaatatttcgaataaa

SEQ ID NO: 79536 - DNA, 1069 bp, Heterodera glycines
  Genomic contig location: Contig_ID=SeqID_15302; Location=1035..2103; Strand=+
  SCN-specific regions: Sequence locations=1-87,109-310,349-1069
atgccgtcaacatccatggcacgctgtgacttcatgtcgacaccatcgacatcaaaaagcgccttcgcctttggtctcgatgatggtgagagaaattcaaacaaaaatttagttttttgtcatttcattttcataattttagtccatatgttcgacgagctgcggcggcgccacatttggaccgaggaggaactgcaacgacagcgccggtcaaacgccttcctccggaaacagctcaaggcccagcgcgaccggtcgacgagcctcgagcgttcgtcttcagcatgccgccagcggagagtcctttccgacgtgaccaccaacccgcaggaggacaaaaggctgagcgcggcgaatgatttgctcatcacattggatgcaggcatttcgttcaaagcccgtgaagcgtgaaagcggtcattcaccgaccacggacttgacgtttgagcaccgacgagagcggtgaagcgtctgaaggcggagctgttcgaggttttttgatcaggtggcgacatctacaaaatcctcgaccacgaaaacttcgcttcattcaccgtcccaattccacccggaccattgaaattcttgctaatcgatgctatgaatgatctgcgcaacattttcgtttgtctcgtgccaaaattcttcagcccagtgacctcaaattgacgccgctcgttacccagtccgcccaaagcttcattctcgctgctcacgtcgttccatttgcacgcactcatctctggtggggactgatcagtgaacagggaatggagcatatgcacagaatgtgcaacaatttggtttaatgaataatttttcccattaaaattataaatccaggtcggtcgttatgctcatctcggcactccagagaaggttgttgagaagttggtgaaacacgtgacactgctgaatgcccttcacgatcgaggtgtcgaaaaaaatcaagaaaatggaaacaaatacccaaacttttgatcaaaatttcatttttccaaacattttcaccatttcacatttccactatctgaatattatgttgaacacatcttttccgctttctata

SEQ ID NO: 79537 - DNA, 1066 bp, Heterodera glycines
  Genomic contig location: Contig_ID=SeqID_15303; Location=1103..2168; Strand=-
  SCN-specific regions: Sequence locations=1-346,371-594,616-660,682 -1066
atgacgaagccacaacaattcactgttgttgtcccttttttgctgctttgcgcgtttttttccataatttgtgaagcggtgaaggacaatgacaagaaccaaaacaatcaaacggcatcacaatcgacaaattcggcaccaccaacagtaatttaccagaatgagccaccagttatccatgttgagcaacaagaattcagtaaaattgttcaagaaacaacaggaaatgcagcagcaagcacaaacaacaaaaagggaggaaaagctgacggtccattatcattatcatcttcagtttttaagcggccggcaccaaagaaattggccgtgttcaagccgcacgaaaccagcagcaggcccatcatcaacttttcaacttcgtcatcatcgactcatttccaaaggggtgaaacaaaatttcaaatgcttgatggtgtggaaaaacggctattgctgccacccaaatggctggataaaatgaatgataaagtactaactgatcatgtgatcgatcagtgaggttttgacaggcgaaagaagtgaagatttttgtctctgagaatgccttttttattggatgagagaatggtgaacaaacagatattttttgggggatctgatgatgattaaaatgatttattttgttgaaactagtcttaatttatctaaccaacttttaaattccgaattttttttgtttattatccattttttggcattttcataaattgtttttttatttgagtggatgttggccaaaaatgtatttttaaaaacaaaaaaaaaaattgaatttcgaaaagaacaaaaatatggacaaaatcttcaaaaatattgtaataaccatagttcttaagtgtgtttgctcgaggctatctgtgtataaaatggagaaatgtcttactttggtcgaatttttttaattttcagacgacggcatccgccctttccgccgggaaaatgtatgtttttatgaaagagaactgttcaaaattatttttttagagaaatagcgaacatcagcagtagttaagcattgttgttttaaaccctcataagcaataaa

SEQ ID NO: 79538 - DNA, 1282 bp, Heterodera glycines
  Genomic contig location: Contig_ID=SeqID_15303; Location=2749..4030; Strand=+
  SCN-specific regions: Sequence locations=1-98,189-235,302-1282
atgtccactggtgtagcggtagtgcgccagtcagcgttttttaacccccaggttggcttcctctacatgcaaattctttttttgctttttatgccaagtaaattatcaaaaattgtttataaaacaaaacttttttttattttttcattcattttatacataaaatactcaataaaaatatttttattcaaatcgacatgatatttaaagcatcattgtacctttatgtttaatgtaatttttaattttaataaaattaaaataaagattttgcttcataaaaaatatttttaatatttaactttgcataaaaagcaaaaataaaaattgtaaaatgtattagcatgcaaaggattcgaacctacgacccacaaaaacttgactaacgcactacctctaaactaatggctactgttgtaaacaacgaaataattactctttttcattaatagtaaaaaactataaacttttggtacatcataaaaaacgaaaccaaaatttaaaattttaaatacgaataacgaaacgaaaattgaaatatttaaatataactttttgacggacgaaaacgaaacatgaaacttaaaaagtgacgaaaaaggggggcgatacgaaacgacaagaaatttcgcacatcactggtcccgattatgccgcgagtcgactccaaagtgggcctccagcatggccaattacgactttgaaatagggtacagcaacggctgacgttctctcgcgcctcattgccaattagccccaccgggggaggaaatttttattatgaacatttgcaccgaaaccgagtgctatatcagcacaattctgcaaaccaagaccatccagcttctagtcactgcagaagaaatcgcagaagctacacaaaaatatgaaattttagcgaaaaccttggcattcggtcgatcgaattagccaaagaacgcagcgattcgggcaccgtgccgtatttaccgaaaagggaatatattgtgggaaggcactcacccgccaacacgtacattggcctggcatcaattcacaaattgaaaggattgtcagtcagggtgaagaaaatcaaatgcctcaaaaagcaccgattcattttggtggactcatactccaaatggccggacgtctaacaaatgaactcaatgacagctgaagcaatcgtctaaaaacactctgtcaatcatctatcgactcgtcattccgaagaaatcttttcggataacgggaaaccaattttcattcgtcagaatttacggcattctgtacggagttcgga

SEQ ID NO: 79539 - DNA, 1601 bp, Heterodera glycines
  Genomic contig location: Contig_ID=SeqID_15305; Location=176..1776; Strand=-
  SCN-specific regions: Sequence locations=1-169,193-234,273-944,966 -1234,1257-1271,1316-1446,1476-1601
acgaattgctgccgaagaacagcgaaacaccacaacacgcggattggccaccacacattcgtcgacacagatgcgttcctccactggcgcaactgatcagcaggtgaagcggaaaaaacggaattttaaactcggctaaataaaatgccaatccaaaatggcatttcagctttttctctctcgcgccccctccacggccgattcgagcagttcgtccggcgatccgatcaaacggtaccaccaccagcaacaacaacaacagcagaaggacgactcatcgacaacgccggccacggctgagcatcggtcattggccgttttcgtcgccattcaagactacgtgccggagccaggacaagcgccgggggaggcgctgttgctggagcaaggccaaattgtggaagtgttggacaacaaaaacccggcaaattggctggtcaggaccaaggtgggcactggactacttttgtttggcatattcgccagtttttttcaaaattggtcagaatttaggccaaacccccgctgacgggttgggtgccggggtcgtacttcgagacaccgtcaaaatactacacacagcggaagagcacgcgtgaattgacagcggatgagcaaactttgagtgaacagcaacagacacttctgaagagagagtgaggagggggggggggcaattaattaatggccgctaattattgcctaatttatctttttcattggcagacaagttttccatgatttgcttcgcaccgaagagcaattcactgcccaattgcgcgactgttccaaacactttttggatgctttcgaagcgcccgaggcaccggacgaaattcgcacacatcgaattgccttgaacatgcgcgagctatgcaattttcattcaaagtaatataattagaaatcactcataaaaaattgtattaacccttcctaccgtattctcttttctttcttgtatcgtacccaatgttttttgtcatcgcttttactccgtttgccaattagtgccattttaccacctcccgtattatttttccttcatttcctctcaaatgtttacagtgcgatgctgaatggattacagtattattcggatgactcgggaaaggtcggacagacatttttgcgcttggagcgcgattttgagcaacacgtggcatttctgcgcgagttggacaatgcgcaacgaatcgtcgcagaaaatggcgccgtacaaaaattcctcgaggtaatcatttttataattattcaattagggaaaaatgaatattaaattaaaaattattattctttaaatttacaattaaaaggagtgcaaaggcaacgcgggctccgacgtgaaagagtacagctattatttggaattagtgccgaatcgaatcagacaatacgaagattacttcaaggcaatgcaaaaattcgaatttcgttttcaaattcaaaaattattttttttaaattttatttttgcaggaaatcatcaaatattcgttgcgtgttcagcaacaacagaacgccaaagtgatgcagaaggcattggagctgatccaatcagtgccgaaacgggcgcaggagatggaattcacgaagaatct

SEQ ID NO: 79540 - DNA, 1988 bp, Heterodera glycines
  Genomic contig location: Contig_ID=SeqID_15306; Location=639..2626; Strand=+
  SCN-specific regions: Sequence locations=1-964,1014-1131,1154 -1190,1214-1481,1533-1547,1569-1810,1832-1885,1907-1956,1978-1988
atggtcggggcgtccaatttgggaagcagcggcacacagaacaaaggcggtgggttgggaaaagctaattgtgattagaaatgtgatcatgtgatctggggcatgagcctggtcccaagactcgagacaattgagtccaagagatttggccgcaacattttgatgtcgagagtttaccaaaatccaaatttcgctgcaaatttgctagtccctctaaaagcggactaagccactgatttgatgcactccaattaatttaagcaattaacacctttggaaatctgcaaatgaacggcaccgggccgagcaacggcggcttcttgtccaactcaagctttggccccgacggatcgtcaggcgccggtgtggcggtgtcgggcacgcagatgggcagcaacaaattcatcagcgtcagcgacggcataaattcgaatgatcggcagggatcatccggtatgtgttacgtatttaccgtaccatacttaatctcacagcgtccaatggttacggaaaattggagggcatcggcaatttggcggccaacggctcttcgtttgtgctgagcggataccaaacggacagaggcgcggcacaaattgtggagacggtgggcaaatcgattgccacgaacaacacggcagcagagttacgcattaaaaaccaaggcaccgaagtgatcaatggaacgatgggcacaaacagtgagtgatcagaaaaagtaaggacattggaaggacagtgccaaaaagcgattcggaaactaagggcatggaaagtaaaatgacgaaatatgatcagaaaaactaaaaaggaccaagaaaaaattccaaaatgaagaaaacaaagaaagtgccaaaggtaaggatattaaaaggaactgccgaattattgtttgttagccatcttcctattaaaagtttaagtaatgaattattcaaagtatttctgatcactaattaatcgattgtttctttttgtatttttcgtttgatcattttgccactcttttcttctccttaagcgaccagcaattcgtttggcaaatttctcggccaaagtggttccgtgcaaggcaattcaatgctcaattcgagccgtcccggcggacagaatgccaacgcgaacactgttgcccaagggggtggggcaggtaaaaacaaataccaaacggacgggggcaaacatcaaagaattttcattgaatttcattttatttctaattgtaaggcccatccagcgcaatgacggacacgggactgcttctgaacggcccaagaacagcgtaaaagtactgtagcagtatgaaaatacaggaaaaagggaaataatcaagaaaaatattgtagtcatcagagacaaaagtttgtcaattagtaattagtcgtaattttgcatcattcattatcagacatatgtaaggtcatgaatctggatttcagtactgagtcgggattttcgcattgactaaaaaatgctcaaggaaaaaatttgaaaaataattcaaaaatatgcaaaaaaaaaaaaaaaaatttcccctcctcaccttacaatttatttttaaggaaaacgccagcgggcaacaaacagatgccaaaatcccgattttgccaactgagttccaagcaggatttttcgggaatttcagaaccagaattttcgttataacattgtttgaaattatcggatttggcccatatatggcaagccctagcttatggaaaatggaaaccattccaaggggtccaatttcaagtcacgcttctttggcattaaattgttatcccatgaaaatcctgacagcatgttgcttttttcattctaatttgttcagcaacgaacatccgtggcaatgtgaacgccaccggtgatcagacgtatgtgcaaagtgtgtcaagtgtgtccgatcagaacagacaacaggcgctgttcaactctcagaatggtcagacagccgacaaaattaaataataaaaaaatgcaaattttaa

SEQ ID NO: 79541 - DNA, 1901 bp, Heterodera glycines
  Genomic contig location: Contig_ID=SeqID_15307; Location=548..2448; Strand=-
  SCN-specific regions: Sequence locations=1-660,700-751,801-890,913 -950,974-1254,1276-1540,1562-1681,1703-1765,1787-1901
atgaacaaacggaccaaaatgaagacaaaaattgcactgatcatttttggcactaccatttgctggctttcggtcagggtcgttttcgtaccgccgttttcgtacgggggacattttcgtacgagttcttgtacaagcgtcagattcaaatagaaaaacttaagaactaataaaaccaaaatttatcattttttgtttcccattcataaaattttgtagaaaattcataactttataataataacaaaatccgggacaaactaggtcgcatctcataatttcggaaaataccagcgagaaaattgttaaggttttcgggattgacattggcattggcataattgtgatcattttgagggacaatattgttattgatatcgttatagcgttggacgagacgaagaatccgtgcgtcggcatcgcgatacttctttttctatgcaccatcatgcaccaatttatggtgctaggtcgtttcttaaaaaccgccacattgggcgtttcttaaaaccgccagggcgtttcttaaaaccgccacattgggcgtttcttaaaaccgccagggcgtttcttaaaaccgccacattgggcgtttcttaaaaccgccacattgggcgtttcttaaaaccgccaactcatatgattatgtatgtatatccgttaaattaaatatacaataatatctattaatttttatttgttgtgcaagtaagtgtcagccggaaatattattagtctagcagtgacagactaaaaatctttattaaattaattcacaattatttacttaatttttatttggttgtaccaataggtgtcagcaggaaatatgaggctggcagttttattacaatttaaatggtataaatagctaaatttctttaacatacatttattataaaaaatattattgccttaattcctttaataaattaatccaatgttattagcatttatattcttttcattcataaatattattaattgtattagctttgatgaatttgtttcaaacaatggcgcaaataactaaaaattaaggcgcagccactatagaatatccagctcagtttaatttcgtttcttctgaatatggaccaggagaagtagaaacaataataggtgatggaaattgtggttggcgtagtatatctctagctctaactggatctgaatggaatcacacagaaattcgaagagatgtgattgagtatttggaagaatcaattaaccaacacacgcatttaaatcataatgaaaatgaatggtggtgtaagtgttaattttttggggtgttgcttaattattaattttaagtgctatttaatagcattgaaaatattagaaaacacatcgagatatcagtttcaccagcagcaggagctcacgaaactgagaaatggatgaacaatttagacttagcatcaaccagcaaattgtttcaattaaatataatagtttgcgaacgtatacaggaaagaattttccgttggcaagtgtatacaccagatttagaaacatcggttagactcttttgattatacaaattcatattaaaaatttagcttacgaatctgagtcaaaaagaaacaacagcatcagtatttttgtattataatgatggacattttgaactgattaaacagccaacaaagataaattaattattttgttttatttctgtgataatctttataaaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaataaa

SEQ ID NO: 79542 - DNA, 736 bp, Heterodera glycines
  Genomic contig location: Contig_ID=SeqID_15308; Location=33..768; Strand=-
  SCN-specific regions: Sequence locations=1-69,91-407,430-449,472 -491,516-664,686-736
  Gene Ontology: Mol. function=glycogen phosphorylase activity; Biological process=glycogen catabolism
atgtacgatgtccatgtgaagcgcattcacgagtacaagcgacagctgttgaacgcactgcacgtgataacgctgtacaaccgaatcaaggcggacccggcgaagaaagtggtgccgcggacagtgatgttcggaggaaaggtgccaatgggtgctggtggtgatccactaatctgatcagtgatcactcgctatttcaggctgcccccggctatcacatggccaaacagatcatcaagctgatcacttccgttgcctccgttgtgaacaatgacccaattgtgggcgacaaattgaaagtgtgtcgtccttttctgttgattatacttttttccaggtgttttcatttattatttacccccttctgttctcaggtcgtttatttggagaattaccgcgtttcaatggccgaaaaaatcattccggcggcggatttgtcagaacagatttccaccgcgggcacagaggcatcgggaaccgggaacatgaagtaaatatatttccttggagtttttgatgccatttcacacaatgccgcacattgcaactccagattcatgctcaatggctcattgacaattggcactttggacggagcaaatgtggaaatggcggaggaaatgggtgccgaaaatatggtgagggaagacggaaatcgccatatcttggaaataattccttttcagttcatttttggcatgcgagttgaggacgtacaagcacttcagaagaaagg

SEQ ID NO: 79543 - DNA, 488 bp, Heterodera glycines
  Genomic contig location: Contig_ID=SeqID_15310; Location=555..1042; Strand=+
  SCN-specific regions: Sequence locations=1-191,213-432,455-460
atggaagccgaccaaattgggaaaagcatcggaagtgatcagtcgaacatccaactgataagacagaacgaaaaactgacacgtgaaaatgtgcagttgaagcagagaaatcaggtgggacaatttaggagattctaggagaattatttcattttaggggggggggattgaacggaataatttatttttcaaaaatcaggaacaacagcaacaaatccaagcactgatcggcgccaatcgggagctaatttgggcgttcaacgaaagtcgaagggaacacgacgaactgatgcagcaattacgggtcatggccaaattggtgaacaacggaagttcaacgcgtcccgcgggggtcgaaaacaccggcgaaacattgcaattcgaacagcaaaaaacgaagagtgttcgcccgaaacaaatcgccaaaaagaatgccaccactgcttctgctgctaacagtggcggaggagggggaggacgacagagaa

SEQ ID NO: 79544 - DNA, 1284 bp, Heterodera glycines
  Genomic contig location: Contig_ID=SeqID_15311; Location=113..1396; Strand=+
  SCN-specific regions: Sequence locations=188-194,234-234,296-424,447 -582,604-1284
gattggcgttccgtcatcagcagcgttttgcgtaagcaatatgtgctccaactgttcgaggcgctttgccccgaattcaccggctcaaatgtggtggatttggcagtgaaaaatccaagccgtgccgacttcatccaaaagtcgctgaacttcgtcttcgatgccgaaaatgaacttttcggctcttccacttctcgcgactcttattttatggcaatcgctgagaaaatcttcacattgcgcgaggcgaaagaccgtcaaaatttggagaaaagttgccaaaatgggacgactgaacgaattggcgacgcggttcggaggaggacactggcggatgtgctgaagccgaaacacaccaaatcgagggacgaagacattttggacggggacgaaatttgaaggaggacagagtgatcatttgcttttggtattttgagaaaaattgcttaatttgtttgtccgataaaaatggacattgaaatggtatttgatgacaacacaacgatctcttaatttattgtaatggacattttaaccgagaaaataatttctttttcgccataaaatgtgtgtggaaaaagtaaatttgagaaggaatgaaaacagaaaatgtttgttttccgccggtggttcctttccttccgccattttccaccggtttccatccatccgtccgtttctcctcactttccgaaccgcgcaattgcggaccgatccaacggcgccctcttgccgaatctgtcgaatttggggtttcaaatcaacaaaaattggatgccattgctcaccgtgccaacgcggaacggtcgagcggtgcgcgcttaccaaatctgtgggggatacggtggggaattgactgcgttgcgttgccttcctactgtacctggccattgcggaacggtcgagcggcgcgcgttttgcaagactgaaatggggaggacattaattggagaacaattaatgagggtggaggggactgacctttcgaagggatagtcgcccaccctaccgtaatcctccaaaaggccttccatttggggccttaaaaagcgaattttcaaatgggcaaatggcactttcttttcttttttttacccttcggctaacattccgccgccgtattgaaactgcgcattcgttttgctgttcaaaatgacgaaacccaacaaaagggaggcgaggagaatgttggcgacggggaattgggccatttgagaagggaaaggacgaattggagaagaatgaacgaatgggaggaggaggtatctaaaagaagcatttgca

SEQ ID NO: 79545 - DNA, 525 bp, Heterodera glycines
  Genomic contig location: Contig_ID=SeqID_15311; Location=799..1323; Strand=-
  SCN-specific regions: Sequence locations=1-525
atggcccaattccccgtcgccaacattctcctcgcctcccttttgttgggtttcgtcattttgaacagcaaaacgaatgcgcagtttcaatacggcggcggaatgttagccgaagggtaaaaaaaagaaaagaaagtgccatttgcccatttgaaaattcgctttttaaggccccaaatggaaggccttttggaggattacggtagggtgggcgactatcccttcgaaaggtcagtcccctccaccctcattaattgttctccaattaatgtcctccccatttcagtcttgcaaaacgcgcgccgctcgaccgttccgcaatggccaggtacagtaggaaggcaacgcaacgcagtcaattccccaccgtatcccccacagatttggtaagcgcgcaccgctcgaccgttccgcgttggcacggtgagcaatggcatccaatttttgttgatttgaaaccccaaattcgacagattcggcaagagggcgccgttggatcggtccgcaattgcgcggttcggaaag

SEQ ID NO: 79546 - DNA, 1632 bp, Heterodera glycines
  Genomic contig location: Contig_ID=SeqID_2403; Location=1953..3584; Strand=-
  SCN-specific regions: Sequence locations=1-281,310-362,391-641,663 -895,924-1166,1189-1422,1444-1450,1472-1632
atggcccttctgacgcccgtcaaacgaccaccaccagcagcgggacagtggcagcaacagcagcaagcgcaaccgtcgcctcaagtgctcacacgtggacaaatcgccgcaacacagacagacgacgcaactgtggcagcagcaacagcactggtggttgcgcaacatcagcaacaggaagagcaaccgccgcaagcgactactaccaattcgtcaacgcaaccgccgcaaatgaccaactcgacaacgcaaccgccaaaagtggatgagccgagcatggcgcaacaacagcagcagcaaccgccgcaagcgaccaccatttcgacaacgcaaccgccaaaagtggatgagccgagcatggcgcaacaacagcagcagcaaccgccgcaagcgaccaccatttcgacaacgcaaccgccaaaagtggagccgagcaacgaacggtagagtgattgatgcccgttaattttgatgatgatgccgtccaccgcttttagcagcattttgtaaatgccattttcagacattccggaaagttctttttgacagcttataaccgtgaaaaccgcaaagtttcaaatcgtttttgaattgacggcatttttctggaaaactgaaaatgcggcaaattttcgcatcattttttaatgaatttcagtgaatcgaaaaattacggcaaattttcacatcatttttcattgatttcagtaatctttgcaaaattttcacaccattttcagtgatccgaatgtggtgaacgaccagcaacaacagcagaaacacattttaccgcttcctccacaacagaacgaacaaaacgaagtcaaatcgacgactggtctgacacctgctgaagctgttcggcgttcgcagatctctgcattggtggaaccgaaacaaccacaacaacagcaacaagaaatcaacaacggcgccggcgacgaacatggcggagtgcttcgcaggcaaaaaaaaaaaaaaattcagtaccaatttgtgactcaccattttccccttttcaggtcaatttcggtgctcagtgataattggtacgattgggttgaaggcaatcagacggacaaagctgggtaaactccatgttttaagcaattttgatcgattctttccccacgcacagtttaagcaatcaacaacaaaatgtcatcgtccatcagtcagtcaacagcaccatcaacgcggatgagcatggcatatctgatgaagccagcccggtcgcctcactgtccacaatcgaccttggccgtgtgtacaccactgttggcactgtgatggaatcgctgctggttaactttgcgcacctgtggcaatatcgggtgagcaaccagagcggcaaatataccaattaacacggggacggacgatgaattaatttgtctcccccgcttccgtttttcagcttttccgttttgccttcgtccttctgtccatctacttctgtctgggcttcttggaacagtgtgctgtcgcgatgaccgccgcatgcgtccgctgggcttggccaccggtgcacttcatgctcggttcgtcacggggaacgctgttctatttgactgactggttcgcgtggatggacgacttcttgtcaagttgggtgtgcgacatggccaacag

SEQ ID NO: 79547 - DNA, 440 bp, Heterodera glycines
  Genomic contig location: Contig_ID=SeqID_2403; Location=4078..4517; Strand=-
  SCN-specific regions: Sequence locations=1-440
atgtctgtacattattttagagttgtttgcagtcagttttattcggttggtcaaatgttagaggcgattaagccttttggcccttaatttctacggaaaacttagaaaattcaacataactctccccaaaagacatatttctgtatgcaaaataaacagaaatgtgaaaaaagattagttctttcttatttaacttgttttatcagtttctttttgttagttgttgagatttttcttagttttccaaagtgtctctattttaaattaacacgccaattttggaaaaaaatcgtaaaacttttttcccgcaccatttcggtttctcactttcagaatcttaatattttcagaattgctacgtacagttaaaaattcagctcgatcggttcatgggaagtggtcaaactcccaaaaaacagggtgtctttattttaaattaa

SEQ ID NO: 79548 - DNA, 1055 bp, Heterodera glycines
  Genomic contig location: Contig_ID=SeqID_2404; Location=96..1150; Strand=+
  SCN-specific regions: Sequence locations=1-499,523-1055
tatttgacacattattccaattcttataatggacgacgacactccaaaccggaaagcgccgaccatcaagaacaaccgcaggacaaccgtgaagcgcaaatcgtcgacgacgcgaagtgtgcggacaaaccggaaagcgccgaccaccaagaacaaccgcaggacaaccgtgaagcgcaaatcgtcgacgacgcgaagtgtgcggacaaaccggaaagcgccgaccaccaagaacaaccgcagggccaccgtgaagcgaaaatcggcgacgacgcgaagtgtgcggacaaaccggaaagcgccgaccaccaagaacaaccgcagggccaccgtgaagcgcaaatcggcgacgacgcgaagtgtgcggacaaaccggaaagcgccgaccaccaagaacaaccgcaggacaaccgtgaagcgcaaatcgtcgacgacgcgaagtgtgcggacaaaccggaaagcgccgaccaccaagaacaaccgcagggccaccgtgaagcgaaaatcgtcgacgacgcgaagtgtgcggacaaaccggaaagcagacagacgatcaattggtgattcgacagcggtcaattcatcgcgttcgggtcagttctcaaagatccaacttccaaaaataacccagtaaatttaaggaattgaggactcgcttggtgcttctacgaccggcaattcatcgcgttcgggtcagttctcaaagatcccacttccaaaaataacccagtaaatttaaggaagtgaggactcaattggtgcttctacgaccggcaattcatcgcgtttgggtcagttctcaaagatcccacttctaaaaataactcagtaaatttaaggaagtgaggactcgagtggtgcttctacgaccggcaattcatctgccgaatccaatgagtgcaacgactccgaccccagctacgccccgccttctactgaatcggaaagtacggacgacgatgccccaaaattgtgctgccgtgctgaagcaaggaccttgccgaaacgtgaccgctaatgtttcctgtgatcaccctttgtggctgttgtatgta

SEQ ID NO: 79549 - DNA, 425 bp, Heterodera glycines
  misc_feature (44)..(44): n is a, c, g, or t
  Genomic contig location: Contig_ID=SeqID_2404; Location=2179..2603; Strand=-
  SCN-specific regions: Sequence locations=1-403
ttttttcgcgttgccttcgtctttctttccatctacttctgctngggcttcttggaacggtgtgctgtagcgatgaccgccgcatgcgtccgctgggcttggccaccggtgcacttcatgctcggctcgtcacggggaacgctgttctatttgactgactggttcgcgtggatggacgacttcttgtcaagttgggtatgcgacatggccaacaggtacagtacagtgtgatggccatacagtcggatgatacagtatcacccctaattttggtccccattttcagatactgtcaccaatacgatgtgatgtgcgattgtcagtgctcctttgtcagccgaacgcagcgggcagctttgctcggtggccgtcgcttctgatggatgtaaagaatttgatagcgatttgtacatatatgtatgtat

SEQ ID NO: 79550 - DNA, 457 bp, Heterodera glycines
  Genomic contig location: Contig_ID=SeqID_15312; Location=861..1317; Strand=-
  SCN-specific regions: Sequence locations=1-25,54-295,317-341,370-457
tgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 79551 - DNA, 663 bp, Heterodera glycines
  Genomic contig location: Contig_ID=SeqID_15314; Location=1993..2655; Strand=-
  SCN-specific regions: Sequence locations=1-57,107-138,229-354,504 -596,619-663
  Gene Ontology: Mol. function=protein binding; Cellular component =axoneme; Biological process=eye photoreceptor cell development
gacatagaaaaactgagagacagtctgaatctgagcgaccaagtgttggtctgtgacaaagacgaggaagtggaggagggcgagcacgaggaggacggcgaagaagcggcgatggacaaagacaacgcgaatgaggacgaagaagaagacggagaggaggatggggaagacgaagaagaaaaggaagaagaagacgtggagaaggaggaggaggaagaagaggaggaaacggaacagcaggtggacagacattgggggaaggggagaagaaacatagggaaaaggaagaagagggcgggaagggaagagaaaactatcactgataaatgctcaaatattcagtcgaccgccaacgacgaagaagaagcagaggaaatgataggcgagggggaagaagacgaagaggaggaacgggagggcgatgaagaggaggaagagacagaacaggcggcagagaagaaggaggccagaaaatacccggaagaggaggaggacgaagatgaattctatttttaatcatttttcatatcctttttgcttctcattttccaattcttttttattatttggacctaaactaatattgtcgctccgttaattgtaagtttttctaagcaattatgcatgttttctaattgttttcgatgaaaatgatttaataaa

SEQ ID NO: 79552 - DNA, 2505 bp, Heterodera glycines
  Genomic contig location: Contig_ID=SeqID_15315; Location=1677..4181; Strand=+
  SCN-specific regions: Sequence locations=1-153,175-212,236-610,633 -751,773-1051,1073-1678,1702-1976,1998-2019,2042-2193,2215-2384,2409 -2435,2458-2505
atgatgaaagcgaaggagctaaaagggagacttgagaaatatcaagtaactctccaaagtttcgaattagaaattatttatcggcctggaaaaaagaataaagtggcagattttttgtctcgatataatataccgggaaatgaaaaggatcctgaaccaaaacaggaagaaaattcagatgagtttgaccttcagccaaaaattttaagtgcaaaaaatattaatgaaaatttaattgccgaaaatgatggaattttgaatgaaaatccgaaaataaccttaaaaacagtaattgaggcacaaacaaaggtaaaggaattggccaaaattttctatattttaaaaaccgggaagtgtccaaatgatgttctgaaatggaaaagagttgtttctgattattgcctaataaatggggccatttactttataaaaggtaaagaaaatatggaaagacctaaattaataatccctcattcattacgacaaaaacttttcattattttctattcagaaggccattttggagtcgaaaagacttggcacgaaattaaagagcgattttattgggtcggaatgaaagaagacgtaaaaatgctaatcgaggcatgtgaaaagtgccaaatgaggaaaattcagccagggcaggccaaatcggctccgagtgtccctatcgaaccatcaaatggcccatttcaaagaattcattgcgacttaatgggtcctttaaagagaaccgaaagagggaatttgtatattttcttggccattgatagtttttcaaaatgggtcatggccaaagcaatcccggatcagaaagctaatactgtatcagaaaattttgttgaaatggtggtccatcaacattcaactcctgagattgttgtgactgatcagggaagacagttcacttctggaatttttaatgacttggccaaaatatacggttttgagcatgtcactacaacaccatatcatcagcagtctaatggaatggctgaaggggctatgcgaatcatggctaatattatttctcaaatggtcaatgaaaaagggaataattgggatgaaattctgccgcacgctattttttcatacaatgtttcaatacattcagctaccaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaagtgaaattctaaaagcgcaggaaaggaacaaaaaagagaatgatcgcataaggaaagcgaatgaaagagaatttgaaatcggtgatttgtgttgtttaaaaaagaagttttgggccataaatttgatcagcgttggctgggaccaatgcgttgtgtgggggttgaaaaagaaaagaaaaatgttgttttacagtcaattgatggaagagctaaattaagaaaagtacatcaagaaaaagtgaaacattttaatggaccagcaattcttcctctaaggcagtcagacaaaccattaaattgggaaaagtacgtagatgatccgaatttagaacaggaagaaattgaaggtgaaagttgcgaaagtgactgtgaggaaacgcaagacaatgaaaatacgcagtcaaaaaacaaaatgggattaaaagtttcaaaatatggctttgagagttctgacgatgagaatgattggaatattgttgcgtttgtaagagaaaaccaaaattctgaggatgatgaaggcccggaagttataatggacagaaaccccgaaatcgaaataatgccaattttcacaatactcgaagtccttattgagggttcatttactgaagtatacaccggatggagagaccccgtaacaatctcattaatctcaagcatacctgaaaacctagtaagggaaaattgggaaatttatgttaatggaaatggctcaagatttgttatggcatggatttttggcgaaagttttgaaattttcattgtcaacgaatttgatcaaattatgttgggaattgatgcgcaaatgttgttgggtgaaagatggcgaataaaaactgaaaatgaaattgagacatattgggaaatctacttcgatgaaaatgggcacgaatttgaaattcccagaattcctgaaatccttttttcagaaaaggaaaatttggaaattgggtatgggtcaaactttgcaactctccgaaattcagaagaaatgttaagtgaacagaatgatttagaggaaggaaatgatttttcaagaacagacattaatgtgataaattatgtaaaaccgtttaaaagtttattggatttttcaaacgaaattgatgaagatgaaggaaatgaagaattagtggaaaatgccggagaaagggagagaaatatgaataattctctagaaattttagggagaatggaaaacgaacagttgaatgaaaaagggcggctaa

SEQ ID NO: 79553 - DNA, 1601 bp, Heterodera glycines
  Genomic contig location: Contig_ID=SeqID_15316; Location=19..1619; Strand=-
  SCN-specific regions: Sequence locations=1-511,543-675,781-1068,1090 -1318,1340-1453,1481-1601
atgattaattatataaagttcattaattaccagttgcagaacgtcatatctaatgatgttcatgaattcctcaacttcttttcgatggtaattttaccagtgataattgactggagaagacagctaaaattgtttttacatattccctatataagaaatttatacccatgatccaagcataaaaactaatttaagactttctagcgagttttacaggtcgatcgtggggtctatcgacgtagttttttaagggctataagggaaaaatagtgcggtttcgatcggtttagaactgttcgaactgcattcgaaaaacaagtcaaaaaatcacactttattgaatgtcccatttttgaacgctttttgcatgccttaaaagtggtcaaatcaaaaaacaaatatgtttgtgcacatctacaaactcttggctttcgaatgataccagggttgttttggtccgggtccgggaagtgccctaaaaaaggagctcaagcacttttggtcgggatttcttccaaaaaagaaggaaaaggaaaagggaattaaatggcaatggggcaagtgactcggtggtcaagtggttagtgtgcctgacttttgtgctgcgatggctgagggttcgactcccattaattctgtgttttttatatattacatttttttgtttacctattctatttttaatttgtttaatctatttttatgttttttaattaattaattttttaaaataaaatatattttttacatatctaactattttataaaaaaataaaatatgcacttttggtcgggttttttccaaaaaagaatgaaagggaaaagggaattaaatgagcaggaggcaagcgacccggtagtcaggtggttaaaaaattgattgttttttattttctcttttgttttacgttatgtgttcctcctactaactatgatctttgacctcgtatcttttaccagcttaaaatcaatctctccttcttcacttttccttagtgttttcattattcatttgctgattcacagtataaattttcctaaactgacgataagaccatttttaatccgaaaaatttatattattattttggcaaacacaaaatagcttttaactataatttcttttttcagattaaagttattaccatttttatgcctagaaagagatctttaacgactcggcaagagcgtaaacaaaaacgcgaagccaattctcgtcttcggaacacattgacctcttccgaagcaggggcgtcttcgtcttccaatattgacacaagacaagaagagtccgaaactgcggttttctgtgacctggatcatgacaatttgaacaatacaccggcagaacctctgacaaaatgtgtgtaagaatttggttcgaaaaacattgacttcttccgcagtagggacgtctccgtcttccaatattgacacaagacaagaagagtccgaagttgctgttttctgtgacctggagcaggacaatttgaccacaacgccgatgacaaaaagccgaaaattggatcaaccattttcggcatcaatggctccattcgttcaagctcaaactgggcaagggcgcattgactctttatcaa

SEQ ID NO: 79554 - DNA, 478 bp, Heterodera glycines
  Genomic contig location: Contig_ID=SeqID_15316; Location=1557..2034; Strand=+
  SCN-specific regions: Sequence locations=1-71,101-112,153-412,434-478
atgaacatcattagatatgacgttctgcaactggtaattaatgaactttatataattaatcatttttcaacaaaaaatattcaaaaagcaaattttgtgtatcggaattctgttttttttaaattttaaattaaatagaataacaataaattcgaaagttagatcggtaatattttatgaacaaatttttcagttgactttcggttccatttgcgccaacatcacatttgaaggtgaaaaagcaagaatggagtggtatttggggcgtctttccaaaaatgctcaaatgatactcgacaacgtggagccttccttatgtgtcaggcgaacttgtaagatgattcttttacattaatttaaaagtagtgacaaatttgtagtgacctttatttctacttaaacaatttatcactttttaaaaaattttatatttcctaaaaacctagatcagccctattatggcacctttaaccaatta

SEQ ID NO: 79555 - DNA, 608 bp, Heterodera glycines
  Genomic contig location: Contig_ID=SeqID_15317; Location=836..1443; Strand=+
  SCN-specific regions: Sequence locations=1-185,208-542,564-608
atggaccgagggaccggtcccgatgaggatggagctgtaaggaagaagctggctgggcggttaaaacgcggaaagcgggggttgataagatccataaaagaaagggcagatgtgcctcggtagcttaatggtagagctgcccacggaaagggtgcatgagtgggttcgattcccacccgaggtttaacattttgcccatttcttattatatagaccttttggctacgccgcccggctttgctggcccggtcaatctgagcggtttccagctggacgttgagcgcattttcgatgacgagcgggcggaggacgaaagcagtgacgacgacggcggtgccgacgcggttgcacgcaccgttggcggtgcccacattggcacagaaatagggacggcacaacagcaacaattgttggatgtgggcgccatgcttgacgaggcggcggcggcacaaattggcgggctaggcgacaacaatggcagagcggacgctaccgccgccactgttcggcatcaaaaagtggccgtaatcgccgccgagaagggacaccaaaacaggaggcatcctgaacggactgatgctgtcggtgttgacaacgaggaggaggag

SEQ ID NO: 79556 - DNA, 351 bp, Heterodera glycines
  Genomic contig location: Contig_ID=SeqID_15318; Location=869..1219; Strand=+
  SCN-specific regions: Sequence locations=1-166,188-351
atggcaaatttgaaaaaaaagcttggaaaagtttgggccggtaagttggaacaaataacggatgaaattaggttgtttcccgaccttcggtaaaagaaatgttgtggaccgggcacaaatgcccgacaaatttttcaaaaatgacgtggatgaaatttgttgcaagaaagaaaaaagcaacagaaatattttcaccgaatttatttcccgtcacccgccctgcctttcccaccgtatattttccccctgaaaataaaaaaactttcaattaaaaatttttcaaaaaatcgttgaaaattttttatgagaaatcaagaagaaaaaaattgaaaattttcagcatctttttga

SEQ ID NO: 79557 - DNA, 1026 bp, Heterodera glycines
  Genomic contig location: Contig_ID=SeqID_15319; Location=809..1834; Strand=-
  SCN-specific regions: Sequence locations=1-103,130-196,218-338,360 -766,788-855,877-896,945-1026
caagcagataaacaaaaatgattcggttatgcttgtttctgatcggttgcacggccagtgttgtttattctgcgacagacagtgcttcttcagcagcggatgcagacaaaaacagcagcagcaaagattttcaaggacaaaaactgtcctggaaggcaagtgcattcattcattaagtgctgctggttcgatcggaacaaaaaggacccaaaatcttcccatttacgaaacttccttgttaattgaatcgggactaaacattgctcctccgtgtttcccagttgcggtcattttcataattaaagtgatcagggctgaagcgcagactaagtccccatgaatttttaaattgggccaggattacagtacaattgtcgttcgggaaaagcgcaatcttgtccttatttaaatatatacagaaaactgtgcaacatttttaaggacgacgatggccttgaggtgaaaatcattcggccaattgcgcaggagaagtgcgctctgaagagtcggccgggcgacacggtcaagcagtactacaaactgactgatccggagggcaaagaaattggatcaaatttcggcgaaaaaccgtaggaaccgctacagtacaccctcagagggttttcactctatttttttctcattccatgggataatgatttaccattttttgaacaggtactcgttcacgctcggcatgcaccaggtcatcgaaggcatggacaggtggtgccaattgaaaatttatgactttttcctgggaggctaataaaatgcatatttttgggataattaatcgttaacattgatccgaaggtgccattgttttgacccggaaatgccattgttttgatcaaactagacattataaattaattcgaatttcaatattttggaaaaatattttgaaataaaaatttaaatattacatttattttaaatttcgtatttgcagagcaatgaccggcatgtgcattggagaaaaacgccgtgtgaccattcctggaaagttgggcttcggcgacg

SEQ ID NO: 79558 - DNA, 715 bp, Heterodera glycines
  Genomic contig location: Contig_ID=SeqID_15320; Location=727..1441; Strand=-
  SCN-specific regions: Sequence locations=1-333,356-492,519-589,612-715
atgggcatgtcggaagaaattctcacatacaaagacgacatttgtgttttcatgggtgttggttgatccgttgcagtggtggaacaacaatgaaaaaaatttcctaaactttcaatgattgcgcgtcgttatttgtcacccccatgcacaagcatttccagtgaacagctttttagtgtggcaagatacatatatgactaccgtcggtcaagcatttccccagagacggctgaaatgttgatatttttgcataattctattcctgatgtcaatttctcatattaattttcatcagtttttggcttaaaaatatatttgaacacttatttattgttttggaaattttttgaaatttaccgcaaatttgaaatttccgggctctacccgataccatgacttaactggctcagcagatcttgtatgatggaaagttcaattttctgcaatcagtttttgccctaactttcaatttatttaaaatcttttcttttaattatgcagtgcatatttcaaaataaatttagctaatgcaaatgcttattcgtttgccacgaacaggctggatgccaaagaagcgagtgttaagaaaatttatgtaaaatttgaaccaactgcacgtctgaaatttagcgaaaagaaattccacgggcattcttttaaaataagagaacaccaaaatgaaatgcgaaggactgacccacgaaatatgaataaa

SEQ ID NO: 79559 - DNA, 1384 bp, Heterodera glycines
  Genomic contig location: Contig_ID=SeqID_15320; Location=1545..2928; Strand=-
  SCN-specific regions: Sequence locations=1-574,597-793,815-1099,1128 -1384
cccagccaatttggcaaatctatctttttaaacgaattaaagaagattcggtcgagtgcttggagtgtaagcaaaaaaacgtgagtaattttgctcttaaattgtcgaatcggagtctcaaagggctcaagatccatctgtttgccaagcacaaagacacgccgtatgcagaaaaatatttaaagctggatgaaggcaagtcaaagaaggatgatccaaaaatcactgattatacaacacggagttcgggtacaagaataaaattgtgattttaattaattaccattttagtcagattatgtgtgatggacaaggacattatcaattttattgcttgttgcaatttgccgttccaaataatcaaccacaaaactttcaaaaaaatgctccgaaatccttcggaaaatttacgcgacgaaagccattaccgaaaaaatgttctgcctaagtttacaaagttgtcaaacaccagatcaagggagaaattgcgaagtttgagcaaatttgttgtacctctgacatttggacttcggatacaacaaaagatgcctttataaggtttttatttgtttagtacaaattaaatattcaaaaatttagcttgactgttgttggtgtcaactcaaaattttcgcgcaaaaaatttacactcgcaattcaaaaatttcatggggcccacacttcggaacgcatctctgaaattttaaaagctcttctcgaaagttggaatgtaaaagaatgctattgttttgtaactgattcggcagcaaatttagttaaggttagtttatgcaacatttcatttcaaatagcattttttagaggcattggatttaattcacattgaacgaatcagctgtgccgctcatgacctcaatttatgtgtaaaggacagcttttcaaaagaaaaagacgaaatggctcaaattttcgaaaaatgtcgaaaaattgttggaactttaaaacattcggcaaaattgatggatgacttgttcaagacgaacttgggttaccgaaagctaaattgcttcaggttgctaactaccgaaagtcaagaagaatgttccattctcaaattaattaaggcaatttggtcttcaatatatatttttatgttttaaaattttcaggaacttctaaacccaccgaagaagtctctttatattattgtaaaaaaacactctccgcccgattccgctcactcgcactttggtctccacttgggaacgaggtgatctttctgtgacaattgatggcgaaatgaaaatactaaacgaagtgagggaaatgcgtaccaggctgattgaggcggttaaaaagcgttttttacaaaaagaaaataggtatatacctacttaaaatactagtaagttttataaataaa

SEQ ID NO: 79560 - DNA, 525 bp, Heterodera glycines
  Genomic contig location: Contig_ID=SeqID_15322; Location=58..582; Strand=-
  SCN-specific regions: Sequence locations=1-69,113-250,272-363,400-525
atggatgaaaaggacgtaaaagcggaggagggacaaaaagacaaaagaaagggagcaaaagcatcccttgggggaggggagggggtgcgcaacggaggagggggggggggggacaaatgtgccctttaaaaagggtgttggaccaatgccaagttttaaaaaagcaaaatttcagctgatctctgcccactcggctgtcattttcactgcaaattttttgcaaagtcgcgtcgtcatcaatgacattggcggacaattggccaaactttacgatgcgttggaagtgaaaaaggcggaagagtttgagcaaaggatggaagaattggcaagtgccggggatgagaggagaggtcagtgggccgagtggccaaaaggaaaaaccaaattcaatctttgcagggagaaaaattgccgaacttcgggaagcatttcgcgagtgggagacttttttggcacggcttgacgtcgagttggagcgggtggccgggccaaacatccagacggaactcggcgaaacgggcaggg

SEQ ID NO: 79561 - DNA, 3008 bp, Heterodera glycines
  Genomic contig location: Contig_ID=SeqID_15323; Location=1..3008; Strand=-
  SCN-specific regions: Sequence locations=1-149,183-308,359-371,400 -418,449-473,509-522,655-1018,1044-1081,1103-1245,1272-1290,1367 -1398,1420-1571,1601-1737,1760-1987,2009-2051,2073-2319,2344 -2345,2368-2385,2530-2551,...
  SCN-specific regions: Sequence locations=...2576-2596,2622-2895,2932 -3008
  Gene Ontology: Cellular component=extracellular space
tgtcaatcagttttactagaatatttttgtttatttatcatttcattctgtgttttttttgttttgtttagctgttttcccctgtttttcccgtcgactttctttctccccaatgtgattaattccatttatagacacaataaaaaagcattattattttatcatttatttattttatttttgacaattttattgctgccttttcactcctcttttttgtgcttcatgtgctgatgatatttgtattagttaatgtgtttatttggcccaacaaattaacattctcagctatttatttcaacgctcgcaaaatattatattcaataaaataaaaacaatttttgttatttttatttttgcctccctttccctaaaattttgatttaattaatttattttcattgagttaaacggaaactttaaattatttatttttagatttaaaaatggaaagaatttcactttttgtcaatattgccggcattgtgttcatctttttctgtattggaaggtgatagcgcctataatttaatattaaaaaaacagtaaaactttttttaatggaattaaatatctaaaataattatttttatttatttaataattattttttcttaattaataaattattttgatttaaaaaattaatttaaagtattgtttccattttagtgatgccgtttcaatttcggactgtgccgaacggcgctttcccggctccgaatcatttgtctgtgtgtgcaatcggacattctgcgacctgccaattgggccccatcggctgggcaaaaatgacaacaatgccattgtgtacatttcggacccggccaaattccgtctccatcaacagcaagtgccaattgaggtggaatacagtgaccaaaatcgtcggaaggataagccgcagcgcatttgctcatcggatgacgaaggtatggaaaaaccagcacattttggcagtaataattcagacctggcaaatgccaattaaaagaaattgattaagcgaaccataaacaattaattattatttttttaaaataccttgttgttccgttttgcttacttaattttaacataaaatcatcaatttttctaaaatataagacattttaccggtaatgggaagcaggcatgaaaaacgaataaaaaattgaaaaaaaatgtaagaaatccgctttagcgaattcataagtcccaacgacccttagaaaagtaaataatgatgaagctgttttagctccttataaaatgcaatttttttcaaatttcgaagaaaaaaaatgttggattattttaaatatttttaaaattaaaatgctaaaaaaatttttttaaataagttacttattaataatttttatttcctcaaatgaaaaaaaaaatccaaaaaccatcattatttttcagatgaagggatcgaaattgttgtggatgcctcaaaagagtaccaaacagttcttggctttggcggtgcgttcactgacgcggctggcgtcaatttgaacgcgttgagcaacaccacgcgtgcaacactgttgcgtgcctattttgacaaggacattggtgggtttgtcacaatagaaaccttaaatttaaattggaatttttcataaaattagtgtaattagatttaaactattttgctggttattcttatcagcattcaaaaatatgagaattaatatttcagcgacattttttacgcttttatggaagacataataaaaaaaatagaaaataaaatagaggttagaacggcataaaaattccgacttactaatatttccgaattaaaaatacccaactccatggtaaaaacactgacaggatgtttactgctaagcctaataaaaaaaatttcccaaaaattcacactttaaaatttgttcaaaggcattaagtacacggttggccgtgttgtgatgggtgcttgtgacttctccgtgcgcgaatattcttactgcgacacgccggacgactttgagttgaagacatttgcattaccaaaggaagacacggaatggaaggtattgtaattaaaactattttgttaattaattaaattgattatcaaattgattttgaagatccccaacattcaacaagccattgaaatgagtggtgatcagttacgcttgttctccagtccttggtccgcgcctggttggatgaaaacgaacggacgaatggtcggcgctggacaaatcaagttggtctatattagttacttgaaccgtaattctaaaatttagtatagtaaaagaaattcgttttttttttaaattttgaatctaaattgaaaatctctaattctccttattggaaataaaaaattttttcaatcaaagaaaatgtgaaatattaagtaaagaaagaaagagctaaaatatgattaaacaatttatacaataaattaatttccttaatttaagaaataatttttatttttcccaaaataaaaaatataatttcaattttttgaaaaattttttatttgtgttaatttttgcttttattaatttttaagactgaattttacaaatcaatctaaatgacatttttggtaaaagatcatcacaaagccaaggaaatgttttatatatataaaaaaaaattttcaggggcgaattgcatggtccatactatcgcgcatttgcaaattactttagacggtaacacttgaaaaaacaattgaaaacctttaatttttttaaattttagatttttcgaggaatacaaatcccataacatcaatttttggggactgaccttgaccaatgagcctttgcatggtgcaaagcctggaatggacttgaactcgaccatgcaacggtaaaaatgagcatttgaaatcattaaggggataaatgataattaaaaattggttgaaacaattaaaataattaattaattaaaaattgatttattgaaattgtagattatgggcaaatgaagtacggccccgtactgaaaaaatatgaagtgtcaaaaaattgaccgcaggc

SEQ ID NO: 79562 - DNA, 1263 bp, Heterodera glycines
  Genomic contig location: Contig_ID=SeqID_15325; Location=293..1555; Strand=+
  SCN-specific regions: Sequence locations=1-110,132-138,160-266,288 -648,670-903,946-1093,1117-1137,1161-1172,1208-1263
atggtggcatcgtcggaggaggaaggtgcggaccaaactgacactctttcggcatttggagacgacgaaatgctcatgacagagcttctggacgaagtgccaccctttgacctaattaaccaaggggtaaaaatgcataaagtgatcaaaaattaaattagaaaagtcattaagataggaatattttcatttcctcagttgaaataggaacccaaataaaaaaatgacattaaaattttccttttccataaaatttgggtacgatttgaagtgatcattttgaaaaacctaaaaccgacggcgccgaaatttttgaaattttaaaacgcttatgggagggtcataataagataaaaatggaaataatataatgctgagaaacaattgttttgaagattgttgacaccatacacctcgcaattatggctcgccatggagttttgggcggcaacataagaacagttgacgtgagagtagttgacggacacggcaattgcatctacactccgccacctgcagcgcatgtgccgcaactgttggagcaattcatccaagacgtgaataatgtgattgggcgagcttcgacaggactgatggaggcacgcgttgttgccgcgtgggcgcattaccaattggtaattggggtattacctttaccatttaagacaaaaatttgtttaagtttgcaatatttttggccaattaaaagtttttcattttatttatcaattttgaatcagacttttgtattattaaggctatgctttaattggggttttcgctttgaaatttttgattgttttaccctattttcccactttttggccttttgaaaattaattgaaaaaaagaattattccaatcttaatgatcaaacgcacgcaagtttcctaaaaatgaatctaaaattaaaaaaatgaaatttttctacataaatattattttcggaaaatgaaaaaaataatgcatccacaaaataattttttgatacgtcaaatttttcataccttgttcaaaaaataagtcaattcgtcagtggaaattcgtcagaaaatttttttgagcaatgttcaaaaattcttgcgaaaatgattgttaaatgtaataaatataatttttatagattcttatcatttctagttactttatacttcaattaattgactaaattctttaaaaagattatttcataattattataaaatatcacaaaatattaatcaacatttttagcgacttaaattaattatcacatggttttaa

SEQ ID NO: 79563 - DNA, 481 bp, Heterodera glycines
  Genomic contig location: Contig_ID=SeqID_15325; Location=3087..3567; Strand=+
  SCN-specific regions: Sequence locations=1-13,35-245,305-481
atgcactggtaagaattgttatgtttatcattttcaaaaaaaattattttttaaaggaatattgaaaaatttgacatatcaaaaaatggggtaaacccaactcatctaaacccaactcacatgcacaaaaaatgccacggccaagaccgcataagtagaaaggccacgacaattactcgttgtgttatggatgagttgggtttggatgagttaggggtgactcaaaaaaatcattttgtggaatcattatttttttttctaaaataatatttatgtataaaaaattcattttttaaattttaatgttcatttttaggaaacttgctgagtttatcggggaagggaccagaaaagtcgggacctggaccaagttacgacagggaccgggaccgcgagaaaaactggtgccgagaccaaccaggattttttccaagaggaaaattttttgaaaaaattctaaaattttaatctaaattcatta

SEQ ID NO: 79564 - DNA, 2524 bp, Heterodera glycines
  Genomic contig location: Contig_ID=SeqID_2405; Location=302..2825; Strand=+
  SCN-specific regions: Sequence locations=1-321,343-524,547-602,633 -1345,1367-1518,1540-1911,1943-2098,2120-2125,2149-2157,2265-2524
  Gene Ontology: Mol. function=ubiquitin-protein ligase activity; Cellular component=ubiquitin ligase complex; Biological process =protein modification
tttattctcgttgtctgatcacggaggaatggcgtctgaacagtttggcaaatgatcgcttcattgagtactgttgtgagattttgcgctgtgaaatgccaccaaaatgtttggcactcattgacgcggtcaaaacggaagcactcaaaacgttggccagtgtcgtgtttttggaaaaggacaaaaagtgtgtatttctattgccattagtgtactatttcgcatcggcggattgttttcccaccatgaaaaaaatatagaagaaactaaatttaaatttttaaattcgatatttttcgactttttaaattcataaatcgtctccaagaaaagttgaccaaatttcatcccgatatcgacaattttcacccgtcctccctttttagaattcaaatgattgttgaccagcttgaactgcgcacataccatggcttcctgccatcccaaatccgcagttgcattgacagtttgaaggcaggccgtgtggacggcagcggtggcggtgactgttcaattgcatttgtcacttcactgttttcattggtctaccatattgctggctttgaatacggtaaactgttgtatacccgaaaatttaatggaaaaaatttaaaaaaaaaattattttttttgttgttgttgtttaggcggagatgcgctcaatcgctcttcaatgacggctgtactgcttgatgtcgtcaaaaatttctcacttcctgaacagaacatcagctttgtgacccgttcggtacgcatcattgacaatttgacgggcatggacatcaccgagttcaacgcccgaagtggcaccgatgcggtcatcaaacgactgaatgtaagttcaacctttttctccataatccgccgtcgccacccccctctctccccgaattttttttttactaatttttccaaaaatcactaaaaaactaaaatatgccgaagttccattttttccacagcgcttggtgcctttacactggcaaaaaaacttagttacccacattttgttcctttttttagcatgaggtcaacaagtgcaaggagcacattcaaattcgtcagtcttctcaatcccccggcccgttgctttgcaaccagcaacggtcggcgctggtcaagtcgttgctcaactttctgaagcgtgcagtgggcgacgttcatttggcgggccaaatgcgccgaatcatggacaccgacttgcccacgtcgttgatccatgtgtttgagcatccccaatattatgggccgtcgcttttgaattgtgccatctcattggcaacaaattttattttccaagaggtaaaattactattgaaaacttttcaaatggggttgggccaggaaattagtttattaattttttcatggtttggccaaataccgagtttttggccataatatttaataatcaccttgataacagaaggtcattttttatgatacaaccaatttttacgaaaaatgcacattttccgaatttctaaagttaaaaaaagagttaccaataatttatttagataattttcatgcgatttcctacctaattgtttatttgtttagccggctcaattgacaactttgcaaaacaaggggctgaccatggcaataattggactgattttcaatgaaaaagtacgttttttccccgtgttcatgaaatacaacctccccccttctttttttcatttttctctgctttttagttcccaatttcacgtgaattggtctgtgcattgcccaacgtttgctcggcgctgtgcttgaacgagcgtggcctcaacgagttgaaattgttcaacgaaaagaaaccattggagaaaatattccgcatcgttttttcaaacaaattcctccagtcgatgaggaagagaaaaattgaaataagtgagtgatggactgacaaattgcaattaaattaaaaaaaaaaatttttttttttgaatatcaatctgacggcgtaaatttttgtttagttgagacggcacatgtgcttggcacctcatttgatgagctgatccgacaccatccatcgttgcgcaaagatttgatgggcacattggccggggtgagtaatttaaaatggcctgttttgttgaaaattataataattttttaagaaaagtttgtttgattttttgttatgtgggtagcatcttaataacaaaataatttaaataggttttttagaattttaaactaaaaaaggtttaaaattataattaaataaagaaattcttatatattaaaaaaactaattttatctttccaaattatttttaaaggttattcgttttttaattatattcctaaatttatttatccagtatatttcgcaatttcaatcattttgtcatattatcttacaataattaacagatttgtgacgattggttgtcctttgagcaaacgtgtgagaaggagggcaaacagtgtgccatttcatgggctgttggcaaggctgttgttgaggatgagtcggcactgttgttgccgctgggcgacttttccacaatgatgggca

SEQ ID NO: 79565 - DNA, 1779 bp, Heterodera glycines
  Genomic contig location: Contig_ID=SeqID_2406; Location=647..2425; Strand=+
  SCN-specific regions: Sequence locations=1-99,147-471,493-999,1021 -1065,1087-1779
atgcgttcttacatgcttaaatattttgcaactgatcccaacgcgtgcgccttcatttatgccctttttgatgcgtacaaattaattggaacagaccgattggtgaattttttaaacaccttgaatttgaatatttatcaaaaacaaatattttttgccgcttattaaaatttttgacaatttgaaaaataatattcattttgtttcttaacatccgcacaattttgcttcgcatttgccaggtggtcagttgcaacgcggaacagcagcaggcgacaacttcacaaattgcggaagacacggccaaagtgcgtgaactgttgattgatgatgactcatcatcttcatcaaaccaacatggtgggacaatgccagcaataacaaccgctgcagccggcacagtgccaatgccacaattgatggaaatggacaatggtgccggcacactttatttcggtccaccacaacatcaacaccaaccacaacagcagccccatcggtcggttgattttgccaccaccgctgccaacattttgcggagcaacagcgcaggcagtgccggccgtggtggtctcggtgttggcattggtgtcggtgctggtggcgccattaacatttcaattcttggtggacctactgtcatgatgagaggagcatcgtactcaacaaattctggcactttgtccgcgtccatcagcgatggcattgtggggtcagcaggagggggaagcggtggtggtgggcgcattgctgagcggtccacccattcgattgccattcggacgttgaagcaaatcacggaactgatcacctacattggcaaagcgttttgcaccgtgtcgttgccccgtgtgcgacaacgtgccaacatactaccacaaatggaccaagccacggttcggcaccatgcgcaaaaagtcaccaaaattgtgttcaccggcctgaaacgactgctggaaatggacatgaacaccgataatattgtctacgcatcttccgcctcctcctcctctttgaacaccacgacaatgaacacaattggcctaaggcaaatttggcattttgtttaaaaataattttaaaaatgtttatcattgcatttacagtgcttcttacattcaccattcattgtcaacactgaaaaaattgctggtcgatgatacgcataatttgtcgctgttgttaccatatttttacaagaccgaatgccaccaagccttttttgccctgggcgactatctacggcagaatgttgacaaatgtaattgtttttgccattgtttttttttggtttcaatgacactataattttgtattccccggagaaaaaaaatttaaaaatgcatgttttatagttttttcaattttttagttttttcttaaaaaagttgatcaatttttgaaaaatccctctcggtggaactgttcttgcttatggtctatgccttttgtttcagttgagttgaacacatgcatccaagtttggcttgggatcacccaacgtttggttgctgtccaactgcaagacatgaacacgggcaagagcaacaacgggccacagcagcagcaaaccaagcagcagccgactgttgttgttgaaggatttgagccgaaaaattaccttgccaccttccagaaggcatagttttttaatgcttacaattaatgcaccaattgtttcatcaaaatttttttttcaaaattgctcaaatatcaacaaaaaaaaaactgagttagatggtaccataatcattcgaattcggtcttttgaaactgaaa

SEQ ID NO: 79566 - DNA, 1545 bp, Heterodera glycines
  Genomic contig location: Contig_ID=SeqID_2406; Location=2846..4390; Strand=+
  SCN-specific regions: Sequence locations=1-483,506-588,610-698,736 -994,1027-1257,1281-1404,1432-1545
atgcccccgttggttggccaccgggaggaagacgcattcattttgttggaacgcgtgttgtgcgccatgaaagtgctcatccaaggcgaaatggaactgttggagttcaccgaaggcaaggcggagcagtcgcaggaaatcccagtcagcgaaattgacccggcaaaggtgagaaattttggggtgtatgtacatcggcggaagggggttatagcaatacgcgctagcttaatgggtcctcaattttgggaagaaaagtgtgctaaaaaggctggaaaaaaaatttgtgggctggtttttgaatttttaaaatggcaatattaaataattggcacatggttggctcggggttttccgaaattctggtccagatctccaatttttgaaaggatttctcgaaatcgggatgcgaaaaatccggagattgaaatcccgacaatcctatcccctacctgattcccaatctcgaattctggtcccaattttttaaaaattctcgtctctattgtaaaccataccacttatggacgaattcgttcggagaaccagctgccattattcgtcttgcattttagattttcatatgcttccaaatttgaataaaaatgcatttttttagattgaacaacttgttgaggttggttcgtttgttgtttaattttcttccaaatattatttatattttccattgaatgaatgaatggttgttgaaatacagtttttgtccctgttttttagatgggtttttcacaaagtgacgcggttgatgcactcatgcaatattccagcgttcacgaagcagccggtaaaaatttatttatccaataattgtgaatgtgtaatgcgcccaaaatttccaacatttaatttaccaaaattccagaatacattgtgtccatgctggagcgtgtgaccgttccccccaccgtttcacgaccacctgcagcagctgctgtacaagaacacccggccatcactgtgtcatcatcagcaaccgccgcagctcctcctcctccagcaacaactgttgcagcagcgacaactgtggcggcaaatttggttgccgctgcgaccgccgcagcggtctccgctgaaccaaatggaactggtggtagtgctggtactgctagctacgacaacgcactgcaacatcaacaaccgcaacaagtaggcgatgctgctagtggtggttcaacaacaacaaatgcaacaaccccgatggaacaggagcaaccactgcaacaacgagagcgcgaccagcagcaacagttgcagcagctgaccgcatcgctcgctgatgttcatcaacgcaaccaggaggctgccgaggcggtggaacaactgttgcaagcgcttcggggtgagggcgtacaccaccggggagagatgagcggcacattgccaccacctccagcagcggcagcaacagcgatggaacaggacggaaaatcgtttgacgagttgaagccgttgaagcgagaggaattccaggcaattcgaattgatttttgtgaaataactaatggtcgggtcataacataaaaa

SEQ ID NO: 79567 - DNA, 969 bp, Heterodera glycines
  Genomic contig location: Contig_ID=SeqID_2407; Location=1..969; Strand=+
  SCN-specific regions: Sequence locations=1-47,69-251,273-649,685 -780,802-969
gaaatgctcattgaacgggatgcggagccgaagacggcaggccaaaaaggttgcttttaattgtggatgtagggagggaaatcccccggccaaatcggggaagaatccgaaaatcttttttggcaaaaaattttagccattatcatttgttcaaaaatgtttctgcgtcggagagataaaagctggaaatggttgtcgtttgcgtcaagaaaatacaatttttgctattcctgaggctcaaaattttcttcaaaaaaaaaaaatttttttaacccccccccccctcccccatagtaaaacgtgcggtggagacaaccttctacatttcgtttggcctcatctcctgcgccgttctgggcgtgatgacctacctcgtgttcaaggagttcttcgccttcaacacgccccagggcgtttaccgcgatgcggtgaaaagggtgaaggcggacgagcgctgtcgggaaatgttcggcaagcgaatcatgacatttggcgaagagtcgggccggggacggcgacggcacattctccacaacaaatatgtcaaggacgggcaggagcggttgagcgtgatgttccatgttaaggtcggagggtcaacagctcatttcgaccaccaagaaaataatttatagagggtttttcaaagaaaattttaaaaatctgaaaaaaataaaaatatttccaataaatatcttttcaaagaaatttgaaaaataaaaaatacagagcctcaaaatcaggagacaaacccctggtccatactttttcaaagttttgtctctaaaaaataacaaacaacattaaatgccatgaaaatatcaataatgcataattaagggtgacgcgggcattgggaaaacgtacgcggagatttacaagggcgaggacggcaaatgggactatcgctttgtactggtagagagtgacgggtttccgaagaaagccattttcttaattgacaacagg

SEQ ID NO: 79568 - DNA, 1119 bp, Heterodera glycines
  Genomic contig location: Contig_ID=SeqID_2408; Location=909..2027; Strand=-
  SCN-specific regions: Sequence locations=1-118,142-163,185-830,852 -931,955-1119
  Gene Ontology: Mol. function=FK506 binding; Cellular component =nucleus; Biological process=mRNA splicing
atgagcgaatgggagcgtttgtccgagaaattgcgccacccggaaaatccaattgtcttttttgtgggtttttcattttgcctccacttttttcattccaatttcgtcaggacattgcggcaggtggagcacccattggttagaaatgcaaatgcctacgcaaaaataaaacattttttaacgtcacaggtcgtattacgatggaattgtttggggatgtgacgccaaagacggcggaaaactttcgacagctttgcaccggcgaattgtaataaaataaacaaattgccaataaatatgtaaatcaatttaaaaatgcgtaataaaaaatgttttagaaaaaaggacggcgttccaattggctataagaattcgcaattccaccgggttatcaaagtataaaatttttttaaatgttttcgcaataataaacttaaaaattttaggattttatggtgcagggaggtgattttgtcaatgtaaaaagagacgtggcgaaaagtttttccaaccactctgtttttttttcagggtgatggaaccggaatgacgtcaatttatgggccaaaatttgcggacgaaaattttgaagtaaaacattccgagcctggaattctttcaatggtgtgcaaaatttttccaacaaaaattattgaaaatttgtttttttaaggctaatgctggccctgacacaaatggtataaaaaaataatattgctttcttggtaacacaatttgcttcctcaatttttaggctgccaatttttcatcacatgtaacaagtgcgattttcttgatgccaaacatgtcgtttttggtccgtccgttcattgttttacaattaatggggctaggtccgggtttccctggttttcggcactcttttgggaacgaaagtcctaaaaccccatttacaaataaacaatatttgtttttgaatttgaatttgtttcaggacgtgttcttgacgggctgcttactgtgcgaaaaatagaaaatgtattcgaaattcattactttctatcagtcacatttaccatttttttttcattccaggtgcccaccgttcagaacaacaaaccgaaaataccaattgtcattgaacagtgcggcgaatta

SEQ ID NO: 79569 - DNA, 1996 bp, Heterodera glycines
  Genomic contig location: Contig_ID=SeqID_15328; Location=38..2033; Strand=-
  SCN-specific regions: Sequence locations=1-44,66-599,623-1066,1092 -1650,1672-1996
atggcttcaataaatgatttagattatgttcgagattatgattatgtttatgatttagattttgttcaagttgaagaatgtgttgagatcatagaccaagaaaatgaaatagaaattagaaactatgctgtgtttgaggagcacagttatgctaagagaccaagatttgtggatgaaggttccagccaggcatctctgagcttagatattgccattgcaggaccatcacgtatgagtgatagtcaatttgaagaaagaagaagtaatgagtatttgaaaagaaaaagagaacgcgaaagattgagaagagcaaacgagtcacaagaccaaagaattatgcgcttagaacagatgagaaatagaaataatagtcaaagatctgaagaaagtgtgttagagcgacagctacgcttagaacagatgagaattagaaatagcaatataatagcaaatgaaaatgtgatggaaaaacagttgcgcttagaacagaaaagaattagacagagagctattcgacaaggagttattaatgtttatgcagcagggtctaacgagaatgctcatgaacatagccttagcccaatgaatatgagatgtgatttttgtgatgctctgcattttgcagaagagaaagtgcatggtcgcggcaattccttcaaggattgctgtcactatggtaaagtttttgtcccagaaattcctgaacaggattttccggaggaattgagagatttgttcatgaaatttgatgcaagacatgaaaatttttttgagaatattagacatttgaatagcagcgtttcatttgcttcaatgaatccgcttagatatagatacccgaaccgaggaccgtattgctttcgcatttatggtcaagtttatcatagaatgaatttggctttgaacccagaaaatggcgatgaacctgcttatgggcaaattttcatcgtagatactgagcatgcagtgagagcaatgagacatgctaatgtggctattgatccccaattgctgaggactgcttatgaagttattagaaatgtgaatccatttgctgaagcttatgtgatgatgaaagaggaagaaaatgatgaagctgagagagcgagaaatgagaacagagagccaaccgagattaaacttttgtttgagaccggaaggcaattggaccgacgtttggggtacaatgtaccaagagtaaatgaagttgctgcagtttatgtacctggagctgacggtgaagtacctaatgccaagattgttgtgagagaacgtggaaaggaattgaagattttgaattgtactaattcaatggtaactccaatgacttacccgctgttttatccgcgtggtacgcttggctggcaccctgaaatgaagcatagaaatagtaacagaagagtaacgaggttgcagtatgtgtgttacacattagcaattagagaaagagagtttaaccctattttgtacggtggaaaactctttcaacagtattgtgttgatgaatatgttaagattgaaggagatagaatgaactggataaaaagtaatcagaaaaagattttggctgatgcatataagaatgtagacaatatgttaatgagacgagcacaagaaagaggcttgccactgggaaggaaggtcattcttcctccaagtgtgacaaacagccctagatatgttgagaagcatttccaagatgcaatggccgtcgttagacggtttggtaaacctgatatgtttttgaccatgacatgcaacccgcaatggggagagatttcagacaatttgtttcatgaacagacatcaagtgatagacctgatttggttgtcagagtttttaatttaaaagttaaagctattatgaatgagataagcaagaaaaagatctttggtgaagtgattgcatggatgtacccggtagagaaccaaggaaggggactaccgcacattcatttgcttttgacattgacagaacaagacaaattgataaatg

SEQ ID NO: 79570 - DNA, 736 bp, Heterodera glycines
  Genomic contig location: Contig_ID=SeqID_15328; Location=2183..2918; Strand=-
  SCN-specific regions: Sequence locations=1-508,531-736
atgagaaccatcatattgaagaaatgctgttggcttacaattggttgtgatttcatctctgaagtgttgaacctgtcggtcggccactcaactttttgctcactttcaagaaattcactacttcaactttggcggccccttttgtaagtgggttgggaagagttgtggtaaatttgccaaatagccaaatatctgataaaacatttgtgttcgttatatgaatttagtgtgacacaattatgtgtgtcatgtttttgataaacattagtgttcgttatttgagtttagtgtgacacaattatgtgtgtcatgtctttgataaaacattagtgttcgttatttgagtttagtgtgacacaattatgtgtgtcatgtctttgataaaacattagtgttcgttatttgagtttagtgtgacacaattatgtgtgtcatgtctttgataaaacattagtgttcgttatttgagtttagtgtgacacaattatgtgtgtcatgtttttgataaaacattagtgtttgttctatgactttagtgcgacacaattatgtgtgtcatgtttttgataagacattagtgtttgttctgtgacttaagtatgagacactaaagtctggcatgacattgataaaacattagtgtttgttttgtgacttaatgtgcttctcaaatttcagaaacccacacaagcgtgaagcaatgaaacatgcacggtctcatcattggactttttaa

SEQ ID NO: 79571 - DNA, 80 bp, Heterodera glycines
  Genomic contig location: Contig_ID=SeqID_15329; Location=3504..3583; Strand=+
  SCN-specific regions: Sequence locations=1-80
cttacaagggaacattccgagctgtgagtgggaaaatgcatataagctatataccattggatagagcggggtcgacttgt

SEQ ID NO: 79572 - DNA, 3280 bp, Heterodera glycines
  Genomic contig location: Contig_ID=SeqID_15330; Location=572..3851; Strand=+
  SCN-specific regions: Sequence locations=1-217,239-434,457-504,526 -625,647-1039,1129-1167,1189-1476,1498-1952,2030-2085,2112-2882,2906 -3021,3043-3160,3269-3280
  Gene Ontology: Mol. function=chaperone activity; Cellular component =nucleolus; Biological process=protein folding
atgactgtcatcgtatttctgctatgtctcatagagccaatatgccaacttgcattagctgatctccaaggaagtgtttccagaatgggggttcgtgaaaatggcaatttgactaaaaagaaagtgcttcataaagaaaataatattcctgcacttaaaaatgcttcgcttacaagttctaagcatgaggatgatgacttactgagtgaggcactgattaatcttcataaattgaatggtaaccattttttaaaattatttttctccacgattttttagaacaaacacaaaatggaagctggtcagaaaattcggagtaagcattttcgtttaaagtttcattgtttgggataagtttaaagtttcacggaagttgatgggagttttttgagcttttgcaatacaaatggagaaaaaaaggaatttagaaacacttttgttttggtcatttttgagaataagactaaaagtagctttgaaaaaacggaagaaaaatgtcctttaaaggcattttcagggaaaatgaaacttttattcagtaactttttggatcggtataacgtgaatattctttaagaagccgggacctgtggagaatacaagtaccaagtttaggtagacatgaattttcaattgtccacatagttacatgcattatcgtatctttaattcccaccagcatattggcatttgtctttttggtataaatcaaatatagcatagaattgcgatttcatattttgttatttgttgggtcggaattccggtttttgataaaaatcagaattttcacaaatcttttttacattttttaccaatttaaaatgatttatttttatagggtcctttttatgtcattttgactcccaaatgaaactcaaaagcataaaattggtcatttctgggcaaaatttattaataaaatgcaaccaaaaattttcctggccgcgcctacgccgcaaaaaagtgttgtaaataatccctttttcaaaaatgtaataaatgtaaatggacatgaaaaaagtttctgatgaaaatcatttaatattttttaaatattataaaacatttttaaatcatatttatttttaattttttgttaagaatttaaaatttattaattaatttcttcaaaaatttccgacttccgctttccgatttttggggttggaattccgatttccaaaaattttttgggcctcgaaatttcatttccgaaagagttttgacctcagaatgccacaccttgtacaatctgtaacatatggacctttctatttttcccaccgttgcctattaccaacgctggttcccaacttaatgaattttaaatattttatacggcgctgtttgacccttttctacataagtgcaataaatgagtctgagatttgttcaaaattattatgcaagttttttaagtgaaacattgacaacgctgtattcattagtggaaattgaaactaaactgaccaaattcgatgaaaaagctgcaaagactatccaagagctcaataagaaccttatgacgaactccgaaaatgtgatgataggcgaaagtcaaagcttaaaagaactgagtgaagaattgagcaaaactattgacacgatgaaaaataaggaggacaaggcagcaaaagttagcattgatggagtaaacggcactctggtacaaatattgcaaaaggcaaatgtgcacaaaaagtcaataaggttgcaaatatatgtgcaagtgatgaaactgctaaatctaattcacgagagaatcgagcaaagcccggaaaaagacacaatcggaaaagtcatcggaaagagtacagtcgcaaacagcgtgaagactgtaatgccaagtcaattagtgggattaataagggaactttggatacattttttgcaaagaatccgtaaacccgaccaaaataaagctactcaaactaacccaaaggtaatacttataatattttaataaatttaaaatatatacaataaattattattcgaaaattacaattattttagataaaaaaatcaattcagattaaacaaaatgaagtgatcccaaaaaaacaaaagcatgctttgtcaaataaacaaaaacaagagacacaaaagcatctagtttcgcttggcgataaattccgacgacgacgacgttccccactgcccatcgcgataattcgctctctatcattagcctttgctatactttgtatcactgtaattgccttggaacatcataacccatgggccgttgttgtaattgcgtttcttgcactatattcccaacaggaaaatactcgtaactttcccacacaaattgccgatggaattagcaatatcgtgaatcgaatttgtggtacacgtcacacagagggaggtccctgtctcaacggacacaggaacaattacggacacgaatcacatagaaacatctcacaaacagatgtaccgcaagcctattcttgtggcaattacgtacaacacgattggcacaaccttgccccacaagcaaatgagctatgtgcgacggtgcgaaatgccaacccgagtgccagcggtaacccagctaggcgaagcagcaatgataacaacggcagagctgcggctggctcagttcggcagcgattaattacccctgatttaacgcttgaaatcaactaccgggcgccagccaatcggaacaaaaataaaaacaacagtcgcccgggtgttgagccttcccgaagtcgacggcctaatcggttcgctactaattcactggctagcagtgggaacaatcagcagaatgaaaggccgccatcaagaatatcagaaggaagtggcgaggagacggatgacaacaacagcatacgtagtagtaaatgtactgcttgcaagtttgaaaatagcagcagttcagaaaacaacagtcggcctggtcgtgaatcttcccgaagccaatggcctaatcgggtcgctactaattcaatggctagcagtggaaacaatcagcagaatgaaaggccgccatcaagaatatcagaaggaagtggcaaggagaaggatgacaacaacagcatacgtagtaaatgtactgcctgcaagttggaaaatatcagaagcagtagcagttcatcagatatgagaaatgcaaaagccgctgagaaaaatgatgattccaatgatcatgatgatgacaaaggagaaaatgatgaggatgatgacataaaagacagtgatgatgatgatgatgatgctaatgatgatgatgatgaatgtgataatgatgtcaaaaatctca

SEQ ID NO: 79573 - DNA, 1440 bp, Heterodera glycines
  Genomic contig location: Contig_ID=SeqID_15331; Location=1298..2737; Strand=+
  SCN-specific regions: Sequence locations=1-524,548-593,616-1440
atgaccccgcaatatccgcggtgcaactgtctgcaagcaaatgacgcggcgcatcacggtgggctcatgacgaaaatggccgtacgaaaatggcccgtacgaaaacggccgtacgaaaatggccgtacgaaaacggccgtacgaaaacggccgtacgaaaatggcccgtacgaaaacggccgtacgaaaatggccgtacgaaaacggccgtacgaaaatggccgtacgaaaacggccgtacgaaaacggccgtacgaaaatggccgtacgaaaacggccgtacgaaaacggccgtacgaaaatggccgtacgaaaacggccgtacgaaaacggccgtacgaaaatggccgtacgaaaacggcccggcccctcaaattcttcccaaatgcacaaaaaattttcaaaattttctttttagtatttttttgaaacttttcatgacttttttaactttaaaacagggtggccaagtgtgcttatttctaagatttgtgcttattttgaggggtcggatcttagaaagccaaaatgtgcttatttctaagatttgtgcttatttcagcattacgtgcttattttgtgcttatttttgggtttgaaaataaaaatgaaaattttgaatgacagttttgacttatagttttttattgaagcgaatacttgaattaattcgatttttgaaaaaaaaattacatttttattttaatggactgacacgcggaatttgttgcaagtcgaaacagtcaaggcgttggtccaaaccaaagccaattttgatctttcttgcccacaaatgtaccaaatgctcatttccaatcacaaattgttggagaaaatcggcggatggggaaaatacctttgataatcaatttcaattgtttttacgctaataaaatattgttttaagtcgatttttcatggtttttttgcgtttccctcgcgctactattagttttagaaaaaatcttatttttggggtccaaatcttagttttagcctcgtttgtccttattttgaaaaaaaacttggccaccctgtggaaaaagccttttttgtattttttattataactcaagtcctaaactgctgatttcaaccaaaatgcgaaaactaatcattttctattgattctaagtgttcaaagtgattttgtagcatataaaccaaaatttttagaattagtgaatttgatgttttttcatgtgttagagacatgaaaatagtacgccaaaatgagaggaaaagaaatgcaaaattttcatcatcccttaactttaaaataggatagaaattcattaaaaccttatagaacattcgatgcagaatttttttcataggaaaaagcgacatgctaacctggtggtatgtccgaaaaatacgggcccgggcgggctctaattttcccttctaaatttattcgttttccttaaaaacagctta

SEQ ID NO: 79574 - DNA, 2246 bp, Heterodera glycines
  Genomic contig location: Contig_ID=SeqID_15332; Location=602..2847; Strand=-
  SCN-specific regions: Sequence locations=1-321,343-1453,1475 -1706,1728-1926,1952-2173,2195-2246
atggatgccaaaagcaaatggcctgaagtggtcagaatgcgaacgacaacggcattggcaacgatcgaagcgctaagaattgtcttcacagcgcatggacttcccgagcaaattgtatccgataacggaccgcaatttagctcaaaagaattcggtgattattgtcaatcactcggaattatccatacaacgattgcgccatacaaccccaagtcaaatggagctgctgaaagatttgttcaaaccttcaagcaaggcatgaacaagctcaaaaaagaggggatgaggcaagaaattgcattgtctcaatttctcctgaaataccgtgtcacgccgcacgcagcaacggaattagcgccttcggaaatcctcttcggccgcaggcttcgaactttgttggatttagtaaaacaaacagcggcgaatgattttgaagcggccaaaatgcaaaaaagttcctacacggaacgaatgaaaaggaatttcgaccgtgagacaaatgcgcgaaaaaatttcaaggtgaaccaaagagtttacgcgagaaattatcgcgacggatcaaaatggatccaaggacaaatcacccgacaaattggcacggcaatgttcctcgttcgaacggcgagaggaatttggaagagacactttgatcagttgaaagagaattggaccgaagagccttcggacaatccgagttcagaaagtgcagacaattcggactcggaagacgaagtgccgatcgaagcgatggacgacgagcagcagctgccaccgccggaagaacagccgcaaccggagcagccacaacagcaggccaacgctgaacctcgccgttcaacgcggaagcgcaagaagacgcagatcttcgactcagtcacaacaaaagtaaagcgaataatttgcgctgctttgaaatacaatgtcattcaggtcagtggcgatcacgggcggggattcacaaaaatcaccatttcgttggcccatgcattgcgcccaaattccccttccaacaattttgttgctgctgtttttcccgcaaaagattcacgaaagaatttgaagaatttctgcggatcgttgtgggaacaaattgagcacctcaatgaaattgacgggcgctttttgattttcggaaaattttccaggtttcttggcggagatctgtgttttctatgggcggttggccattgcggttcggcaatgacagcattcccatcccctgtgtgtgactgccgaagagaccatctgatcagttcagcaaaatgccaacttcgaactgtgcaagaattggagaggcaagccgatcagttccagcaactgacccatggcggcgacaaagcaacggcagagactcgggctctgacgaaaggcattgtttgtgcatctctgctgccgtcgatcagttttgagcagatgctgttggccccattccacgtcttccaaggcctcggaaatgctctgatcaaggagttggaagcgggataaaatgccgaaattgctcagcaattcttcagacgaataggggcaaagaggaaagcgttcagaaagcgcgacttaacggggaacagcatccgcaaaatcctcgtccatgccgatcaaatggaggcccttttcgagacggaatgggcgaaaacaattttccaaacaatggcacatttggggaaaatccaaattttcaccaaagtaattggttttcatttttgtggaaataattttttttaatttaaggcccagccattgtctccaggtggcttggatggactggagacggcagtttaccagttcaaggcatttctcgacgaacaaccaatggtgcgaacgcttctttcaaaaaagacaaaggcccatttgctgcttcaccactttgttccgtttgcgcgccaacacggatttttgggccttttggatgagcagggtgggaccatatcatttttgggggttcaattttaaaagttgtgatttttcaggagatgaggcactgcattccgtgtggcggcgacttgagcaactttggaagacgatgccggactctgaacaaatgcgacaacagctggagcatcatttcgtctcgaattggctgctggacaccggcagactcgacgaattgaagctggtgagttgatggaaggggatttaaaattttaatccaactaattaagcgggaggaggaacaacgggagcaagcggaggaagacaaaacgaatgaagaaagtgatcaagatgccgacgtcgatatcgttgactga

SEQ ID NO: 79575 - DNA, 107 bp, Heterodera glycines; identical to SEQ ID NO: 51702
  Genomic contig location: Contig_ID=SeqID_15332; Location=413..519; Strand=+
  SCN-specific regions: Sequence locations=1-9,31-31,56-107

SEQ ID NO: 79576 - DNA, 189 bp, Heterodera glycines
  Genomic contig location: Contig_ID=SeqID_15333; Location=1599..1787; Strand=-
  SCN-specific regions: Sequence locations=1-189
atgcgtctgacgaccaccgccgtcgtcgtgtccgcaactcggcttcgcgatcgccgccccccaccaaacaaaaaaaccaccaccatcaaaacaatggccacggtgacttcgtcaatcaccatcatcatcgtcgataggtattcccacaacagtgtcgcaatgagagaggcactgtgttgtgaagttcag

SEQ ID NO: 79577 - DNA, 61 bp, Heterodera glycines
  Genomic contig location: Contig_ID=SeqID_15334; Location=1..61; Strand=-
  SCN-specific regions: Sequence locations=1-15,38-61
gataacgaaaaaacagttggaggagaaggcgcagcgattggagcgcgaaatgagcgaattt

SEQ ID NO: 79578 - DNA, 87 bp, Heterodera glycines
  Genomic contig location: Contig_ID=SeqID_15334; Location=2332..2418; Strand=+
  SCN-specific regions: Sequence locations=1-87
tagggagtgatcatcatgtattgcggtccgttttatgaccgaaacaaagggttggacattggcaacaaccatattggctaaaatgca

SEQ ID NO: 79579 - DNA, 357 bp, Heterodera glycines
  Genomic contig location: Contig_ID=SeqID_15335; Location=1..357; Strand=-
  SCN-specific regions: Sequence locations=1-95,117-175,198-357
  Gene Ontology: Mol. function=transferase activity, transferring groups other than amino-acyl groups; Cellular component=integral to endoplasmic reticulum membrane; Biological process=fatty acid elongation
gtgccgaacacaccgccgcctcttcgctctttctgcccatgaacttctttgctcactctctgatgtattcgtattacgccctcaattctttgggcttcaaattgccccgttggttcgctatgattgtgaccaccgttcagacgacgcaaatgctttttggggtggcaatcactgcgactgtttttaagctgaaagtgttcgacggggcaaggccggcacttttccaagaagcttttgctgagatctgtgctcatttctttgctttaggtgccaacaaagcatgggcaatttgtacttggccattttcctttattcgactttcgccgttcttttcattaaattcttttacgacctgca

SEQ ID NO: 79580 - DNA, 966 bp, Heterodera glycines
  Genomic contig location: Contig_ID=SeqID_15337; Location=101..1066; Strand=-
  SCN-specific regions: Sequence locations=1-3,25-51,73-409,431-451,473- 662,685-894,938-966
atgattattattattttgttcattatttgccccctgaatttgccttttgcctccggccaactttcgacaaaaccgtaaaatttggaatttaattttctaatttgtttttgttttttatagtgttcatctgacgaatggacaaaatggactaacatttgtctcataccgcgcgcctgaacaacgcgagtcaaatgggacggatgaaaaggcattcggaatcgaatttcgccttcccgaaatagccggacactgtgacgatgggtaggaagcagggatgtgccgagccagacaaaatccgattccgattaaatcgccgattccgattatggccaaaaatccgatacggttttaaaaccgattacgattatggcccaaaatccgattaattgcgattccgattacgattccgattttttaaaaataattttttcccaaaaattttattcataatcaaaatcataaatttaaagattgtgatgcaaaaataaaagtttgtccacattctcaggcaataaacgttttcagatctgtcacaatcaacccagcggtggagaatattcccagatatttgacatttttgctaaataacaaaaaacttgattatatcggggagaattaatccggcactgctttgtgagaaaaatttaatttcagtcattatgttaaaataagattaaaacattcgtttcagaaaacattttttttcaaaattcattggtattctcgctaaaaaaattccttcaaaaggtcaattcttaggggtgtaataatcggatttcaaggcaaaatccgattacgattatccgattccgattatggcccaaaatccgattaattgcgattccgattacgattacgattccgattcggcacatccctggtaggaagtaaatcaaaattattaataatattaatattagctaatttttttaaaaatcattcaaggctaaaaaatgaaaaaataaa

SEQ ID NO: 79581 - DNA, 757 bp, Heterodera glycines
  Genomic contig location: Contig_ID=SeqID_15337; Location=1841..2597; Strand=+
  SCN-specific regions: Sequence locations=1-340,362-616,638-757
atggcattggctgtgcggtgccaatccctcaccctcttttggcactcaaaaatgacactcaaatcggaaaaagagctccactcattgagaaaacttttgaaattaaccaaccaaaaattagtttcagtttttcacacaaattactatatttttggaagcaataaaaatgcttcgttttagcattttttgtcaaaaacttcattcaagaacaagatggaattagaattgttcgatttacttgactttcggaattccgattttttggttttattgcatttttattgagaaatttcaaaaaatctcaaaagagtgaaagaatagtgacaaaacgccaaaatagtgaattttcactatttttgtgacgaagctccaaaatagtatttctagtaacatcagaatcgaaaattttcaacgcagaaatgcgttttttgagctcctttcttcaaaacattgagcaaaaaaaaaaatatagttaaatcaccaaaattagcggccctaataattatccacgaaatatttttagccgttttttctttttaccgtcaatgtccgggtaaattcgtgaaaacatgtgttttaacgtgcggcgtttatctccaaaaaaagggttttggagaacgggtgggggtggggtaggtccgggcggtgccgataggcgccggccgggggggaagatttaaatttgagtgaaattgttaacagattttgtcgaaaaatttgtctaaattttacgattctgagacgtttttttaagaaa

SEQ ID NO: 79582 - DNA, 1024 bp, Heterodera glycines
  Genomic contig location: Contig_ID=SeqID_15338; Location=2411..3434; Strand=-
  SCN-specific regions: Sequence locations=1-140,206-297,319-601,623 -732,754-767,793-1000,1022-1024
atgagtgaatttgcttttggtcaattaacttttcttcgtccatttatcattttaattcttttttgtgtcggcgttttatctgatacggaaacgaataagcaaacagaaaattccgctccattaagcaggttattttgatcattaaatttttaatttattttccttttgaaaaggaagaaaaaataaataattatattaattaaaactgctaacaatttagagacaattcggctcatttggctcgtgtgctgcaattacggcaaaaccatgaagtaattacgcaccgaaaaagggacgaaaaaagaacaaatgccaaaacaaataatgggaaggcaaaacggtacaaatgttttttggtcgatgacaacgactcggaggaggtaatgacaaacaattaattattcattaaaaaaagaaaattttaactttaaatgccgatttaaatattcgttactgtgtttagaatttgactcaacaaaaaagttattttgccaaattccaagaacgtcaaaggcttcccactgacattttgggtttgtttcgactaattaatgaaaattattccaatttaaaaatgattaattccgcgtaataatcatgccattttcaggttgggaagaaagcccccgtcgatctgctggagctgctggggcacgatatttgtatttttcaaccaaaggcacaacacccgaaccaataattgaggtaagtttgtggactaattacaacaattaagttataattgctattttaatgataaaagtacattttttaatggattaataaatacacgtaaatatttttgtcataaattgcttctttcaagtacattgacgaggacaatctcaaggaggccgaagttggcaccaccgcaccttttgagggcacggccgaattttcaatcggagcattggcacctcaacggacgacgatgagggcgatggcaccaccgaagcagcagaagttgaacatgcaaacagcaattactgctacaacacctgtggtggttaaatgaaaaaataaa

SEQ ID NO: 79583 - DNA, 1621 bp, Heterodera glycines
  Genomic contig location: Contig_ID=SeqID_240; Location=1997..3617; Strand=-
  SCN-specific regions: Sequence locations=1-107,129-610,634-1133,1155 -1324,1346-1621
atggcaccgccaatcaaaaaaaagcaaaagcattcctccgccgaccatcgcctcatttcttcttctgctgcaacaattggtggaaagcaacagcagcaaacgttgggctcagtgatgtcatcttctggaaaacggcaaagtctccgcgtggccatcaaaaagaattgtcgaactttgaggaaaatgtgtgccgaattttctttccatttctaggccaaataatttttggcattttcagttgggtgtgcaacgatgttttgatggatattctcccattttttgaccgtgcccaacttggtctcaaattggcattgctttcgccccgtttcaatgcgttggtggacaaacatttcgacggcaaaagcgaattgacgctttggaatgagattagcattcataacgaggacaatgaaccagaagcgaaactgtctgtgcagatcgatggcaaatttgtgacatttccgttgccggaccattcgatgcccgacaaaatccgctttgagaaccttaaaatcgagtaaatccaaacaaaattcaaaaaatgctaaatgattcattccctttcagttacattgactattccgtcatcacatttctccgtgccaatcagcaaatttttgacaaaggcaccaatttggatttgtatttgtatttgttttacgcccgtaaagccaagaatgtccagccaatttggaatgtaattgctgatgaaatttggcccatttttgcgccaaccattcgcaatttgaatttttttgatgctcatgatcttgaagagttgattcgccacacttcgccgtcaattctcactgatcacaacatcaattcaatcgattccggcaatttgttgcccgatgtgatcgctgatgatggaccaaatgcaactgctggccaagcgctgtcaaaatggttgaacacgccgagaaaagatagaaagccaaagcaattgagttgtcgtgatgcttcagaaccaccaaatatcaaatggatcaacgggttcaaaaaggtgtgtgaaattcaaattctaagatttcggatttttggtctaaaaaaatggtctaattattttatcacgagaaaaaaaaacttgaaatttttttcgaaaaagaggcgctaccaccggcacttttgcccatattttcaataaaatatttgtattaattgccatttgcttttcattttttccattgtttaggcatttctccgtgccatcaccaccacttctgccaactacataattcgacttgaagactttgaaccggcggagaatgcgccatttgaattgacgaacgaacggaccaacgaaatgctgacattggagaaagaagaaaaggatgatgaagagaacgaagatgatgattatgacattgattattggctgttgaagcgatgcccaattgggaagacaattcaatgggaggacgaaaatttgaacaatgtcagctttcgtttcatacgattgggtgagtggcatggcattagcttttgctataataataatcaattttaattgcacttagccgaatttaggcaattgtctccaccaaaagcgggccaaaagaaagcaacaaatcgtctgaaaatgaaacccgggcccagcggacagcggaagaaaaagtga

SEQ ID NO: 79584 - DNA, 570 bp, Heterodera glycines
  Genomic contig location: Contig_ID=SeqID_242; Location=815..1384; Strand=+
  SCN-specific regions: Sequence locations=1-183,205-398,421-570
atgccaaaatggggagacgacgacggcacaatggacggaccaaaattcgaacaacaatttgaacaatgtcagcatttatttgaatggcgcaaattgcatttggtgagtaaaatttgcgtaaaattattaaaaataattcgaattaaaaaatcattatgtgagggcccttcaattaaaatttaattggaaataaaaaatagattttgacatttctttaggccattgttgtccactccggcgacgcgaaaaagcggcagaaaaaggacgtcgaattgcgcggaagtgaaatttaattgagaaatgatcggcttattggggattattgttgtgaatggacaaattgatcgatctgctaatccattgttgatgatgattctttccgacgaaaatattttttattatttgttttcacttttgacattaaatgaatagggctgctcaaatgagggctgaaatccccagaaaattaaccctcgtatttctccaaaatgctgttcaaattcggatctccgcaagggcgtagcgaagggggcgggggcttaggaggctaaagcccaccgaaaccgaaaa

SEQ ID NO: 79585 - DNA, 856 bp, Heterodera glycines
  Genomic contig location: Contig_ID=SeqID_242; Location=1407..2262; Strand=-
  SCN-specific regions: Sequence locations=1-145,170-856
atgttcaatcgcgctttgttctgttccatggaccgctggtacggactgacattgacgccaattcgtatagtcgaagatgaagcacaacaagcattggatgaggtgggttggctgcttctgcggctctattgcagttcacaggaccataaaaaattttttgaaaatttaatgcaccgtaactttttctaaaagcgtccaaattaaacattcttggtatcattcgacagatctaagcgtcctctatcaatgttcaaaatttcaataaattttgttatgtttaaaaaaagttatgaacagaaaacttcaaaaaactggttttataagtatttttgatcattatttttttgaaccgcaatgaaattttttgaaattttgcaaatactaacagaggcttcttacatctatcgaatgataccaagaatatttaatttgagtgatttttgaaaaagttatggtgctttaaagttttgccaaattgttttttgctaaatctctttttcatggtccgatgaactgcatttagagccgcaattaatacactaattgattcaatgaagcccccatttcatcaacagacagatgaactcgcgactgatgactcgtcgcagggaatgaacgcctctaacggaactgaacgcgatgatgatcaatcgagtgacgtgccgatgtgaccctgatcaatttgctcattatacatacatattgtagaaaaaaataacaatgataataattcggcatttgtcctttcacccccaggcactcctttcggcacttattgtacatttactgaacacactcgccaatttcctcattatataagttcgtcttttgtgcttcttctgtgccagaaaataaa

SEQ ID NO: 79586 - DNA, 1068 bp, Heterodera glycines
  Genomic contig location: Contig_ID=SeqID_243; Location=78..1145; Strand=-
  SCN-specific regions: Sequence locations=1-100,122-526,548-1068
  Gene Ontology: Mol. function=phosphatidylinositol transporter activity; Cellular component=membrane fraction; Biological process =nonselective vesicle transport
atggatgccaaattcaaaaaatgggggccaccacccggctgtagtattgttaccatgaaatgtgtaatcaatgctaattggtcgctcgcgttttccagaaaaaagctgccctctcttctgcgccggcttttgccaaagggttcaatgaatgtgcatgaaaaagtgtggaacgccttcccgtactggaaagaggagctgaccaacccggacttcatgaaggacaactttctgatccggatggaaacaatgcttttgagcgatcgtggcaacacaaaaaacgtatgtttgatggagaggatcaatcatcatcatccatcaccaaattgtcgattatttttcgcgtgagcccgagtttttggacaataacttttttcattgtcaaccaaatccaattcaatgttggtatcattcgaaagctgaccatgtttagaattgtatctatgcaattgcttggcgattcgacaattgccaaaaaaaaaatgcaaaaagtcgaattaaaaaaattcttaattacttttttgcagaccataaaatcttttgctttttatcaagctaatagaacatgtgaagggctttcgaatgacaccaagattgttggatttggttgacaatgaaaaaagttatacatttagttcaaaaactcgggcccgcgcgaaaacggctcgcacaaaaacggtctgtcttgtccgcaattttttcaaaatttttcaggcgttcggtctgacgaaggaagcgctgaatgaatgcaagaagatggtacgcattgacatcgccaacgacacagagtttctgagtgcagaggacattcaagaagacagcataccgtccacgttccgttcggtgtgcacaggccgtggtccgttgacgggacagtggcagaccaactgcgagccgttcatgtgcgcttacaaattggtgaccgtcaagttcaaatggctcggcttccaaaccgtggtggagtctttcatccaaaaggtgtgatgagctgatgagagagattcatttgtcgtccaccaatttccaaacgaatgcaccccaaaatttcgccggataaatttaaaaaataaa

SEQ ID NO: 79587 - DNA, 1812 bp, Heterodera glycines
  Genomic contig location: Contig_ID=SeqID_245; Location=905..2716; Strand=+
  SCN-specific regions: Sequence locations=1-11,34-179,201-278,300 -649,673-783,805-940,962-1078,1123-1192,1215-1218,1256-1752,1775-1812
atggcattcggaggccccaaaaaatttgggaaatcggaaaccgaaattccgaggcccaaatacttctcggaagtcggaaatctaaattctgactctaaaaatatcggaaatcgtaagtcggaattccgtgccatccctgatacctaccgtatttactcgcgattagagcccccgggggctctattgttcaacccccctccgaaatggggccatatccgcttttccacctactatgatctgcatacactcagtttgaggatataattttaaagatttacgtttcttaattatgaatgaaataagttaaaaaaattttccggttttcgtttcgtttcgtacgaaaatggttattttttcgttttcgtgcagccctgccacggtgctatgtcgttataaaaaaagccatcaaaaaaggcgctaaaaatatgcatacatttaaaaattcataaaaaatttatagaatagaattcatgcgagcttttcagaatatattaagaaggtgtaattttcccggcgccgcctgcctaaaaattgcgaaataatgcgaaaaatggtaaaataggagcgaaaatttgaaaatcagtgcgttttttcaatgaaattaaaataaaatcgatgaaaataacttattgagaaaattaattacaaaggaattaaatttcattcttttttcgaagcaaaaaaataattggggtttctacagaaaattctttttttttcagttttttgttagtttgtattcttaattattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatggagcggcgcaaatatccgcggcgcaagtgtctcatcacgttcagaatatattaagaaggtgtaatacacatgtaaataaaatttgatgcgtttcagagcactttctgaaaaaatatttatgaataattttgcaaaaaataaaataaaataacgaacctcccttaataatttttctgcgcctaacaactaaggtactcacttggccgcttcgcggccccccatgaggaaagggacagaaataaaaccgtaatataaaaatttaatattatgatcaatataattaactgaatgatcttctgtcaaatgactcagctgatgaacatcatggaggactacttcaagtaatccataccaaggacggtatgaaattattttttggtttttttcccattttcaaattcctcccaatgtttttcagtgataaattcattaaaaataccatttaaatttgtaaataatgtttgccatatttaatccttccctttggtgttcaggtggagtcccagttgccggagaagacggagtacgtgatcaaatgtgacatgagtgcgctgcaacgcctcctctacaaacacttgcggaagggacgactgctcattgacagcaaacatgtcagtgaacaattacacgactttttcaatttaattgcattttttcatacaaattttttttcatccttggtgacgggggcgtacatttatgtatttccaattatttaccacctctattgtatttatttgatcgaccacttttgatgttatatatttatttgagtaattaaaacgatttaatttatgttttttgtatatatagtattccacgtaaattacgtcattttgca

SEQ ID NO: 79588 - DNA, 837 bp, Heterodera glycines
  Genomic contig location: Contig_ID=SeqID_245; Location=4008..4844; Strand=-
  SCN-specific regions: Sequence locations=1-361,383-397,419-528,551 -736,758-837
aatgtgattccaacttcttcagccagtgaacagatgcaacgaaatctctttgaaatcctctcacaaaatgaatcatttgcattccagcaaattgctggtcaaactcatttttaaatgctttcaaatattatttcatttgccctttttactcattcaaataatttgttcaacaaattctacgaatctctcttctttttctgttcacttgccttcaatttttttttactcaaattttatgattattttccatttcaatttgttactcactcaatttttgttattttttagtccatttttgaaatcattcgcaaatcccaaaagaatatttttttattcatatgcctatcatttgtctttttacaagcaataatacaaaatttgtttgacaattcaattaatcttttgtccattttatgttcagtcggcggcacttgcgagtcgggaaaatgtcctcacgtacaaaactattttaaaactccattattaatcccaaatcctcacataatagcttaaaaaaatgatatttcattggttttttaaaatacatatttatgaaagagatgggaatcttctgagttttcaggaatttaagttattcatcctgtttaactttttttttctaaactcaaaaaattctcggtcgaacggtttcggttaaaaaaccgaagaaaaattttcggtataccgtttcggtttcggtttttttgaatttttttattttttcccaaaaaaaaacaacaaaccatttttatcaatagaaaaagcgaaagatcacctctgagtaaaatggggggggggcggaagtttgggcactaaattaaggatttaaaaaataaa

SEQ ID NO: 79589 - DNA, 2049 bp, Heterodera glycines
  Genomic contig location: Contig_ID=SeqID_246; Location=518..2566; Strand=+
  SCN-specific regions: Sequence locations=1-117,155-211,233-459,481 -539,561-787,810-968,990-1004,1030-1081,1103-1105,1129-1252,1275 -1310,1405-1606,1628-2049
atgcacaccacacgcatcgtgatgtcatcaaacttggacaaaaaccttgagaacattcgtcgaattgaccaattcgccagcaaagtgatcggatattccacccacgcggcactgttcaatttcaggttttacatttacatttttgtaaaaaattttctcatattttttgaatggctccgcactttactaaatgagtggaaaattgcggcacaaatgcaaaacttcaataccggataggaaaaaagaaattgcgctttacttttcttgattgattgttacccctaaaaatttttttatcaatttatcgcaaattttcaaaaattccattgccctcactccatgtttttagcaccgagcagaacaaatggctgaagacggaggtggacggcccgctgttcatctacgaacggcttgaccaaccgctgtactcgttggttgtcgtcaatcgccagtcgccccaaaattttgtggagccaatcacggacgggttgaagttgagctatcacccgccttacatttttgtgcatcgcgaagatggtaagaaaaaacaaatttacagcgaaatcctcaaaattgggtgggagggggttggggcaaaaaaatttcaaacattttggatgagggcatcgggggccaggatttcagcccccccccccccccttcggcgactaactttttttcggcgcattttttattggaacagcgggggccagcggtgttgattaaataccgccgggaaattttaaattgatttttcctcaatttttaacagattttgctggtagccaaaaaaaaaattttttttttttgcgcataatttgaccgtattttcgcacgttttcaggctatattcacagtctctgggtgttcggcgaagacgaatgcaaacgagttagtgcatttcattctcggttcatttatgtgcgaaaaatgggtgaccaacgtgcttttcaatgcccaatctttcatttttccccactcattttcagtccccataaccgggcaaaaaaaaaaaaaaaatttttttttgtaaccctatgattttttctgtaactgcccctcaaatttgtttttgacctttagagagtgtaatttttaaattgttataaaacaagcaaacaaataaaatatggccgttccaggctgtttcattaaaaaaaaaatttttttcaaaaaacccaaacaaatttttttttttttgccaggcgtttgacactctgacgaaattgagcatggcgcagaagatgataagtgccggtgccaccaccagcagccccaaaaataacatctccaacaacaacgacaacggtgccgtcgccgctttcgctgccgcaacgccgccgacgaaaattgtcgctgccgccaaaccgtcaacgccgccaccgtcgcagcagcagcagcagcaggcgatccgtgtcagtagcattactgctaccatccgtggtagccacatcaaatcaaacaaggcccaccacgtcggtggcatgacgaccacctgtaagaatttttcggggcggagggaggggtgtggagtaaagttgtgtactccacacgacggttcaaattttctaaaatcaattcttttaaatttcctagtggtaaattgttgggatgcctccgcttgtcactgtgacctcgaaattactgatggccaatgtttgactgtcctttacagaggtattttgtgtaaatataatttcgtcatatataataatataatgtctttttttcagaaggagcagctggttaccgttccgtcttcgctaaacatccgatttttctgaacaaaaaacacggcattttttactttgaaattttgataaaaagtctgcatgagcgactgcttatgggttttacggctaaaaagaaggggattatatgtgaacgggatgcggttttcatgctgtcttcacgcggcacacaacggcgaaacgaaatcgtttcgcagcatgaaaacagtgctttttatgttggcgattttgtctgttgtggcattaatttggcaaccaaccagtttctgtgcaccaaaaatggcgctatcttgggtta

SEQ ID NO: 79590 - DNA, 219 bp, Heterodera glycines
  Genomic contig location: Contig_ID=SeqID_246; Location=1..219; Strand=-
  SCN-specific regions: Sequence locations=30-114,136-148,180-219
taaaaaaaataatttttaaaattaaaattcttgccacaaaattacctttttgagaaaattttttcatttcttaggagtgctttttgaaattttttttgtcgattcttaggggtgtattttttgaaaaaatttttaggtcgattcttaggggtgtattttttggttttattgcatttttgttaaagaattttccaaaaaatgtcgaaatagtgacaaaat

SEQ ID NO: 79591 - DNA, 1090 bp, Heterodera glycines
  Genomic contig location: Contig_ID=SeqID_2409; Location=697..1786; Strand=+
  SCN-specific regions: Sequence locations=1-858,881-1090
  Gene Ontology: Mol. function=cyclosporin A binding
atggcaagtggtcgtaaacatatgaccatgactgtattttctgggggtttgtgatctttttaataatggtggagggttcggtgaagaggtcaatgaaaaggttctcacacttgcgtccataccatttggagacatcggttagatgctttatactttttacaaatttaaaatatttaatttggtttagtcggcgtaagcattccgttggacaatgaaacgggcaaacacagaagttttgggtaagttgattcattttaagttgaatgttagtctttgctttttgagatttgtcgaatttgaacttccggaggatgcagcggcagcaattgacaatatgaacgactcggaaatttatgggaaaacaatcagagtgaattttgcacgccctccaaaagtgaatgagcgaagtcaacgaccaatttgggcggatgacgagtggttgaagcagtacggccatgggagtggacagggcgaaccaggagaatgccaaaagtttatttgggcatcaaaattggaataaggttggcattttgactctattgcagcagtttacaccgaccataaatcatttttaaaatatataatccgaattaaatattcgagtccttaattagtctgttaaacttcaaatgatttcgttttgtttcaaaaaggttatgactagaaaacgcaaaaacacttctcaacattttagtccgcaaattttgaatcttgaatgattttttcatctttcctagactatgttttcaacaaagattctttggctctaatgcactttatgagtccaatcaattgacaatcccgggtttttatacaataactttttccatgttcgaacaaaccctatctttttggtatcattcgaaagcacacagtctgacgaagctaaaatatataaaattgcagcgttcaggcaattaccaaaaaagattaacacaaatttcgacgacattcaagactgctttttgttaaaatatgaacacatatttaaccggaaataatgaaaggtgtgtgcttgatcagactttatcttctctatttgttacactatcgattgcttatagaaaattgcataagatatatacaatta

SEQ ID NO: 79592 - DNA, 401 bp, Heterodera glycines
  Genomic contig location: Contig_ID=SeqID_2410; Location=797..1197; Strand=-
  SCN-specific regions: Sequence locations=1-166,188-284,306-401
atgcaaacatttttttcgcagaaccattttgctgctgaaggaatacaaatgcaaaaatggcggacagtgcgacgtcgaaaaaggcaaaaaatactataaaaaataaaacatttagtgctttcgaagtcatcaatattttaaatttggttcattttgggcgaagtcattaataattttctataattttccatttgatggttttttgagtaacgatcctgcccaatccagcgatccgataggcttcgggaaaaattttataatgaaatactgcaggttgttagcccttatatttttactgcaaaaatgaaaacgatgaacgcagttacaaaattaacattttcccaaatttattattttacatttcttcacaaattcaatcaaaaagacaaataagaaataaa

SEQ ID NO: 79593 - DNA, 1356 bp, Heterodera glycines
  Genomic contig location: Contig_ID=SeqID_2410; Location=1289..2644; Strand=+
  SCN-specific regions: Sequence locations=1-544,566-674,696-739,762 -1017,1041-1042,1066-1119,1143-1356
atggccgaacttaaagctattattagccgcttaactgctattgaaaaattaatttcaaccaacaacaacaacaccttggcaaccgaaatgactgcgcagttcagcgccattgcggaacgcctgggtgaaattgagcgcaaaattaacaacaatggcattgtcagcgcggaggagatagaacgaaaaaggagccttgtgctcatcggtcttccggaatcggaggaggaagtgccatcactgcgtgcgaaggatgacgcgaaaacggtggaggaagtgttggaccggctggacgtggaagtgtgcccgcaaatggtctacaggatgggcaggaggattgacgagaagaggaaaggaccgcgcttggtgaaggtggtcctgccggcttcaaccttccaacgttttgcgctgatgcagtgggggcgtcgtcggacggagctgaagaagagacctggatgggagcgtcttctggtcaggccatccctgacgaaggaggagttggaaattgagcgggaacagcgccaaaagaagtggatggaatttggaaagaagaaaacgggggaaaacatcacgacgcgacgcggaggcaatgaaaaaaacttttgaggtcacctccttttttaaattgttatatttcaatgtacgaagtttggcgaacaaattggacaagttaaggtttttgttattagaaaataggtttaaaatcattgctgtatctgagagttggttgagtaacaaaatagaaaacccccaaattttggaaaatctcccctattctataataagatcagatagacttaacaaaaaaggtggcggggttgctttcataatatcgaatttaattccttttgaaattatcaaaactacaaaaaacaaaaattccgatattctttgtgttgacctattttcacctcttaaccacacaaaaatacgttttattttggtctatagacccacctcccatgaaaaacaagaagatttcgaaaaattggtcgaacaactctctgttttagtctcggcttctgaaaaatgcattttgttgggtgattttaattttcctcttttaaaagcaaaagacttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataacttcaaaaaagcaaattatttggaa

SEQ ID NO: 79594 - DNA, 1407 bp, Heterodera glycines
  Genomic contig location: Contig_ID=SeqID_2410; Location=3311..4717; Strand=+
  SCN-specific regions: Sequence locations=1-116,138-592,615-907,929 -1200,1222-1407
atgactgcccaaattccagaaatatggaaaaagtcaattatttgccctgtcccaaaaattcaaaatccggtaaacccagtcgactttcgtccgatttctctgctatgttctgtttccaaaattttggaagaaaatatagcaggaaaaataaaaaattttgttgaaaaaaataatttgttaccaaattgccaacatggttttcgtaaagcacattctgttaccactcaacttcttgaagtggtggatgattttagttttgctttagaaaataaaaaatcaattgatgtaatttattttgatttggctaaagcattcgacacggttccacataaccggctaatatctaagctaaaaagcattggtataaataattccttattaaaatggattcaaaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacatattgaaattatctcgaaaaaagcattacgatctgcttttgctatattaaagtcaatcaaaactggtgatacgaaaatacttgtaaatttgtttaatatttattgcagaccaattttagaattcggatctccaattttcaatccttatttaaaaaaggatatagaaaaattggagaatgttcaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaatgaattcattataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgccaccccaactccaaaagtga

SEQ ID NO: 79595 - DNA, 1132 bp, Heterodera glycines
  Genomic contig location: Contig_ID=SeqID_2411; Location=595..1726; Strand=-
  SCN-specific regions: Sequence locations=1-193,216-580,602-684,709 -1132
atggcttccaacaacaaaaattctctgttgctttttctgctcctcatcgtcgcattgcttctcaactatggcttttgtcatcagcaacaagacaacgacagcagcaggtgctgtgattttgatgagcagcaattttgaaatccgaaaaattaaaatacatgcactcccactcaaaaaaatgaaaattaaacacaaaaatccaaggcatggatggggtggaaagcgaccgcaattcgcatgtctcggcgaatatttttttgctccatacgtgtccagggattgcatcattttcgaaatagaaatcccaatttttgtggggtaacctattccaaatacgctacttttttcccatttttgtgcatgtttccgaaaatttgtcggtgtttgaatacgatccccctaattctcaaatttgctgatgataaattcaacttaatgttttccccacattttcagtccaattgagcaagtggacgatggggacgatgacaataaccatggcaaccactctgctatgttcgttttggctgttttgtttctttccatttcattcatcgagaatttgcttagaatagatccttaattttttcggaattggtgtcccgacggaaaaaatatgctgatcacgaatccgagctgggattttgcaaaatcattggttttgctatgcttttcatcatgtaattgtttaatttttatttccttttccttgtcgggacaccaattccgaaggattaccctttcgtttcatgcatctaaagtacaataaaatttgaccagggttgcgacaaaaccggttaattcatttttcagttggtggaccgtgtttcttctgtcagtcggctgtgccatcatttgtgctgtcttaatcaaggggcagagcgagcccgctgagcagaacgccaacaatgaccaaaacgaaggtcagggagacggagaaattgctggcggaggtgttaacctcgacgatattgacatggatttcattgacggagaaattgattaccaagccacttgggggcataacccttttgagcatggaggcggcaatttgttgcagaacctgcaagagcaaaacattgacgagcaagaggaggagaaaggtgagcacttgaagggcttcggagtttaa

SEQ ID NO: 79596 - DNA, 312 bp, Heterodera glycines
  Genomic contig location: Contig_ID=SeqID_15339; Location=888..1199; Strand=+
  SCN-specific regions: Sequence locations=1-199,225-287,309-312
atggccgtaactgaagctgagttattttgtgcgctgccgacgactactccggagcaattacacgcgtttggcaattgtaagtttagaagaatgctgtacgactcttaatagacattttctgagtaaaattttagaatatcatttaagactgatcaaaaaaatactctttactttttcattgatttaaaaaaaatctatcttattattttttagttttgagacagtttagccaacatctgcacgatgagcacggcttcactgactagggcaattggtataatcaaaattttttatgggattatttccattgta

SEQ ID NO: 79597 - DNA, 1108 bp, Heterodera glycines
  Genomic contig location: Contig_ID=SeqID_15339; Location=1213..2320; Strand=-
  SCN-specific regions: Sequence locations=1-290,312-475,506-596,618 -654,677-1007,1029-1108
atggcgatggatggcacacccactttcttatctaaccttaattatcggcaattcacattcttatcgaatcgtgggcggatttttggcgccagtgccctccaaaaacactccgcatcccaaagtagttaaagataaatttgtaatttggtttacaacaatagtgttcattaaccattttagcaacatttaatgatgcagaaggtcgaaaggtcgaaccaaagagtcaatcaattaacaaatagattaaataagttctgtcatcaatttacaattaaaaaatacacccagaaaaacataaaggaaagcaaaaatatttggttatttaattgctaaaattcttaaaatatttggttatttaattgctaaaattcttgaaataaattccctgaagcactcatcattaaaagtattgattatctttttcaaaaccgttgcatattttgatcaaaaattcaaatgcgcaaaaggacaaaggaataaaaaattaaatttaattttaaaaaatgacgcatttctagctttatatgttttatcattggacgtattgacatttgataaactttatgtattgcaaagagtcgggattgtttttgcaaaaagagaagaacggaagaaaagagagactgacaggcgacgtacgacggcacaaagcgctgggcaatggcaccgccgagggatgaaagagggatgcgcgataaaaatattttgtgatgagataattatgaacggaaggaaaatttctgtgatggcacattagagtgggagagaagcataaggcacaaataattaagtaattgttatgatagtaatgaaaaaatgggagacgaaacggaatggcaaaactgtcaaagactgtgcaccaaatttgtttccgataaaacaatttcaaaaccaaaacttacactcgtgcacagtccattagacaatcggcaaatacattttgtgaaggggatcaaatggaatctggaaatgactctgtcttagattttcataatctgccccccccctccccttttctcttattccccacaaaaatcagttgaattctccaaaaagcacttttcactcctacaaaaatgtatcataaaaaaattgtttcaaaaataaa

SEQ ID NO: 79598 - DNA, 384 bp, Heterodera glycines
  Genomic contig location: Contig_ID=SeqID_15340; Location=495..878; Strand=+
  SCN-specific regions: Sequence locations=1-13,35-98,174-384
atgcatgccaaattcgtgcaaattgttgccattgcgtgccaatggccagaagcgacgttgaccgatttgaacattctcaaactcagtgaggagaaatgaaaattaaaaaaagaaaattatttttttcttttttagcctttaatttataaaattatttattcatttttattttagttttgaagagcatatgtagccaggttcgttttgtaacccaatggatgattgagaaaaaagttgatttttatccgtgctgaatcgtttagtaatagacatttatgaatattaattatcatcttaacttttttcaggggtaatgaaattttttttaatttgtgcgttaattgagaaacataagagctattaaatggcccaaattgtatttaa

SEQ ID NO: 79599 - DNA, 771 bp, Heterodera glycines
  Genomic contig location: Contig_ID=SeqID_15341; Location=120..890; Strand=-
  SCN-specific regions: Sequence locations=1-35,122-137,240-710,736-771
  Gene Ontology: Mol. function=protein binding; Cellular component =axoneme; Biological process=eye photoreceptor cell development
atggggaggaaaagcagaggaaaaaagggcaaaagagaaggcgacgaagagaaagaagaaaaaggagtggaagaagaggaagaaaagagagaagaggaaaaggaaggggaagaagaagaagcagcgaaaggagtgcgagaggcagtaaaagaggacagcgaagagagagagggtggaaaagaggaaaaggaaacggaacgtgaggaggaagaagagggagaagggacaaaagaaaaagatggcattggcacagaaagaaccgaagcaacagctgaaaatcagagggggaaaataaggggagacattaaacaatcagtgatcagagtaattgctgatcaatgccaaagggctaatgggagggaataatgcgaccgaacacactgctgctgcttgaccccattccttctcaaaacaagagtcggcattatgccgtctcatcgcgtcgttcgtctcgtcattttgccaaagttccgtctccccccccccccttttctcttttcattgcgtcctcaccacgtgagtttgtttttcctctccccaatttcgccgttcacttttcagcttttcactgcatgcagtattttggcagggcaattttctccgttggttaatcgaattttttcggggtaaaggcaattgcccctcgagaaaaagggaaaaagggggggggggagacaaaatgagagaaaatgaggagaaatcgaaagtgcaaaaaatataaattattatttaaaagagttaatatgaaatatttactgaaagaaaaataaa

SEQ ID NO: 79600 - DNA, 806 bp, Heterodera glycines
  Genomic contig location: Contig_ID=SeqID_15342; Location=559..1364; Strand=+
  SCN-specific regions: Sequence locations=1-154,185-369,391-806
atgccccgctttgaattgcagaatatttgtgcgcttcaaagtcaacatcagttgcgacatttgccgaagagtgaagcgaacgacggaggaaaggaagcggcggaagtgccaatcattgtctacgaagagagtgacaacgagacggagcagcacacgcaccaccaccagcagcagcagcagaagacggtgggccaaccgccgcggacggccgtcgaccgacgcgaggcggcgcgcattgcgtgttgggcgagtccggagctgagttgtgaaggactgtcgctgaaagtgcgcgagacgcagccgcgggggacgacggagggtggggaagcgaggccggaggtcaaagagcggacggagcaatccgagggaaaagcaaaagcccaatttgaggtgtgtgccgcggtgcagacggactgctgctcgtcccccacctcctccacgctttcctcctccgccgttctgctcgtccccgactgtcccgtgccatcgcttccgttgggccccgccctttgcgacggcaccgcccctccggcgctcccttcgcttttcgctccctcccaaaagcctttccttcgccgcgcttccgcgttggcctcactgctcgacccgataaatattggcagcggagaaaagacggaggagcagccgaaacagcggacggagaaggacaatttggggggagagaaagggacgacgcggcgacaacagccgatgatgtcatcgcaagcgaaatggagacacgcggtgcgcaaattgcaaatgaacaagtgagcggaggatggaaaacggacggagagagcaattag

SEQ ID NO: 79601 - DNA, 453 bp, Heterodera glycines
  Genomic contig location: Contig_ID=SeqID_15345; Location=451..903; Strand=+
  SCN-specific regions: Sequence locations=1-453
  Gene Ontology: Cellular component=mitochondrion
gtgcaaaaggcattggacgcgttggtcgaggggaaactgatcagcgaaattgaacgcgtgggaggcgcgggctttaaagtgttgcgctgtttggagggggccactgcttacgtttttgcctcgaggggctgcaaaaaatgggacaccgccgcacccgaggctttgttactcgctgctggtacatttagaaattatttttcacaacaatctgcacttttcggtggaactttatcggatatgtccggccgactgattaattacggcccctccgtacagttgataaacagcgggggagtgctcgcgaccgccccgggcgtcgaccaccaagtaagtgaaaaggaaacattggggttattagttgttgattttccattcattttcatttctaagagtttcgttgccgccatcccccaacttgtgaaggaatcgctgccagaaacagaaattgttggt

SEQ ID NO: 79602 - DNA, 559 bp, Heterodera glycines
  Genomic contig location: Contig_ID=SeqID_15346; Location=1582..2140; Strand=+
  SCN-specific regions: Sequence locations=1-559
atgggcgaagatctgaaaaggatgacaccgattgggaggacaccacgtctggacaccgcacctgtgcaaccgccacaccgaaatgccctcaccacaggtgacgaaatcgctggacatcgccacgtgggaacagccgtgagggaccccgtcaagggacaactgcgaatggccaaggaaagggacagaacgttacacaaaagaaaaggccaattcattggccaccgaccgaatggacgggctgcgttggctgagcatttccatcaaattcaattggcaacggccacactttgagctgcgcgtcttggccaaccgtgacaaagtgcaaaccgtcagatgcatcaacagagagaccgttgatggggccggaatgtgcctggaggacgtgcaaacagcggcgagtggccaaatgccacactcggacttggccatcacgcgcaccggacagaacggtggacagacgggtgggatgtttgaccaacaaattgacctgcgaacgtatggattaaacaatttgaaaatatacgaagaaatgtaggtaaatggggataccgaaatgcca

SEQ ID NO: 79603 - DNA, 1204 bp, Heterodera glycines
  Genomic contig location: Contig_ID=SeqID_15349; Location=811..2014; Strand=+
  SCN-specific regions: Sequence locations=1-772,794-888,910-1204
atgataaaagagcttcgagatgaagtgttcggaaagatcgacgagcttcgagatgaaatgaaccaaaaatttggccaaatcaacacgagattggaccgaacagaccaacgactcgaccaaatggacaaacgactcgaccgaatggaccaacgactcgaccaatttgaggtaattttgacagatctaagcttagttgtcggtagttctgcttttgggcttacatttattgttgctgggtttgtttatggacccattgtactttatttctcaatgtttggacagaccatacatttaatctcattgaaacccaattcggggcaggcgcttttggttagcggcgttcgttccccaaaaaatgaccaggattcagtatcgcgtttgaataatttccctcccctccactgatcagcagtatggccctgtgccgccaccgatgccgcttcagtccggccactacagtggtattgaggtatattcccaaattttaattttcgggaggaaacgacgcagaccgcaggttgggaaaacgaactgctccgcttgttttttggcgttttgtcggggccaaaatttgaaaatgcaattccttgaattacaaatacacaattcacagtctacctccgagttttccgagttgcgccagattgggacttctgccgcatttgacacccgccaaaacaccggcagcgaattgcaacgccgccctccatttcttcaccacgtgtccgagaccggcaaccctgtgccaatattggtgcggagcttaactaaaaacctttcctattgataaatttttcaaaaattttcagactaggctgattaactataaatttttgtgatatcagactttcagagttcgatcgggctcaacgctctgttcactcctctttcccatttttattttggcaactgtgttccgtcaatgacgtcgccgatctgcccaaaggacaaagtatatatttggtcgctggtttaattcactacggcttaggcttaattgggccgccccccactctccgtaccccatattcagtttttcaaaaaaaaaaaaaatcaaaatggcgtctattttacaaaatttgtagccgataaattactgtttttgccatttggtcactatttttcaaaaatgataaaatgtgggtatcgcagctttacgttgtacaggtcaggcagtgccgtcaggcaccgtcgggaaaattaa

SEQ ID NO: 79604 - DNA, 1190 bp, Heterodera glycines
  Genomic contig location: Contig_ID=SeqID_15352; Location=246..1435; Strand=+
  SCN-specific regions: Sequence locations=1-1037,1059-1190
  Gene Ontology: Mol. function=RAN protein binding; Cellular component =integral to membrane; Biological process=protein-nucleus export
atgaaggccaattaccaagtgtccgaattggtcaaatgcgatagtttttccgagttgttaaacagtctcaccaagttcaccctggaatgtctgtccatgtcccatttcttcacaaccaacagcatttactacttgatctctttctggagcaaactcgccggttccctcggttacgcccgtgtcgacgtcgaattggtcatcagttttcttttattttgttcaatttccgttttttcagatttccctttgcattcccaaagtttgcactgctttcattcagtcgagaatcgcattgtgtgaaagtgttgttaggtcagtgaccgttttctcatcccatgcatttatttgcctttcctttttcagacagggcgtcgaagacccattggacgacatgggctcagtgaagcaactcatggaattgtttaccattctgtcgcggaaggactacaagcaaacggtgaaggaattgctggtcaggttcgatgagagtcttggcattcttttcacgcagggcatttctgaagaggttcaaaatgtagaacgaattttggaaatggtttgaagttaaactttttaaggagcaaattatcgcccggaaaaggctgatttggctgattacaatgatggccgctggaataaacgggaaggcgtcttccaacagcagcgaattggacgacgacctttacgacggggaagttgccgcgcgcgtttggaaggtttgtgccggcgtacctaaccattgcaaaagtcaattgacattttgcagacaatgcaattgacaaacggacgattggaacggcaacatccaagcgttatggacatccaattggagttcgcttacatttatctgatggacgaatttcgcaaggcttacatttccgaccaagtgatgcgtgatagtcaagtgtacgaaaagttggcggaactcggcataacggacgactccgaagtgttacgactttatgcccagaaaatgttgggggatttgttgtgcataatgagtgattaacatgcacttttgccttcttagaatcgtcaatttgacttactggggaaaggacgagaagatcctttcgtccactctctctcttctgaatgatctcaccgtcggatacgcaaatgtgcgcagacttttgaagacgaaggaaatccaagaactgctccgaaaccatgctgtgacttgttcctga

SEQ ID NO: 79605 - DNA, 976 bp, Heterodera glycines
  Genomic contig location: Contig_ID=SeqID_15353; Location=71..1046; Strand=+
  SCN-specific regions: Sequence locations=1-136,158-298,320-732,755 -773,801-931
atgaagcgaaccaacgcatcaaacatcactccgcctcgcgcaaaacgttcaatggcacctgcactggacctggacccaaacactgttgcactcgcagagcaagaacgacaacgcactttggtgttcattggcctcccggaaagcaatgctattcgcccatcggaacgtgttcaggaagacagggaagccgccacaaaaatcctggaccatcttgaagttgaggcccaaccaaccgccgtctttcgactcggacgttacgacccgcagcgaacaacacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaacagcaatgcaacctcgccagacaaatgttccgactcccgtcaaagaaaatggaccaaatcagaaggaggccagcgacgacatttccaaaccgccggaagtttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaaaaaaatacatttattccagtacttcacatttctcaccaaaatttttcctcaaaaaaaaaaaaaaaatttttttttttctcctacaaccctaaaaaaaaaacaaccacttttccctttgttggaggtctgacttttctaatttctgcttctccattcaaaatttcaattcttttatcactgctttccatttcacctcatttccgccaaaagtgtaagtggcacatgtccttcttttggttatttttatttttga

SEQ ID NO: 79606 - DNA, 1405 bp, Heterodera glycines
  Genomic contig location: Contig_ID=SeqID_15354; Location=1252..2656; Strand=+
  SCN-specific regions: Sequence locations=1-197,220-295,408-566,601 -628,651-679,711-758,874-898,920-943,1033-1405
atggcatttttcaacaatggcactttgttgtgctactcactaagagactataacaacaattcagttggtaaaatcgttttggttttttaatggctaaagagcttttaaaatctattaaattagagagttgaatttttaaaaatgccggcagctgatgggcgttgaaaattgattgaccggtggtaggtagagccggccctttttcaaaaacccaagtttttgggtgcccccagtccacgttatttcaacaagaaatcacggggcggattgcgatacgcttttgccactttaagtgtaaattaattgaaatttcatttttaaatatttatgttcaaatataaaaatttacaaaaattgcttattaattttcaagtaaataattttttttatgattatcaaataattttgcctttcatttcaccatacaatttattaaactgttaattaaatttaatgtcaaatgctggcaatgaaaacatcgaatagtgcggttagtttttttaaaatttgattttcgatagttttaataacttatcaatagaaagagaagctaattagctaattacttattattaattttgttatttaaaaatatttatagtttttctttatgtgttaagtagaattgggattttaattaagggaaaaattgatttaattggcaagaggtttcgtcagcataataaaatttaatgaaaatatttatttttctttgggaatttgtaggaactttttttttgtaaaatcaatagagtcactataatttttacaataaaataaatatacaaatttttgtttaagaaaacatttaattattttaatgaattgtttaaaaatgaaattattgcaataattctttttaattatatttttggtcgcccaaattactcaaatcgaaacagaaatgaaaaagttggaacaaaagtcatttgaagaaatatttggagaaaaatgggaagaaaaaggagaagaaagattggaagaaaaaagagaaataattaaaaaatattatcaaataaatgataaaattaacccaaatagaaagaaaatacccagaaaataatgcaataaaattgaaagaaaaatagcgaaaaaattgggaacaaatcgaacttatattcaacaatggattaaagaatttggtcttcagaaacaaatactaaaagctacaaatcaaaacatgatgaacaaaagttagaaattgttcaaaagtttattgcaatgaaaaatgaatataagcaaaaaagaaaatattcaagaaaagaatggaaccaaaattatgcagaaatttgtaagaaaattggagttggctatgaaacaattaaaaaatggaagaaacaatttgggatttgccgaaaaataaacacggagaaacaaaatggataaaatgaaattttattggaga

SEQ ID NO: 79607 - DNA, 219 bp, Heterodera glycines
  Genomic contig location: Contig_ID=SeqID_2413; Location=550..768; Strand=+
  SCN-specific regions: Sequence locations=1-219
atgtttgctacaccggaatttatggatgccgaagacagtttgatggagatgaaatcgaatcagttcaaaatggacaaaaatgagttcattgccgcggagaaattgatcgacaaggtaagcaaaataacattttaatgatataatgaaaaatgaaattgcttacatttttaggactactacagggactttggcgatatctttgacccggatgtgaagtaa

SEQ ID NO: 79608 - DNA, 1373 bp, Heterodera glycines
  Genomic contig location: Contig_ID=SeqID_2414; Location=49..1421; Strand=-
  SCN-specific regions: Sequence locations=1-499,523-1373
tttcgttcaacgccgtctcaaactgttctcaaagcttggatctgctgatgacagtgccttggtcaaacaacaatttgctcaacttccccatcggaatgccttcgtccaatgtctgttcatccgagcttcctgtttcatggagcgcaattgggacggggaccaattggactcggtcagggattgcctcgccattcttctcttctgcccttcgcacaaaaaggcccattctttgctcattaaatgcttgatctctctaaaacaactgccggtaagcattttcaaatcccaaaaagtgacacccaaagaattgggttttgtcgttttttagttggccaatgaatgttttgaacactactgcactttgcaccattttgacgatgagcacacaactgaattgaaacaattgttgggcgacaaaaagcaagaggaaggtaatgaatgggggggattgaattgaaaagatttaatttgtaaaaattggatttgctgccgaatctcttataatccaaaaaagggaaaggaataatttacaggggaaaagctgtggaccccggagtacacaacccaccatcgtgactatgtgcagcgttacaccggccatttgaacataaacacggacatcaaagagtccaattggtttggccccgacgaccaattcattgtggcgggcagcgattgcggctcattgttcatttgggaacggaacagtcagtgcatcgtcaatgcactcaaggtcattttgactgacttggtacttgaaaaatctcactaacaaattttctatgaattagaaaaatcgcactaaattttgtggagaattcaaagaattaggaccccctctcctcacccgaaataagtgtaaaacaattcttaatggtttgtttgacgcgtttagggcgaccattacacagtgaactgttgccaaccacaccctctccgatgcctaatcgcaagttctggcattgacgacgtgatccgtttttgggagcccgcatcggttagaaagggacaataccatttaatatttattcgtcaattaactttagtcgtttcagttttttgaacttttcgttaaataaatgaaaagaatttagggataaatacgtggggagggggggggaacgattgggggaaaatgttcttctaaattcatttgaagaatttttgttgagggtataaactgtagacggactcagcaaacgcactaaatattcgagaaaagggcgtgatttcagactcaactgaaaaaggcaactgatgcgaatttcccagaggacgcggaagatagaaacatcaccgaactgtacgaactgatgagacaaaaccgtcgtgccagaacaccggaattggtatgggagcaactgctcaattcg

SEQ ID NO: 79609 - DNA, 403 bp, Heterodera glycines
  Genomic contig location: Contig_ID=SeqID_2415; Location=478..880; Strand=-
  SCN-specific regions: Sequence locations=1-102,125-403
atgtccatcgttgccgcttctgtgctggtgatcgtcacgcaatgctgcggctgcgggaaggtgaggccggcatttttgaaatttaacatttgagtctaatgaattttccacttttcagaaagatgctgccgaacaacagatggcgccgactggggaccaaatgcagcagggaagcgtggcaaagcagggctcacaaatgggacagagtgcggcacaaggcggcgcctccaagatgggacagagtgcggcgcaaggctccaccatggcaaattcgcagatgcccggcttgtcgacctacgcaggtgggagagaagggcgtcgattttacttgctttttaaactaaatctttcaattttaggcgttgcacaatcgccaactccaattgaagtctcggcctgggcg

SEQ ID NO: 79610 - DNA, 492 bp, Heterodera glycines
  Genomic contig location: Contig_ID=SeqID_2415; Location=1975..2466; Strand=+
  SCN-specific regions: Sequence locations=1-492
atgaccactccagcaaacgcggcgagggcccggagtgccaaggcgaagctgcgcgatgccaagcggaggagggcggcagttggacgcgcaggatacgtaagttgaacaaacccccaatccaaaaaaacaaacaatgaaatttcccaaatttcagacaagaaaagcgcagcggggcgagcgatgtgccatctgcatgaccaacgtgagcgccatcacgcggacgacgctcggctgcacccatccgttccatcgccgctgcttgtatcgctggatccgctaccacaccaattgccccgtgtgccgctacaacttcacccgcactattccgcgccgtaactaaccgctgtaagatgccatgtgttgtgatcgccatacgatgtcatttgttgtgatcatatttgtatcccattgttaggttatgcgtatgtatttgtacaatggaatgtatgttcttatatgtattctgtatgtatatataatactcgtcagtaa

SEQ ID NO: 79611 - DNA, 709 bp, Heterodera glycines
  Genomic contig location: Contig_ID=SeqID_2417; Location=171..879; Strand=-
  SCN-specific regions: Sequence locations=1-1,71-273,295-432,455 -555,577-709
atggtggtgctgctgctggtagtggtgtctgctgctgcttccgccgctgccgccctttttgctgtcactgtgacgtgtctccgctcggctgtgagttctgcttgcggtggacaacgagtgcccgtttttgttgcttttgtgctcgtgatggctctgctgatccctgctactcctgcaattgttgttgaaataattgttttatcgcagaaatggccaaccatatccaatcccgaaaatacacacaaaggtgagccaaaaggatgcttactacaaattatttgatgacgaaaatgtcacttttaacaatggtgcatgccgtataggtaattaggactcccaattctgctgatttatcagcattttttcttttcaaggtgtcaaagctggtttttgaaaattttcagttgggagcccttcgtataacacacaaatagaagagatagaaaagatcaactttaacacaaacaattttcaatacaataccagctaactaactgtaagtgatggctattttcgctaaatccgccgactcgtcaactaaccgtttccgagaggacgtaaatttgttacaacttgaaatttgagttcgctttgattctttgtccctgaaaacatcaaaaacataaagaagtcagagtagatcaaacgaacgagaaaagaaactcattcaatcaaactaacaatcagattttgctttgttgttaataaa

SEQ ID NO: 79612 - DNA, 960 bp, Heterodera glycines
  Genomic contig location: Contig_ID=SeqID_2418; Location=292..1251; Strand=+
  SCN-specific regions: Sequence locations=1-12,144-259,285-475,497 -684,707-960
  Gene Ontology: Mol. function=protein kinase activity; Cellular component=transcription factor complex; Biological process =regulation of mitosis
atggtcgcgaaccctccgccaccaccaccaccgccgccaattccatcgttcagcggcgataccaccactgcatttcttgctgcaaccggcgcgcctgtcgttgcaccaccgccgccgtcgacgcctccgcctccaccgcccccagagaatgaacatgctggggagaataaaggtttgacgcgccatgcaaaaagggggggggggcagagaaaacaaaaacgattacattattaatttcattttagtgggttccgctggctcaccgccgccgcctcctcctccagtgcccgttcctccgccaaaacgttgcagaccgctgtaagtgtgccaagttcttgattttccaatggcacttgtcaatctatgctaaactggtattattgttctaacagttcggtatatgccaggaatatcggttagcaaaaaacctgactctcttgtccaactttttgtcgtaaatcgtccgcctgaattattaaagcattgagccctctctttttctatggaaccccacttttctttttgctcgaccctttttgtttagtgtgctgaaacctcgcgatttgccaacaatctccgagggctggggcatcggaagtgcggataaattccgcattatcgaacaagtgggcgagggcacgtacggccaagtctacaaggccagcgatggacaaaccgggcgaatggtggcgctgaagaaggtgcgcttggagaacgaaaaggagggttttccgatcaccgccgtgcgtgagatcaaaatcctgcggcaattggaccatccgaacattgtcaaattgttggacattgtcaccgatcggacggggccggcaagtgcagaacagtcgccgcagcagcagtcgccgagcatcggcggcgatttgtccgcacaacgcaagcgacgctcgtccacgctgaccaacagcagcactagcgggggtcaaccagcaggtggtggaggtg

SEQ ID NO: 79613 - DNA, 1069 bp, Heterodera glycines
  Genomic contig location: Contig_ID=SeqID_15355; Location=250..1318; Strand=-
  SCN-specific regions: Sequence locations=1-32,54-73,102-118,140 -228,264-1069
atgccaaaatccgagcgaaaaattggcacggacaataatggacatcaccaaaacaaaatggatgaaattaaacaggaggatgaggaggaggagaaggaggacaatgtaagggatgaaaaattatacaatattaaaaatgtgtgcattttaagacaattaattatcaaaaagggcacgaaaatgggaaagcaaattttacaccaaaatcttatggaaaaatccttgaacaaaaaatgttatttaaatttatttaaaaaaattttggtcactattttatcacttttttgccatttttcgtcactatttagttaacaagggatttttcgtaacttaaaatccacgccttactcaatgaatgttaattattgcagctcgatctgttgaaggcaaaaattttgtctgattttaacaaattggacaatgggaagaggaaatttacgagcggtgctacgctgggatatgtgacaccggtgagtgtagtgaaaagaatttactaagcgattaaaacttataaaaagatgtaacacgaaaaccgcaaaaaatcagaatttttgcatatttttatttatgattatatctatgatttttgaaaagccaataaagcttgttgcgagctttcgaatgataccaagtttgttggtcaacaaagaaaaaagttatggtgctttaaacttagctcaaaatccgattgtgtccggcctaattccgaaccttggataatttcgaacaaaaaatcaaacttaattttcctcttttcgcgtttttggtctaaaatcggtttaaaagatatttattgaagcttctcaatttttcgagttttaaaccggtttaaatgcttttccgcgcccaattttgagctgttctatcgttctcagcgcctaagaaaacctataaaagtgtttatgcgacttttcgttggtaccgtattcgtcaatttttccttttttagtttatttccttacatttaaaccggttttgaaccaaaaatgcgaaactagaaaaattttaaatttcatatttttgttcggattcggaattcgaattgtgtcgaaatggctatcagaataaa

SEQ ID NO: 79614 - DNA, 458 bp, Heterodera glycines
  Genomic contig location: Contig_ID=SeqID_15355; Location=1927..2384; Strand=-
  SCN-specific regions: Sequence locations=1-458
atgtcgcctctccgttttatcattgcctttcttttggtcgttttgtgcgctttttccgcactgataaccgcgcaagaagagagagttgacaatgaacctgctgctctgcgcgccagacgtgagtttttattaagcaattattaattaattacatgccaaatttaaatggacaaacattttaatttaaatcattcgaaaaaaggctttttgaaaattgaaatgaaattcaatttaaaagtgccaacatttcagaatatttatgtaaataattcttttgtctgtttaggcggaatgtacggttcgccgtacggcggcggaatgggcggcggcggaccatggggaggaaatttcggaaagaaatgagaagggagcaaaatgtggggatcaagacgaacagaacaagccatttgattgaatatttgtgaaaatagtaaatataacaattagaaagaaataaa

SEQ ID NO: 79615 - DNA, 667 bp, Heterodera glycines
  Genomic contig location: Contig_ID=SeqID_15356; Location=431..1097; Strand=+
  SCN-specific regions: Sequence locations=1-295,317-667
atgctgaagcggaagcgttatttgccaattgatagttatttggaagcgcttacaattccgttagaacggaaacaaaagcgagaccaattctaccaaaatattcgctcgttctacaaaaggaaatggtgactatttgtgcaaaatagcattgttaattttctgtatttcatctcaggggcttcgatttcaaggcgccttcagcgaacggacaggagctcgacctttttgagatgtacgaagcggtcacttttctcggcggctggcaaaaagtgacagcactgaacagatggagcgaaggtggccactttacacaaatctttctgctgattttgacatttttggtcgatgttcggccaactaataataatttattttactacaaaagcattttttgccccgagtaaattcagccgttagcatttgccaattttagtgctgcaactgctaaagattgatgaaaatattcaaatggctgagcacgccgttcaattcctttacatgcgctttctcagcaaatttgaacagagcgaagcgggcaacgacatcagcgaagagcacgaagcggaactgatcagcggacgcaccaatcgtttcaaaacgtttgcctccctctcacaagcgaactgtgcagagccacccttttctgcaccaaaaggtcggaaaatga

SEQ ID NO: 79616 - DNA, 268 bp, Heterodera glycines
  Genomic contig location: Contig_ID=SeqID_15358; Location=163..430; Strand=+
  SCN-specific regions: Sequence locations=1-268
cgtgttttttgccatcgctttctgtggccaatccgtcggtcaaattaggcattattttgggctttgtctttcttccctttccctttgcttattttaccgttttcagctcatccccgatgttgtgaaggcgcgtttggccgggtctctgctcttccatctgatcgaatatccctctctgatcgattccctttctgaccgtgggaatgatcaggcaaaacggaattggccattccaattggacttaaatattcagaaattcgctggctag

SEQ ID NO: 79617 - DNA, 1086 bp, Heterodera glycines
  Genomic contig location: Contig_ID=SeqID_15359; Location=1121..2206; Strand=-
  SCN-specific regions: Sequence locations=1-412,443-472,497-620,659 -900,935-1086
atgtcgataggcatcaggtatggcacggaaagacttccgatttccgacatttttggggtcggaattccgacttcccaaaatttttggggcctcggaatgccatccctgataaggaccgccggaccccctgttcctagttttttgaaaaattgcaccgcaaaaaagtgggtttgaaaagaaaaaaatagttaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccacgcgggattacgggattttggaaattttaaaaaaatttagaattaaattttgaaaatctccaaaaaactaaatatacctggccattttaaaaaagaaattttttagaggctggcggtatacgtgaaaaggggttaatgggttgatcaagatttttaatggtcagagggttggagatagattagccgacaaattgttaatgggatcaatctataaatttaacgatttccctatttattatatttttgaagaattttttatattattttcataaaacttttatgcaactttttcaggcaaacattaatttctggtgattacttactgatcaacgatcagccaaaaaagatcttttacccaaaattgattttatttattgacattatttggcttggcttcatttttaaatgctaaaatggcagtggcattggtgaatttccaaaaaaatattggctaatcttctccaaaccgaggccccaccaatgataacaaaactagtgattcagaaaagttttatattaattaaaattgaattattattaattgggtatccctttattattaatttttcaaatggattagacttggattttccgttaaactgcgcacaaaattggatgtagcaattctaagtcgctagggcacttatgcatattatactgatggcgcgatttggattaaccggaaagggaataaa

SEQ ID NO: 79618 - DNA, 68 bp, Heterodera glycines; identical to SEQ ID NO: 70099
  Genomic contig location: Contig_ID=SeqID_15359; Location=2121..2188; Strand=-
  SCN-specific regions: Sequence locations=1-68

SEQ ID NO: 79619 - DNA, 85 bp, Heterodera glycines
  Genomic contig location: Contig_ID=SeqID_15360; Location=557..641; Strand=-
  SCN-specific regions: Sequence locations=1-85
caccacgccgaacccaaacgccagcgctttgccggccgctgctgcgatggcagccgctgcaatcacagcaaagattcaggcgcag

SEQ ID NO: 79620 - DNA, 2172 bp, Heterodera glycines
  Genomic contig location: Contig_ID=SeqID_15361; Location=1..2172; Strand=-
  SCN-specific regions: Sequence locations=1-292,314-328,364-706,728 -767,790-806,829-958,995-1459,1486-1738,1761-2007,2029-2108,2130-2172
  Gene Ontology: Cellular component=nucleus; Biological process =cystoblast cell division
ttcttttttaaatgaccaggtatatttagttttttagattttcaaaatttaattctaaattttttcgaaatttctaaaatcccgcaatcccgcgcgggatcccgcaaattttaaatgcggaatttatacctgcgggatcccgtcccgcaaaaattttcagtaccaatcccgcagcgggatccgcaaatttgaaatttccggtctctattaattactgaaatttctttgtcaaatgaagtttaaaaaatattatttgatttgctgtcgaattaaaattatgtatacttttatttaaatacttgtatttacaaagtacaaatttttcgtgaaattttattttttttgaaaaattaagaaaattttctatacccggttttaccgggtacccggtgtagaatgttgtaccgaacccggcttttcaatacccggacccgatttttgcccaaatacccgttcccgtctaaccctactctgttcaatatcttgtgactcagttgaccagtcccaaataaacatagacatgcatataaatggtgtgcagttggagaggaaaatcgattccttttttctgaggcatagaaagtattgaagacaaaaaaatgtacatgtcccaaatgtattactaaaaacggatgggatacaagcaggacacagattatcgcaatgctatttgcaacaatttcagcaagcaacttttgttttaataagtgtctgtcggcattttgttaaaatggatgtttacgcgagttatgtgactcaacagaatgggatgaagcagcaaccgcaacaaaatggtaccagcaaattaaaataaatagccaataattgtcacatatttttagcccattatgcgacgagcactccgccatccgtcgattctccgtccgcagccccaaccaccaaatttgtcgctatgcctttgcttcaacaaaccgcccgagtcagtggcataaataattttcttttgcatacaaataatttaaggtttttgttgggcctgggcagcagaaagaagcacaactgatcggacttgggcttaggaaattgcgcacttatgaaaaggaggacttggaacgggcgaagcgttacgcgatggaccaatccgtgaaatatgtgatgctgaaacagcgcgaggcacaccaacagcaggtgatgtgtgatcggacgatgagcccgaccaaaactgacaatgaatgggcattcgttggcattgtgttttgggaattgagtcggtcgaccgttgtgacctggcattatccctccgaccgttgtccaaatgggaaatgaatgctttgtttcccaaagtcattatttgttgcccctcccttcagaatggactccgcaaatggtaagactgacccgctgcagacgaaccattctttcatttgcttaaccattcatttttcaccttttctcccattaagaaggaaattactaaaagggagtgtgatgggacaattcacacaaacaaacaaacacagaaaatcagcagaaattttgtgctctttgtccgacgattgtgcgttattaatgctgtcccccaatttcagcaacaaaagtctccctctacacacaggcgctgtccatcatgtccagggtgtacatcgggtcaatcaacttcgacataggcgaagagcacctgcgccaagtgtttgcaccgtacgggcccatcaaactgatcaacatgtgccgggatccgtccaccggggtgacgggccgaccctcggggaggaacacttggattgtttgtttcgttttttcagaatcacaagggctttgcatttgtcgagtatgaggtgcctgaagcggctcaactcgcacaggaacacatgaacggcaaaatgatgggcggtcggacgataaaagtgtcaccggtgagtcaatcattcaaagagtgcaaaacggaaatgaacttggggtttaacagagggactcccaattttatgagaccgccgaatatatgaaaagaaatacgaaggcacgattaattttgatggttttttgagtaatgtcataacatcatctcaacagattatctgacagaagattaacttctgatcaatgtggaaagaaatagtgttaagaaacgcagaaaattggacagggattaaagaaatggaaaaaagtgattaatgaagagtggaattgccggagacaggtgctagtgcattt

SEQ ID NO: 79621 - DNA, 1585 bp, Heterodera glycines
  Genomic contig location: Contig_ID=SeqID_15362; Location=1038..2622; Strand=+
  SCN-specific regions: Sequence locations=1-26,48-71,104-115,152 -600,622-808,850-1157,1201-1585
atgagtggtgaatcgaaagaaaaacaaccggcacagaaaaacccaaaagctgagactggtaaaaaattcactaaaaaaattcattaaatttaaataaattttagaaaacattacactccataaaaataataaaaacttttcaaaacttttctgaaaatacaaagcaaattttttctttttgaacattagattcataaaaataacaaaatttactaaaatttcggatctatgagccctgccgttctgtctgttatcaaacagcagcactcaaattacccttactcgtccggcggagtcgaacccacggcactttcaattccttggtgggctctaaccgactgagctacgggcccaaggagattattattccattcctatatcttggatgctctcattttcaatcattttttggcaatggcaaatacattttgccaaccaaaaaaataacgacacatttttcataaaataaattgaaaattttcagcatcgaccaaattgccactggattatgacttgcatcgtgtggctgcaaaagcggctggcaatgtgtacgcgtggcttccggccgacaaacagcccaaaaagcttgcggacatcaaaccggcggcaccggcggcaccattgccgccagccgattatgacgtggagcgggtggcagcaaaagcggcggaaagcgtttacagttggttgccaaaggagctacagcccgaaatgatgactggtaatgcagcaaatttagaatgcatttctccaattttttggtattaatcgatttccagggggccaaacaattttaatgtccaaattaggagacaaatcctccaatatatttccagaattaaatttttgatcaaattaagagtgaaatgaaccaatcgatttctaggccaaacaatttttgtgccaaattaggagacaaacctctaaaataatttttggggccattcaattttcgtgccaaattatgagacaaatcctccaatctctttataggctaatcagttttttcatcaaactacgagactaatcctccaatctatttcgagacgcatcagttttcctaggcactaagccatttttgcgctcaaaaccaatttttgggcgctagctaacccacttgcctgaaataatttggaaaattccatctaaacaaacggaaatattctaatttaaataaaattttaaaacaatttattatttcagaggatgaacgtgttgaatttacagctgaagttttccaggacatttgaatgtcatcgaatcattttttggtcttcaaatgattcagtttagcgaaggatgacattttattttttattcatttttgtaattgttcaacaattttataagatataaaaaaaggtattttgtttgatattcttttgtgggtcaaattgtacaaaatattttttttgtgctagaaactctctctgattgataagaaaataagtaaaaatgttatttttggacttttgaatgcgagaatatagtcgcaaaaaaagtaaagacctaaaaatccgttccatgaaatatggactaaaaagctcaaaaatagccaaatatggaccaaaataatgactaaaaa

SEQ ID NO: 79622 - DNA, 1187 bp, Heterodera glycines
  Genomic contig location: Contig_ID=SeqID_15364; Location=466..1652; Strand=+
  SCN-specific regions: Sequence locations=1-312,334-796,818-1187
atgaaagaattaatagggtcatatttttatggtcatccaaaaaatgtaaggacatttaaatgcataaaaattgttcaaacttaaattaattcactccgtgcttgatacgaaaagatagcccaaagattactctattgttctgctaaagaaaattccttaataaaaatgcaataaacccaaaaaatacacccctaagaatcgacctaaaaaaatttcaaaaaatatacccctaataatcgatctaaaaaattttttgaaaaattttctcaaaaattcatccccaaaaattttttttcttgacaaaatttttgatttaaaaagttaaatatttgctaagaaaatattctcatttgcaactgcattcagtaaatatcaaaatttttttcctcaatttttggctgaaaattatatcactatgcccgaaccccgaccccgaacgattttgtcaaccccgaccccgaacttgctgaccacgacaaccccgaaccccgacttttccaaccccgacggtcgggggcccaaccctacttttacataatattttttctgcgcatataggaaaaatgggctcaagaacagcatttcttctacgttaaatgcacatatataaccagggttcgcagatctgaggctttagcctcattttgtggttttttgataggtcaatgaggctaaattttcaaaatgaggctttgaggctttttgtggttttttgagaaattttgagtctttttgaggcttttggggaaaatcctcagaatcttttaaattttgataaattggcataatgtttggcaatttaaagaattttttaaatgaaaatatgctaaaaatatggtcaaaattcttaatttttcccccggcggcgcctatcggcaccgccggaccgtaaaaatccttaatttacaagcaaaaatttgctcaaaatcgcaaaatttggtcatttttcggacaaaatctgttaacaaatcgcattgaaaattacaaaatttttcccggcggcgcctatcggcaccgccggccccccgtgcgctccaaaagttttttgggaaaagcgccgcaaaaaaatcaacttcggtttttcatgcttagaatttcaaaaaatgtttatttcgaaccaaaaattgctcaaattgatcatggacaatcaaaaatataacatttgaacattttaaacgtggttttga

SEQ ID NO: 79623 - DNA, 188 bp, Heterodera glycines
  Genomic contig location: Contig_ID=SeqID_15366; Location=1696..1883; Strand=-
  SCN-specific regions: Sequence locations=1-159,181-188
ctggaaaatttgccaggaactgatggatcacttgcggggaaatttcgtgcagtgcgattgcgctttgtgctaaggagaactgattttgagatcgacttttgccacattggatgattttttgtgaagttatttgccaaataatggcgtttatttatttatcgtattgttcaaaatacaattttaaacat

SEQ ID NO: 79624 - DNA, 2750 bp, Heterodera glycines
  Genomic contig location: Contig_ID=SeqID_2419; Location=1095..3844; Strand=-
  SCN-specific regions: Sequence locations=1-18,45-1363,1385-1951,1974 -2108,2131-2154,2176-2286,2308-2326,2385-2750
  Gene Ontology: Mol. function=pre-mRNA splicing factor activity; Cellular component=nuclear matrix; Biological process=mRNA splicing
atgtggcaacttgtggatctggaggaggaggagcggaagcggcaaaaacgcgagcggaaggagcggaagcgggcacggaaggaggcgaaacgtgcgcgaaaagaggcggcggaagcggacgaagggaccgcagaggtggaaatgagagacaaaataaagttgaaaatggcacttggtagattcgaaaatttggcacacaccgaaaaaaaaaattatttacaaaaatttcagacagaaaaacagctgcgcaaacgactgaaaaagaagagtaaaaagcggaaaaaggacaagcaagtttcgcatgagtctttgactccgccgccgacgccagcggaggaaacggcgaaagacaccgccggggcgagccgagcggcggaaaggttcgacatttctttattagtggctatatttcactcataaaaggtgaaactccaaggattttttgtttttatttttgacacaaatcggcagccattatgacaaacagcttttccaatttggtgccataaggatgtcagttctgggcaacgttcgccaaaacccgttttatttcactctttaaaatgctttttcacaacaaaaattgattggttcctctggtgactcaaacaccatttaaatatattcatgtcagcagaacagcttttgtcgccgcgccgaataacgccgccccgcgtcggaccgccgcctcctcagcgacttcgcgctcggtcgctgacatccgcagagacgaggatgccgtcaagcgtcgctcgccgtccattcgtcgaccggcgcctgagcgaattcgacgcccctaccggccgctgcctccgcgtcgcgttagcccacagccgcgcatgccggtgcgacgaaaacgaccgctgctgccctcaaagtcgcagacaatgacccatcgacgtcgcgttgtccgccgctcgttgctgacgccgtcaccaccgcctgctgcacgcccacgcggcgatactctgcggccgttatgcgcgcgctcactgagcccaccaacgccgctaccgccagcgcgtgtgacgcaaatagagcgggcagtttccgtgtcatccgctggtgcgtcgtcggtttcacgcggcagaagcaggtctcgaaggtgcttttgcctagctaatatgccctatttcggcttgggaatttagggaccttttttgccatacaattttcaaaaaataaaaactatttaattttaggtcctccgccgcgtcgtcgacacggcgctcacgttgccgtgggtccagtggcagcggaagcagcagcgcttcctcctcgtccagttcttcttcctccacacgctcgcggcgttcgtccgctgccagcagagcgggacagagcagtgacggcagccgaacgtacagctgtaagttaatggacataaaggggaccattaattgttcagagagataattccctttaagccgacgatagcgataatgagccgaaaaaacgacggactgtccgatcgtacgggcctgatgccaggtgttttgcaatgtttaatttcactttttgacaagccaatttttttagaacatttcctaatttccactgctttcagctcgtggcgaatgtatgagaaggcacgggcagaatttttgcaaaagaaattggcagcgggtggacaggcgagaatttcttgtttgattaagtgacaaaacccatgtgcatttggggagaaaaaagaaccgaatgtgactcattatttgaatcttttttagctgcctgcgcatgtgcgcgacccgaaactcatctccaccctccggcgtccgtacattccaggagcaggacggcgcagcacatacggcttggcaaggacgatcaatggggaaacaacgtctgggacaacgacagcaacaactacgaccattttgggactacgcggacgcgggtcagtgtttaagtcaataagagacattaaaaaccggggggggggcatggatgtggaatttgggacaaaaattttcattcattgtcagtaaaacattcaaatttacagccgtcttcgcggccgtggtggccgagtgaacctccgtttctttactcagcgaccaaaggccgattatttggacaatcgtggacaaattgacaagcgaaaactgttggagattgccaccgaaaatgccaccaaattagccatggtctgacaaaaaaaaaaaaaaaaaaaaactttcattgtaaataatgtcaatttaggaaggaaaattacccaagggggccgaattggtggacacaattaaaatcaaatcagtggaacagttggcaagtatgttagaccataaataaaaaataataatggagtagagacgtatacagaaaaaacctctgtttattaaaaaatccaaaataaaaaaaagaagagaaaaaaataaaaaaaactcgtccgacggtgccgagagggaggcaccgcccgggaaatggaaaatctcggatttatttcttaagaaatatgctaaaaattttagcaccattaattaaatttagcagtaaataaattggtcctttcagcgctctgtaagcaggtggcggatgaggaggccgcccgtccagtgcccttcaccaaatggatcaacccgaacttcccacttggcgtcgccggaggcgcaccacccaagcgaatgcatcgcgccggagggcccgtgggcgatgacgatgactatttgctgttacaaaaagtgtccagcggcagcgaagaggaaggcgacgaggaggagcgattccagcgtaagaagacggcattttga

SEQ ID NO: 79625 - DNA, 848 bp, Heterodera glycines
  Genomic contig location: Contig_ID=SeqID_2419; Location=7540..8387; Strand=-
  SCN-specific regions: Sequence locations=1-44,66-439,466-768,790-848
tcgtcccgtttctcgcgccttttgttctccggccaccgcactttgctttggctcttcggctgctccctctacgccctctattgggccgtgttcgtcaaacccaccgtttacagcagtgtttacttcggctggttcttttttcccattcgtcggctatcgccccgataatcaacacgaggtaaacggacggacaaaagtcgaaaatatgctcgagattgctcttcctttctcatgaatttgataagtctcgacaaaggcctaaaagtgccatctaaaaaggcatttcccttaagttacagttcgctgttcaactgcacactttccacgacattttggtggcgtttctgtgcccgggcatttatctgatctttgccctcgttctttgcgcttcgagttacgattttaacacaatgcaaaaaaaggtgttgatgggtcacagaaattaaaataaataaattaataattgggattgtttccgacctttctgcaagtgtttttggtctctctgatcaacactttgaccggcagtctctacgtgtacatgcaacacaacgacttgcgccagcaatggatgctcactctcgccgaatttgcttggtatgtaaacccaagtgtcttttcaaatttgctaaatcctaattaacttttcaggtttcatgcccacggtccgtccgttttgtcggcttttctttttgaattttaatttttttccacttttcccaaggatttcctccggtcatttatttggcactgaacaaaaccatccgcaaggacagctgctcattgttcatgaaagtgttccagcggcaccgtatcagctcggtgggcgttgttgccgtgtccgcccc

SEQ ID NO: 79626 - DNA, 787 bp, Heterodera glycines
  Genomic contig location: Contig_ID=SeqID_2419; Location=4622..5408; Strand=-
  SCN-specific regions: Sequence locations=1-787
atgtcgccccgttttgggtccaccagtgacatgacagccgagccaatgccgagcagtgcccgctgcaactcgctgatggcaatcagcaacgaagaggacgccgacggggagtcatcgatggcaccgatgtggtcgaacatttgttgggagaagtctaaagaatggggagatgagggcaaggtcgacgcaaatttgagtctattcggtcacaaatttcattaaatcatcacccttttttatttgctgtatttggcgttgtccccctcctcctccgctggcacttccatctccaacaccgccgtcccctttttgatcgcctctcctttcgatgccaaaatctcttcgatgttctttttgccgtccaaatcgctgaaccagcccaaattgtccgcaataatatggtgatttctgcagtgatcgcatcggatcagcacaacgccgttttcataagctgaacgcgagaattgcttaggcccctaaatttggggataatcgaaagggtttgcttatataaagcaaaagccatgcctgtctcgtggaacagactttacacgtaaaaatgattgccaattgcgatttgattcggccgatttcctcctttttcgtctcaattgaagagcaaaaattgcggaaggccgaaaaacttatcaaattttgactatgaattaaaagcggcgacacagaagcaacttgtttggtgtaatttgtaaaaagaagtttataacaacgttgcgatttttgaagtaattgaatggtaaaacgcataaattgtcttgaaacaaataaa

SEQ ID NO: 79627 - DNA, 435 bp, Heterodera glycines
  Genomic contig location: Contig_ID=SeqID_2419; Location =10010..10444; Strand=+
  SCN-specific regions: Sequence locations=1-397,421-435
atgtggcagaagaaggccaccacaactcttaagccacgggagaaagccaaagagaaagtgcgaaaaaggtaattatcgtaattagttgaaatgttgttattacatgctaaacgattgccagtgcatttggcactaattaattatcaattgagttaatataaaatattctaaaaatatttgagtaattcttacaaatttttttagctgttaggcgtaaatgtaaaagaaaaatgacgacgcattgtttaattgcccattgcttttcccattggcacgcattctctccaatttggacaatttgctttttcttcaaatacaaaaaggaccaccccacgcattattaaaaatggtttttgccgtccctcccccctccctttctcattttttcccataaactattaaataatcaaaataatttatagaaagaaaatttag

SEQ ID NO: 79628 - DNA, 1204 bp, Heterodera glycines
  Genomic contig location: Contig_ID=SeqID_15370; Location=858..2061; Strand=-
  SCN-specific regions: Sequence locations=1-23,69-682,704-878,900 -1128,1150-1204
  Gene Ontology: Mol. function=ATP binding; Cellular component=nucleus; Biological process=DNA replication
atggagacaaaagaccaagtggccattcacgaggcgatggagcagcagaccatctccatcaccaaggcgggcattaaggcgactctgaatgcgcgttgctccatcctcgcggcggccaatcccatcggtggcaaatatgaccggtcgcagccgttgcgcaacaacattgctctgtccgcaccgatcatgtcccgcttcgacctgttctttgtcctgctggacaccaacgataatccggtcggtcattttgaaattttcaagtaatttttggccgatggctttaggtggtcgattataacattgcttgtcgtattttggaaaaccatcgtcgggcactgcaccatgaacggtcgaagaaagcggtgtacacaacggacgaaattcgcaaatacataatgttcgcaagatgcttcagaccacacgtgggaataggacaatgataaatttggcttattccggaacagtgctttgattttgttatttttgtcgcgtctttcagctttccgctgaagctgaacgagcattgaaaagtgcgtatttgcgcttgcgcatcaacgacgacggcaacggcacgcgcgtgacagtgcgacaactcgagtcgctggtccgtctttccgaggcgtacgctcgtctaaaatgcgaagcggaggtgcggagagtggggcaaaagagcatttaagcaattaaaaataaacatttatttgaggtgaccgaagagcacgtgaaaaaggcgtacgaattgctctccaaaacgattgtgccgatcagtgcgccgcagatcagcttggacgaggaggacgatgtgccattttaaaattggttgtgcaagcgcataaaccccaaaattcaggctgattttaatgttgcgccccaaccgatggcggacattaccaaccaaacgcagcaggacgaagaacaacaccaaatggacatagacaccacccaatttatgggcgaaaaagacactgaaactgaacagcttggacgacaacgacggactgcgagcgacacagcaaaatcagccggcgctccctctgtctgtgccctttccgttgacggcggcagcgagggactaaaattgtcacatgaccagtacatgcgcattgcgaatatgctggtggtacatatgcgggaggaggaggagcgcaacggggacgagccggaatggccgggcacacgacagtcgcaattggccgaatggtaa

SEQ ID NO: 79629 - DNA, 2056 bp, Heterodera glycines
  Genomic contig location: Contig_ID=SeqID_15372; Location=768..2823; Strand=-
  SCN-specific regions: Sequence locations=1-254,278-548,570-655,677 -881,910-944,967-1179,1347-1852,1874-2056
atgatgttcctgatccgtcactttctcccatgtcattacaatgcggacgaagacgatgccgaatttgaggagggtgccctcgttgagtattgccgatcaaaagttgttcgaccgtcagccgtgctcaaacaaccgccattggttgttcggcgtccttcttccgcggtcaaaggaacacaaaatttgtttcaaaacggttaaaaagcgtttagaaatgaaactatttttataattacagaaaagccgaattcgaaagagaaaacaaacagcagcagaaacaacgaccaatttggaagaaaaacatttgagggcgaacttcgaaacggatggtttatcgatgagaagcaaaaacgacaacagaacgctcgaaggaacacggcaattgaagaagggcaacagccagcgaaggtgggcaaaagccaaccgacgagtggggggaccattcatttgccattaccacacactttcaatcgatgtttattttattttgtcgggtcgaatcgactgacttttgccgataattttgaagcgcattttaagccttacgcttttccaaacatcaaagccattcattggtggaacagagccaattcaatggaaaagtcatatggacataagaaatgagcgaattgaatttggggcagaggccgttgaggaagggagggcagtggcggtgcgaagcatggaattgccaggggacggcgggggaagggaagggacggttccttccgtctgttagtcctctcatttattcagtccttgggactcatttctttgtcagttcgttcttcctctgctttttgaggaatgggcttttggttagtttctgtcaatttttgtcattttgtttgggggggggcttaagcctcgtttcttctcacccttggcattgtttggtgagtgttccaatttttaaactcccaaattggcatggctgtcttttccatcatcggcttcttcttcatctcatcattcattccgtttctctttgtccgttctttttttcactgtttccttagctttcccttcgccgaaatgaatggcaatgccaaaatgtgtgtgtgttagaagaaatgtttgggatttggagcggatgcagaaggtggaatgggggtgaaattggctctttgccccttcggcttttcctttgcttctcggcttttccccctcccccccccactccctttctctctctctctctccctttctctctctccccactccctttctctctctccctctttttctccccctccctttctctctctctctctttctctctctctctctctttctctctttctctctctccctctttttctccccctccctttctctctctctcttctgccgctgttcttcctttttcactccataagtccacatttcttcctttaatctcaattcataatataatagttcttcattttttctcatagttcaaatggactctcaaatattaattttccaaaattgaaagtgtctattttaagtagaaaattccgctcttttccatccaatttaaaattccaataagcataaaatgtgctgttgactgccaatttggcgcaacagaggagactaatttagcgaaaattgcggcttcaatggccattcacacataaaaaaaaattcattttcgggcccaacattaatacataaattgactaaaatggcccttagttttaaatgcgattttggatttgaatgaatttttctgaccttcactaacaaattttatgatttggcgtcgcagatttcaacaggttttacagagattcaactaatcttaatgaatgtttgttgggtttccattcgcttttcttccttttttcccatgtcccccaattcatttccctttccttttcagatcgtttttggtggcaattctacggaaaagaatcgctggcgttcaaacagcagcaccggggctggcatcgcggaacgttccttgttgtcaagcgccggtgacattgcacgtggcagacaaatggcacatgtcattgacattgaggtggaagaagaaaaggggaaggaaacaccacaaaaggagtga

SEQ ID NO: 79630 - DNA, 443 bp, Heterodera glycines
  Genomic contig location: Contig_ID=SeqID_15373; Location=445..887; Strand=+
  SCN-specific regions: Sequence locations=1-133,198-443
aaaaatcgtgtcatcattttcactgtaattgtcgaactgatttttggagtgtttccatgcttcgtttcaattttgtacaatcaggtaaatcacattttttattaaaagttaaatcaaaatggacaattaacagaaaaattcttaaaaattttattttaataaatattaattttttaaatgtttttttacaaattattcaaagtgaacgtcgtcagttgctttaggtattaaatttgccaattggagccccaaactctggtctgaaaggtgaaattgcgatcacctgttgtgcattcgatggcgcaatgtgtggcatactgtatatgtccgttttactcaagcgtagccatggttcatctaccgttgctaatgccgttactactgtaccaggagcatccaaaaacttgcagaaagcccatgagaatttgccaaaaatctcatga

SEQ ID NO: 79631 - DNA, 311 bp, Heterodera glycines
  Genomic contig location: Contig_ID=SeqID_15373; Location=1539..1849; Strand=-
  SCN-specific regions: Sequence locations=1-253,275-311
ttcggcccggatgtgatcgaatgtcggcactgtgcctaccggcgatgggccgatgcgccagggaaaccgaccaacgcgctgaggagccacctgaaaagtaccatatgaatgtgctggcgcggtaccgtacagccataccggagagggacggtgggcatagcaaaactaatgacgaagaaagtagccaaaatggtgggatggacaacaacgacgacgatgaccaacaacgaataatgccaatgccaacagaggagggggcgggacgagaagggggcggagctcaaagcagcagaagcacggacatcgaatga

SEQ ID NO: 79632 - DNA, 1010 bp, Heterodera glycines
  Genomic contig location: Contig_ID=SeqID_15375; Location=2148..3157; Strand=+
  SCN-specific regions: Sequence locations=1-391,413-424,463-858,880 -1010
atgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatgttcaaacaaatgagaataatgaagacatatatatttcttgttcaaaatgtcgttattttcgcgaacaagaaaaaaatgttaatgtcaaatcgatcgtcgcatcagctgttctgcgacagggaacacaacttgttatgttgcagtcaaaccataatgctaactgtaagcccgaaaaattagagaaactggaagcagaacaggttgatagagaacaaagaagagaaaattataaatgtgagtcagaaggcaagattatttggcgcaaaggtttgggaaaagcacgagaatccgacttaaaaacagatattgatccgttagatgaaaattcgatttcgagtaattatccctcttgggtatcagttcgacgtgcttacaatcgtaggagacaacaattacaaggcacagattcgaataatccgtttgatgttcctgaacggttacaattaacaaaattaggatcactcaaacttctgatgggaaaaacaattactgaaacagaatggatgatctatagaaatcgagaaattggaactttgctttttgcatctaaaattcaactagaggctgctagatattgtaaaataatggtagcagacgctacatttgagttagcacctagaggatttagacaaatatggcttaaacatctcaatttgggctgagcgggcgtggcgttgtcggtttccttcatggtctaaaaattttatttagataaatagtcattttttctaaccggtaaaacaaatctcctctaaatttggagtgcgccaaatttgttcgattttggaaa

SEQ ID NO: 79633 - DNA, 210 bp, Heterodera glycines
  Genomic contig location: Contig_ID=SeqID_15375; Location=3316..3525; Strand=-
  SCN-specific regions: Sequence locations=1-22,44-210
atgcatccaatcaaaaaatttatatttttgtatcttatactttaccaaagtgtgaaaatcgaacaaaaaccggtacaccgtcgtgctatcctctctgtcttagcaattggaggtattgtcgctcttgttttggtaccaattgtggtcggatcggcggtggttggatatttgatatcctatagcatacatggcgttaatggaaaatgttag

SEQ ID NO: 79634 - DNA, 1354 bp, Heterodera glycines
  Genomic contig location: Contig_ID=SeqID_15376; Location=288..1641; Strand=+
  SCN-specific regions: Sequence locations=1-103,130-251,281-328,350 -1038,1060-1155,1177-1354
atggctctgcttaatttatgcattttaagtttatcttgttcatgttcggtgtgtattaattgtttatccaatttatccaatagtaacacttcactgctatatctaatataataataattttattttttacatgcgtaccagatccttttcgaaatggtttatcatgacaaaaggctgctcaagtttatgcttttctattcggcataaaaaattaaaatctttaaattccctcatttttatcgaaatatagcaaatttaattaaaatgaattattaaaatagtttcacattttatatcaaatatcaatttcgacttcaagtacgaaacttgaatgaaattatatatatgttatattgacaaggcaactcatccttaaaaccaatttctcgggaacggctgggcaaaccgggctgaaattttgcaccgaggggtagctcgagacggggcatccgggaaaaatacgaattttccgatccggtggccaactgagtaccggggaccgatttcctgttttttcgtgcagttcggggcccataacttttcttccgaaacataaatcaaaaagtttccgctggtaggaacctaagttgaagtgttgtctaattttcaaaaaaaattccaggcctctacctataataggaagggctgcagaaattggcaacttttcagtaccaactttgtccacttcagtaccgggcgaataactcattagcgtttgaactgagcggggggtggccagcggacttattgtagagttttgtaagcccgattttttcaaatttaaaaaattcgaaaattttcaaaatttctcgagctaggccccctaagaggtttttgggtttttgaattttatgattttttgccgatttttccggggaaaacggagaccactttcaagcaaccgtttttcgagctctatcgattggtaagtttttgaaaaaaattcggtttttttccggaaatagaaaaaatttttggcctgagcgggacatttgagtcccgggcctataactcgtcagggatcggttttagccaaaaattgccttagaacatttttgtagagcattttaaatgctatcgaatggtgtactataagtctggaaaatttcaaaatttttcgagctaggccccctagaaattttcaaatttttttttgtgggccaaaatgggggtgaaaattttttttctggggtattttgaggtgctgaatacgaatataatgtttattttaagttttggaaattttagaattttttaaaaattcgaaaatatttttcaattttttgacccttgggattttgggctaatatttgaaaattcataacaatgtgttgtattggccaattttaatgaa

SEQ ID NO: 79635 - DNA, 707 bp, Heterodera glycines
  Genomic contig location: Contig_ID=SeqID_15378; Location=79..785; Strand=-
  SCN-specific regions: Sequence locations=1-3,66-105,130-278,302 -472,508-524,548-635,657-707
atgggcgatgacgacgacaacatagatgataatgacggcaatatggatgataacgatgacgatgatttaggcatagatatggatgcaataattagagaattggagatggaagagggaaaggatggagaagacgaaggtttagggctagattatgacgaagatgacctagagggttctgatgatgatcctgcagagaaagaggatgaaccaaaaccaaatgtattagttgcttgcactttaacttttataccaatttattaagaaagcgagagctcctccaaaaaccaaaaccaataaaacaacttcaaaggtgaaacatgaaaactctaaattttattaattaatttccagatagcggccaagaaaggcaaaaagaaggttttggaaagtgaagacgatgacgaagatgacctagagggttctgatgatgatcctgtagagaaggaggatgaacctaaaccaaaggcattagttatttttattttaacttttaaacaaatttattaagaaagtgagagctcctccaaaaaccaaaaccaataaaacaacgtcaaaggtgaaacatgaaaatctaagtttttattaataatttccagatagcggctaagaaaggcaaaaagaaggtttcggaaagtgaagatgactttgaagaggattgggattcgggcgatgattactgggtattggcttggaagaaaagacaataa

SEQ ID NO: 79636 - DNA, 906 bp, Heterodera glycines
  Genomic contig location: Contig_ID=SeqID_15380; Location=1649..2554; Strand=+
  SCN-specific regions: Sequence locations=1-168,190-525,547-598,628-906
atgaaaaaacaattgcacaaattaagaaatgaacaagagtcaaaaattatttcccaggggcaaaattcagttaacaaatgtattagaaataaattatcaaaagttaatgaaattcctacgttaattgatagtgctggaaatatgttttccagtaatgagcaaaaatgcgaaatattagcagaaatatttcaaaaatcttttttagaaaattcagttgttaatggttcactgactcaatcaacacagaataagattaaactttctgacattgaattgaatgctggcataatttggaatatattaagaaagctccccaggcgaaattccacttcaccggataacattccttacattttattaaaaaattgtgctgagccaattacaaaaatattagctgacatatttcgacttgctttggattccggtcaaattccggaaatatggcgaacatcattagtggtaccaattttcaaaaaaggcgaaaaaactgatccattaaattacaggccggtgtcattaaccagcactgtctgtagagtttttgaacgaattttaagtagcaaaattttagaatttctgaacggtataagattttttgataaagaacaatttgggtttttaaaaaataggtcgactacaacccaaatattaaaaacaatggacgatatatataattctctacaaaaggatcaacaaattgacattatctatattgattttgtcaaggcgtttgattctgttctaattgatttattacttcaaaaaatcaaaaagattggaattgaaggaaaatttcataattttttaactatctttttaaaaaatcggagttttaaggttaaattggcgaagaattgtcagacagtttcagaatattttcaggagtgccccagggaagtgtcttag

SEQ ID NO: 79637 - DNA, 1050 bp, Heterodera glycines
  Genomic contig location: Contig_ID=SeqID_15381; Location=695..1744; Strand=+
  SCN-specific regions: Sequence locations=1-547,569-693,722-955,977 -1001,1024-1050
  Gene Ontology: Mol. function=serine protease inhibitor activity; Cellular component=cytoplasm; Biological process=regulation of proteolysis and peptidolysis
atggccaacaaagtgtacgtgaagaaaggcatcagagtgaagaacgcgttcaaaaagaaaattgaggaaaactacggtggacggatggaaacggtggactttgaggacatcgaagggacggcggaggtgggaaattgttttattggcatagtgccaaatcagtcccgaaaaatttttcatatgaaaatttcgagctaaaaaattttactttcataattttacgtgaatcatgtaaagcgctacttaaaatcgttcattttttgaaatttattataaacacagggcgggctttttgtttgtaaaaaacaattttgatagtgtcaagtcgggaaaagcgttcccgggcgttttctgggtctctctctgatcacgaatctgacaccattcatttcgatcaattcaaatctctggccgaattcgaatagaaaagcaaaatttttatcgcttttttgcctcagaaaatcaacaatttcgtggaggaagcgacccatgagaaaatcagcgatttgatcgcgcccgacgctcttgacaaggagagttggtaaaagttttaatttttgtttctttaactctatgacttttcaaaagtgttaatctaatacatagaaatacttttggttggcacacgcaaaaaagtcgccggacaaaacatcgtcgcaaaataactatcaaaaaaacaaaacaaaaccgtggtttactgagaaataaaatttcccttaaatttttttgtttccttgaaattctaaaaaaaaagaatttgtttacttacaattatgcttatcctggtaactcttcggcggcaattttcaaaaattacgaacatttttttattctttgccggcgattttgatggaagaagtaaaaaacaaattgtaattgtctgaaaatgctttctttctttcagcttggtgctgatcaacgcgctctacttcaaaggcgcatgggcgaacaaattcaacaaaaaattcaccaaaaaggcgacattttatgtggacgcgaacaccaaaaaagaggtggcggaaacaaacacattttaataattaggaaaaa

SEQ ID NO: 79638 - DNA, 910 bp, Heterodera glycines
  Genomic contig location: Contig_ID=SeqID_2421; Location=143..1052; Strand=+
  SCN-specific regions: Sequence locations=1-202,225-313,335-690,713 -791,857-910
atgatgcatggttcgttctgtgcaaatgtgactttcaaagggaactctacagaaatccaatggtttcaaaaagagattttactgatcgctgttcagatcatggatcacgcgaaaaaatatgtggaaaatgaattggtgagccatttttaacctttactaattgacaatttatgataattttaataacaaaaaaaaatcagtttgtagttataaacagggatgcaaaaaatattcacaaaaatgaccaaaatatgcacctaaatatgcaaataaaattgtcaaatatgtacaaaaacttcaaaattagggggtgaacaaaaatttatttctcataaattttatcggttatttttgtaattgcaaatcaaaaatttctcaagattctcggcagtgaaactcactgttgacccactcgcgcatccatatttggaaataattttaggcctaatcaattttttttcttaagggatattcaaatcggtaaatttttgacgaaaaatggcaaaatatgtatgaaatatgcagaacaacccaatgcatttgcatattttttgtatccctggttataaatgccaaaaacatcattactataaatattaaatactcaaaaaatgataatgttaaaaaatgttttttaaatgtattgaataatgtttgcagaaaataattataaatgttaattatatgataattgtttaacaaaaaacaaaatttcttagtcacaaaaacgggcacggatttaatcaatgaaattgcagtaaaaaaaatctgaacttttctgacatatgctgtaataataaaaaaagaataaatattttttttcattatgcattttgaaattattaaaaatttattacaggaaaaaacatttccgctgattgaaattggattggtcgaaagtaaaaattga

SEQ ID NO: 79639 - DNA, 564 bp, Heterodera glycines
  Genomic contig location: Contig_ID=SeqID_2422; Location=518..1081; Strand=-
  SCN-specific regions: Sequence locations=1-113,143-153,190-564
atggccacattgtggaattggtcttcgttcgtgagcggaaaatgccgtcgttcaaaacggtccagaacaacagacattttgccaatgtcgaagtattgtctaaattaaatgccatattaataataaatatttacaatattaagttatggatcgaaaaatgcaataaataaatatgttaaatgaaaatatgcgataaaaactgccaaaatatatggatctaagcccccaaaaatacgataaaagagataaacataataataataatcgagcaaaaatagcaaaaaaaatttccccccccccctcatatactgaaggtatttcgccaaaaactgtctgcggatggtttgagcatcctgatccaagcggaaaagccaatcgtaggcatcgatagctctgccttggtcgacgtaagtgtcgaagcgggttatcacaacatggacaccgttgtagtccaaaacggcaaaacaattctcaggggaacagcgcagtgtgaagtcggtatcattttgcaaatttgtcgacacaaagccttgccgataatatctgcgtaaacacccaaataaa

SEQ ID NO: 79640 - DNA, 688 bp, Heterodera glycines
  Genomic contig location: Contig_ID=SeqID_2423; Location=630..1317; Strand=+
  SCN-specific regions: Sequence locations=1-60,84-108,167-211,233 -241,263-297,341-343,370-391,419-497,519-688
atggcgaaaatgaaattgatttttaatgtgaatacaaatgacgacagaaaatctaaaatcaattttgaccaattttgcatattaaaaatgtgaattttgatgatcaggaaaaattatatatgttgttttttatttatatttttaaatttaaaagaaaaatttaaatctcggataattcactcccgcacatttggacggaaattggacactaaaaattagacattaatggaaaattggacattatttgatataaataaataaatggagcatattaaaataatatcttttagccaaaccaaaatttttgtttattaatttttaatttattatatttttataagcgtatattgttattattattttaccatcgctataagaaagccatcacttatcattcataaagaaaaaagttttcttttagatagagttcccatttttcgtgcattttttggcacatgacaaatcattgtgcctattgaatgcttgatcaacagaaatcattaattcattaatccatttttcgcgcgaaaagtcaacttgttcctgcatttttgctaattctaaaggctctaaaatcaaatccaaatttgaatggatgcgcgagtgggtcaacagtgagcttcactgccgaaaaccttgagaaattttgatttgcaattgcaaaaacaaccgataaaatttatgagga

SEQ ID NO: 79641 - DNA, 678 bp, Heterodera glycines
  Genomic contig location: Contig_ID=SeqID_2423; Location=1327..2004; Strand=-
  SCN-specific regions: Sequence locations=1-496,540-678
atggaggcaatcataaaacatgtccaatatgccgccgtggtaagaccttaatgaatttataatttcaataaatattaccgatttatttttccgattatgcaaattaatgcttgatctcgttttgtggcatttcggaattgtttatcggtaaagataatttaaatatgggtaaattattttaaaaacgatcgtgaaacttgtcatgaattggcggcctatgcaaataaattcgtcctccattttctttaaatcaagaaatggcaacacaaaatgtaccggaacagcaaaacaatggcacggcgaatgggcctaattgatggatggattaaggagatgggacggatgaacggattgacaaagtgtttgattgtgttggcgttttgttttacgccaattattttttggcaatttttttcgttttttaccgtccatggatcagatgctcaccaaactttgcagagatacttaagtcaagagaattaacctatgattaatttatcttcccatttattttgcttaaaaattttataacatttttaattgtgccctattattttaggtttttttaatgaaaatgtaattcctcaaatttttcaagtagtgatcggcagaagcgtaccatattttggaatttttaattattatgcacttgaaaattatgggtgcaaattaattaaa

SEQ ID NO: 79642 - DNA, 199 bp, Heterodera glycines
  Genomic contig location: Contig_ID=SeqID_2423; Location=2065..2263; Strand=-
  SCN-specific regions: Sequence locations=1-119,146-199
atgccaaaaatacattttatggccattgatcagcaacgtgttgattgcgcaatttgtctcgatcaaattcctttggagacatttgtcagaccgttgccgtgtaacgtaagataaaatcatataattaaatacatgaaattaatgacgctattttcagcacattttccacaaccagtgcattgaaaactggtatttttaa

SEQ ID NO: 79643 - DNA, 588 bp, Heterodera glycines
  Genomic contig location: Contig_ID=SeqID_2423; Location=3750..4337; Strand=-
  SCN-specific regions: Sequence locations=1-518,540-588
gaatacaattgttcggatgaaaccgaatacaactttgtcaaaaatgcttggattgaaattaatcaaaacgatccggcactgagccaattgttagaggcattatttgctacggtcatttcggcaaataaagctttggaatacggtaaaaaataattcgcaggccgaaatttcggaaattttcagacgatgctaacaaaatatctgcgcagcttaatgaactcaaacagagtttggcatatgccgtgtttttcatggcaaagcgtggccaaattccactggaaagcccacgagaggagaaggaaagggagccaaaagaaattttaattggcctaattgacatttataatgagtgtcaattggacgctgataaggtgctaaaaagttgtggagaatgtgggaaaaaaggaaaagaagaaaaatggcaaaaaggaaaagaaaaatatggcaaaaaagaacgacgctttcttgaatttgttgcgcattcattggaaatgaaatgggacgcaaatgcattttcagcaggtggtcagcagcagcaggacgacgatgatggtaattatatgcatttttaaatgattttcaattaaa

SEQ ID NO: 79644 - DNA, 918 bp, Heterodera glycines
  Genomic contig location: Contig_ID=SeqID_2424; Location=1879..2796; Strand=+
  SCN-specific regions: Sequence locations=1-119,146-672,694-918
atgccacaaatacattttatggccattgatcagcaacgtgttgattgcgcaatttgtctcgatcaaattcctttggagacatttgtcagaccgttgccgtgtaacgtaagataaaatcatataattaaatacatgaaattaatgacgctattttcagcacattttccacaaccagtgcattgaaaactggtatttttaaggcttttcgggtctatgttttcatacatgtgcatatatgaagaaaaatctttttatattggggtgttgtataagttctgtcaccccgaccaaaaatttcattcaaaaatttataaaaaatcaaataataactcaaaattaatcaaaatatgcccaattattctccacaatcttctcccatttttgagaatttaaaaatgatctgtcgattaaattcaagatagttaaactcaaataaactgatcggtctacttaaaaaagtcgccaaattcaaccactgatttcttggccaagaaaaggataaaggtacaaaacaaattatggttttgtagagcaaagttgggactatttgacaagctgaaaaagagtcaccaagaccgacgggttatttttttaaattgtcctgtctgaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacttgatttggccataaaaactgcttttaataaattccaactgatcaaagcaaagttttga

SEQ ID NO: 79645 - DNA, 574 bp, Heterodera glycines
  Genomic contig location: Contig_ID=SeqID_2424; Location=3320..3893; Strand=-
  SCN-specific regions: Sequence locations=1-135,157-323,346-469
atgcctgacgcggaaaaaattttgcaacaattggagcaccatttcgtcaacaattggctgctggacaccggaaggattgacgaattgaagcgggtttgttttttcaaaaggtttgccttttctgaattctcatctttagaattatgaagaaaggaagggcgaggatgacacggatgaagaagtggcggaagaaattgatgacgaatgccaaattgatgtaatttaacaaatttggattaaaggatgattttcaaaaaaaagtgaagaaacaaaatgttttatcatttttgtttatttttcagaatatttatttgtcattttacaagtcttcttttgcttaaaattagagtgccacgggaccgggaatttttgccaaaaccgggaccgggacttgccgggacctgagaagccgggaccgggacctagatttttttcgggaccgggaccgcaagaaaaaccgggaaccgggaaattttaaaaattcaaaaaaattttaaaaatttaaaaaaaaattcaaattttaatttatatcaagtgaaaataatacaaattatttggttttttatttaataaa

SEQ ID NO: 79646 - DNA, 1029 bp, Heterodera glycines
  Genomic contig location: Contig_ID=SeqID_15384; Location=600..1628; Strand=+
  SCN-specific regions: Sequence locations=1-114,136-410,432-538,560 -863,885-1029
atgaattttgatgaacacgggcaaatcaacgtaatgagcagcgagcacgcctactttatgctgaaggcggcgcatttcggcgacatggcctcgttccatcacatccgccatgcgccaacgccggcggcggcaaaacggcttggccgtcacatcatgccgtttgtcgagcaacaatggcacgtcgtccgcttcgaattgatgtgccgtgcgctgcgtgccaagttcgccgttgagcacttgcgcagtgcccttcgaacgacgggctacggccaattggtggaggcgtccagagatgagtattgggccgctggacgcgagatgcacgacgtcggtttaacggctacggccaattggctcgggcagaacgctcttggtggagccctcatgataatccgggaggaagtgcgcacacacccaccgacaccgaacaacctggtgcggcattatgtcgtcgcgcaagcttcggctgaggactacgtcattgtggcggcagcctttgatcatgagcccttctttgttcgcgttggaaacgacatgctgcagggcctgggtttgcagcgcaatctcgccgttggagacacgctagttctggttggctactactggagagcagctttcgaacaagtagcgcagattggtcatccaacgttgccgggctggctccatcagggccaaattgtgcgtcaagcggaggcgcagtcggtacagaatgtcgtcttggtgccatctttcgtcatgccaggagtgatcagggccatcaacaacggcagacatcagggccatcgcattgtttgctcggtgaatgtcctggtacacggtcgcatccatactctaacgaagcgaaacatgaacgaaggcgtaattgagcttttggaagagggccaaaatgtgcaactgcatgtgatggaggtgccggcaggctggtggtgtgctcgaaattacatcctccctccaaatgcgcttcttggcactgggatggaatggcagtcgaacggaggggaagtctttcccctgtggttggagctttga

SEQ ID NO: 79647 - DNA, 982 bp, Heterodera glycines
  Genomic contig location: Contig_ID=SeqID_15385; Location=773..1754; Strand=+
  SCN-specific regions: Sequence locations=1-147,184-262,284-408,430 -702,775-830,854-982
atggcacccgattttgacccgtccacaatacccaaatcattgccaattaccaataatgggccacctttaattgctgtattatggaccaatgattgggatgctcaacgccgtcgggttctcattagggaaacaaatggtatactatacaaaatttattttaaaaaatggaataatttaaattttgcactttacagaggagacaattttggcaatggcacaaaatgaagtgaatattcaatttcgatatggcaaagagtttgagccaaagtcaatggtgattattacatggatggattcttctgttactgatgaagacgatgaaaatgaggtgatcaatttaaactagagctcggcataaaatcgtggatctcgacctggatttaatggttaagctctagacgtggatttcctggccaaaaaccgaagaaaaccaagatccaggaaaatccagacttgtcatggcctggatccaggtcgattcaatgttttttgacaacatgaaataaaaaaaagtaacacaaaataataaattcgaaaataatacctggaatttttagtttttcatgatttcggcagttttaggaaacgatccatcaccggtttttttcatatttgagttggacctagacccaggaaaatccaggcatggatccaccaggttcaggccgagctctaatttaaatacaattgattaagtcatggagaaaatacaatttattaaagtgttaaaatattttcaaaaaaatttctatttattaaaaataaaaaaaatttgtaagcgttttttatcgcttggaatctggtgacaacggccgtaaattcccccttattttgtttcaaaattttttgaaaaacaccatatttccgatgtttacagctttccgatgcagatgtgttattccaacttgccttaattgttgggaacaatgcatgttttgcgcacaatattttcagcaaattgccgaagagcgtaatggcaatg

SEQ ID NO: 79648 - DNA, 2980 bp, Heterodera glycines
  Genomic contig location: Contig_ID=SeqID_15387; Location=612..3591; Strand=-
  SCN-specific regions: Sequence locations=1-90,114-140,164-335,364 -555,577-1547,1569-1605,1629-1764,1786-1786,1810-2136,2168-2454,2476 -2610,2633-2754,2801-2980
atgcaaaatttttttctctatcggtatgcaaaatttggtgcaacttgtatgcatagaaaaaaagttatatggagagaagtaaatgttgttttttacataattaaaaagaagagatagtacgccaaagtgagagaaattacaaagaaaaagagaaacgacgagatagtactaggcttttctctgcacagtggggcgtacccatagtgctgttggttcatcaaaatcttataaaatttcacttttgtacaagtcccttccgtttatttacctctaccatttttcattattattctcctgtttattttaaaaatttgctgcctcctaaaatgttgtcctcctcttcttcatcgtcctcttcatcattgtcagactttccgcctaataacaacgaacaagaaaacagttcccagcagaagaatgccaacaacgaattgcttgggaaagaggtgccaaaaataattaaatggaggggagggggaagaaatttttttgcgttttctgtacccctccgaaaccggttgaaaacttttcaaactctgacaaaaaattatccaaaggatgtttttcctgtccattcaactacacatctatctttggccagaaatttgccgaaaatatgcctttttggcgtaaaattttgaaaatttaatgccaatggcgccaaaaaatccttgccgggaaagatttcgaaatctgttggccacatttaatgctgaaaacgcgtctttgtccgtgcatttattaatgttttttttccattttttctccaattttttttcctgaaattgcaatttttgcaacttttctcaggtcaaatgcgagtgcgaaggtggccaatgcgtcactgttcgtgtccaattactgctccaatgcaatgctttccgaaagacagtgaaagttagtgccaatgaatgaacaactaattagcaaaaagtttggttggattggattaagaatttctttttttagcagtttataaatggggtaaaaatgaaaaagttgctctatttatgacaatcgcctagatcattggtcctgaaattttttctttaaatttttttctgaaaattcttataacacttatctaggggtgttttgaggcgctgagcacgaatcctgcctccatttagacctatttataacaccggacccgaattcgaacattttaatttttttttataaccaaaaatcatcgattgccttatttattgcggttgcatcaaggactaaaaaagcctgggttttcaaattactttaagtctcagcttttctaatacttggcaatgtttttttctttaatttttgactaatagacaaccttttggactaccaaattgtgtcaacaaatgcaaaatatttgactattttcccacttggacttgggttccggcgtttgaccttgattttatgcacaaaaatccaggaaaagaaaatccagtctaaaaacctattctattttttttacaatttatatgaaaatctaaatcatgtttttcaaaaaaaaaattcgtttttttaaattttcggaggggggcaaataaaaatgacctggatttagggcccaattctttataatgcaacaaattcttccgtttgtttccttttcgaattacaattgctttgttttcttcagattttgggccttttgcccgaggcattgccggacgaatttgtgttcccagtgagaagcatttcggtgcacacctttgaaaagatggtccaatggatggagcatcgcgatggtgggtacccacccctggaggggaaaataagattaaaattcccgaaattttttaaagaaaatgggcatttttttaaatttatacaaaaaaagaatgggtagcccacgggacgacttgaaggaaaatttgtgtcaaagggtggcaaccgaaaaaacgaacttttttgcattaacgttaatttttcatgccatttttaccaccattcttatttttttaacattttgtttttttcaggaaagccagagccaatcgttgaaagggtttgtggaatatgcaaaaatacatttgaaaatttaagaaaaaaaaacttttgtttttgcttttcgaatttttagccaaaaataacttaagaaaatcgtaacaattccgaacctcgaattcgaattccagcagaaatctcaaatttaattaaaacatggaaattattactgaaaattctctatagcaatgaataagcactaagcaaatctcaattcgaaaatgtgaatttcgaaaaatcaacttttaaatttttcgttcgaattcggtcttatgggtactgaattagccgaaattgactcattatcaccaaaacaccccggggagctttacttttcatgtctttaaaaaaatttgtcctgaaaagagtccacaatagactggtattaccatgaaattttgtttaaattcgaattaaattaaaaagtatttatttccccgtttattttttgcaggaccctctcaccggcacccaaaaatggcaagtgttcgacgagtttgacaaatcctttttcaaggtcgtcgattttgcattaaaaaatgccacttttcgccctaatttccaaattcagattgagttcgctgagttgaaaatgcttttgaatgcgagtcatttcctggacctcaattccctggtaaataataaatccccactcgtcgtgtccctcaaacaaattttacaaaagaaaaaaaaattttggaaattttttcgtaagaaaatttggcgctatttaaaaagagtacccttttgaaattttttttcacttttttttggtcaatttttttttttttgtttttttgacacataatgctaatattaagtattaacagcataattatggcgaataaaaaatatattcacgatttttttgtcaatttttaactagcgctaaattttcttttaaaatgtttttttcagtttattaaatagtatgcaatacgttccatgttaaaaaaacaaattctgcataaaaaataaa

SEQ ID NO: 79649 - DNA, 321 bp, Heterodera glycines
  Genomic contig location: Contig_ID=SeqID_15387; Location=3766..4086; Strand=+
  SCN-specific regions: Sequence locations=1-269,291-321
atggccaaggcgaaacacgcccgatgggccaagaaaagtgagtttttccattggtttatcgtaaaatctctaattttccaatttttagccgctccccagcccgacaccgatgccgaaatgccacaaagggccgtcgacatcagaggcaacggcgcaggacaacgacggacaaccatcatcaactccaacaccggtgacaccgctggaaatggacgtgccgtcggtggagatgatgggaatcggtgtgtcattcccttcaacgcctgccgacgaagaccaacaaattcaaccaatgccgtcaacatccacggcacgctgtga

SEQ ID NO: 79650 - DNA, 1016 bp, Heterodera glycines
  misc_feature (873)..(873): n is a, c, g, or t
  misc_feature (882)..(884): n is a, c, g, or t
  misc_feature (887)..(888): n is a, c, g, or t
  misc_feature (892)..(892): n is a, c, g, or t
  misc_feature (898)..(898): n is a, c, g, or t
  misc_feature (917)..(917): n is a, c, g, or t
  misc_feature (920)..(920): n is a, c, g, or t
  misc_feature (924)..(926): n is a, c, g, or t
  misc_feature (931)..(932): n is a, c, g, or t
  misc_feature (934)..(934): n is a, c, g, or t
  misc_feature (939)..(939): n is a, c, g, or t
  misc_feature (947)..(947): n is a, c, g, or t
  misc_feature (949)..(951): n is a, c, g, or t
  misc_feature (957)..(957): n is a, c, g, or t
  misc_feature (969)..(969): n is a, c, g, or t
  Genomic contig location: Contig_ID=SeqID_15388; Location=110..1125; Strand=-
  SCN-specific regions: Sequence locations=1-28,142-242,287-330,383 -497,520-562,596-812,836-957,982-1016
atgcgcaacatgatggcatccgtgtaagtaaatttatttataattctaaaaataatggaaaattaattacgttttttataaattataatttattttgaaattttaagagtgatattttattttaaaataaaaattaaaatacgcatttcattaattagccttttgactcatgcattcattgtgattgccgacaccgctcctgtgcaaaaaacaatgattgagcagtttattgccggtatgtgaaataaaaataaatttcgaaattgataatttaatttataaaaaacgtcattttcaatttggttaaaaagctctttaaaatttgtcatctttaattaaatttaatttaaattatgaaaatttaaattaagaaattttttaacttgcagagattggctcctcaattagtggcgtcaacgagactgaatttgcacgagcggctggacttggacagcacagtgccgaaaaacgcgagtctgacaccattggggatgaactgccgaaagtgatgaaaaagggctcttcgctggaagatcagcttgaagagcttgggcaagacgatgaggaggaggatgaggaggaggacgaagaagagagttaaacactccaaaattaattaagcctataaatctaattacggtaatttccgttttttagaaagcaattaaggattccaattacgcattttctcagatggaaatttatcgtaattacataaagctcctattgattaagcattaatttttgtatcagataattatttagttgagtttatgggccgtaagaagcgagagaatgccgacgatgccaccgttaaaaacatcacactgatgaaccaagaaattttgaaggcgatgatgaaaatctaccaanaaattattnnnaanntctnaaatanacaaaaattttccaatttnctnattnnnatttnnanaaatnaattaatntnnntttccnaaattttaaatnataatttaaattcttagatgtaactgtttcaaacaagaaaaaataaa

SEQ ID NO: 79651 - DNA, 165 bp, Heterodera glycines
  Genomic contig location: Contig_ID=SeqID_15388; Location=2125..2289; Strand=+
  SCN-specific regions: Sequence locations=1-10,32-98,120-165
atgcattgttttgaaggcaaaaagtaaatcttttttataaattaccatacattccagtggattattccgcctggacatctttcctattcattttcgggttttaataaataaaatattatgaattgtagcaaatttaaatgaaattccacaactctttcaaattaa

SEQ ID NO: 79652 - DNA, 1783 bp, Heterodera glycines
  Genomic contig location: Contig_ID=SeqID_15390; Location=211..1993; Strand=-
  SCN-specific regions: Sequence locations=1-222,244-775,798-892,915 -1169,1192-1570,1593-1783
atggtcttcagttttgccacttcgtatgggggttttcaatgctccgttttagaaaatgccgactccgacgaggtctttccgtcctcctccgatgccgtcgatgggttgtcgtcggctgctcaaacagtcgcttcgttgcgcgacagagttttttccgccatttccgaaacttatggacagtggtcgcaaacaataggagcttatttccaagaggacgatttggaggaggacgatgacacggaggactacgaaccgccggttctgctgaagcagccggtccgcgtcggaccccaattccaagttggtggtgtggtggagaggagggggtattatttggacagaaatcggctctattgcattcacataaccataaatgatttggcaactttaatgcgcaccattttttagaagcatccaaatttaacatttttggtaccattctatagcctcaagtcatctactaatctgataattttcgttctttgccaaaaagatggtcaaaaatgttaagaaaaaaaaaagttttttgaagtttactggtcataacttttttgaaatataacgaaattctttgaattttataggctaatagagaaggcttattgtttgagctaaaaaattcttataactttgctctaaagcaaccagactttttttaacccttgatatttctctactagcctgcaaaattccaaagaaaatttgtttactttcaataaagttatgtccaaaaatgttcgagaaacaaggtttttttattagttttagtcctatcttttttaaaagttaatgttttgttgctgtggaataaagttgtacagctaacaaataagttaccccctaaatctggaattatatgatttcttttttttcttccattttcttttataggtcactgaacttccgaatcaatcgatggaaacccaaccattggacgagttgtccgagaaactttggtgcccgtcgactgatcgttgtccaaatgcatttatagacgcttatctgactaacttcgcgcaaataaaggccgtgaagaagccgtgccggaatccttctgcgccaccgacgactccgctcgctgatgttcggccagcaaatgtgccggatgacgaagacgcacttttggcattaatgaaagtcagacaaaaatggctaattgtaagaaaacctattttttatatttaagcacaattatgatccaaaggcagcaaaagacagttttatgtgttccgacaaaacttcacaggctttcgagagtgccaatgcgccgaaacgaacgcagccgacgcggccattggtgtggacggacgaggagtgcgagcagttcgagagggggatgaacaaacactacaagtgcttttggaaaatccaacgtgattttgtatggttttgattttaaacagtcgaacatgaaaaataaaaagatggtgggcttgggagaaataattctacaaattttgttttaaatctaagaaaatttcaagcatagggcgggctctatttgattttgctccaaccctaattactttggtgcttttttaaattaggcataaattagcatttagtttactatttatattaatttaattttactcaaattgtccatttttgaaaacggcaatgagtgttttttacattttaatcggttcttttttagctgccgtgtcggacagtgggcgaattggtcacattttactacagttggaagaaatcggagcgctacgatttgtggaaagcggaaaaatgccggagagagcagcaagtggacgcgagaacaacgtaa

SEQ ID NO: 79653 - DNA, 58 bp, Heterodera glycines
  Genomic contig location: Contig_ID=SeqID_15391; Location=67..124; Strand=-
  SCN-specific regions: Sequence locations=1-21
atggctgatgccgatgctcaaagtgactatgaggaggaagaagaagatgacgacgaag

SEQ ID NO: 79654 - DNA, 1361 bp, Heterodera glycines
  Genomic contig location: Contig_ID=SeqID_15393; Location=600..1960; Strand=-
  SCN-specific regions: Sequence locations=1-311,333-574,597-627,652 -694,720-1050,1072-1093,1152-1337
atgcgtgtgagttacgaatcgatgcatgccgaggcatttttgacggcattggtaaacacgcggcagaccggacgaagttatgtgggagagttcgaagttgccaattactccaatcatgccaatgatatgtgagcagaaaacagggggaaagggcgacggaacgctttttaggtattttttcattgggttgcaccaaattccgatggaccgactcgacctgcgattgatggattggtattacccgcaaatgatcaaaaacttcgtgaaaggaaaagcgcccgacattggcaagtaaagagaaaaaaaagaggataaaatttcattttaatagggtggaaaccccaaaattggaacggacgcaattactttcgcatcactttcaatgtcagcgacaacggcactctgacggattggccacacggagtggacggataccaggcaattaaggagcacgaaaacgcaatatgaaattggcaccaacgaattttcaaaacttaatatttcattccgtcggaggtgccaattgaccgttcccttttcgtcccgcggatccatcggatgaaaagggaattgacccgactttgacgtcccattttcagtaaatgcttaataactctgtgcttcaggacgtggctgggcttgacttttggcttcacgaactgccccttgtggaacagaacgcaacgcgagagacggaggaggaaaaggaggaggaggagcagacttggcaaagtgtgtttgtgccgagaagatggcaggaggacgggaaaagaacggagcggtggaacgagagcatgaaccactctcgacttgccatgtccgccctgatggcccatggcacattcatggcgaaaccgttgcccgaccaaatggtcggcatgccaatggacgacgatggcacggaaggagcggatgaggaaaagggcacaagtgacaatggcaaattgctatctggtggtggcgaattgcgcagagtttggaccgccttttggctcgcattgtccgccattgttctgcttgcagttgcggtaatgactcatcaattaacacttatttcttttaattaattgaaaattgctaaaaatggcgtaactttttcagtttttatttttctttgttttttttttgttaatttattttcttcttcatttgtcagttgcttctgttaatggtcaaaaggcgcagaaattatccttatgcatattcttccaacaattccaccggggacagcgaattttgcacggaaaagtcgcgaatttatgtggcaaatgatacgaacgcaatgcgatactcgtaaatgatgaatcaattaacaaatggaaaaggcatttcggatgttttaaaaatatttattaaataaa

SEQ ID NO: 79655 - DNA, 380 bp, Heterodera glycines
  Genomic contig location: Contig_ID=SeqID_15395; Location=29..408; Strand=-
  SCN-specific regions: Sequence locations=1-38,76-380
atgatgctaggacgaagtgacaaaagtatcaatgttcgtaatatttaaatttaattatgattttaattttatttacagacagaaaatgattttcgattaattggcgttttcaatggaattgctattcgaatttaaacatagtaagctctaaaatgcccgggcacggcctccacagacagtcgaccaaaagtgatgacagaccttccattcggaagcgtagccattgccagacccagtcgttgaacttgggcagataaagcgtcaattttggcataaagaccgctcagatttggtgtcagatgattctcgaattctgttgccgacatttgccaattggggtataaattccggtcacttagtaagttaattccgggaataaa

SEQ ID NO: 79656 - DNA, 125 bp, Heterodera glycines
  Genomic contig location: Contig_ID=SeqID_15395; Location=83..207; Strand=+
  SCN-specific regions: Sequence locations=1-125
atgtcggcaacagaattcgagaatcatctgacaccaaatctgagcggtctttatgccaaaattgacgctttatctgcccaagttcaacgactgggtctggcaatggctacgcttccgaatggaag

SEQ ID NO: 79657 - DNA, 631 bp, Heterodera glycines
  Genomic contig location: Contig_ID=SeqID_15395; Location=620..1250; Strand=+
  SCN-specific regions: Sequence locations=1-158,197-264,286-289,337 -498,525-607,629-631
atgactttggtgtcgggatttgtcgaggcatttgaatttgtaagttggcccaaaatatttttggaaccatgaacatgtcgaactcgcccagcatttgtcgtgcgtttcacagcatctgatttgggagtggaaatggacgtcaattggacgatacagagttatttttttcaaaaaaaaatattttgaaaaatttaaactgatttaaaaattccaaaacttgtcaatttcgtcaacggtttcacccgacccgccgacaccgcacctaaaaaacattagaaagatgatgatgatattataattaatagttgaaattaaaataattttaactttttttaaggtttaagaaggtcacaattattaattgatattacaattaaggctctattgcactctttatgagtccaaccaattaaccaaacctggtttttaatcattcgaaagcacaaagtctaaagaactaaaatatataaaatctctgcgtttaggcaattaccaaaatttgattaattaattaattaattgttgattattttcgtctgtaactttctttaaatgttagcattcccttactttctctcgtattattaccttatttcagactttgtgctttctaatgattccaaaaacatag

SEQ ID NO: 79658 - DNA, 606 bp, Heterodera glycines
  Genomic contig location: Contig_ID=SeqID_15396; Location=228..833; Strand=+
  SCN-specific regions: Sequence locations=1-372,394-403,446-451,473 -476,506-512,534-559,581-606
atgtttaagctgggcttcggcttaatctcaaatttggcatccacctgcacagtgttggactcgctttgctgtgccatttatttcacgctggcgtttgtgccgcccggctggcttaaaaggaatgcaaatgccactgccattggtggcaccacaaatgctcaacttagagaaccaaatcaacagcagcagaatcggactcatcgaatcccttctttcaacaacacagtagggccgggaacaaatcagccgaaccgatactgtaacggaatggtaccagttgttacggtaggagcaagaatttgaagaagagagtctcagcagatgagtaattgatcattcttcgaaaaaaattaattattttcttttgcaatttttcggaaaaagaacaaaaacttaccttttcaaaaaaattaaacaattcatttatgtttattaattaaaaattctattgttttccttttagaatcattttacactataaaaactattaattaaaattttattagttaaatccaaatgaacacttaaattatttcaacttgttgggtaagcaatttttaaaacataccgaataatttcattgtaacacgccaatggggtaaaaaa

SEQ ID NO: 79659 - DNA, 537 bp, Heterodera glycines
  Genomic contig location: Contig_ID=SeqID_15398; Location=655..1191; Strand=-
  SCN-specific regions: Sequence locations=1-172,195-249,304-537
atgccaatgtttgtcataagaatctcgaaatcattgacgacaaaagttggactgtccatcacaagggaaaggattatggtattttcgaaatttgttattaatcattttttttcctcaaaagattggtcttccgtctttgcaaaacatccgattttgctggataataattcgtccaacattttttactatgaaatttcggtaaaaaataaaaaagggtaagaaactttatttttgagaccaaattatcagaaaattaaattattattataattattaatacttaatcctttattattaatttttcagttgggtcttcttcggattcgccttcaaacagcatataaaattggattggataattgaaaatattggcacttatgcatatgaaaatgatggcgaaatttggattaataaacaaagaaagggaataaatgccgaacattctaacggtgttggtgataccgtaggaattggcgtcaattcgccactcgcagatcatttcacaaaaaatgaacttcgtttgggttggtaaataaa

SEQ ID NO: 79660 - DNA, 692 bp, Heterodera glycines
  Genomic contig location: Contig_ID=SeqID_15399; Location=306..997; Strand=-
  SCN-specific regions: Sequence locations=1-132,154-406,428-494,516 -551,573-604,626-692
atgtcaatttcgaacaattcaataaatgatggagatgatttgacgccagcagaaaatgagggtaaatgtttagaaaagggaaaattgtagaaaaattgaaatttagaatgtgaaattaaataaataaaattcaacatttaattactgtatttattgaattagagcccccaggggcgctattgttcagcccccctcaaaaaggggccttgattttaggaggacactaactcagagggtggctataattcaggggggggggggctctaattcagtaaattcggtttatattttcagaagtgaatggcgatgcaattagtttggacaacgatggtcaattcgatgggaaaaacagcaaattgatcactgatcgacaacagcttaaggtgaggggaaggaaaagttgaaacaatttggagaaatatttgaatttaatggaacaaaagtacttttgttgtaatttaaattcaggaatttcgtgaaaagattgccaaaatggaaatggaattgaaaatggccaaattggaactcgaaaatgtgaggagttttgccataaaatttggaaaaagaacaaaagttaaaacagcagcaggaactgatgggcgagcagaaggaatttgaggaaaaaactgaattggagaaacagcaacacgaaactacgaccaagggcgaggaagttttaagcgaataataaa

SEQ ID NO: 79661 - DNA, 856 bp, Heterodera glycines
  Genomic contig location: Contig_ID=SeqID_2425; Location=216..1071; Strand=+
  SCN-specific regions: Sequence locations=1-100,128-321,345-526,562 -605,628-856
atgagcagccgtcgtccatcacccaaagcatcgacaagtagagctcgatcagagcatgaagtaattgaaatcccgggctttttgcaaatttccaacccaaaaattttttgacattaaatattataatatttcaattctaaatttgtactcaaattttcttgtaattattattttttcagcgcgctcgttctcgctcccgacatgaacgaaggggaatgtttgaaattgttcggcaaggaatgtggtcaaaaattgtcgtcactttgcgaagtatgctgccatcgccaccaatattggaacgtgaatcggtctctaatttggcatttaaaattgaaataaaaaatggatttgataatttaggtttatgacaatcacgcgcaaccatttcgtggaatggccttgattataaataattacatcttccccgatgacagacgagaaggaacaaacgttgatagtgtcaacttgcaggaattatttcagcaattcggctacagagttcaaatttaagaaattaattccaatgatttataatagatttttattattttagttttttttcaacgcatgtggaggacgtaagtgaaagcaaataaatcaaattatttcatttttgagttgttttttaagcaaatgaagaatatggagcctataccggaagcaggacccttgcaaaaccggcaaccggacaaagcagtgatagtgctgactctactgttgggtaaattggactaagtttgagtttgcggtgtagcccctctattgaatcagtcccccgccctccccctgatcagttccctttgattttttaaatccaagttagaaatttttcaaaaaagcttcgattttattttaa

SEQ ID NO: 79662 - DNA, 1220 bp, Heterodera glycines
  Genomic contig location: Contig_ID=SeqID_2426; Location=193..1412; Strand=+
  SCN-specific regions: Sequence locations=1-1,23-115,143-336,360 -541,577-621,644-860,883-910,932-1024,1060-1104,1127-1220
attctgcatatttctatgagcagccgtcgtccatcacccaaagcatcgacaagtagagctcgatcagagcatgaagtaattgaaatcccgggctttttgcaaatttccaacccaaaaattttttgacattaaatattataatatttcaattctaaatttgtactcaaattttcttgtaattattattttttcagcgcgctcgttctcgctcccgacatgaacgaaggggaatgtttgaaattgttcggcaaggaatgtggtcaaaaattgtcgtcactttgcgaagtatgctgccatcgccaccaatattggaacgtgaatcggtctctaatttggcatttaaaattgaaataaaaaatggatttgataatttaggtttatgacaatcacgcgcaaccatttcgtggaatggccttgattataaataattacatcttccccgatgacagacgagaaggaacaaacgttgatagtgtcaacttgcaggaattatttcagcaattcggctacagagttcaaatttaagaaattaattccaatgatttataatagatttttattattttagttttttttcaacgcatgtggaagacgtaagtgaaagcaaataaatcaaaattatttcatttttgagttgttttttaagcaaatgaagaatatggagcctataccggaagcaggacccttgcaaaaccggcaaccggacaaagcagtgatagtgctgactctactgttgggtaaattggactaagtttgagtttgcggtgtagcccctctattgaatcagtcccccgccctccccctgatcagttccctttgattttttaaatccaagttagaaatttttcaaaaaagcttcgattttattttaaataaattaaagtcaaggttttttggaaaatttgagaaattatttcttcataaaatttataaattcgctgaaattttgccctttcaaaatctttttttgctgatgttgctttattaggctacagagttcaaatttaagaaattaattccaatgatttataatagatttttattattttagttttttttcaacgcatgtggaggacgtaagtgaaagcaaataaatcaaaattatttcatttttgagttgttttttaagcaaatgaagaatatggagcctataccggaagcaggacccttgcaaaaccggcaaccggacaaagcagtgatagtgctgactctactgttgg

SEQ ID NO: 79663 - DNA, 667 bp, Heterodera glycines
  Genomic contig location: Contig_ID=SeqID_15401; Location=825..1491; Strand=-
  SCN-specific regions: Sequence locations=1-202,224-476,616-634
atgaagcgctcaaaaagaaattcgtcaaatacaaaaacgaaaaaaccccgaatttctaaaaactttgatcaccatgaaggaattaaaccatgcattaaaaaaatcgaagaatatacaactaatagtaagaagtttcgattattgcggtcaaaatcaaagtttgtagtggaaaatatagagaaatgcccaaacccaacaatagaattagaaaattgtataaagacatcaattgatgaagccattgctgacgctaaaaggaaattgggtggagcagacaaagctggagttataatttcatcagaaatgttagagcaaggtgatatcattgtaccaataagaccaattaattcaaatattgcagaagcagtctttaaccaatttattaaagtggaacaaagtttatcaacaaaaaatattaatctttatggatcaccatttataattactgtaactgtcctgaacattaatgatttgagaaaaaataaataaatatataatcttaattttattactattcgaaattattattattatttttttgtttatctaaaagtctttgtagtgtttatgaattaaaaaatttttaatttaaaaatttttttttaactaaattaagtcgccagaatatgagtagttaattatttttaaaatataatttgtaaataaa

SEQ ID NO: 79664 - DNA, 350 bp, Heterodera glycines
  misc_feature (299)..(299): n is a, c, g, or t
  Genomic contig location: Contig_ID=SeqID_15402; Location=557..906; Strand=+
  SCN-specific regions: Sequence locations=1-90,112-250,272-350
atgtcaggcgagggatctgacttcaacccagcttttttcacggtggaggaaaatgctcaataccaaaccattctcgagcgtttgcgttcttttgaagctgcagtttgcagccaatttcgaaagcttgaaagttctctgaatggaagtgaacgagccacaaaggaccaattgagccgtctcgagtcatcgctacaaaatttggacgagaatgaagagatggatgaattcgagactaaggagaaaattttcaaattggaagagaaactggaggagacacataacaaattcgaagttcttanagctaatgtgtctgaaaacttaaaggaatgttttgagaaattgatactcag

SEQ ID NO: 79665 - DNA, 474 bp, Heterodera glycines
  Genomic contig location: Contig_ID=SeqID_15403; Location=298..771; Strand=+
  SCN-specific regions: Sequence locations=1-474
atggcaaatccgacggttcagcaattgatggacatggttaagcaactgcttgaagcacaacaaaatgcgccgcaagcaggccagcaaccctccaatgtgccgtctctaccgaatgtggaaaacttcgaattcggagagcaaagcaccgacatcgaggactggctgcagcaattcgactttgctcttgactgtgccgcaccaaatttgcaggatgtgctgaaggtgaagcttctcatgacgaagctcagcaaggaagcgtttgccgaatacaaaaagtcctgcatgccgaaaaatgtgacagacttcgacttcgcgaagactgtggagcagctgaagagtttgtttgccaggcctcagtccatttggattgacagatatgactgcctgcgtgcatccaaactggaagacaaggaattcagagcatttgtgaaccgacacaaaaggctgttaagggatttcaactcaagaagctga

SEQ ID NO: 79666 - DNA, 102 bp, Heterodera glycines; identical to SEQ ID NO: 51410
  Genomic contig location: Contig_ID=SeqID_15403; Location=1150..1251; Strand=-
  SCN-specific regions: Sequence locations=1-102

SEQ ID NO: 79667 - DNA, 606 bp, Heterodera glycines
  Genomic contig location: Contig_ID=SeqID_15403; Location=1301..1906; Strand=-
  SCN-specific regions: Sequence locations=1-202,224-345,367-438,473 -485,519-606
gtcggaataaaacatcattcccctgcttgtctactgtttgtcccaatttctattttgccaaaattttttgccgggccgaatttgcctctgtttggtcccgacaagtggtgcaacggccgggaacctctgcactgatgaatgcttgtgatcagcgggtggcagacgctggtacaagggcgacaggacggagaagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataataaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatgggaaaaaccttaatttaattagaaatgttccccctcttcgtcgttctattcaaaaaatatttgtttgtttacattcaattcttattcatttctcacacaaaaatgtattaatca

SEQ ID NO: 79668 - DNA, 576 bp, Heterodera glycines
  Genomic contig location: Contig_ID=SeqID_15404; Location=244..819; Strand=+
  SCN-specific regions: Sequence locations=1-45,85-278,300-576
atgctaaataatggtaaattcgttttttcttttcatatttttctctaaaattaataatttcatattttattataaattttttttcccgccttcccacccccctcttgcaaaaaatgaaaatttctgggtttttaattaggtgtccataatttaagccgttttaacattgttcacaggaaaaccgggctctgccaccattgaagcaatgctaattgacttcaaattgacggaaacgagtttgaccacgccgctgcccggtgttcagctgcattggatccatttcaaccatgccgtgatgctgggcaaatacaatttggccatgtccttcgtcacttgcattattatgctgttcaccattgtcagcttcctttattggtggtacgcactgatgttgtccgtccgcatggccagcaattacggcgaattcctcggatgggccacagtttcaatggcactcgttttttacatccttttctttatggcattcgtattattgtagggcctcgcgctttcgggacgagaaaatgtcggagccatgcttttttcggggtcagctattatcagggttgggctaga

SEQ ID NO: 79669 - DNA, 1214 bp, Heterodera glycines
  Genomic contig location: Contig_ID=SeqID_15404; Location=2419..3632; Strand=-
  SCN-specific regions: Sequence locations=1-285,307-376,402-479,526 -901,957-1114,1136-1173,1206-1214
ttacaaattaatttgttcaatatacacacataaacgatggagcttggtgatatggttttggcaattttggagttgatctgttgcttcttcgtgccggtattccaattgaactatataattatttggcaattttacgattaagggacgaaatattaacattaaaccgcgtgaataaattgcgtctccgttggttaaatctgagatatttttttaggggtccggattcaattccattagcatctgtaaaatatttgaaaaattacgctttatcttttggtagctttgtgttttcaatattttgcccttgctatttgttttttttttgtaacggtcttcgtttttttaaattgtatcaacaattaaaacggttgctttgagcaaagttatgccaaatattttttccgaaaaattaattagcaaattagccacaatcaggccagtaatcggaggggggcggcagttgcccccgccacgaaatgaaaattaaaatttttaaagaaaaaataggtaaattttttaaaatttgtctaattttcttaacaaatgtgaccaaattttataaattttccacgggtatcaattttcttcctttttttttttccaaaattttgtctcgaagtggccaaaatttgacgaaaatggctaaaaaaatttcccatgtttttcccacgcagcaaaatataggaaaaagtacgctggaaaatatttttgggtcttcgggtgccctttcccgaaagttttgtacgggcctctgcccacaataacatatttttgtctgtaaaagtgccttgttgctttccatttactagcatattaatccattaattcagcccattgccattctgctgaagtcgggcgagtgcaaccaacaagtgctgatttcggtcgttctttggtacacaaataaaaaattttttaaaatatattattattttttaatttgtttttatttaattcagcattttgttgtggatccctgccgtcatccatgccatttggtactgtttcattcgctgaatgccatggcgaacaatggcattgaaatgattcgattggaccgtttcttattcataaaaaactattccgattttgggatttgttacatatccaattctcatcattttcaccttttctcatcaacatttcaaaaataaaatcgatcatggttgtaaaatttcaaatacaaaattaaaagaaaagtaaatttcaacccg

SEQ ID NO: 79670 - DNA, 340 bp, Heterodera glycines
  Genomic contig location: Contig_ID=SeqID_15404; Location=1002..1341; Strand=+
  SCN-specific regions: Sequence locations=1-340
atggaaatccagcacttgaacaacattttttctcttttcctcataaaaatgcacattctttggcgtgtatgtcggtgtcgggagccctaccctaattgatcgtgtattaaattagactaagcactttgatggactaattggcaatgctgtccttgttaccacacctttttgaatgttttttaatttttcagtcaaaaataagagtttttctagagttgagcacgaatctagcacctcattttggccttccggattttggcccctgattcgaaccaaaagccgaaaacccaatttttactaattcgtttttatggaacctgaaccggttaaactgagtgaa

SEQ ID NO: 79671 - DNA, 1532 bp, Heterodera glycines
  Genomic contig location: Contig_ID=SeqID_15407; Location=2372..3903; Strand=+
  SCN-specific regions: Sequence locations=1-123,145-425,447-584,618 -940,962-1325,1348-1481,1503-1532
atggaggaggaccgagccaagaacacggacatcaagtttgagcggctcgtcgaagaatgccgctccattttgtcgctcaggagtgccgccgctgcactcgaacatcctggtcacgggtggcaggctaattcaattttagttaagccgcagcgtgagaaggagcgacaaggacgacagcgacagttcagtaattctcgcactcagggcatttcaatgaaggacggacgcacagtcaatcagcaaacggccgccagtcatcaaagccgcgtctgccttttccatgcaaaacgtgtggaggaaatcattggaacaacgagtgcaaaagcaagcgtgaaagtcatcggaacaacgaaagtgacaacaaactatggcaaaagtgctacaactgtgatcgagtcggacattttgcacgatagtgccgaagcaaaaagcagaccaacaacaacgactcgatgttcgtcatgaatgtgtccgacgacactgacggatggatcacagtggattgcctgatcaacggcaggcaggtttcattggtggcagacacagccgcctgaaaaaccatcattcaaacgcccatttgggagaaattgggaaaacccaaatttaaaagggcaaaactttaggaaaatatattcagggcataatttcgagttaattggtttatttgattgtacagttgagttcgcaggcattaaattggagttggaatgttttgtggcaccaacgggagcactcaatctctttggtctcccatggattcgtgcatttgaattggcactgcaacgtccaatcgccacaacacttcaaattgtccaaccagaaccagcattcatggccatggcttcatccgcagacctggacatcgtcacggaattggaccgtttgttggcaattgaggccattaaacagattgattacagccgttgggcagctccgattgtggcagtcaaaaagaagtcaggtgacgtccgagtctgcatcgacttctcaacagggctcaacgacgcgcttgaactcaaccgacacccgttgccacggcagtagtaagtactgccacaccttagcagtctgacgctaattagatgtgacagctggcggggaagggtgtcaattagtcactaattgggggggatactaattggtcagcggtcaagagggcactaattggtcagccgtagcgtgtggggtggggtgtaaattaattagggaaacccaaacctattgaacggtttcaaattgtcacgtaactttttttgatgagcgaaaaaatttgattgatttaaaaagtgacagccgagggggagggggaatttgattggtcagcgaagtgacagatgagggaaaaattcaaatttctgatgggcggggggacgtgaattttgattgatcaacatatgacagtttttgatattattaaattattcaaatgaagtgaaataatttgttttgcactcggtctttatcaaacttgttatgaaggtgcaaatttgcaatttgttgacgatttcgcgcaatgtttcgaccgaaattaa

SEQ ID NO: 79672 - DNA, 408 bp, Heterodera glycines
  Genomic contig location: Contig_ID=SeqID_15407; Location=4037..4444; Strand=+
  SCN-specific regions: Sequence locations=1-288,310-408
atggcaccacgtgatgactccagtaacaataacaataatggtcagccgtcaatccaatttgatcaacaagttcgccaggaccctggtctaaatgctgtttttgactttgttcgggaacagggcgcgcgggtaatttgtcacagcaaattaattttttcattttttgattaattttgtttagcatggcattttcaacacacccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatgggaattctgaattattattatttttttttcttacatgatttaatttattgacaatgctaaaaca

SEQ ID NO: 79673 - DNA, 660 bp, Heterodera glycines
  Genomic contig location: Contig_ID=SeqID_15408; Location=216..875; Strand=-
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 79674 - DNA, 1543 bp, Heterodera glycines
  Genomic contig location: Contig_ID=SeqID_15409; Location=13..1555; Strand=+
  SCN-specific regions: Sequence locations=1-333,362-378,400-400,425 -437,459-705,817-1339,1401-1543
atgtgggtcaaatatttttctggggtattttgatgtgctgagcacgaatctgatgttcattttcagtttaggaaattttggaattttttaaaaattcgaaaatatttttcaattttttaacccttgggattttgggttaatatttgaaaattcataactaacctcagggtaagtcaattttaatacaacaaagctttaaaaatagcaaaaaatcaggagaattttatggcttttatttagattctctatcatgaatataaaaaaagttattccagaagttctagaaaatttcgaattttcagaaaaaaattctgaacacggttctgaaaagttattttggaaaagtaaaataatacaaaaatccgcaattttttgctctattttataaattttattttagctttttatcacttttttgaaaaaagttatagaaataaaagtgattttgggaatcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaagggggagggggcaggttcgaagccgggcggtgtacattatttttctaccatttttttcgtgtttttcaattttattcatttaaaatattttttgagttaataaataaaaaattatattttatttaatttttttttgataaataaattttataagttttaattaattatttttttaattgatagaatttcatgtatctgttgtacctttttaatcacttttgtacctcttttatcaaatttgtacctcttctaatcactgttctatttcttctaatcactgttgtgcctcttctaatcactgttgtacctcttctaatctctgttgtacctcttcatatcactgttgtacctcttctaatcactgttgtacctcttctaatcactgttataactcttttaatcactgttgtgcctcttctaatcactgttgtacctcttctaatctctgttgtacctcttcatatcactgttgtacctcttctaatcactgttgtacctcttctaatcactgttgtaactcttttaatcactgttgtactaatcactgttatcttctaatcgcttttgtacatcttctaatcactgttgtagctcttttaatcacttttacacctcttctaatcatttttgtaactcttctaatctctgttgtttttttggcccttgggaatttgggcgaatatttgaaaaatctcaaggggtattttaaattatttaatttttttatttaaattgttttattaatttattttaaattattttctgatgaataactgttttatttacttcttttaatcactgttgtgcctcttttaatcccttttatatctcttaatccctgtgtgattgctcgtctgagttcaactaaattttaaaaacgggcgcgaagcgcccgcccaagccca

SEQ ID NO: 79675 - DNA, 1902 bp, Heterodera glycines
  Genomic contig location: Contig_ID=SeqID_15410; Location=806..2707; Strand=+
  SCN-specific regions: Sequence locations=1-118,140-1250,1273 -1378,1403-1614,1636-1824,1846-1902
atgttccccgatgacgatgggtacgaatcggaagatgatgaaattctcttgccacctccgccgatccccccgcaacttggccaccctccaccaaatgtgccggtaatttcggtctcgcttttcgttgcttttctcaaatttccgagtggttttttcaggcagttcgtgtccagccaatgcatgttgggcagcagcggctgccgctgagagacttgccacaattcgaggaccatctgcaaaatgtgccggtaattttgggtcgattttcgctgcgttttctcaaatttctgcgtgtttttttcaggctgttcgggtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgtttttttgttgtttttttaattcccgaatgcttttttcaggccgttcgtgtccaaccagttcaacaaccgataccactgagagacgtgccgctatttggcaacccaccaccaaatgtgccggtaattttggctcgcttttgttactttttttcaagatcccgaatgcaggtaattcgtgcccaaccgatgcctcaaccgttgccgctgagagacatgccgcaaattcaccatccaccgcgaaatgtgacttcaatttggatcaaattgtggttgctttttcccagtctctgggtgtttcttcagggaattcatgttcgacaaattcaacgggaatacgccgtaccgcaatttgcccatccgccgccaaacttgccgtatcatccaccagaaaacgttccggtagttgggtcttgtttttcgtgcgtttctcatattttcggatgcttattcaggcaatccaaccacggcaacgaccgcgccagctgagagacgtgccactattcgaccacccgctgccaaacggacaggtaatttcagaccctgtcttctacctaacaccgaaacatcttttctaagcaaatgcatcccaaccccccgagagtgctggaagtgatccgacggctgggcgagtggagaggaagaccaagggacccaagacgtccgcttcaatgaatgaatggaatttggataaaatttgttgtttttaaattttttgtaatgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggatttttttcatgtgcattattttggtgctagtaagatattgccgaatgaattaattggttttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactataccaataataacatttaa

SEQ ID NO: 79676 - DNA, 80 bp, Heterodera glycines
  Genomic contig location: Contig_ID=SeqID_15411; Location=1248..1327; Strand=+
  SCN-specific regions: Sequence locations=1-80
cccggtgtgcccagccgttcccgagaaatcggttttagagatgagttgccttgtcaatataacatatatataactagcgg

SEQ ID NO: 79677 - DNA, 1708 bp, Heterodera glycines
  Genomic contig location: Contig_ID=SeqID_15413; Location=1398..3105; Strand=-
  SCN-specific regions: Sequence locations=1-219,245-407,442-455,478 -738,779-865,887-1014,1036-1100,1122-1288,1310-1708
atgacaacaaatagctgtgttttttaccagcacgacctccaaaagcagaagcccaacgaactggtggcctatgtggcacgtgccgtttgcctgtacaccgacattttcaatcgcatgacggaggaggaacgacaaagtttgaacgaaaccatggcctatgaagaatcgctgaccggacagaagaacattgaactggttggccagaagttggacgcacaagttgagaagaaagtgaagagtctgatcgccgatcagcacatcatagaatatccgactgatcagcggacggtgctgaacatgccgacactacacgagtttttacggttggagcagggcgagtcgtcggcaatgggcgagaaaaaaggtgccattgttgctctacccggcagtttggatgaggtgcgcgaggggctgatgaaagggaaaattctggaaaatttttgcaaattttcaacaaattcattaaaattccaaacttattcattggcgttgcgttataccaagtgaaaaaaactgaaaatggcaaattaatttgagagaaaagcaaaactgttttttttatatttttgaatttgcactaaaaaacatatacatagaaatgtgggaagtgtgtgccgggcccgagaaatgagggaaattgtccgaattttggtcctgtgatttcccgaaatttgttttaattattccaaattctctttaagcgccctcccctctcgtgcttccatgcccttcctctttttatttcctattcttttcctttaaataaatttattgctgtacatatgggtaaaatggaaatataaaatttgtgagatgagaaattaattagatcgatcgcccaaagcgcttaaagaatgcctggggaaaaaatgccacttttgtcgggtcccggggaaaataaaacggtgggaagggaattcggagtgccttttgtacgtgaaaaatatccgtaagtggcggaagggagtggaatatgaaaagagggatcggataggagggagattgagcgggagacaaggtgggaaagggaaaatgtggttcgccgaattgagtcccggggtttgagtaaattggaacgggcttgtggattacaatatacatttaaattcacatttatattcagatggctcaaacactgatagaggcggaacagccatgggatgacggcactgatcagtttcagggatttagtctgcttcaaagacggccaacattggaagatatgttcagcagatcaccattgacaccgatcatcgaaagcagcagtgaactgaggctgcgatcggaatcagagaactctgatcagatgtacagtttggaatttcacgccttgccaagcccacagtggaatgacaagattgtgatcggtgatcagaaaggagacacgatggtgatcagtgatcagaaaatgagccaaaaagctgatcagaagcattctcccagcaaattaactgatcaggagcattcacccagcaaattggtactggtaaatgatcaaaaattgaagcaggaagctgggcatgcaagaagaaacagcactggtagcatccatagaggtcaaaagaaggaaaaggaagctgatcatccgtcatcaagcagagcaacaagcattgatcaacggccggcgcttcaataccatccagcggctgatctttatcaccaacgggcagcttcggcaactgataagagcgacggacaattatggtga

SEQ ID NO: 79678 - DNA, 119 bp, Heterodera glycines
  Genomic contig location: Contig_ID=SeqID_15413; Location=4650..4768; Strand=+
  SCN-specific regions: Sequence locations=1-119
atggctaaaaatggcttcgtctttgagtcctggccaactcagtcccacccattcataacccaccccgccgtcgcttattgtcaattgttgtctgctcgcgctacccggcgacaacagct

SEQ ID NO: 79679 - DNA, 928 bp, Heterodera glycines
  Genomic contig location: Contig_ID=SeqID_2428; Location=508..1435; Strand=-
  SCN-specific regions: Sequence locations=1-136,166-420,445-669,704 -737,782-824,846-928
atgtcagcctttcaaatcgtgcaatcgggcgaaaaaccggtaggttgggttccaccacataccaatgttcgaagcgggcctctgcctccgctttccgacacactcctttttattattacgcaatgataatggattctttttaaataaatagaaaattttaattttgaacaacaattataactattttctttacaacgaaaagataaatattaaggctattatttagtaaacttcaaaatttaaaattctttattggttttatttaccatattaatcttatgggaagcatttttgaattgcttagcttgcaaatattttagatattattctcaataagctaatttttattatgcaaggccgaataaaatctttaaaaaaggtttatattcaattaataattaggtaaataaagtttcaattccaaatgaattgaaatttaaaaaatatcatcaacaagcgtattatgatgatatcggttagccgacattaaatttttctaatatgaacttgtgcatcaactcgaaagtagaaatccttattttttagaatattaatttgtcatcgataaatttgtagatatttatttttaattttagatctatagttttggagcagctatggacgatgtggcgcttaagagcatgtttgcattcgtgggtggtgattaagttaattttatcttatataaaaaattaattttattctaacaaaacaacttaaataagtgtatttgtgggaataatatttctatcaattttattatattattaatcataaataactgatttttcgtagcaagtaaaaataatacaatcattggtaaaaacatttagttgaatttaaaattgttggactaaatttattaaatagaacagagttttcaaatatttgattatctattcattttttatcatagatgggcaataaa

SEQ ID NO: 79680 - DNA, 2630 bp, Heterodera glycines
  Genomic contig location: Contig_ID=SeqID_2429; Location=776..3405; Strand=+
  SCN-specific regions: Sequence locations=1-176,198-352,374-413,435 -643,665-691,713-957,981-1022,1045-1367,1390-1466,1507-1822,1844 -1979,2001-2630
atgaactgctcgctctccgtggcagcagttactccaacccgacgcggacaagtcaaacggtcggaacaacacaagtatactgcttgatctccgtgtcagcagtacttcacgtggaggtggttgtggtattttaatcaaaaatgagatagccttttttgtaaaattttctggtacaaaatttaattgtgaaattttaattattcaattacaaaatctgaaatcaataagatttgcattgatttaccggcctcccaaaaccactttaaaacaaacaaaagaactttttaaatttatacaaacattttggtgtgaaaattataatcttaggagatctaaatttgtcaaatcgagaattggtatggaggcaaggccaaccacacgctataaatcatattggtgaaatattttgcgacttttttaataaatttacatttataaatgccacgaatgagcccactaggggtaaatcatggttggatttgatcttatcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgctgtgccttcaatagcgccttgttgaatgccttgaacgagtgtattccaataaaaaaattactaaaaaaagatttagctccaaaatatccacaacatttattggcatccattaaagaaaaggcaaaattatatagacagtgtaaaattgatccaacaaaaaaagcactttatgatagcattactttacatataaaaatccaaaccaaaaaaatacataatttaattgaacataaggctatttcaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaagttgtcctaaacgatttaagtttggacaactcctatggtaatattcaatgctttatatcggacataaattttaacatcattgagactcaaacactgttaagaaaattgccaaataaaaatggaacttctccggataacatttcttataaagtcctaaaaaattgccatttttcattggcaactgttattactgagttgtttagactatcattagacagtggttctcttccaaacatttggaaggaatcaattgtctttcctctttttaaaaagggggataaattcaatcctgaaaattatagacctatttctttaacctgctcactatgcagagttatggaaagaattctcagcaaaaatatttacaattttctattaaaaaataataaaatttcagagtcccaatttggttttattagaaataggtcaacaacaaatcaattaataacagttgtcgaagattggtatgaagcaattattaatggaaaaaaagttgactgtatttatattgactttcaaaaagcatttgactcggtacctcataatttgcttttatataaattggaaaaaattggtatacggggtaaattgctgaattggataaaagcatttttaatgaacaggacttttcgcgttaaaataggggattctttatcctctattaaaaaagttggctctggcgtcccccaaggctctgtcttgggtcctttattattccttatatatattaacgaccttcctgatgtcataccatcaggagtgaatattaaattatatgctgatgatgttaaaatctatatttgttataaagcaagaacagaaacggaaattatgcataaagcattgcataatttattcgaatgggcaaataaatggcaaataaaagtttcaattcaaaaaacttttgtactttatttgggttcaaaaaacccaaaagaaacttataaatttgatgggaatacaataaatgctgtggatacaattagggatttaggagtaaacattgataacaaattacaattttccgatcatattaatcatataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaaagagtattttttaaatgcagccttccgccaattccataccaaaatcgattagaatacctgcaactgccaacacttgagaaaaggcgaaagctatttgatctgttcatggcgcataaaattgtttatggccgaacagatctagatatattaaaaattttcaaaccttctgaacgctttaatgtccccttttataggtttaacacaaaatataaattaggcaaaaaatttattccctttgcggggagggctacaaaattgtggaatcagctggataaagaaatcattaaa

SEQ ID NO: 79681 - DNA, 564 bp, Heterodera glycines
  Genomic contig location: Contig_ID=SeqID_15414; Location=8..571; Strand=+
  SCN-specific regions: Sequence locations=1-415,437-458,493-564
atgccgagtttaaataaattaacattttatgaatctgaaatggtactcgtcaatgtgttttgtgctcaactattagactgtcccgtcaagtcactgcgcgaccgaattaaccaccccgaagatcgtgtaaatgcaatgaacggattgatggggaagaaagttcgaacaacctacaaagatcgcaatgggatgcacaagaccttttttgtcggcggtatcacggagcgcggtgcagctttcgttccggcttatggcaatctacgggcaccatacaacgtaaatgtggcagcttatttttatgcacggcatcgcataaagctccatttcccttacgtgccttgcgtaattgaacgcttttccgggagaggtgaggaccgtttctacacaatggagttgctgggaattgtggatgacgaaaacaaagggagattgtttggacgaatgtttatggaaattggtgaagaagcagatgatgatgataatgacgaggatgtttcaacatcctttgactcaacactacgatttgatatgggacgcgatgagtgttcccaattatggcgatga

SEQ ID NO: 79682 - DNA, 2618 bp, Heterodera glycines
  Genomic contig location: Contig_ID=SeqID_15414; Location=759..3376; Strand=-
  SCN-specific regions: Sequence locations=1-234,260-440,462-784,806 -1460,1482-1702,1725-1915,1938-2157,2179-2240,2264-2502,2525 -2567,2589-2618
atgccctgcgcattggctcagctggtgccatcctacggattggacgtcgaagacaaaccctttttcccgcatttggccaaccgtccggagaactacggtcaacacatctacccaacccctgacgactatttggccaacggaatgatgccagagaagcgacgacaattcgatcattggttcgagcagcaccgcgaagagccttttcaactcgatgaagcactagcgaggtaaaacatttttaaattaaaatatttattttggactttttcagttattgtacgaatgacgttgaaattctaatggcagctctcgtcgcattccgccgcgagttttttgatgtgtcgaagcggaacgaatatgtcgacggaatcgacgaccgggaaaaccacgatgggattgatgttctacgggaatgcatgactgttgccggtgcgtgcatgaagcacttcaggttgaaccatctgccggcggagcaccttgccattgtccctgaaaagggctatgacaacacccagaaccagagcaagctggctctccgctttcttttctggtatgctgaggaaaacaacgtacaagtgcagacagcctactcacctgatggagaaaaaaagattgcaaactacactgtggacggttggattgaggcagaagggtgtgtaattgaagtgaatggtaatttttctatatttttaagcaatttaaaaaaaagttgtttgcaggttgtgtttggcacggctgtagaaaatgctttccctctgacaacatgatgttgcccaacgggaaaactgctggagaacaaagggagcgcgatgccaagcggttacagttcttgaggactcaagtgacacgagttgatgtcttctgggagtgcgagattcaacgaatgttggacagaagcagggaaatgcggaaaaaatttgcagaatatgtggatggtggaccgttggtgatccgtgacgcgttcaccggcgggcggacgggaccactaaagctcttccacaaggcaggcgcagaccaaaaaatttcctacttcgactttacttcactctacccatacataaagtttgtcatttttacataattgtgttacaatttttaatttccagtttcacaacccgttatccagtgggccacccgaaggttcacgtgttgaacgaggatgttaattggacgagcccagcacacaacaccttccctttggcactgattaaatgctgggtgattccgccacgaaagtgcaccattccggttctgcctgtgaaagttggtgaacgtttatgctttccattgtgcatgaagtgcgcgaaagactaccctactggaggagttgacgacgaatatcactgcagacataatgaccaacaacgcggatgggtcagcaccagcacttcaattgagctcaacgcagcgcttgaagagggctaccgcgtcacgaaagtgttccgggtgttggagtacgagcagagtgatgacaagctatttcgtccatacatcgctgagtttatggcgcagaaaatccaggccagcgggtttgacagcagcatcaaaggggacgccgaaaaggagcaacaattcgtcagagaatgttatgagcagtttgggataagcattgatccgtcaaaaatggctgtcaataagggaaagcggtctattgcaaagctatgtctaaataatttatgtgggtttttctaatcaaacgtcaataataatgaaataaatattaagggggtcgcttctctttgcgcaactttggactttcgcagacgttgatcacagatgacccagttgcgttcagagaacacttggacaaccgatcggtcgatgtgacggcaatcgacgaacttgttttggaccatatcttacatagctatgaaaataagaaggagtgggtagaggagcacgactgctccaacataggtatgggaaaaagattccaatgaaatataaaaaatatgaaaattgcagtgatttctctttggacgacctcggctgcgcggctcctcctcctaaaggcgatgcaaaaggtggcacgaacacctggttgcgtgcttttatacactggtaaatttattatcatttctaggtaaaaataacatattgatcaacaatttagacacggattcattgatctttgtgcacccaaagaacgcctgtccactcaaaactggcccacatttgggtcagtttaccgatgagtatccgcaacacgaaattgtggagtactgcagcggtggtgcaaaacaagtaattaatttttaaaatgctaatcaatatgctaatatatttttatttagtacggattgaagttgaggcgcttaaatgcacctgctgctgcggtgttagagtatgtgctgaaggtgcgcgggatgacactcaactacgatgtcatcaataatcaacacctacggtatgaaactttcaagcaacaagtgttggacttcgccgctactggtgactatgagccgatcatagtcacctacccaaacttcctgcggcctagcatcagagaaggaggaaaagtgaccagtggcccaatgcagaaatgttataggccctacgttggaaagggaattgttaagtcagattttaatgttttaaactttggtcacaccttgtaa

SEQ ID NO: 79683 - DNA, 502 bp, Heterodera glycines
  misc_feature (305)..(305): n is a, c, g, or t
  misc_feature (349)..(349): n is a, c, g, or t
  misc_feature (409)..(409): n is a, c, g, or t
  misc_feature (477)..(477): n is a, c, g, or t
  Genomic contig location: Contig_ID=SeqID_15416; Location=31..532; Strand=-
  SCN-specific regions: Sequence locations=1-9,33-351,373-441
atggaaaaccaaaaggaggcgaaaggaacaaatcggaggtatctgaaaaaatcaaacataaacaattttaaaataaaataaaagacccaaaggttggccattctttgtgaagataatccgccgagtggccaaattaatgccacaaccgacgaaatcgccacgagaaaagttcggcattccaaaattctttgacccattggtccaaaattggccatcgctttggtatgcacaactgtccgaattttggccaacattttcgcccaatggcatcgctttggtggcaaatccaattgagcaaagactanattaaaatataaatcaaatcgaacttaatttttttttgtaattntaccttttacagcttttaattttgatttcaaaatagaaaatgccagattcggtgaacaanattgggtgtttagcgaacacagaacgatgaccttattatttatatttttataaaatatttattattanaaaaatattttacattaaaaataaa

SEQ ID NO: 79684 - DNA, 743 bp, Heterodera glycines
  Genomic contig location: Contig_ID=SeqID_15416; Location=491..1233; Strand=+
  SCN-specific regions: Sequence locations=1-10,34-284,308-457,504-743
atacctccgatttgttcctttcgcctccttttggttttccattgtttccgttcatttctttgaatgattctggcgattttattgagacaaattttgggccacaattcaaattcgaccccgcaaaagtaaagagaacaaaattatttaatcaaataatttgaattaatcttaaggtgattctcaattttccacgacaaaattattgggatgccaatgtttgtgatgagaatctccaaatcattggcaacaaaagtttgactgtccatcacaagggaactacttctggtatttgtttttaaatttataaatcccatttttttcttcataagattattatcattccgtcttcgctaaatatccgattgcgctgaacaagtctttgtctgactttttttactatgaaatttcaattatgaaaaaaggaaaaagcgagtaagcgaatttgatattttgaaacatttataattataaaaagaataagagaaatattttattatttatttcttctttattcagttgggtcatgttcggatttgcagtcaaacagcagcagacaaaattggatgaattaattcatcttgaaaagggcacttatgcattttacaattatggctatttatgtattaacggaggaataaagggaagaaatgccaaatattcctacggtgttggcgataccgttggaattggcgtcaatttggccactcgaaagatcattttcaccaaaaatgggcttcgtttgg

SEQ ID NO: 79685 - DNA, 178 bp, Heterodera glycines
  Genomic contig location: Contig_ID=SeqID_15417; Location=898..1075; Strand=+
  SCN-specific regions: Sequence locations=1-59,124-178
atgaatgagaaaatggacaaattccaattggaaatcggcaaattgaaccaaaatgttagttttaattttttttttttttttaatattttaacaaaagatttattaagtatattaaaattttaagtttcagattatcgaaaataaatttaaagtgaatgagaatcgccgggaaattcag

SEQ ID NO: 79686 - DNA, 508 bp, Heterodera glycines
  Genomic contig location: Contig_ID=SeqID_15418; Location=1..508; Strand=-
  SCN-specific regions: Sequence locations=1-168,204-486
atggccgataattttggatggaaagtgggaaaagtgttcaaaaggcgcaacgggaataagcaattggctgaaagatgtgttggcacagacggcacgaagggatggcacgcgctaatgatcgaacagaagaaaaatgggctgatccttgagtcctcttttgggtgagtgatttaatttaaaattaaaaagcaaatttaattttagaaaggatttatccgtggaaataggcccaaaattttttgtgcacggctccgactttttggacattaacatcacaaagggtacagttctacaacaaattaaatttaattgatcgagtcattagcgttaatgagttcctcttccgctaaattggccgagttccaaaatgctcttccgttcggtgtttttttgaatgatttcgacggcgcagcgcttggaattgtcgcatttgaaattcattgtgccattggaacaaatgacgtgaacacttgcaaaacgatggtaaagtgaaatttaaaaaattaaa

SEQ ID NO: 79687 - DNA, 131 bp, Heterodera glycines
  Genomic contig location: Contig_ID=SeqID_15418; Location=1571..1701; Strand=-
  SCN-specific regions: Sequence locations=1-131
tgttgaagaaaatatgtagcccaaattcaaaagccgaaaaagaattaaaaaaagaaaaaactacaaatatgaaaaggatttgcaacaaaattccggcacttctccacttctcccaagtttggcatttcttt

SEQ ID NO: 79688 - DNA, 189 bp, Heterodera glycines
  Genomic contig location: Contig_ID=SeqID_15418; Location=583..771; Strand=-
  SCN-specific regions: Sequence locations=1-14,37-189
atgaatttaatttgcttttcgttcttttttgttgttctggcgacaaatgccatcggtgaagggtaattaaatgaattaaaatcaattttcaaatgctttctgttctttagacttgccgaggacaaatggaaaaagtgcgaattgaatggaaacggaatgatcagaatgggaaagaaagccaaaaagtaa

SEQ ID NO: 79689 - DNA, 62 bp, Heterodera glycines
  Genomic contig location: Contig_ID=SeqID_15419; Location=1913..1974; Strand=+
  SCN-specific regions: Sequence locations=1-62
tttaaaataggttaattctcttcctttcagtatccctgcaaagtttggtgcgcttctgatca

SEQ ID NO: 79690 - DNA, 3476 bp, Heterodera glycines
  misc_feature (212)..(212): n is a, c, g, or t
  misc_feature (2636)..(2636): n is a, c, g, or t
  misc_feature (2684)..(2684): n is a, c, g, or t
  misc_feature (2707)..(2707): n is a, c, g, or t
  Genomic contig location: Contig_ID=SeqID_15419; Location=1..3476; Strand=-
  SCN-specific regions: Sequence locations=1-42,71-305,367-442,465 -504,534-693,734-1139,1178-1296,1327-1343,1365-1546,1577-2028,2050 -2286,2308-2634,2725-2859,2909-3036,3164-3179,3321-3331,3353 -3384,3407-3476
  Gene Ontology: Mol. function=receptor activity; Cellular component =integral to plasma membrane; Biological process=axon guidance
cccttgcttatttatccttgtctgaaatccgttaattccccaattattattattattattgtaattattactcaaatgtgccgagctcttatcctttcggggtcccctgattcatttgccaggttataatgaatatttacaaatttaaaaaaaaacccgttccaatttttaaaatatgcattttaggtacccaaaatgggcacaaaccttcngaaaatgaacttagttttgaattcaaaacgcgcatgcccaatgcattactgctgtatacagatgatggcaagtttaaatgataaaacaaacagaaattattacaataatttttgataaatatttttatcaatttttaataaataaactttatttgcaaagttcgtttaattttcaaaaagccttataaagttaaaaaatatataagaaaaaaattggaaaattttgtagtgaaaatgaaattttcttatttaaatgttctaagatttttttgaaaattggaatatttttcaaaaagttttaatgatattttgttattaaaaaatgttctgatatttttttttgcacatttttaagttggaattttttaaattttcatttttcaaaaaattggggtgaaaaactgaaaatttggcaaggatacaatttttcccaactgatttttttccactattttcacaagcccctctaatggggtgacacaaaaaaaatatttcaaaaataaaaattaatttttaaatttcttctatctcaggcactgttcaacaaaattttttcacaatttcgttgcttgacgggcatatccaagtcgaatttcgtctgggcgagcaacaattcgaaatgccggaacgacgtccggttatccaaatcggatttgtcaatgccgcacgggtggacgacggaaagtggcatcggttcagctttttccaggtgttttttttgaatcaaataaatgaaaaatcgtttaattttaactttttctcaaaatttaggcctgggaaaatgtgagggttcaacttgacgaggaaaaggcgttccgtgtgctgagccaacgcacttttgcgctgggaaacattagaacaaattcggatgttttcgttggtggaattccgaaggttggatgagctcgttaaaaatttattattgccttttaaaataaatttttataaaaattttattataaaatgtcattcgctaattaatggaactgggatttttactaattggcgcgacaagacccgagcacttaaaacatatcgcccgccacacatttcagggttttagcacatatttcgctggtgcacctttaaaaaaaatttttttttgttaaaaaatgcattaaaaaattcgtcaatgcaaaatttttaaattttcttgatgagatgacgaaataaaacatttttaaacattaattttccatcccatagggttttgttaaaaaatttttggattttccaatttgctatatttttccaatttttgaaaaaattttgccacacataatttttcgatgatcagaagcgcaccaaactttgcagggatactgaaaggaagagaattaacctattttaaactaaatcatcccataatctgaaaatatattcaacgcttattattttaaaagaattttttcaaaatggcacttaggtatatttattaaatgcaaaaacaaacaatttcaggaaattgaaaagctcagctcaccacttcgacggcattctcagcattttgcgggtgcaatacgaagtcttgtttatcgactgttcccacagggtcagaagaaattaatattccgaaaaaaacaataattaatcactaattattgttggataataggtttatttttaaaaacgagaattatgagtagggattatttccaaataaacttctttacggaataatgaagttagagatattcaggattgaagaatttcccaaatacggcagcactcctatttatggttaagccccgaccctcgtggagtcgaaaagtcttagttcggggatgaaattgcccgacaaaatttgtcggggatgggtggagaaattacaaaaatatcggggagcaaatgttcataaaaatattacagaaatttttaaaaagtaaaaaattcttagtaactcattcaaaaacattttcattcggtttgacatgaaacagcagatgagattcataattcctcgtatcggatcggtgcttaatcctactcctaattaccatgatcaagacttctgatcaaactcaaacataggaaaattctggtaagaccattgattccctgtccaatcacgattaaattaattgataatattgcatagaataaattgcccttaattaattataggtgtttcaaatcctcaattgatggattcaatgggcacacgaaaaactgataaggattattgccagccgacattcacctcattggcatcatctggtttggctgctgttgttgcggccagccgaatggccaaattggcacaaagtgccaccaccaccgacactgccccaggagtttattgtcagaatgatggccgatgttacagtgcaaacaatggggcccgatgtgactgtacggatagtgattatgaagggagacggtgtgaaaccagttcagttttttgttgttttgcttaattgtttnaaaataatatataaaattataaaatcaaaataaaaataatatttatantaataataattttaaaaaattanaaattaaattttaaatattatttattcctaattttgcgtttcttctagaaaagcccagcacggaggtttcttttttcggcaacgaatggttgggttacgatctgcgcaaagaaccgtctacggtagacgaaattgctaccggtagaaaaatgaaaatttaaattatttatttttaaaattttttttattatttttaaaatagtttctttggatggggatgaggaggatgaaccacaagcggtgtggagtttacgccagatgtttaacatcacatttcgaacaaattattctaatgctctgttgttgttggcaggcgatggacgggtgagaatttttttttattcgaataaaaattttgtttttaattaatatgttttttttaaatatattttttctctttttaaaatttagaatagatttaatcaaaaaacatttattataattttaaatttattacccattactaatagcttttattttaatttggtttcatttaattttagaatatttatctttgaaattaaatttaaatttaattgcaattgaaattaaaataatatttaattttttaattgaattaattttttactcattttacaaaattattttctaatgaatataatttgttgttcaaaaaatttaaaactaattctgatcagagtcatgtggagcttttcgtggaaaagggtgtgattttggcacgctcccaactggccggaagcgaaaaacggatgatcagagtgcaggaccgtgccttacggcgtgtcca

SEQ ID NO: 79691 - DNA, 1519 bp, Heterodera glycines
  Genomic contig location: Contig_ID=SeqID_15420; Location=1335..2853; Strand=-
  SCN-specific regions: Sequence locations=1-47,72-1519
tgtggtttatcggttgtaattcctaaatattttgccacatgtacatatcattttcttcatttttattttcagatggcagagaaacaagaagctaaaagaaagaatgatcaggagcgataccgacggcggacggagcaatctgtcagcccaggtcgctcacccgtcccagacggaagtgcagatgggaatggagaggcatcggcatctctccggggcaccaccaccccaagtttaagtgctttgcaaataagcacacctgcttcttccattggaagtaaaaaaaggggaagacccttgaaagcaggagcgaagccaattttggcaacgcaagaaactgtgtcctcaattgacacacctcgaactgctgtcacccaaagtgaccaaggttcgccgtgcaaaaaaaggggaaaggtcaccgagtgtgacaaacccacgtttgcaaatgaagctattgcttcaacgcctgtttcgactcaaagtcgtggagggcgaccagttaagcaactgggagggcatgccggtaaaggaagaggcaaaaccaacgagtctatgaccaaaagctctgaaatggaccaaagtgtggaaaacgctctaagtccggcaccctcgcacattgtgtctaaaaaaattgacttcagcactgtgccaattaatttcgccacatcgcgaaattttgcctgtaaaatttggagatgggcagcaattggcctttacgagcgtgatggcgaaacagcacttggcccacgctctggcccaagattcattgagacctgttggaacaggccaaatgaatggctaaatgacagctttattgttgcctatttagcttacattgcaagtatttcacaacgaaaaacagtagttgtggattctttggcatcgagaactgatatttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgaaaaaaagcgcattttatggcacattaacgagctatatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacaggcagttgatgccattctcacccaagcccaagtggccggtgaaaaccaagctgacatgcttg

SEQ ID NO: 79692 - DNA, 1047 bp, Heterodera glycines
  Genomic contig location: Contig_ID=SeqID_15422; Location=647..1693; Strand=+
  SCN-specific regions: Sequence locations=1-306,329-441,463-493,524 -625,648-1047
  Gene Ontology: Mol. function=myosin ATPase activity; Cellular component=muscle myosin; Biological process=muscle development
atgctttttcaagaggaagcggccgcgaaacaaaccaaaggcgagaagggcggcaagaagaagggcaagggcggctccttccaaaccatttccatgatctaccgcgactcgctgaacaatctgatgactgtgagttcctttcgcatttgcactgcttgtcttactgtagctttacactacacaaaatgcacttttacggtacgccctaatccaaaaaaaaacacattggaccgtttaacacagaaaaaccataaaatgattgagtcggaggaatctccgaattggaaatattatttaaccgatctttgaaatcattataaataaataagtttaataattgttgctttagatgctcaaccaaacacatccgcacttcattcgctgtatcattccaaatgagaagaaacaagcagggctaattggtgggaaaagccctttaataaaatattattcatttaaaaagcattgctttaatggaaaaagaataattagcaaaaaaatattcttaaaaatatataaaattccctatttttactgatttagcttatataaaaaaaatgttaacgttagatgctgcacttgtgctcaaccaattgacttgcaacggcgtgctcgagggcattcgaatttgccgcaagggctttcccaaccgaacccaacatgtgccaaagacaataatcattaaatgaattgaaaaatgattaatattttccaattttcagcccgattttgtgcagcgttacgcacttttggcagcagcggaggcagccaaagacgggaaaacgaacccaaaaacggcatccaccaatatgctggcacggctggtcaagcagggcgacttgggaccggaccaattcaaaattgggcacacaaaggtgagatggacaacccacactaatgggctcattaacgaaattaattcttttgacccacttgttcaggtgtttttccgtgccggtgttgtggcacacatcgaagacctgcgcgatgctcggctgtcccaattggtcacggctttcaggcggtgtgccgatggcattgtgccag

SEQ ID NO: 79693 - DNA, 338 bp, Heterodera glycines
  Genomic contig location: Contig_ID=SeqID_15425; Location=1552..1889; Strand=-
  SCN-specific regions: Sequence locations=1-126,189-338
atgacgaatgaccatttacacagagtcccgaaaatgaactcctttatcaaaaaggtgccgtgtgtggcaaaaaagttttttgtaagaagtaaacggaaagaaggaggagggtcgagtccactccacaatattaatgtttttatttatttttctttaaaaataaaatgattatttttgaaaatatttttgaagctttattaattgattttttttttgcagccgaattggatgaccttgacgagaagcttttctaagcgaaaaagataagccacaatgcactataaaaaaattgtgggccttgaaacttttatttttgaatagcgaaaagttgtaataaa

SEQ ID NO: 79694 - DNA, 1305 bp, Heterodera glycines
  Genomic contig location: Contig_ID=SeqID_15427; Location=78..1382; Strand=+
  SCN-specific regions: Sequence locations=1-326,348-789,811-1305
atggcactcatccagtcaataattgctgagatagtgcccgggaatgcgtcattcgctgttgaatacgtgcagaaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcaccagtgcttccttcctcggaagatactgctgttcttgcgcaagcaccagtgatcggcgaaaatcaagctgacacccacggtgttgttgcggacacaattgtccagcaagaaccaatcgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtcgcaacgccgatcacacggcgttgctctgcatttcacaaggggtggcaatgcgctgcagcagcagccaaacatttcccggaatattgtgactccgggaaactcggtgacaaaaaatgcgccgattgcggtgcgcatctcttctcacatgaagacagtaccatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggcacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaactccggaagagcttcgcttatgtcgcatgactttgtga

SEQ ID NO: 79695 - DNA, 591 bp, Heterodera glycines
  Genomic contig location: Contig_ID=SeqID_2430; Location=3373..3963; Strand=-
  SCN-specific regions: Sequence locations=1-96,118-229,251-591
atcgaatgcacaggatggaagtgcgcaacacggtgaagtcgcatttgtgcgatgatgggacgagctcgggcatcagcactgtgccttccgactactataccaaataatttgttaaaatgttttgtgttaggataaataaaattgtcttgtcttctgccgtttttatacttacatagttttactcgcgggggaagtttggacatcaaatcaaggattaaaagaaattgtgaaaaaattatgtaatttaaaagcttaggtcgctgatcacaaatccggcatccattcggccaactccgaaactcggacacaaattcgaacatttaaagtgggcaataattggagattaaatttcacttcaaaaaaaaagatgagaaatgagggacggacgacgcttcgtatgaaaaatctgagcaaaaggggcggaagacgaaaaacggacgcatttgtcacttgcgagaaattggactatttctcgagaatcgcctttcccggtcattttgggattaaatatgcgagggatatgtgatcactgatcagtccgattcagcaatttacacgctgttcaatgtggtctactggacttattacatg

SEQ ID NO: 79696 - DNA, 1094 bp, Heterodera glycines
  Genomic contig location: Contig_ID=SeqID_2431; Location=645..1738; Strand=-
  SCN-specific regions: Sequence locations=1-430,468-484,521-621,667 -1072
atgtctgaccaatctgcccaatgttatgaaaaaaagaaacaaatttcggctccaaaaaatttgctcgacgtggaggaaagtgaggtaaaaatttggagttgatgacttttcattcgaaataataacttaaatttgtctttaattacaaaaacatgttttccagtggttttcggggtcgccgctgatcattaatttgaactctatttgacgaatttccaaaccattaacccaaaattcgtacaaaaagtcggaaattcaaaattttctaattcacttttattttcgaattcgcatccagggttcgaatgaggctaaaatgccgaaaaaaggtgcgaaaaatttcaaaaaggtactatttgcaactagcgcaaaatgttcgaattttgggctaggggttcggaaattggggaaactatagaaatgataaatgataaaaaaaatatatattttatttgaaatttatttttcatacatttccagagaaaatttttaacttaattttgtttcaccaaaatataatgaaatctaaaattttttgttcttaaattgctccgtgcgtataatttcttcttctaaattgccaaaaaaaaaccattttcattttaagcagataacttattcatattttatctatttttttaatctatgaattttttttttaatttactatgaaattttctctttttctcatgtaaattgaacataattctttccattttatgacttttacatcattgcacatcattaagttatcgctttttgacatttcccaccaattcctttaatggatttggcgaaatgttttggcctttgagcccatccgattggaacggatccgcgcaatggcggcgaaaatggcacaacgctaatgcattttggaggggaaatgcccggggggaagggtgggtaaagtgcaaattgctcctaattagggcttctcctgggacatctctccatgccaacatggcattgctttattgcataagccgaaagcttttcctaaaatgtaaatgggattttttgaatgtgacagtttccttcccccaggggaccaactaaaggaaaattgtaaaattgaaatttttaaaaataaa

SEQ ID NO: 79697 - DNA, 155 bp, Heterodera glycines
  Genomic contig location: Contig_ID=SeqID_2432; Location=422..576; Strand=+
  SCN-specific regions: Sequence locations=1-155
atgattgcacgtaattgccgaaaaaattcgagaccaatttccgaatgttgaccgactaattgcaaaacgaaagccgtctttgtcaaagcgccttaccgagtcaaaaaatttggaaatgtatttcatatgcaatttcaaccaacaaatttgaagaa

SEQ ID NO: 79698 - DNA, 671 bp, Heterodera glycines
  Genomic contig location: Contig_ID=SeqID_2433; Location=1274..1944; Strand=-
  SCN-specific regions: Sequence locations=1-136,206-244,267-351,388 -502,536-671
caccaccaacagtcccagggcaatctgatgagcggcggtgtactccttccgccaggtgcccatccgccccatttctcttccggcgcattccctcccctttcttcggcgggtcagcagctttcatttcccatggaatcagcaacacatcaacaacaacaagtactgcccctccaccattcacaacagcaacaacaacaacagcagccggcggcattgatcggaatgtttcagaggcaaagtcgcgaggacgaggggcagcaacagcagcaccaatcacgacaaaaccaagctgggcaaatgcagcaacaaatcaaccaacagcaagtggaacaaatgggcaccgctggaagcaacacaaccgcaaaccaacagcaacaggtcgtttggcgttgctttccgttcgcatgtctttttcgttcgctcagcagtccacgcctgcccccttgtccgtgtcgtctgtctcttctgctgccctctctccccatttgatggttccgttttcctgcccgtccacttcttccccagttgatccttccactccactgcaattcatttcccatcatccacaacaccaaggcgttccgccgccgcctccctaccaaatgcatccgatggccatgtcggaagcacccgttgggcccagtaagttttcttgctcatcccgtctctga

SEQ ID NO: 79699 - DNA, 521 bp, Heterodera glycines
  Genomic contig location: Contig_ID=SeqID_15430; Location=1505..2025; Strand=+
  SCN-specific regions: Sequence locations=1-219,241-521
atgcgctgctccgatcgctccatttgggttctgagtgttctgctcggagttctggtgctcggctcacagacggcgcccattttcctactgaattgggttctgatcagagagccgcgtccgttgaatatcactcggcttggcggccccgtggccggcgttgacgaccagggaccactggtaagagagggaaaggaaaagcttaatttaaacaaactcttaacacaattgaaataatgaaattccggatgattttttcctttttttgccttaggaaattccgttcgaatacaatgccggatactttggcatgtgccggcaacgattgccattgaacctgagcagcgccgaagaggcaattgcggcacaagtcgaccaattggtgcccattttggcaccggacatgtgagaaaggcgaagcgggaaatactaattaaaatcacaaattattaaaattatcgaattcatttcaggtgcgtttggaactccatttacaccgggggagaagaaatcggagaatttag

SEQ ID NO: 79700 - DNA, 662 bp, Heterodera glycines
  Genomic contig location: Contig_ID=SeqID_15435; Location=772..1433; Strand=+
  SCN-specific regions: Sequence locations=1-226,248-426,453-662
cttgtggacaaggacgagcagaaggcgcgcgcggctgtccaacgcgagttggcgctgctgcgccgtgcagtcgcccaactgaacgagggccgtcgcatcaaggacattggcgatctgcgcgagcgcatgctggacgctcagcgtccgttgccgtggcgagcgatggccgacgcgcgcgaagtgcacgagttccgctcggtgcaacaaaacttctactcggacaggaaggaggagctgctgcgcgagatgtaccagctgcagggtgaataattaaattgggagcaggtcgcccccccccccctccccccgatttttttttaatttccaaacagaaattttccaaaaaaaaattcttaaataatttcttactgttactaagaaaagtgcaagaaaaaaaaatttcagcgatttttttgttgagctactaagttttttcaaaaaattccaaaaaatcgctgaaaatttttaccgggggggaggacggcgggggatgaagtacaccttttgcttgaaatagtcaatctcccctattttagctagtaatgctttcgattaaaaatgggaattttcaggcaaaatgggcatgtttctgctgggccgtgaccgtgcgttccgttcctattactacatgaacaccgccttcatcattctgtgcccgcgcc

SEQ ID NO: 79701 - DNA, 204 bp, Heterodera glycines
  Genomic contig location: Contig_ID=SeqID_15438; Location=551..754; Strand=-
  SCN-specific regions: Sequence locations=1-204
atgccttttcgtgccataacgtccacaaaaggagaggtaaaacaaaacaggggaaaataaatggaaattttgttaaaataaatttttaaggtgtgcctgttccctgaaacgatgtcttcacgcttgtgcaaaaaaatcggcttaacttttggcgaaaaattatcaatgagcgaaacgtccgaaacgaacagagtaaggcattaa

SEQ ID NO: 79702 - DNA, 818 bp, Heterodera glycines
  Genomic contig location: Contig_ID=SeqID_15439; Location=1137..1954; Strand=-
  SCN-specific regions: Sequence locations=1-56,79-191,265-271,293 -319,342-398,421-450,485-523,545-649,673-818
atgggggtctgggtgagaaaagagaagggaattggtgagaaggagaaatttttgagaaaaaaattaaattatttatttgtttattgcttttgtttacatcgttatgtggtctagtggctacaccttctgcttttcatgatttttcgctttggttcaattccccactaagacagcatatttttcttatttcctttataatttttatgtaatgaaattttaattaataaaaaaatattccaagtttatttttatttaatttttaaacaggctaaaaaatcacaaattaaccaaatattggtcattttttgacaaattctgttaacatatttcactcaaaatttaaaaatttttccagcggcgcctatcggcaccgccggaccctgccgccccctcaccaatgttaccaaaagttttttggaaaacagcgccacaaaaacagcgattaaaagcaaaaaatttaagaaattttaatttattaaaaaatccagaattttgggaatcagaaaattccaatatcaaccccgccccagaaattaaaatttttaaacgttttccatcgaataatggaaaaatttttcgatttactcctcccaaacgaaaatttaaaaatttttatgggtacattttagaaaataggcaatttttcataacaaagtgcactcaaattttcaagttttttttcaaaaaaatttttcttgggaaattcccggttcaagaaagagggcccaatttcaaggacgtccttgccattcaaggacgaatgagaaccctgcataatagaaagtccatttatattcaactcaacaatttgtaataaa

SEQ ID NO: 79703 - DNA, 196 bp, Heterodera glycines
  Genomic contig location: Contig_ID=SeqID_15441; Location=1106..1301; Strand=-
  SCN-specific regions: Sequence locations=1-196
tttcccggcggcgcctaccggcaccgcctgctccctcttcccaaaaagttttttggaaaaagcgcgcctcaaaaaagctttttattgatttttaaaatttggaatagaattttacaaaaaaaaatgatttttgctttatgattttgactattaaaaaagttgtagaaaaaatttcgctttcgcgtttcgcaatttc

SEQ ID NO: 79704 - DNA, 705 bp, Heterodera glycines
  Genomic contig location: Contig_ID=SeqID_15442; Location=1070..1774; Strand=+
  SCN-specific regions: Sequence locations=1-366,388-392,414-435,470 -495,518-624,646-684
atgccaatgtgccaacattttgtgccgacaaaattggcacaatttggagaaaaagtgtgggtgtgcaaatggtggaaaaagcggcgggccggcgcgacggcaaaacggcgcgggacaattgccataatttggggttggcagcgaaatttttgccatcgccatttgaacgaacgaacgatggatgaaagaattaacataattaatctaccaatttgagagattagtttttcaaaaacggattggtaaaaattggaaaaaagtttacacgaaaacgggtgtcggacgcgattatcggcatttcccctttcgcgtaaaaagccaaaaacggcaaaatgtgcaaaaaagaatcgccaattttaattaggattttggaaaaaaggaggtttccctccatgaattaaagttatttgaaaaatggactaatattatacgaacatttaaatttgttttttattatttattttttaatcaaatttcccttaattgggtgggaataaaaataattaacagaaaataattgatgctcaatgatcgatcaaacacttcttgccacactcaatcagtttcagacgtttagtttacgttcggcagcggctaaaaacgaaaaaaattataaaactttgcttaattaaaaatttaaattttcagttttaggcattctttttttccatttattttttgccctattttaaattaaaattttaa

SEQ ID NO: 79705 - DNA, 1035 bp, Heterodera glycines
  Genomic contig location: Contig_ID=SeqID_15443; Location=72..1106; Strand=+
  SCN-specific regions: Sequence locations=1-148,182-195,217-232,254 -295,327-360,382-617,652-761,792-808,831-1035
atgctttgcgactgtatgattcagggcgtttcgtatgtgggcgaattttcttacttttccgtggacccgatagaaagaccgaaaaaaaaggtgtgtcgaatggtattatgtacggtcgattatagtccgatgttatattgacctctcccatttttgacaaaaatattttttgttcatggtaaataagccctttttccaacaaaataagcttttgaactttttagcgaaaaaattgagctaacatttgtattttgaccgggctaaatcgggcttaaattttgccagtgaaactgtcaaaaattggaaaaatttaaaattattttggcaaaatgtctttttcaaagtgtgaagttagaactgaaggaatttttgaaaatttgtacagtttcaacagattaaaatttttcacggcgatgactaacggtaaaatttgatccaaattagtaattttttgttaaaatctcttaaaatgggtaaaatacagaaaattcaaaattttatcgcccatcactaaaaatcattattcttttaaaaattgaataaattggaaaatttgaaaaaagtcgatttacatcactttacctaattataagctaaaataaaagactaccaatttttatgttattgatcaaaattcaacaaatttttaaaaatgtccgggcccgccagggcgccctacagtacggtctctggtccgagtattgcctgcacgaaaaaaagcttggctaatttttaaccattcgggtcaagccggttattacattttataaaaaataatttaataaattttagccaaacttgtctggtttttacaaagaagaaattaaaacagctgctatgcgagaattatgcaatttgctgcacatttcatcaatggagccaatgatggaaaaactaaaaaaagtgagggcattttaatttggaaatgcttgctcagagatgtgccgtatagtgactaccgttgccattaagtagaattttttttctaaaagagaccccaaaaatctatttaaaaacaacataaacagaaattca

SEQ ID NO: 79706 - DNA, 813 bp, Heterodera glycines
  Genomic contig location: Contig_ID=SeqID_15446; Location=817..1629; Strand=-
  SCN-specific regions: Sequence locations=1-421,443-578,600-813
ttttcttttttcagttgccatttccttccgtcgtcgtctttttcgtatttacgccttcattcttccgtccgaatctgaccaagtgaatgctcggaatcagtttttagtgtaattccctttcagtttggttcgtcccatcctgttttggagtgcgacctgaacaaaacctgcggcgcaaagtgctgctcgcaaccgttgatctttcccggcctcatcagtttcgaatcatccactttttcctattttggaataacgcagcaggtccttcctaccggtacccaatgcacttcatccctttctatccgatttcaggcgccttcttacatttgggtgacttcttcgccggacgatgagtctgaaaaggaccaaatttgtgccacaactctctcaaattggtcgaaactggctctctaattcccacttttaccccttttttccctttcagccatcaaatccagaacacatgcgtcagtgtgtgtcagctgtctgggctgtgcgtctctgtgggtgccgatggtcgaatggcatgttcgcttaacgggaggatggcaccgaatgggcagggaggtggtgctttcaacttttttgtttctttaaaatgtttaatgaccaataaataactgacagatggtgaaaatctcatgcagggccgtacacttttgcacttgataatgcatgacaaatcaattgcagaaagcgaagacaataataaggcaaacaaaaaaacgacaattatcgtaaactgtttaaatgaaaatgatatttttacagaatttttgcttctcacacgacgagtgttgtacttatcggagg

SEQ ID NO: 79707 - DNA, 534 bp, Heterodera glycines
  Genomic contig location: Contig_ID=SeqID_15447; Location=1146..1679; Strand=-
  SCN-specific regions: Sequence locations=1-99,122-435,457-534
ttcattggacaattttcaaattgcaaaaagtagagaaattagtgaaaatcaaacggagagggaatttacgactccgcaagtaacaaatgggtcgacgggggaggagaagaagcgcaatgagaggagaaaagaagcagacaaagcaccggaccaacgatcgaagaaagggcacgacgaggaagccaatgctaacgaagtgcactccaccaccggtgcccagccgcccacattcacaaggcgacatgacgaggaggccaatgccaacgaagggcactccgccgccggtgcccagacactccctttcacagtcagtgcccgactgcccatattcacagctcggactttcacttatgaagtggatgttgcgcctgctgttgcggaacgatttgaaagtgctcaggtcagaatgaaatgtcttttacatctgattacgcattttttgttgtgctttctcttaggttgttgacatctacaacagtttaccaccaccaatggatccacgaatgaagcgagaaaatgcgaatggcatttcag

SEQ ID NO: 79708 - DNA, 1485 bp, Heterodera glycines
  Genomic contig location: Contig_ID=SeqID_2436; Location=324..1808; Strand=+
  SCN-specific regions: Sequence locations=1-428,451-479,502-580,602 -797,832-882,919-953,992-1242,1266-1485
atgttctcagtgtggggaaccgggccacagaaaaggcacaaaaaagtgccccctttacgggaggggttctctgaccccggtcgttcaggagaacgtcccgaaattggagaagcgtggccgaggtgtgcctcggcttcagatcgccgcgagaaagccatctccggtttcgccatctccggtttcggaggtggcaaccacggaatcaagcctcccgggtcttcacacctccggcagcgcggagacaaaaccgaaaaaaggttttgcgcgccccaatttgactgaaatgaccgaattatccaatcgatcagtcttagtgaaaccggacctctccggttttaccaggatctccacggaagggagagctggcacgagtgggtacggagtgccgggcgccactttttccatcgtggaggcagtgcgggcactgcaatcaacagtggacactttggccacaacagtccgtggaagagctgcgggtgttggaggtgcgtgggtgccaatttctcccgttaaaaaggagagaatggacactcctcctccctttttgactggggggaacaccgaaccactggggcgaagaaagaggtgctgctgccgttgccacaatcactcgtcatcgccatcttcctcatcagatgagccgaagaaacgccgacaccgcaagcattgacggcccccggaatttgtcgccaaagcgaccaaaaattgattaaccgatcaattttgttttgaaataatatttatttgtgatgattcatcccctctcccgcctcctccggggttcgcttataaaaggcagccctaacattcattcaaaaaatgtaaatgaataagcagttaatcgatattgttaagcaaaatttgtcccttttttcccattgcatttttatgttttaaatttaattttcaaataaatttggattagaatttccctttttgtaagggaattaaggaaagattctttttccttaaaaagcctttttggtttggtcgaacttctgtcttttctggacagaaattcttaaaacttccccagtcgttgggaagagcaaatttttgcggcctatttgtcgacaattatgtttgcctcgattttgaaagaaaactcatttggccattgacttttggactttttaagccatattgggccttcccaccataatggatgtgataataattcttcaggggtacatcctctacttccaacatctgctgggttttcttctgtgggtacggctatccgacatttgcggatttaacatttgcggacccgacatttgcggacccgacatttgcggaacccgacatttgcggactcgacacttgcgggcccgacaattgcggataaccccgacatttgcggacccgacatttgcggaacccgacatttgcggacccgacaattgcggataaccccgacatttgcggacccgacacttgcggacccgacaattgcggactcgacacttgggaatcaccttttta

SEQ ID NO: 79709 - DNA, 5532 bp, Heterodera glycines
  Genomic contig location: Contig_ID=SeqID_2436; Location=1464..6995; Strand=-
  SCN-specific regions: Sequence locations=1-28,50-755,777-1153,1178 -1422,1444-1590,1612-2131,2153-2235,2258-2395,2418-2454,2476 -2522,2544-2727,2750-2817,2847-3359,3429-4260,4282-4399,4421 -4589,4611-4808,4842-5014,...
  SCN-specific regions: Sequence locations=...5036-5107,5177-5407,5431 -5532
gttgaagtaccatcagtatatttccaaaactcccgtggccaaattttttggagatccattagcttgcccagtatcttggcaggcattccaagcaaacatgggcgaaaagccgatatctgatgctcaaaaatgcacatatttacttttaagtctaaaaggaaaagcggcacgttcaatgaaaggctaccaaccaactgcagaaaattataattggtagtaaacgctctaaagcgattatttggcaatgaaaaagtgataaaggaggcactccaaaatgaattattgaatttgccacaggccaatgaatcagctttctcacttcgagtatgcttagaagatatagaaagagtcgtcagacaattaaataatttaggatttgtgggagacaaagattttgtgatgatgacaattaaaaataaatttccaagaacaattatcttagaagcattaaaggcagaaaaagatagtgccatagaatggaatgtcgaacaattgattaatacgatagaaatcatcagagagtttttttggcgcaagaaacgcgaaataaaccaaatggtcggtcaaatccgtttgatcctaaatgttttttatgtgacgggccgcattgggcctcaaattgtaaacagataatgaacagagaaacccgaataaaaataatggaggattaggcacgttgtcatcgttgcttgaaaaaaggacatgaaatacgaaattgtacgggaaaaatgtgttacaattgcgacggaaaccataacaaattaatttgttcaaaacccattcaaaaagtagcagcaaatcgcttcataaatagctcaagaaacgaaagacaagcgcagatttcaagtttaatagcaactgccatcggagaaatgggcagtgaaaaggaagcattactaatgacaatacgcgtgaaaattataaatggaacaaaatatttaagaattctagtattttttgacaacggaagtcaaatctctttaattacggatgaattgattaagaaaattaacccagaaaaaattagtgaaggaaacttagaaatattacctattcgaaaagacaatccggtacgcctaaactcacctaaatacgtaataaaattagagagattggatggcaaatgtgaagaaatcattgtaagccgtattgattttataacaaagaaaataaaaagagctaacattatttcaggaaaagttgagtttgtcgaagaaagacctgacattttgatcggaataagagaattttggagattctttcaaaaagttgaaccattcagtgaaggactcgttaaagtagaaacagtttttggaacaataatttgtggcgaaacagttacaaaagggaaaaatatatgccccctaactgcaatgattatagaaaaagaagacaaggagcccgaaaaattatggaatttagaaatgattggaattaaggacaatcctatagaaaaggatgatgaagttgcactcaaaatgttcaaagaatccgtgtacagaaaagacggacgttatgtagtcagctggccatggaaaagtccaattgatgaattaccaacaaacttcggtctggcataccgaagaatgattggaataattgaaaaattaaagaaatcaaaagaatttttaaaacaatacgatgaaattttcaaagagcaattaaaagaagatattgtggaagaaactgaaataaaaggtcacaatgaacacttcttaccttacctcaccattgtgtattagttgaagaaaaaaagacaagagtagtatatgatgcgtcggcaaaaataaagggcaaaaaatcattaaatgacatgctatttagagggccaatttatatgccagaattaccaggcttattaatgaggtcaagactacctagaattgctctttggggtgatattcaaagagccttttggacgttggaattacaagaaaatgatagaaattatgctaaattcctatgggtcagagatgtcgaaaaaccaatctctaaagacaatttatgcgtttttcgatttaaaagagtaccatttggtgttatatcatcaccatttttattgggggcaacggtgagacatcacttagaaaacgaaccctcagatttggcaaaagaagtcaaaaataatacatttgttgataatgtttttgtgggatgcaataattttgaggaagcaattgaaaaatataaaaatttaaaagaactatttaaaaaggcacgaatgaatataagagaattcatatcaaactctgaaaaagtaaacaaagaaatacccaaaaatgatcgtttaatcaaggaaaacccgaaggtactcggtgtgaattgggaaataaataccgacaaatatattataaagtttccaaaaattatcgacaatgaaaatttgagcagaagaaaagttttaaaagaattaaactcagtttttgacccttgcggttggttagctccgtgtttattacctgctaaattattcttccaaagtttgtgggaagaagatcgaaaatgggacgaccaaatatcagaagaaaaacaaagtgaatggaaattaattaccaagtcattgaaaaatatggtaatcaaatgcaatcgcagaattgtgccagagaaatatgaaaaagcagatttacatgtttttgttgatgcctctaaagatgcatatgcggcatgcgtttatttgaaaatcgaatcatatacaaaccaaattaatttgctatatgcgagaagcagattaaaaccaagaaaagtgcaaatcactattccaagaatggaattattgggagtattattaggcactagagcaattaagtacgtggaaaaggagttaaaaatagaaataaaagaaaagattttatggtgcgactcaaaaccagtattattctggattaaatcaaaggatgatcagccaagatttgtagaaaacagactaagagaaattcgagaataccaagatttagaattccgatatgtacccaccgtggcgcgacgtttgcggatttgacatttgcggacccgacatttgcggacccgacatttgcggacccgacaattgcggataaccccgacatttgcggacccgacacttgcggacccgacatttgcggacccgacatttgcggaacccgacatttgcggactcgacacttgcggacccgacaattgcggataaccccgacatttgcggacccgacacttgcggacccgacatttgcggacccgacatttgcggaacccgacatttgcggactcgacacttgcggacccgacaattgcggataaccccgacatttgcggacccgacacttgcggacccgacaattgcggactcgacacttgggaatcacctttttaataaaatcgtgttaaaataattagaaaaatcatttttgaattcaaaaaaaaattattttttaattaaattaatttaatatggacttttcaaggcaacaaagtcgttgattctttatttgaaaaaaagaaaatgcctttcccaagggccaacgggaaaatgtagttaattactccacatcgggcccatcccaattttcaaaatcatttcgcatcagtcggtattgcaacgatctcagcaaaaaactttatttacctctttcaaaatctaacataacactgttaggggcaataccaagtgaagcatccaaggcctatttttaatagcaaatttaaattaaaattgaatgttaattattgcatggtcagattaaaatacaaacaataagtacctgaagaactcggatataagtatcttcggctttatttgccataagtgcaaacacagctgggacactgctatggtcaatcaagcaattaatcgtatagacttgtagaaaatttcgcgatgcgactgtcaaaaaaactcataaacaaatatttgcaattttacttcagctttaaaactaattcaggacgagttactacctttgaaggtgccatcagaagcccaatcacggtaagttcttaaacggcgaaggccaccggcgcctttgctttccgaaagatgtgccagccgcacgcgccgtttgtttttcactttgccaaaacagccggcgcctttgctttccgaaagatgtgccagccgcacgcgccgtttgtttttcactttgccaaaacagccggcgcctttgctttccgaaagatgtgccagccgcacgcgccgtttgtttttcactttgccaaaacagccggcgcctttgctttccgaaagatgtgccagccgcacgcgccgtttgtttttcacttcagcattactttaaattcttaattcttacacaacacaaaaagtattttgacgatgacataaaatgaaaacgttttttctatttttacattcctcttttcgataattttttgatgcattaaataaatattttaatgcagaatgatggtaaacaaatttattaaactatttgttttgcttcttctgatctctcccaccaatgaaaagccgcatcagaaaagagccttagtgacaattgcattgattggcgccttagcacaattgaaggcgtatttattagcgcacaccggagttatattaacagcatcaatgataacagcatttacaacattgtctctcgctgtatatgttaagctcaaacgtgagatattgtttttaaatatttagaacttatttattttctaaattatagattgcagatgtggcgatctgttaaaagatttctttcccataaccttcgtcctgaactcgtacgagttctctgtgtcagtggaggaatttacacccgacaacatttttgaaaaaatttcaaaagctaggccggaatgttcagcaattttgctttggtttgttttaaattggtttaaattattatagaaagatataataaattcagcttctccttcggaaacgactcgaaagattaaaaaaagtgatgaagacatggggcttcttttactttatgcaacccgaagccaaggacggctggaaatcttcgactgcccctgattcaggaggctggaaatcttcgactgcctctgtttcattttttatgatatttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcccaagtgtcgagtccgcaattgtcgggtccgcaagtgtcgggtccgcaaatgtcggggttatccgcaattgtcgggtccgcaaatgtcgggttccgcaaatgtcgggtccgcaaatgtcggggttatccgcaattgtcgggcccgcaagtgtcgagtccgcaaatgtcgggttccgcaaatgtcgggtccgcaaatgtcgggtccgcaaatgttaaatccgcaaatgtcggatagccgtacccacagaagaaaacccagcagatgttggaagtagaggatgtacccctgaagaattattatcacatccattatggtgggaaggcccaatat

SEQ ID NO: 79710 - DNA, 880 bp, Heterodera glycines
  misc_feature (16)..(16): n is a, c, g, or t
  Genomic contig location: Contig_ID=SeqID_15448; Location=2360..3239; Strand=-
  SCN-specific regions: Sequence locations=1-880
atgtgtcaccgacggncaaccattcgaaaactggatcgaccagttcaagaaggtcggaccgggaatggccaccaccttttctttcttcgtgcatcttcgcgggttttatatgttggtctagatctttgaggcagagacattgattgaaatattagagcccgacctgggacctggatccagtcctggattttcctggatccaggttccaaaccccaattttggcaaattccttttcctggaccaggattttcttggaattttgtccagaaatccaggtccaaccaacatggaattcaggtccagaactttttttttaaatgtcgagctctaataaatatagtcatttgtggtttttgggatcatccaaccaacaccgccgatttgcccccaaaatccataaaaaaattgtttatttataggcatttctcagtgccaccactccttctggcagttacaacatttatttttacttggaagaacaaacaattgaaccgttcgaactggtgaacgaacagaccggggaaaagttggcactgcaacaagtggcacaccaaacttacaattggctgctgaagcgccgcccggaaatttttgttggggaggcggtgccggttcagtgggagtacgaaatagtgaaccgtttgaacactgtccagattcaattgcctaacgacgaggagtgccttgggtgattttaagcggattttcttagggatttgcatttttcttttttacattttttatggtttaaacccatttttgaaaaatccgcattcgattggctgactacaaaaaaaaactgcccttgggtgatttttcaccggattttttccttttggttttcgcccttctgatgacttttttattttttatgaataaa

SEQ ID NO: 79711 - DNA, 90 bp, Heterodera glycines
  Genomic contig location: Contig_ID=SeqID_15448; Location=1218..1307; Strand=-
  SCN-specific regions: Sequence locations=1-90
ggattatttttcaaaacacctcgtagactgggggataattggagactgcgggattaatagagactgggctataattagagcatatacggt

SEQ ID NO: 79712 - DNA, 587 bp, Heterodera glycines
  Genomic contig location: Contig_ID=SeqID_15449; Location=271..857; Strand=+
  SCN-specific regions: Sequence locations=1-587
  Gene Ontology: Biological process=positive regulation of growth rate
atgctaatggccatggaaaaagtgcatttggtaattacaacggacggaaaggtggggagggagggacatggtcaactcaatgaaaacctgttaatttgtaaaatatgcaggagtttgtcacgcgtcggcatttggtcaccgaatgtgccaacgaatgtttggcctccggcggtcgcattgcgttgacggaattggctgcccaactcagcgtcgacttggaccacattcagacggcggtcaaccaattgttggcaatgaatcggcactaccgaatgaccgaagacgaaaataccgtcgaagacatttcgacgcccgccgaattcgtcgtctgtgccggggaactcatccaccggtcattttttgagcataatttcctttgaatttattaagctttagtgaatttatcaacgatttgtgctttcgtcttaatgcacgtctcacggaatttggccaaatgtcactgtttcaactgaccaaacaatgggaagtgcgttaagggaatggcactcatgaagaatgattagtccgataaaattccccctccccccggcatagcaatagcactcaattgatttacgaaaaaaaaa

SEQ ID NO: 79713 - DNA, 968 bp, Heterodera glycines
  Genomic contig location: Contig_ID=SeqID_15451; Location=153..1120; Strand=+
  SCN-specific regions: Sequence locations=73-426,462-496,525-621,644 -916,938-968
atgacgacaacaacaacgacgaccactaccaccaccagcagcacgccaacgacgccaaaggggacgacgacggaaaattggagcgaatcattagcggctgctgttggcggaaagaccacacttgtgctgatcatcgttgggtgcgtttgtccttgtttaccatcattcattggggaccgaccatgacgaaggcgtgtttttttgaatgtcgacaatggcacaaaattctggcatttttgggtcgtttggggaccaattctgacgaatgagtgtttggagtgccggcactgggacgaaattccggcattttgggttgttgggggatcgaccctgacgaatgagtgtttttgggatgtcggcaatggcacgaaattctggcatttttggaccctgggatttcatcatcatcacagcagataaaaagcagtagtaatttcacatttttccccatttgttttttcagcgcactgattgcaatcattgtcctgctcgtggttgttgtgtgctgctgctgctgcaaaaaacgcaaacgccgccgccgccacacttctgccgacgacgacaacgacaaggaggacaacaaaaagcgcaaacgtcgccaccacacttctgctgacgacaagaaggaggaggaccactaccacattgaccagcacaataagaaggagggggagcagcacggaaaggaggacaacaaatcgccgatacaaagcgaactgaaagtgtcgacgatttccgccgtgccaagcgactacaacacgaacaaacggctgggcgcaacagaattggacgtggaagcggaagaggtgccgaagacgaagccggttcccaaaaagtcgaagtcagaaggaggcacaaagcgcaaactgtccaatttcttttggtccaccggcaccaccgagaagcgaccgagcgcggcggaacatggcgtggaagtgccggaaacgattcgtgatgatgaagattga

SEQ ID NO: 79714 - DNA, 1552 bp, Heterodera glycines
  Genomic contig location: Contig_ID=SeqID_15451; Location=1515..3066; Strand=-
  SCN-specific regions: Sequence locations=1-230,252-520,544-1185,1212 -1226,1254-1422,1444-1552
atggcacggcacatttggcccctgttgaggaacggacttcgcacgctggtcagcctgaagcgcaaacaactggcactgatgcgcaaacacgtgtcgccaaccgtcctcttcgactgtccgaaccttgtcgaaatcatcaccccgattttgcccgaacgtccgactgttgacaacaccaaatatgctgctgacacctcggcccgtgacctgtacatgtggctgcacatgccgcgccctgacggtcgtccgttggtgttcaaattgaccaaatggagcaaaggatgggaccaattcgtcaacgatttgtgctcggtgggatttgtggtggatcaatcgatggggacggatttttcaatttttcactgaccttttttgggtttttattgcagttcacacgacgataaaataattggacaattttaataataactttttctataagcatcaaaattaaacattcttggtatcattcgatagcccaaagtgtcctttattagcctgcaaaatttcaaagaatttcattatatttcaaaaaagttgtaaccagaaaacttcaaaaaaatgaattttctgtacatttttgaccattactttttgaattttgaatgaattttttaaaatcaacttaggactaatagaggactctttggactatcaaatgataccaagaatgttgaatttgaatgcttctagaaaaagttatgctgtattaaaactgtcaaatgtttttatgaccgtatgaactgcaacagagtcccttttttgatcattattctgcaactgatctgatcgcatttccccttctttttaacacagtcattcactgcagcgtccgtcccggtcaaatacatggtgctcacttcgttcgaattcaactacaccaggagtgaaaaaatggtcaacattcggacggcggaaaagctgacgctgatgagcaatgtgcatccaaatccaaatccagctgtgggtggcgtggtgtccttcgtgaagattctgcgctgtccggcggacttcagtgacgctgccatggtctcctggttgcgcgtgtcgcgcgtgaacagcgaacgtctcacgaattgggtgaccattggcttctcggatgacgaaattgggtatggggacgagtcgccaacaaatttaatgttcggctttttcttacgcttttcctccgttttcagaccgttgcctggctgagaagaactgagaaggattttcaaactgcagatcaacagcagcagcagcagcagcagcagatgagccctaagcacaatggacaatcggatggaattatataatctgatcattatcgtttcataaattgtatttatccgatcaaatgactgattttgtcactgatttcactgtgtatattctgtatgtacatattgtatttgtcttgtataagggaagtaaagcgtcgctgaatgttgtattttgtgcctcgatttttgaaattagacaatttttccattttgaaaacagtacaatttcgtcggtatttttcttttttgtgtgaatctcttttatagccctcccccacccctccattaaa

SEQ ID NO: 79715 - DNA, 972 bp, Heterodera glycines
  Genomic contig location: Contig_ID=SeqID_15452; Location=783..1754; Strand=-
  SCN-specific regions: Sequence locations=1-466,493-604,632-703,727 -894,916-972
atggcgcgtgctgcacgcagcaacgtcacccggagcacggacggcgtatcgccgtcatcggggcaacaacctaaacaccttctgaacgatgacgaacggttgatccattaccaacaggagttcaaacggttcaaaaaattgctggaggatgagcaggagcgtccagcgcctgttcgtctcacccaactgcccaccgacgaagcctcgaaggggctgctgcgcgatgcactttccgaggcggcgcgaacaattcaacaacaacaacaacctcaaccaaaacagccggcgccgcaccaacaacaacagcagtcgtcgcactctgattcgtctacaatgaggcagcctccacgtcgcagacaacgaccagccaaaaggtcaccccgtacgacatcagtctctacggatggcgccgaagctagccgcttcccgtcatcgtcgtctgccgcctccttgttgacacgcactgataatggaggaagaggaggagctgagacgactgagcgtgaagacagctccaacgacgaccgaccccaaaatatggcggcagttggccccgcaaggaaaggacagcgggaagaagcggacgtgcaactgcatccatcaacatcgacagcagcagcagcagtcttacgtgacactgagcagaggaaacgacaagccattgactatgcgttacgcaacgcgggcacgctgggcatcggagatggacagcaggtgtaccggctgatgcaaggcgcgtaccgtccgatcaagaacagcgatttggatgctttactcacttttcattttgctgagcccaaaccggagaaggcaccgcctgggtacaaaacatttattggcaatgctcggaaagacccgcgcatggtacggatgctgttcggcaacagcggcgcggaaagcggaaagaaaaagaagaagatgggtggtggcggctgcttgctccaccgctgctacacttttgcatgcatttaa

SEQ ID NO: 79716 - DNA, 483 bp, Heterodera glycines
  Genomic contig location: Contig_ID=SeqID_15453; Location=1801..2283; Strand=+
  SCN-specific regions: Sequence locations=1-16,78-290,327-367,399-483
atgtcgaagctgggcagcgatggtaatgatgaacatggcggtgtcaaccttggtggtggagatggtggtgatgatgggcaagcgttgccaaccgaggatgacgggctgggcggtgctcatctccctcccctattgttcatcgatgaggaggaggaggaggagagccccgagtcgcgcgctggggatgacgtgaaccgagtcggtaacggtcagatttacactgaaaaagtgaagcaggaaggggaggaggaatcagacgacggcaacgctgacatggattctgtcagccatgacacgtacagaagcagcagcagtagcagcaccatgagttcgtcgttgttcttgctgcatgactgtcatatgcgccaccactaccaccacgacaacaacaactgcaacagcccgccacgaaaacaagcggcgacagagctgctcaagcttccgctcatcgactatttgtgtgggctgaacaacgggtgcagt

SEQ ID NO: 79717 - DNA, 417 bp, Heterodera glycines
  Genomic contig location: Contig_ID=SeqID_15454; Location=1445..1861; Strand=-
  SCN-specific regions: Sequence locations=1-240,262-417
atgcgccccaacgatgtcaacttttcaaatgcgcaaaaggtgtggaagcgactgtacggacaccctgctcttcaaaagcggacgccacgcttccgtaacgaccagtttgtacgcatgagcagagagaaggggcaatttgagaagggatatttgccaaattacggggacgaaatcctggagattgacgaggtgttgaaagcggtgcgcccgattctgtacaaactgagggatgaacacggggagaaattcaagggcagcttctatgatcaggagctggcgcgcgtcagaaaggatgcagagacgagctaccgcatcgagaaggtttacagaaagagaaaactgtcgtatgggtccaccgagatgcttgtgaaatttataggatatcccaatcgggaatggattaatgagtctcagctt

SEQ ID NO: 79718 - DNA, 626 bp, Heterodera glycines
  Genomic contig location: Contig_ID=SeqID_15455; Location=241..866; Strand=-
  SCN-specific regions: Sequence locations=1-72,94-114,141-164,186 -365,387-398,420-514,537-626
atggaagaagccaatgaaaaaaagcacgttcccgaggaatacaagcatctgctcaaatttacgtaggttttgtttccaaatttttaaggagaatctttacctacttttcaaatgtatttatttttaaattaattatttttggtttaaatttggtattctaatttaaatgcatttttgaacatttttccttgcttagatatccggattcggttaaaaaacctgaggaatatctcggcggaggttttgtcgccatggaaatggatgcgaaaaataagaaagcaaaagttaacttttatgccgctggacacattcatccaacggagcaaaaatttgtggaaaaagaaaaatttgtggaaggatcgaaattcaaatacaacgtggaattgtagtagagaacgaaaaaagggggaagaacaagaacatagaaatttagatcagtacatccaattagaaaaaaaacgtcgtattaccgtaacccattatgtaaacgcaaccatttatttgaaaaaaattttttaaagaaataatctctcattcgattaacaaaatctaagtttaaactattaatgtaacgacatttgactgtttaaatggggagaatttcaattgatccctttttaattaaa

SEQ ID NO: 79719 - DNA, 855 bp, Heterodera glycines
  Genomic contig location: Contig_ID=SeqID_15456; Location=22..876; Strand=-
  SCN-specific regions: Sequence locations=1-116,146-166,188-204,226 -539,610-622,644-751,773-855
atggctcaaaatcgcaaaatttgtcattttttcgtcgcccgggggaggtacttccccaagccgaaatccttggaccttccctgctccccgccctcccactgggaattcggaaaatgaaaaataataaaaaataaagaattttttacaaaataccttatcaaatatgttaaattccttttttcccgggatgcctctcggcacaacaacttgctcttgagctgctggctgttagcagattctgcttgttggcaaaatctctaattattttttaataattcttaggtgcttcatggggccataaaataaaatatgttcaggaattcattgctcctaatccgccatgacgggctaatatgaaaaaagtttagaattttttgaacatttttggtaatgtcggaacaaaagatgtgccctggtacaccgttgcgggcaatcgggattatcatcatttggatggatacgacccaattgcgcctcaaattgaaattataggcgaaaaatggtgaataacggactaataaataaatagtcaaaaatgctaaattaaaaaaaagaaaaaacaattacctaataaatttaaaatataaatattcaaattaacatttttatgaaaaatgcccaattttccgtttttcttttaggacttttcccgccccttattacaccgtgcattacaattttggcataaatttggaaaaaagtgttcgttttgtgatggttgacacagtcattttatgcggcagaaatcggaaaatgtttaaagatgagaaaacttttaccgaagaaatcaaagagaaatcggaaaaacacttcgaatggctggaaaatgaattgaaactggcaaatgaaaagtga

SEQ ID NO: 79720 - DNA, 1518 bp, Heterodera glycines
  misc_feature (330)..(330): n is a, c, g, or t
  Genomic contig location: Contig_ID=SeqID_15457; Location=71..1588; Strand=-
  SCN-specific regions: Sequence locations=1-220,245-265,291-1008,1030 -1406,1429-1518
atgcgcgagttgcagacgcgcatcaacgccaccatcgtggaagtgcaaaaggtgacggccaacccacgcgcggacctcagtttgggccgaatcggacgatgagagagacgacgacaaagggggaaacagcgggggggggggggggatttgatataaacgcccattttcgatgcattttcaaattaggaaatcaaattgaagacggaggattttcacccaattttccattgtcttattgttttttccatatttattatgctttttcaataaataaaatattaatattattactccattcttttgcctctgttcgttctcacttcgaatatntaatttatttttcaacgattgttggttttttcatgtttttaatcctttaaatggggcgtcgtctgcccaatgttttggttaccggaacgccggggaccggtaaattcatttattttatacactgataataaaaaattttaatctgcgggaaaatcgacgttggccaaaaaagttgcacaaaatgttggcatggagcatatcgacaccgcatcgattataaagtgaggccaaaaagtttttcattttttactttgcagaggcaaaaaactgttggaattaaaaatttatctttaaaaatttcaaaccataaggaaaaattttcggttttcatccctccgtttgttggtcataaataagtagttttttttcgattattgaccaataccaaattactctataataacggcttcaatgggtttagggaacgcgaattttatgcggaatacgacgcccaattggacacccacgtgctcaacgaggacgcactccttgaccatttggaagtaaacacaacaacagtcacatcaaactcaaatagttttgaccgctttcattgctttaaaatacgataaaatttaaattgtaattattcattggcttttcaggaacgctttggctctgacgcgggcggcctaattttggactatcactgtgccgaaatgttcccaaagcgatggtaaggaaaagaaacaacagaaaacacattgtttcatgccctccccctcccaatttgccgtaggttcgacctcgtcattgtcctccgttgtgccactgactcgctgttcgatcggctgaccgaacggggctattcggagaggaaaagacgcgagaatttggaggccgaaattttcggcatcatcgcagaggaggcaaagtgggcatttaattagggctgattttttttcaaaattgtcctaaaatatacagttccccttacctgcttcctctcttttgttagaaatggaatggctacggaaaaaacttagtaattcattgtaaaattttgaaaaaaatgaaatttctcatatttctgcctctccttgagcatatatgactctcgttatgcttttaattatatccaaaattaaaactttttccagtgccagttatgacgagtcggtcgtgcacgagttggagaacagcacagccgaacaattggaggccaacgttcggacgatcaccaatttg

SEQ ID NO: 79721 - DNA, 1505 bp, Heterodera glycines
  misc_feature (1464)..(1464): n is a, c, g, or t
  Genomic contig location: Contig_ID=SeqID_15457; Location=2732..4236; Strand=+
  SCN-specific regions: Sequence locations=1-118,148-407,429-642,664 -891,996-1505
  Gene Ontology: Mol. function=acetyltransferase activity; Cellular component=membrane
aggaaaaatttcaagagctaaacagagtgtttaaggaaattaaatggagaaccaaaattggacaataacaattccgccgatttaaaaaaccaaaatatgattggacgaataaatgcgcaaaataagaaatttaaaaaaataataaatcgaatttcggcatagaattgagaagataaagaaataatggcagacaaaaaagtgtgttgctgctgctcacattcagcagaaacaggaagactcgcgcgtcgtccgctcgtcactgcgactattgccaaaatcgatctgatcaggaaattctgaaataggagaaatccattaagagttcagttcaatggatagataggtctctttagagaagggccaatattataaaacagaggttctattttctttcccaccatcgctctacccccggcgcaccccaaaacgtaccccaaaacgtcgccgcaaaaagtatagaaaaagtacaagaacaatttggctacatgtcgtttcaatatatgtcatttcaatactcagtgaaaatgtgtcatttaaatactaattgtaagtcgtttcaatatatgtcatttcaatactgtcgtttcgattcgtttcgtcgctcaattataacgtcctttcgtgactgccttatgttaaccgaaaattttaatataggatattcttcataacaatggttaccggtgtaaataacaaaaaatgataaatttggaatttgggacaaaggtgagaaattatgggtttcttggatttcccgaagtttgggtcttatatcagacatagcaataaatgaaaaaattcaaaagttaaaatgaatgaaatgagaaaacataaaagaaatgttaataggtatgtcaaatccaataaaaatatcttgaaaggacttagtattgaaatgacatatattgaaacgacttagtattgaaatgacatatattgaaaggacttagtattgaaatggcatatattgaaatgacgtatattgaaacgaaatgcaccggggacaaatgcgtaatgacttttttgtatatcgatcaaattatataattccgtatcgatctacctaaatgtgctctttataagcgattaatatagcagaaagttaagcttgaaaactaaaaaagtctcaattttgtatattttcgggaacaatttcttacccaattcattgttgtttttgtccccaccactattttttttagctttaaggccgcaacattttcctgggcgacgatgtgttcctcaattacaactgttgcgtgttggacgtttgtcgggtggacattggggacaaatcgatggttgggccctttacgcggctgaccacccccgggaccgagcagtgcgggaccagggctgggaatacggaagaccggtgcgcattgggcgaggcgtgtgggtcggaggcggagcggtgattttgcccggcgtgacggtcggcgacggcgcaatcattgggtgggngtgtgtaaacaaattggcaaaaaaggcaatgactgactgat

SEQ ID NO: 79722 - DNA, 103 bp, Heterodera glycines
  Genomic contig location: Contig_ID=SeqID_15458; Location=1..103; Strand=+
  SCN-specific regions: Sequence locations=1-103
actaatcagatccaagttggtccatcgccgccagtaatcgttaggccaagcggacagagccatccggtgggcacttcccacatgaatttgtttgccgatctcg

SEQ ID NO: 79723 - DNA, 297 bp, Heterodera glycines
  Genomic contig location: Contig_ID=SeqID_15459; Location=601..897; Strand=+
  SCN-specific regions: Sequence locations=1-141,208-297
aaaggtaccgcggcgattgtttgaaccaggccatctgcaaatgctcatgcgaggcggacccatcaaaaccggcaaaaaatgtgtgcacaaagtccaactgcgactgcttgcgcatcaaggagtcgtgctcaaaggcgtgccaaatttaatttaaattattgccaaatttaatttaaattatttaaaaataattttttaaatttttttcagttatgcgcctgtaaacaaatttgcaagaacaaagagccgccaaaacgggcggcaaaagtgaacaaaccggcacaggggtgtgctttt

SEQ ID NO: 79724 - DNA, 2610 bp, Heterodera glycines
  Genomic contig location: Contig_ID=SeqID_15460; Location=280..2889; Strand=+
  SCN-specific regions: Sequence locations=1-106,146-241,285-451,487 -511,533-621,696-857,881-963,1006-1170,1192-1374,1411-1647,1676 -1902,1946-2049,2078-2142,2185-2203,2229-2283,2338-2387,2431-2610
ttgcaaatgcggcggagattgtgccaacggagcatcaaaattccatgtgcctaaacatgttcagaattgtttcctggaacataaacatgagagcaggtcaattgggaataattatttattttttaattcaaaaaattatattttagacagcaagtttttaaattccaaaaaaaataaaagaattttttcaaaaatattttgtgattttctctaaaaaggaaaactttttgaatttcaaaatgaaaagaatttttccacctggaaatttaatttaaaaaattataccccataaaagtggcctaattgtgacactaattggcgacggttacatttatcgtggcgactttttccatgactcaaagaatgagccgcatgtggaggagcaattagttgccgcaatttatgatctgatctccaagtacaaagtgagtagaaaatagtattagaagtcattaatatttaaaaaaaatttttctattaaattttgcccaaattttcaataaaattaattaccttttttgtgctacagtaattttcattttttttttacattttaattgccggaatttaattttgatttcaactgctaatcacccatcactcattactcaaatgttgatgtaaaattaattacaattttttatttttttgtaattttaatagtatagtttgatctatttttttaattttaatttgcatggccaacctatttttttacattttaattgcctgtcatcaattaattttttttaactgatacttccatccacaaattgaggttgattatttttactcgagttttgggtgtaaaataagctatcattttttggtattatgtgtatactaaaattttgtccatttttttatttattttaattttcaatggccaacctatttttatggcattaattgcctgaatttacttttaatttatcccataaattgaggttgatctgtacgaaattgtcatttttgtgtccaagagtccatgctttcaccaggattgtgagcccaaatgtgaggtggtggacgaatgcaaatgcaataaaggtgtttttttatatttattgactattttatgccttggaaaattcaaaaatacttcaagataaatttttaaaaaaactttttgcccgaattttatttttgatatattttcattttaatatgcccttgaaaaaacaatttcctgaaaaaaattcgagaaatttttcgcccccaatattaaatcattcaattttttggcgtttttaggattttttcaaaaatcttaagttttttagggtggtttttttttgtgttttttttgtctttaggtcagtgtatttttgcgaaattttttttgttgaaaaagccaacctaaaatcaattaagattttaatgaaaattaatttaaaaaaaacaattttacctaaattatttttcaagcttgtgctaaactgttgggattgcttttgtcaaaggtgcgcaaggagttgagcaaagtggatgtgcgaatgacagtcaaatttctgtgagttttaccatattccctaaaacagagccccgggggttttatttttcaaaatcttggaatggtggctttatttcatggggaactgtaattaagcatatacgagacatgtttgtatgattagttaaatatgagcattttaaaaattaaaatggatttgaaatcccaaaaatttcgaaaatccaaatttgcatgcctgtgcgaaatcctctacatattagctaaagataagcaaaaaacaaaaaaaaaaactaaaaacttatttaacatgcaaatttcacttttctaaattcccacgcattcctaattatcatttttttgacctaaaagagatggtttaaaaaaagttctaaatggctgaaataggcttataaataggatttaaatgctaaaaaaaaataatcacataatttaatttaattttaaataattcttttgtaaaggtatccgcatttgaaccgtggtgatctgtacaccaaacagggcattttgtccatgttacagtcaggcatcaaagtggaaccactgttgttgaaggtggtttttgaaaaattttttgggaagttcttgatgtcatatttttgtaaatttaatacattaattgtctgcaaatcttgtaatagatggtcattttatgtttttttttttttgaaaaaaattacattttttttgtatttgtccaaatctttgttatttaaaaaattaaaaaataaatcgaaaacttggaaaattgcaaatataatttttttgggttttcagctttttcttgcaaattttcattttaaaaatttaacgaaaaaataagttttttaattaaaaaattacaaaattcattgtacgaactgtcattgctcctccctcccggttatggggctaaaaaagttttttttttcaaatttttaaatttcaattaattacactaattaatcacataaattaattaaaggattggagtgccgtcatggattgggcaccacatccagaacataagggcgaatatttgcaggtagtgtataactatctatctattcttgtatttgttgtaattacattcattcatcattattcaaataggggtatttaaaaattctataaaa

SEQ ID NO: 79725 - DNA, 1278 bp, Heterodera glycines
  Genomic contig location: Contig_ID=SeqID_2437; Location=143..1420; Strand=-
  SCN-specific regions: Sequence locations=1-352,374-701,727-917,985 -1097,1119-1278
atgtctgaaaaagcgcggcaaatctcaaaagatttgggtgagttttaaaaaggaaagtgcgtagcaatggcatttttatatcgaactcattctccgcccctttggccatcggtgcgaattcggcacaactttttcattctcagcaaaaattgttagccatggcatttatttgtggcattcttcctgcgaattttgaggactttcccgcaaaatgtgaaacggagtctcttctccccccccccctttcattcccttcggcagaaatccctcgagggcatttgccgagaaaaataaaattgggggtataaattaaaaagacattgtgagcacattctcaaataatgtcaaaacagcttccttaaaattttattttcaaatatttatcctgcttttccttctgttttctaatgaaatcaatgccaaaagctttgaagaatcttctgccattttttgcctgttttgaccaattatcctcaaaaagggaatttattttcaatttatgccttctctccgtgtcccttggcttcgccggaataataaacattggttggttggccaagccaaagacagtggccacaaattgggactttgccgcactcccattgagttagcttcgtcttttgttttctctgccgtccactcattcgtatcgattgccattgttttaaagaaagtttaaattaaaattcgggtttcttaatttggctcatttttgtatttttgagaatttcaaactttgactcggcttagttcactcattggccagatgagatggacttggacgagttgcgacgccagcaatttgccatccgaagtttcaccgaatcggtggacgacgaagagacggaatggccattgccaccaacaaatttaatgatgaggagaggggaagaagtgcagttgggacgggatggaagggaagaagaggaggaggaggaggaggaagaagaaaaggaagagaatgcgtggcggaggaggaggaggccaagcccggcgcacagcgacgagtgcggcacaatgcgcgagagcagcacggcagacacaattgtggaagtggtgggcgaacatcgacaagcccaaaacagcaggacacgctcatattcagctcaatcccaactcggccagcacctcaaaatgggccccccaaatggacccgtcaatgggcgaaacgcaaaaatatgtgatgagagtgccgggccccgagttggtggaccaagaattcgaactgcacaaaagtttaatggacaattcggtggaggaagaaattggggaggatga

SEQ ID NO: 79726 - DNA, 1083 bp, Heterodera glycines
  Genomic contig location: Contig_ID=SeqID_2438; Location=319..1401; Strand=-
  SCN-specific regions: Sequence locations=1-546,621-831,963-1083
  Gene Ontology: Mol. function=protein binding; Cellular component =axoneme; Biological process=N-linked glycosylation
atgacaagtgaaggcggcgccatcgtcgaattatacgccggcgccgaacgcatggaaagcggcgaccaagtttggcgtgagctgaaaaaaaaggcgcctaaaacggctgaactgctcgaagacgcgtgggcacagatcaaaaaacggtgggcaaaattcaacggaatgctaaacgacgaggcgaagcagtacatggagaaggtgaagcgtgggaacagaacatttatttgagttaaatattcatttatacataaataggtgaaatacagcggttggcattggtttgttcgccaagttgtgggcccatttgtacgccttcccaacgacgcgaaaacgaatctgacgctgagtttgttcgacgcgtatccgttgatgaacacagtgatgagcaaattaatggccaaccgaacattcttggattgggctggagaatggtacaaaaatgcggaacagcaaattcagacaatggaaaagggtaattaattaatgaacaaatagaaagaataataattggggagggggggggggtgcgaaggagtaataatcagagagggaaagatggagagagagagagagagaggataaagcatagatcggagagggaaggaatggaaggaatgataaagaagcgattagagaggaaggaaggtaaagataatgcagggtagaagagggggaggggggggggaaaatatatgtaaatcaaaaataattacagaaaaaaatgccacgaaagaggagctgaatgaggatggcataatggcacagatgaaagaaatgtttaagcagatgaatctcggaaatttgaacgatttaatgggaggaatgggtgaagaagaagaggaagaaatgagagaaggtgaagaacaattggaagaagaggaggaggaagagaaagaggaagaagatgaaaaggcagctgagaaagaaggagagggcgaagaagaaaaggaagagggagagggacagtgcagcaaaagcaatgaaagcaatgaagaaggaggacaatgtatggcaaaagaaggcgaagagaacgcagaaaagtcagagacgaagatgaaagaggacagagatgaattgtga

SEQ ID NO: 79727 - DNA, 548 bp, Heterodera glycines
  Genomic contig location: Contig_ID=SeqID_2438; Location=1028..1575; Strand=+
  SCN-specific regions: Sequence locations=1-406,429-548
atcaacggatacgcgtcgaacaaactcagcgtcagattcgttttcgcgtcgttgggaaggcgtacaaatgggcccacaacttggcgaacaaaccaatgccaaccgctgtatttcacctatttatgtataaatgaatatttaactcaaataaatgttctgttcccacgcttcaccttctccatgtactgcttcgcctcgtcgtttagcattccgttgaattttgcccaccgttttttgatctgtgcccacgcgtcttcgagcagttcagccgttttaggcgccttttttttcagctcacgccaaacttggtcgccgctttccatgcgttcggcgccggcgtataattcgacgatggcgccgccttcacttgtcattgctttgatcagtttgagtaacaaatctttgggcaatagagctggaaaagatgtttcgccaaaaccagtaaagacattcgtttaacacctcgaaaatgtcagggagccaattagcgataaatgtgtcacattttcgggctaaataaatcagccaaaataccctcctctcctaaa

SEQ ID NO: 79728 - DNA, 669 bp, Heterodera glycines
  Genomic contig location: Contig_ID=SeqID_2439; Location=286..954; Strand=-
  SCN-specific regions: Sequence locations=1-6,39-669
atggaatttgtgccatttttattatttatttttctgtttctgctcgcaattccgccaattcgttgtgatgaaattccgttggatgggcccgaccccgaggtggacgagcacatccgaaagcaattccaaagccacgcggacgcattctcagcggggattaaggacggatgggcagaagagatacaaaagcaaatgggtgagaatttagtcaaaaattagcattccctcctatttatgtaaaataattcaaatattgcaatttaggagaggagggtaatttggctgatctaattaagcccgaaaatgtgacacaatttatcgctaattggctccctgaacattttcgaggtgttaaacgaattgtctttcctggttttggcgaaacaattttttccagctctattgcccaaagatttgttactcaaactgatcaaagcaatgacaagtgaaggcggcgccatcgccgaattatacgccggcgccgaacgcatggaaagcggcgaccaagtttggcgtgagctgaaaaaaaaggcgcctaaaacggctgaactgctcgaagacgcgtgggcacagatcaaaaaacggtgggcaaaattcaacggaatgctaaacgacgaggcgaagcagtacatggagaaggtgaagcgtgggaacagaacatttatttga

SEQ ID NO: 79729 - DNA, 783 bp, Heterodera glycines
  Genomic contig location: Contig_ID=SeqID_2439; Location=153..935; Strand=+
  SCN-specific regions: Sequence locations=1-783
atcaacggatacgcgtcgaacaaactcagcgtcagattcgttttcgcgtcgttgggaaggcgtacaaatgggcccacaacttggcgaacaaaccaatgccaaccgctgtctttcacctatttatatatttaactcaaataaatgttctgttcccacgcttcaccttctccatgtactgcttcgcctcgtcgtttagcattccgttgaattttgcccaccgttttttgatctgtgcccacgcgtcttcgagcagttcagccgttttaggcgccttttttttcagctcacgccaaacttggtcgccgctttccatgcgttcggcgccggcgtataattcggcgatggcgccgccttcacttgtcattgctttgatcagtttgagtaacaaatctttgggcaatagagctggaaaaaattgtttcgccaaaaccaggaaagacaattcgtttaacacctcgaaaatgttcagggagccaattagcgataaattgtgtcacattttcgggcttaattagatcagccaaattaccctcctctcctaaattgcaatatttgaattattttacataaataggagggaatgctaatttttgactaaattctcacccatttgcttttgtatctcttctgcccatccgtccttaatccccgctgagaatgcgtccgcgtggctttggaattgctttcggatgtgctcgtccacctcggggtcgggcccatccaacggaatttcatcacaacgaattggcggaattgcgagcagaaacagaaaaataaataata

SEQ ID NO: 79730 - DNA, 1626 bp, Heterodera glycines
  Genomic contig location: Contig_ID=SeqID_2439; Location=1504..3129; Strand=-
  SCN-specific regions: Sequence locations=1-143,199-431,453-523,545 -786,808-809,831-1515,1572-1626
  Gene Ontology: Mol. function=receptor binding; Cellular component =extracellular space; Biological process=Wnt receptor signaling pathway
ttcatttgggccggttgttctgacaacattcgctttgggaatcaagtgaaccgaggatttttcattctgtaaaaattccaccgtttttttagtttacgcgtaaatttattgacactgccgaaaaaaagcgaagcgatgcgcggtaaaattgaaaaataattttaaaatatttaaaatgcaaaatttttaaaattatttggccagtgacattcgctgtcaccaaactgaacaaagtttgaagaaagaatgaaaggaatgagaatgacctttcacacgccatctcccatttttgtgtgtcgacgattattcttttattcattcgaccaaaaatggggataaatcaaacaaatgggggacaatttatgaaaaacggaaaaagggggggggggggggtactgtggtaaaaacgaatggagatactgtaggaaatgatacaaaatggggagaattatgtacataaacgagaggattattcttctacgaagggggagtactgtaaaaggggtaagggtgagatactgtataaaaatgatcatttattaggaattagccaaggatcaattaaaatttagttttatttacttttagctcattgatgaacctgcacaataatcgcgtgggacggcgccttttggccacaaatatgcgcaaaaagtgcaaatgccacggcgtcagcgggtttgaagaatgttttattactttaatgaggctatttgagtagtttagttcatgcgtgacaaaaacatgttggaaaacggtgccgacgatggaagaatttgcggcacttttgaaacagaaatacacaaatgccaaacaagtgaacaaagagaaagggttgggaatgatgaagttgccatggggaggggtgattaagcctgggattgtttggcattttgaaatgccatcccccactaatcgactcaatattcattcattttcggcactttttcttccccaattgcgccaccatttgtcatccgtttcacaggtggcattggccctggacagtgcccttctcgtgttgggtttgcctccgcccgaccccctccccgctgccacttccgtccgctccgatcgctttgcctcctccgcccagtcgtatcagccccatcattttccgccccctcaacccagcagaactgacctcgtttatctggcaaaatttgaacattttctcatcgcatcatttcaattgttttcaggttcgttcgcctgattattgttcgctttacgcagaaaatggacagaaaacaatcagtgggacaagcggcagagaatggcaatttaccattattcttttttggcacttttatgtcggttttcttttgacagtttttcacaaatcgaatgccaacagttgtgctgtggcagggggtgggaaacgcggcacgaaatccgacaggagccgtgccgatgcaaatttgtgtggtgttgcgatgtgaaatgtatgcgatgacatgggaattaaaacggggaggggggggggggtgagacgaacccatcgaattccgtcgcaattttaagtatttaattaaaatatttaaaaatgaatttcattttaatttaaaaatcggtttctctacaggtgatatttgccgccgtgaagttgaacgtcggttttgcaga

SEQ ID NO: 79731 - DNA, 127 bp, Heterodera glycines
  Genomic contig location: Contig_ID=SeqID_2440; Location=402..528; Strand=-
  SCN-specific regions: Sequence locations=1-127
atggccgctcaattagcctcggctctatcctcgcccgactattacaattgccaaatgcagccgggattgacacggcgccaacgcgacatttgcgtccgacatccgtccgccatgcgatcaattagcg

SEQ ID NO: 79732 - DNA, 408 bp, Heterodera glycines
  Genomic contig location: Contig_ID=SeqID_2441; Location=105..512; Strand=-
  SCN-specific regions: Sequence locations=1-212,234-408
atgagttttcgggacatttcgccaatttcttcgccactttcgaattggtctccgctgccgcttacttttatgttctccgtttgggccatctgctgctcgttgtccgtcacttcccaactgttcgacaccggcaccttcagatacatgcccaagcacagcttcggctccctttacgacggtggacggccgcatttgccgaggagtgccagcacattttttgccaggtaattaacggcggatggcacacaaaaagcaacggattatttaaattgaatacactcttcaaaacgcaataattatttgatcattttcagtcatttcgacgaccgcacagccaacggtctgatggatgcgatgccggactatttgcgcaccacgggcggtgccactgcgccccatttgtccggg

SEQ ID NO: 79733 - DNA, 423 bp, Heterodera glycines
  Genomic contig location: Contig_ID=SeqID_2441; Location=620..1042; Strand=+
  SCN-specific regions: Sequence locations=1-306,333-353,376-423
atgccaaatgcttccgatttacgcattttgggcaatttaaacgaagtgcttacgttaatgaatggttataccctcgcctcattacgaatatcgtccatttgtgagttttaaatgaaatgccattaaaataatgagttggctaatcgcactgctttggtgaccattaaagcgaactgatttaatgggacactaatcggaatgtgcacaattcaattgaacggcactttgggtgacaaaccgactgaagcatttcgaagaacaccaaaaattttatttctcgggtaattaaatttcattctatgaaactttattatttttttataaattttaaactgtttaaatgaatttttaggtgatttaatttaatttaatttcgaacaagccaaaggcacaaagagcctaatccttaagtttataaagaaa

SEQ ID NO: 79734 - DNA, 138 bp, Heterodera glycines
  Genomic contig location: Contig_ID=SeqID_15463; Location=629..766; Strand=+
  SCN-specific regions: Sequence locations=1-138
atgcaacgggcgatgagcaatttggctgtggcggtggcaacggccgccgagccgtcgctgaaggcgcgtcatttggaagcagttcggatgttttttgatcggattgccgacgaaagcggttgccaacccgaacagaaa

SEQ ID NO: 79735 - DNA, 551 bp, Heterodera glycines
  Genomic contig location: Contig_ID=SeqID_15464; Location=230..780; Strand=+
  SCN-specific regions: Sequence locations=1-327,349-551
ggatcccatctccgaagttcagttggccgctctccgcgtgctgatggcactgacgcgccaccaatgggcgtatgcccatttttgtgccataactgagtgagtggggttttttgcccacctttagttacaggcccgtaaccagaaaaagattttttgttttgtgtaatttcctaaatttttggtgtcgatggcaaaacgggaaattattagccattttcgccaaattttggccatttttaagacaaagttagggctttgatctattcgcaattataaattttttaactatcgcttttcaaaatgtttctgttgccaatttcaaaccccttttccctccatttcttttcagtttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctgcgcgactattgcacgaaagggcctttttggggggcgccggtggtggaagtcgcgacggaagaggcggcataa

SEQ ID NO: 79736 - DNA, 759 bp, Heterodera glycines
  Genomic contig location: Contig_ID=SeqID_15465; Location=559..1317; Strand=-
  SCN-specific regions: Sequence locations=1-55,77-287,309-371,393-759
atgaggcccccaaaacgtgccccgttaaagaaaaaggattccacagtaaattgcacttttccaatttttcaaaaaatccaatcatttagcaaatttcatccgttcccgatggcttgggtgagatcttcagccgctacatgttcaacatcggcaagattgagcagagagttcgcagcgaaccgagcaatgggatcgtgatcaactgtgccaccggcgaggtgaacaaaaaaagttgggaaatcggcgtaataaaaggggcggatttataacaaaaaaaacggatttgaaaaatcataaaacccccaaatgggattccgtccgattgattccattcagcaggtctcggatgcgaaaaaattttttgggcagaatttcaaaatttggattcaaaagtcaaattcccgaatgtgattccgatgacttttgaactcagacacggaaagaaaattttttttttcatttttgttatccataggccaaccaactatttcagtacgaattcgaccccgagttgtgcaccgcccgctcggatgaggaattggtggaaacggtgcgccgtttggagcgccaaccgaagtttggccgttcagtgttctcatcggtggcgccggacccgggccaaaagaacaaagcattgcaggcccagtggcgcgaattcaacaaggttggttaatttcacgtgatgggtgagggtggacacaaaagttagcattttcttagagttaggaaaacccaacggggggaggccttgaaaataaa

SEQ ID NO: 79737 - DNA, 742 bp, Heterodera glycines
  misc_feature (89)..(89): n is a, c, g, or t
  Genomic contig location: Contig_ID=SeqID_15466; Location=1..742; Strand=+
  SCN-specific regions: Sequence locations=1-360,383-403,425-477,499-742
  Gene Ontology: Cellular component=mitochondrion
atcaaaaattatttttttcattttaaggcatcttaaaattgttgatcactggcgcaagcgaatcaatcacagatgaagcggcaaaatgnccagcaaagagccgggctttctctattacactgccggtcctaaaaaaattttaattgcaaaaaaagttttccgcttttcataaaggtgttcatccgcatgacgcaaaagatttcgatgacggacgaacgttggatttccttcgctctcatttgaccacaaattcgcaatgtgtcgcggtcggcgaatgcgggttggacttcaacagaaatttctcgccacgggaccagcaacttcgggttttcgaggcccaggtttttttttttggcgtttttaaatgcaatttcatacacacaaattccagtgttttccattcttttaaattttttatattcaaaaatcgtgaaaatgtttttccgtggggctttgacattcattttatccaattcccaactgatttcaaaacaaacatcgaaaaattatttttcctttttgttagtgctatttttgtttgcgttggcttttccaggtccaattggcatgtgagcttggcaaaccgttgtttgtccatgaacgtgaagcgcaccaagaaatggtggccattttaagtcgccacagcaaatcgttgccgcccaccgttatccattgtttcactgggacagaaatggaggccaagcagtacatggacatgggactgtacatcggactaacgggt

SEQ ID NO: 79738 - DNA, 421 bp, Heterodera glycines
  Genomic contig location: Contig_ID=SeqID_15467; Location=1051..1471; Strand=+
  SCN-specific regions: Sequence locations=1-100,122-348,381-381,409-421
atgccaaaaattattaaagttactaaggattttcctgtttgccagagaaaggaattcagaaccgaacctgaaaactctcttgatgaaatagattatcatcagcagaatttaacaagtttcgcaccgcttcgcattgcaataaaaatttcagatttgtatgaggccaactatcggcccacttgcccaaacggtggccaagcacttcaaatgcaaacgcgaggagtgccaatgactctgatcggtaaaaaatgcgcggacaatttttgcccgaccggcacaaaatgcgtggagaaggaagtgtacgcgcactgctgctaaaacagcattgattggctaattaatgaaaggaaaataataattaatttgtttttttttaaattccaaatttttgtttcaaagataaaatgatcacagcaaatta

SEQ ID NO: 79739 - DNA, 142 bp, Heterodera glycines
  Genomic contig location: Contig_ID=SeqID_15467; Location=214..355; Strand=+
  SCN-specific regions: Sequence locations=1-142
tggacctcgccggttgtgcggggatgcgcctgccggcaacggataagcagggtcacacaatcatttgcgccggggctggctacccatcgcctaccgcggcatgtccgtccggctatcggtgcacaatgttggcgcacatggg

SEQ ID NO: 79740 - DNA, 727 bp, Heterodera glycines
  Genomic contig location: Contig_ID=SeqID_15467; Location=1655..2381; Strand=-
  SCN-specific regions: Sequence locations=1-155,179-284,306-400,479 -589,612-727
atgaagaaatatattttgtttttgaagcgagcacttttgaaggagcgcatttccggtgccaaagacggaatgggaaagtatggcatgaaggcattttccgacgatggcgcattggttgggtttgagatgttagaattggaaaacatggtaattatatgaattaattttaatacatttaataagaggtattattaacaacatgaaaaggggaattgctcacctaccaaaataaaaacgaagaatgaaattccaaaattcgagagcgatttatattagagctgagcgggaccgggtcgggaattcccggtttttcaagtcccggtcccggcgggactaattaagcactggtaacatgggggtctgggtgagaaattagagaaggaaattgatggagaaggagaaattttaagaaaaaaaattaaattatttatttcatttaaagcatttattaaaatttattattttttctttttttaaacagcctaaaaccgcaaatttaaccaaagctttgatcaaaaagcaatttaaaagcaaaaaaatttaagagattgtcaatttattaaacaatagaaaaattctcatcgaatcttttggaattttaaaataataggcagctttaacgaaaattgttgaattatttaaaaaaattccagaaattttgtgactcagaaattcaaagcttttaccggtacctttgaaaaattggtacttttttaaaatcaataaa

SEQ ID NO: 79741 - DNA, 276 bp, Heterodera glycines
  Genomic contig location: Contig_ID=SeqID_15468; Location=736..1011; Strand=+
  SCN-specific regions: Sequence locations=1-276
atgcttcgatttcggccaaaagagttcgatcaccgccattcgagcagccgatcagttggcctttcaacgcgtccgcaacattttgggcatccgagaaaggaactgatcaaacagcaaaatgtgagagaatatcacattgatcagctgctgcttgatcaacaacacgctgtagctgatcaccagccgcaacagcaaccgttggcggtgatggagcaaggcgaatcatcggcaattaaagaaattgttgctgttggagaagacggagcagggaaaaag

SEQ ID NO: 79742 - DNA, 682 bp, Heterodera glycines
  Genomic contig location: Contig_ID=SeqID_15468; Location=320..1001; Strand=-
  SCN-specific regions: Sequence locations=1-314,353-408,431-682
gctccgtcttctccaacagcaacaatttctttaattgccgatgattcgccttgctccatcaccgccaacggttgctgttgcggctggtgatcagctacagcgtgttgttgatcaagcagcagctgatcaatgtgatattctctcacattttgctgtttgatcagttcctttctcggatgcccaaaatgttgcggacgcgttgaaaggccaactgatcggctgctcgaatggcggtgatcgaactcttttggccgaaatcgaagcatcccttgccactcattctgctggtaataaccaattaatggacaattgcctaataattatttatttatttttaaatcattttaaatatctcttcccccttttagatgagtgtgcccttagcctcggcttcgtccgtgccatgttcgccattgccgcctctgcttcttctcatgccagcaacaacagcgaatggcagacattgagtgggcagtttggtcagaaagtcactgagattgactcgaaatgtgcagagtttggcattagcattggccaagtgccaatcaacggtcccaagggtaaagtcaattaagaaaggaataatcaaatccatttaatctcttaaggtgtccatgttcaaaatgtgcccaactcggaaagtgtgatttctatgcctggattggccggctcacacacccaa

SEQ ID NO: 79743 - DNA, 1430 bp, Heterodera glycines
  Genomic contig location: Contig_ID=SeqID_15469; Location=1679..3108; Strand=-
  SCN-specific regions: Sequence locations=1-54,76-300,323-408,430 -569,591-1241,1264-1392,1416-1430
atggtcacgcaaatctttcacattcgaagccaacatcttgaacaattggacggagtgaaggaaggggaccaaaaagagcaggagcttagtgaatttatgcgttccatttgcaactttcttagcactgttagtgaaatgccatcaaacggatttcataacaatgccactaattcaatcccttttagctgactaacgaaatgaccattatgcaacggataagtacggacactttgcgttcattcattgattcacttctttcgttggtcagcgatcagcgtcttaaaatacttaacaaacaggtgattttttaaaattgatttggcttttttttaatgtttcaatcattttttataggtattccgttctctcaacattattgtgattcgactgtgcgaattcacaaatccgaatgtgtgttttgtggcgctgatgaaattggtcatgaaataccaggcctctgatcctggcggtcaattgtcatcgttggtccgcaaatgtctcaccaaattcactgacgcaattgttgagccgaccaggattgaaaaagtttattaaatagtttttttttgtaaacaaaagttttctttttaggttgacattctgactgtgctgcacccaatccacgagtattattcgcgtttttatgttgccgatggacaaaccaaccaaatttctgacacagtgaaggacacgtccaaattgttgtgcatttttttacagcgtttggtcatcaaccaaaaatatgcggtacgtttgtcacttttagggaaaaacactgtaaattttattaagaattttattaacttttggtttaaaaagaggtttttattttattttttcctattattttcgactaaaaatttttaatttttttgtaggggtgtgcatatactatacttattgcagcctttctaaatggattttgctttttgttagatgctcaactatctgtatccgtttcccgaaagttcccaattggtgagttatgtgcggcgatgtatccgaacggtgggccgaaaagcgatggaagagaaacggcaggacggtggcgcaggcggagctgcccaaaatcagaataatcaaccaaaaatgggcggtgatgatgaactgtcgtcaatattcagccgaatttctggcgacattttcaatggggtgaatgaaaatgaatttttatgtgaaaaatttaaacaaaaatagcaaacaaaaaacggaaaatttgattgcaggctgtcgaggacttgtacaacttcatggacatccatcctgaccaaaatttaaaatttgaacaactgatggctcggtgcgaatacgcttccattgttcggcgcgcatttgtcgaaattcgtcaaactcgtcttaatcgggagccattgaaaccggggtaaagataccattttaaaatttaattttaaatacttagatacaataaa

SEQ ID NO: 79744 - DNA, 924 bp, Heterodera glycines
  Genomic contig location: Contig_ID=SeqID_15470; Location=75..998; Strand=-
  SCN-specific regions: Sequence locations=1-477,499-924
atgaatatttttaaggcaatgtttttattgacggagcagttatcgattgtgccggagaagggatatgagcggtgtgatcgcgccagtgtgatggcaataaagtatttggagtggcggagcaagcgggatggaattgagatacggcacgcggggaacggacgggaggtcaaaattgggaattacaaattggatggatttattacgaatgtgggagggcgcgacaaatgcattgaagttatgggatgctatatacatggatgtatgaactgttatgacccggcagcggaactgattggaggaaggtcggcccaggaattgaatgatgagacgcaggagagattgacggagctgcggaagactttggacgtcgaagaagtttgggtaagtttatttgacatttacatttttattgtgaatttttagggctgtcaaattgagaaggagctgaaaaaggatgaagagatgcgggacttcttcgacgacagagggaatgagaaagggccgattgatccgcggatggcttatgcgggagggaggactgggccgatgaaattgtatgcaaaatcggatgagaagaaaaaaattagtgtttatgatattgtgagtctgtatccgtcagtgaattacggtacagcttacccaattggattgccgcagattattataccgaagagcgatgagattgatgttaattggacgagaccagaggatttgaagtataagggattgtataaagtgagggtcaacccgccgaaggggttgcggattccggttttgcagctgaagtgtgatgaacgattattgtttccgctatgttggagatgtgcgtcaaaatttaagaaggagactacgagatgtaactacaagtgcccacatgatgaggcacagcggagacacgtggcgacatatactagcgttgaattg

SEQ ID NO: 79745 - DNA, 1533 bp, Heterodera glycines
  Genomic contig location: Contig_ID=SeqID_15470; Location=1078..2610; Strand=-
  SCN-specific regions: Sequence locations=1-682,705-735,758-924,946 -1126,1148-1216,1238-1533
atgaacaatattatgagacagagggacgcagctattgagcttttacataattgtggaattgatattaacgaatatagctatggtgtggagcaattgccgaatgttcagaaatattgggtgggtttaaaaacggtgaaaaacatagaaatgaccaatttttcaggatgagatttaccccggaaagtaccgggttgttgcgtttgagaagtcagctgatccgcggaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtggggggaatgccatgtgaaaaggagagtggagtgaagattgaatgcccaaagtgtcaccgttacttttacaattgggagtgttataattatcatcagggacatcagacttgcaaattatggaagcgttgtgtgatctgtgataagacatatttatttaacacgaagaagggacatgaatgcggtgagacttattgccagctttgtagtgtgagccatgaccccaagcgggggtgttatattatgccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggtgagagtgacgtgtacggaatgctgtgatgacaaaaacaggacgaattgcaaaatttgtggggaggagaggatcaaggattggagcgaggtggaggagggacatgagccgaccaaggattttgtggagtggattttaacggcctttacaaattatgatacgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttagactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggataaaattaacaataaataattttttcaggtacaacgaaaacaaggagacacctttttatttggatgatgaattgaaaaaattattgccgaaacgacacggagattttattgctgtcaattattga

SEQ ID NO: 79746 - DNA, 1532 bp, Heterodera glycines
  Genomic contig location: Contig_ID=SeqID_15473; Location=47..1578; Strand=+
  SCN-specific regions: Sequence locations=1-19,41-160,182-359,381 -393,416-628,650-674,711-714,755-933,962-1020,1083-1141,1163 -1205,1228-1477,1499-1504,1526-1532
atgggcgagaaccgttcatcaagcattagcagcatcaacagcaacttaattgatccaattaacagcaatttgagtgatctatccgattatgatgaccagccaatgttgatcccaaatgaatgggcaattaacatgctaatgtaattgggggatggattatttgatgaaaatgcttataaaatgaaatggaaatttacattgtttgagtaaaagcaaggttcacgttaactaaaaataagtaggatatgagtgttttaatatggagtcttccaatttttaaaacagtttgtgtccggcaatgccgatagcttcgccggaggaaattttgctgatttttaatagattttttcaccaaaagaggaaactttttaagaatttctgagctaaattttgagaaaatgatataaaaatgatagcaaatagtataaaacattcatattttggcattttttttttactcaaaagccatcaaaattcctaaaaatttattcaaaaaaacaaaatttcaatttttgagtctttttcatttataaggtaggaattgattaaaaaattgattttaatacatttgaaattgtttctaatattatcaacacagggacaattcgccttttgtgaatccttcgcaaagtttgaaacaaaatcaattcagttctaataatgaaaattttccgtcatcatcatcatcattatcattaccatcatcttcagaggcaccaaatattttgtatgaaaatgctaatgaaaataaaaatgaattgggatttttaaatgcaaattggccagttgtgcagcaaaaaacggccgataaaaacaatgattatgaaattcaaaaagaaaaacggcagaaattggaggagttacaaatggggaacggcgcattggacgagcagcaaattgaagcacagcgaggcttaaaacttttgtgtaatcaatttaataaaattaattattttttaatcatcttaaaggttaaaaaacaattatgcctccgggataattctggaaattttggccctgaaataattttttatgaattttttttttctattatttgttacaaatatttatttatttattttgaactctttatttttaagcaaataatttttgccttggatttactaattaggctttcggatttaaaatgaaaacttttaattcaaacctaacataattttcagtgcataatatatggtatattattatgctgagttttgccattttacaaatccaattggcgcccatcgaaacgaccatgcttcaagtgcagcaaggtgcaaaattcaacttttattatttgaatttggcattggagaaaatgaatgcggacaaaattttggaaaatatcggcactgaattggtgcaggacaaaatgatccaaaataacaaattgtttatggatataattggagaaataaatgtgcatgcaaaaaaagtttttggtcaacaattatatgagtaaggatttgaaattatttttggaaaaataatttttgatctatttaaatttatttgttaaatacataaaa

SEQ ID NO: 79747 - DNA, 1133 bp, Heterodera glycines
  Genomic contig location: Contig_ID=SeqID_15474; Location=86..1218; Strand=+
  SCN-specific regions: Sequence locations=1-138,162-342,377-571,596 -864,886-1069,1091-1101,1124-1133
atgtcaaagcaaagtttggccgatttgttaaatgaaacgacaaaaaatgatttggcatgtttactgttgagccataaagaatcgctgaatttagagcaaattgtcaaaaacatttccatttcaaaaaacgagtaagggaaaggaaacccccaaaatttgggagcgtaaattgtaaacatttttatgatacgctaggttgattttcatagtaactatttaaattttataatgctaatgagcccataatggtacattttaagcaaaaatgccaaaatcggtagaccaaaaaataaacacataaattaaaaggggtgatttttcaaatgtttttgataagaaaacataaaaaataaataaaattaaatttaaaatttttccagcttcggagcttctgtatttttccataacatattaattcatatacatcaaaagcacatcaaccaatataaagagccaatttataaaataattactttcgcacatctttatcggctgatttttgagtattttgatggtatattcaataagatcaatggaccaatcatacaacaatatattgggttggactataaaataatgaaagaattttttgaaaaaagtaccaaacaattaaacggactaatagcacgagggaaaagtgacaaaccatttttatttgctttgaaggaatcggaagaagcatttatcagtgattatttgttggaaaattgcacgcatttaattgacgaacaaaacaattaaagaacagatgaaaaaaagatcaatcaaaaaaagcacagtgatctgttggcgttgtgtttttaggaatgatttttgaatttatataaaaggatttgcatcccaccttaacattttagaattccgttttgttcttatttagatttagtccgaaaatgagcattttgtttttgggtgtgaccaacagcaaaagcaattcgattgggtagcctaaagaatcgggggcgcaataaccagaaaatatttcggcggaggaatccccccaagccctgcggcaattttgccttttacattatgctaaaaaaatttgttagccaaattatgacctaattaaatttctgggctttgtggcgggctcagaggctctcactcctccaaatggaaccatacaaaaa

SEQ ID NO: 79748 - DNA, 589 bp, Heterodera glycines
  misc_feature (555)..(555): n is a, c, g, or t
  misc_feature (576)..(576): n is a, c, g, or t
  Genomic contig location: Contig_ID=SeqID_15474; Location=1898..2486; Strand=+
  SCN-specific regions: Sequence locations=1-233,282-385,407-419,457-589
atgttttcccaaatttttgtttttattttatttctggcaatgtgcaaatgccaaaatgtccgggtaaataatggcaatgcccgtgtggcacaaagccaacagatgttaggtggcaatggacagaaatttttcgtcatccaacgggacacaaacgcattggatggctcagcatcccaggttcaatccagcggaatgggaggaaatttggcggtaaggcatttttagaaatatcgtaaaatttatttattttttaatttaaataaatcttaaaaatataaaaagaaaacttagtaattcaaagcttttaaattaaatggatgccgaatttagatttttctaaaattaaaaaatgcgcaaatttgtgtgaccaaaacaaaattaataattgaatattaggaaaataaactaacaattatgacttttaaatattaaaatttaaaaaaatataattaatatctatcgccagcaaaacatgatgcagcctcagcagcaacaattttcacaaaattttgcaacaccaccgcaggcacaacaaactcaacaggcggttagaanaatcttatgcttaattgcatncagcatcgtttaa

SEQ ID NO: 79749 - DNA, 1763 bp, Heterodera glycines
  misc_feature (448)..(448): n is a, c, g, or t
  misc_feature (1408)..(1408): n is a, c, g, or t
  misc_feature (1450)..(1450): n is a, c, g, or t
  Genomic contig location: Contig_ID=SeqID_15476; Location=50..1812; Strand=+
  SCN-specific regions: Sequence locations=1-851,880-1519,1541-1763
atgaccaccatcaatcacaaccaaaccgtgttcgacgcgacttacacggacgtggccaaacggatcagcgacggaggcgccgatgggaacacaaaccacgaacattcggacgaggcgtaccgaaaagcggctcgtaggttttcgaaattattttccgattttttatttacaatttttgacctttaaaatgtggtgtgtgcacacaattgtaaagtgcctaaaattggcgaacaattcactaaagaaatttaaacattccgatttcaactctttctcggcagggcgtccgtctgaagttcgaatttcccttctacggccatcggctggcgaatttaaccattgcaactggagggtttctgtacgtcggcgatcaggtcagcagctgagaatgaggggtaaggagaaggcgaatttggtccggcggtttagttttgatgaaattttgggncatttgggcccttccgccccccgtcttccccccccccccggcaactctttcaatcgctgttcacttttgcctccttttagacccattcttggcttgcggccacacagtgagtgccaatgccaattggctcttgaaactccttcctctttcttatccacacactcacaatcagatacattgcgccactgatggccaactttgatacgatggccgacaattcgagcatccaatacggcgacgacggcaaacggatggtggtcgagtggagaggggtcacactgagggacaacagagagggttagtcgggggggggggaaagtatgcggaccaaatccaataccaaaataacgggagggaattgacgggacaaggctaaactcgccgggacataacgtcctgcttgaattttttttatatattttaaaaaaataccctcatttcagccggtccttttactttccaagtgcatttgtggcgcaacggcaacatcactttcgtctacaaacaggtactccccggtccgactgatctgtgcattgtaaatgctgcaattttccgtttttaggtgcccgtccccgtgacgaacatttccggtcagttcaaccaatcggggcgctgccaaaatgtcgcacaaaaaaccctatattaaaagttttttctcccatttaataactcaaccccatccgccgcagatgctcaacacccgtgcaaattgggcatttcggatgcctatttgttcaaccacaaagtgtccacgctgtcccaggccgttccacaaaacaaacgcgtgatccacgaggtatattttcagcaaggagagtggttccacttcaaaatggaagcagttcgccccctcccctcaaaaaaacaatttttgtttttaattttgttagttttttttcgtctcgatgcaattcctaatgggttctctttcattggtttgagtttatttctcttttntagtaccaccggataaccattaatcctgaacaaatccgcccncaacaccgtcgtcatgcttaaagcattgccaagtgagtctctcactcgtatcatttgtccctaattccgttttttccaaatccatccttttccaactctcattttacttttccctcatcttcttcccaatgcgtcagcttgtctcgaggccaacagctgcgagcagtgcatagcaatgcaactgaaggcgttcaagtgttcgtggtgtaacccgaaggacagcggcaaagggccgtggaaagagggcggaacggcgacgggggaaagcgtgcgacagtcggagaagccgttctgttcaggtggggcggggtga

SEQ ID NO: 79750 - DNA, 1479 bp, Heterodera glycines
  Genomic contig location: Contig_ID=SeqID_2442; Location=354..1832; Strand=-
  SCN-specific regions: Sequence locations=1-313,343-399,462-549,571 -705,727-741,763-1018,1070-1074,1097-1130,1175-1199,1228-1479
atgcccattccaactgctcacaggttccaactgagcacgggcgccacgcatgctcattcaactgagcacgggtgccacgcgcatgtgccggtagctgctgctgcacgaacatccagacacgcatctgcgcctgagctgctactgcactaacaacctggcgcatctaccccgttactggctacgcctcgaacggctagggcgcggctggctaaactgaaccgcgcatgccctcggagccggctagtttattttatgtaataaaagatttctggcttttgaagcgggctttgatagtttttctgtaaaacgtttttaaatttcaaaagattaatttggttaatatttaaaaataaagcgcatttgtccgttatttttctgttaccattgtttctttttacaacatgaaataaagaatttccatattatagaattttatattcttttaggtgtaaatttaaaaatatctttattcttctaaaatataaaaattgtggttttgaacgtgatgagacatttgcgccgcgccatttgcgccgcgacatttgcgccgcccagcaaaaatggacttttgcgccgcgctgtcaaaaatattatattcataaaaattccactattatcaataagttttactaaaactataagccatcggcaaaaataactaattgaaaattcgaaaaaattactagtcacaaagattgacattcaatttttaaccattaaaatcttaacattgaataggttcatcaaagatatgaaaaaatgattaagaatacaaactaacaaaaaactgaaaaaaagaattttctttagaaaccccaattatttttttgcttcgaaaaaagaatgaaattcaattcctttgtaattaattttctcaataagttattttcatcgattttaatttaatttcattgaaaaaacgcactgattttcaaattttcgctcctattttaccatttttcgcattatttcgcaatttttatgcccttatttatttaatctttaattaagaacaaccttataatatttttaaataatttcatttacttaaacttaaaaagttttaaatcttcgttgtttcaaaattttttattttgatcttcagataaaatttgtaatttaaaagttctatttaaaaagcaatataaaatttaaaaaaggtagtcttcaagaacagatcaacaattggaattagtttatttctgtttatttatattttttaaaaccgttgatgacaaattctaggccgaatttgagttctaaacagaaactaatttttaaacattttaatcattacttcaatttcagaacttatttaattttgagaaagctaatcacactacttcaagatggaccacaagcaaaagttgcaatttacatgcaatacatatgttaatatcaatataatgaaaatactacgcaaagttagctcaaatgacaataatacttaaaaatttatgattattgttcacaaataaa

SEQ ID NO: 79751 - DNA, 1172 bp, Heterodera glycines
  Genomic contig location: Contig_ID=SeqID_2443; Location=675..1846; Strand=+
  SCN-specific regions: Sequence locations=1-289,311-484,507-633,655 -1172
atggctgttcgtaagatcaaaaatgacaacgctcggaatcgtaatgtctatacgatggctgttcgtaagatcaaaaatgacaacgctcggaatcgtaatgtctatacgatggctgttcgtaagatcaaaaatgacaacgctcggaagcgtaatgtccatacgatggctgttagtaagagtaaaaatgacaacgcagggcagtgtattgtctatacgatggctgttcgtaagatcaaacgacaacactgggcagcgtaccgtccaacaccaattcccttgtggtaaacggtttctccatgttcttcatgttcatgttaagagacttttggcttccctgtttgagcacaacaggtactaacgcctcacaccagcgcgaaggtagtctctactcgtgaggcaaccctcacctgaacgaacacgttcaggatcacggggcgaaataatagtgcggcaaaaatacatgagaatgatctctttatttaaacaaaaaccaaaaacacaaacaggtctcagatccttcgctcatcactcgagcagaatttctttgtcggtacaaattcttctgcaaattcttcctctttcatggcaacagaaggccctgcgagagatggcccgacatccatagcatccttaacagatgcgctggagtcatgtactgctggttcgtcacgatgttatgtgcagcagggtagttcagctgttcaggaccctgaaacaccaaatgaactgagctccaattgacatatactgagaaactgaccaagattgtttggaagtggttgagtccattgtaccatatcaaaaccgggttctgtacctgcctttgttgaccttgatggccatgtacagtgaagttttgcagctgatcatgtggaaagtcttgctccattctctgtttttaaaccaatatgaggtaggacttgaaaatatttgtcaccatatgattgccgtctgggaaaaacactccaattgtatggcgaacggtgtcgtcataaaagctcgtagcacggcggacattgtcaggatctacaggtgacacgacaacaattgtctgaccgagtaagacggccgcgatcagagcatcaaatgcgtctgcccaagcagttgcgccttcccgacttgcgatgtaagcgtcaaagttgttgatttgatcgtccaaaaggagtgcttca

SEQ ID NO: 79752 - DNA, 1929 bp, Heterodera glycines
  Genomic contig location: Contig_ID=SeqID_2443; Location=2236..4164; Strand=-
  SCN-specific regions: Sequence locations=1-310,332-663,688-867,889 -1929
atggaaagccgcgtcaagctgccgcccatgatggttcagccgagccgttgtgcgctcatcgaggaaattttccctgccgagctactgaacaacccgcttgcgagttggcagcagctgtcggagcgcgcaattctttgccctctgaacagggacacgcttcaactgaacgagaccatcatggtaaagggatattattgtcaaacgagaatcctatttttcttcttaaaggaccggctgacaacggtggaacgagtttaccacgcggtaactctccccgtggtggacaagacaggcgaagcggacttggagaacatcgccgccgacgccaaccatgagaacttgtgcaggatgactccaccaggagtccctgaacacattcttcgtgttcgggtgggcgcggtcatgatggtcaccaggaacatctctctggaagagggcctgtgcaacggcacccgagttcaagtcatggaactcttcgacaacatcatccggtgccgcattctgaccggcacccatgttggcaatgaacacgacctccatgccgcccgcttcgtctttggtggtgacccgaaggcaccgcacgagggcccgatcaagtgcgagcggatccaatacccgcttcgtcctggcagcgtgatgacgattaataaatcgcagggtcagaattgttccttttccttcttttgtatagtgttttttgattgcaggtcagacgcttgcgcgagtcggagtgctgttggacacctctcagtgcttcgctcacggccaactttacgtcgctttgtcgagggtgcgagactcggacaacatcagagtctgcaccacacgcagtgaccttcgtgtgaagaatgtcgtgattcgggagctcctggacgaagaggaggaggaaatggcgttggcggcgctgcccgatgacccaagcgatccggtatgatttgaataaagggattttttgaagaaatttttcaagtttccacgccatccaccggcggacagtgaacccgatgatgacaagccaattgggatgccgaatgaggcggtgttcaaaacacccacgccatccacaagggcacagcacccaaagacaacgccaattgagttggataacacagtgtccaaacaacatctggacaagttgacggtggtgaaaggcgacatcaccaaacaacaaatttggatgatcgtcaatgccgccaactcggatttggtcaaaggcggtggagtagacgacgcaatccatcgcgcgtgttctcctcgtcaaaaagagctcaaacaactgctcaacatcaagattttgtcaaatggtggaccaattgcggacggcggggtcgtggacacgcccgcgtttggagacttggccaacaacgtccaatgtatgccagtgctaatcgcgtgttagtcttagtcccacattttgtagacattttgcatgctgtcggtccaaaagtcagtgcagcgctcaatgagcaccaccgcaggtccctggcaaagtgctacaccaatgcattggaccatcttgcgagcatgcacatggatatagcaaacccccagccgagatcaattgttagtgcaattggaatttattcgttgacttatctttccatcaattataggcattcccaagcatttccaccggggctttcaatttcccccgtgtggatgccgcgcacattgccattagagcaattctgaattggcttgcggaccaaccagcggatgcaccggcaatcgatgaagtccgcttggtcgcatttagtgacgacgactttaaattgtacaaggagattcgcgaacgagtaataaataagcaatcatgttcgtttctaattttttttttcgtaggtcaaacgccaaatgaacgctggcaaacgtccaacgcccaaaacatcgttgcagacgcctttacgcattccaatggtgtgtatatga

SEQ ID NO: 79753 - DNA, 1591 bp, Heterodera glycines
  Genomic contig location: Contig_ID=SeqID_2444; Location=41..1631; Strand=-
  SCN-specific regions: Sequence locations=1-145,167-788,810-1228,1252 -1591
atgttatgggattgctcatttaaggtggacgaattggacgtgcacggtccgagcggtcaccggattgccgttgagcagggcttcaaggacgaagaggaaaatttgaacgccatttgcgaggcggcccaggccgaagaagagcgaaggcaaaggggcgaagagcgcgtcactcagctgaccgcatacttcgcgtacaacgaagcgaacccgccaattggcctttcgtatgccaactgctacaagaagttgcgctatgaccgagccaagaagcagtggaagctgaatgttgatgcgccagtgcctaagttctgccggctcaagaccgtttcgcccagcaaccgcgaactcttggtagaacgccaagcacattaccaatttgatcattttttctattacaggcaattcgactgcttctgttggttgtgcttgacccaaagggatgggagtcattgcgcaccgtcaacggcaacgtgttccctacctttgttgaagctgcgggagcacgtggtctcctcactgacgaagacctctggatgaagaccatcgatgatgcgttcagaatgaagaagtccatccggcagcgcattcgatggcttgcagtcttctttgcgacagcgaacctcgccagtccttgcacaattttggacaaggttcttgtaactgcggacaagtggctggtgcacacaagcgtagagagagcctcggccgaagagcagaagcaatacgtcctgaatgccatggaatggttcctgctcgccaatggcataacgcccgactcggagccgagggaggatggcacctatgagtccgcttgcgaacacattggtctgccacgtcctcagggccttgtgctcagcaaggacattttcatgaaggtactgaaactgttaccaattatgtgaaaaccatatgcctttattagcttgccttcttccgtgatgatgcgcttaacgagcatcttcatgtggacttccttccggacggtcaacgacgcggtgcaatgcgacaagactaccttcaaaagtacatctccggtcccaagcccaatgaagagcaacaacagctgattgatgctgtgcaaactgcactggagcacgtccaacaagtcatcgatggacaatgcccagacttttcgccagacatccagcgtctcttcatggtcaccggtgaaggtggcgcgggcaaaacgtttacgtataatgtgagatctcatccttatttttccacataaattcctttttctttgtagaagatcattgctcgcgccaagtccgctggcatcaacttcctgcccatggcgtcgaccggcattgctgccgaactgctgtacgagggccagactgtgcacaagcggctttgccggcttaagcaagttgattcatcaacttcgcccaatgttgacaacgagagcaactttgccaacatgctccgcaacatccacggcatcctgatcgacgagatcagcatgcagcacagggacgtgctcgagtttgtcgatcggctgctgcgttctgttgccacgcaacagttcaaggacttgtcttttgctgggaaggtggctaaatttgatcattgctttttcaacgtttga

SEQ ID NO: 79754 - DNA, 2039 bp, Heterodera glycines
  Genomic contig location: Contig_ID=SeqID_15478; Location=90..2128; Strand=-
  SCN-specific regions: Sequence locations=1-260,286-497,519-793,816 -911,933-1332,1382-1543,1565-1827,1850-1867,1940-2039
atgtttttcgcgtcagatcgctaccgtattcaatccgattcgtgcgactttttgtacgccattctctcttgccttgtcaagcgggttcatcaacttgcagccgatgttcagctgcgttgcccgattccatgcatttgtttctgggcgaaattgccaaatttatcgaagttcgaatgactaaccctcaattagtgttatgctcgagaatctcggggtcaaatctttgatattttcggtctcgagcatcagcagcctaagccattgatagatagatagatacattgaatattttcgcattccaagaatggccccgaattcaacactctaaattggggggggggggtctttccacgagagtttgggtcgagattttcgcttggaactcatatccaaaattggggatgcatgccaatgaggtaaaatttggcaatttgttattttccgagccagggtaaattggaaaaatttactattttcagagcccggggtaattttggaaaatttttgaaaatttgccttttccaaacctgaaaaatttcagtaattttttagagaaatttcgatccttttcccttgcgtttaaggccgagaatcagtttgaacagttagagaaggaagcgtgccgtgtgtctgtccaaatgcgacatgttgaaacagtgtttttgagtgcaacaaagtgtggtgacggagaacagcagaacaatcagctgaccaacatcgggacactgctcaattacacccaccggtgaaaacgctgggggcaaaataattaattaattaccccctctttttcggcattttacaaaaatttttaaatgtttcgctgtgccaaggagaggcgctgccgtgaaaaagggttgtcacccgaatcttgaagtccaacgtttttccgaaatgacccgagttcgcagatttttcttatcccgaattccgtctcgaattttcttctgcccttttcccgacccgaatcccggcattttctcgccccgtggcaaccctgacaggggatggaatccccaggattttcatccctttcccgctttggcacagtcgcctaatttcggaatcgcaaaattataacaaattggtctggaatagtgtagcaatacattgattgatccctgatcgctgttcagagaattggccaattcattggacaaaattgcgaatgttcaacaaatgttgagcaaagggggacgccattcgctgcggtcactgctcaacctaatgaatgcgctgtttaaaattaacgaaatcaatttgccattcgacggaagcattcttgacggcacagaccaagtgggatggggttaatgaggatatcaaatttagtaaaaacttttgggggaggggcggatttataaatgtggaaaatttggggctgggaagtggaacgagtggtcgaacccgtggtgtaagccgaagtgccaaaagtatgggtgtggggatatggccgagaatgggtcatttgtatcccaaaactgatcattctcgacaataacatcacgtatatgtcgtcaaaattccgcatttatggttagaaatggaaaattttgaaattaattcaacttctttttcgcacttagaggtccgtgtttggaattgtctgaatgagtgtcatttaactgagcacccatgaagcagggtttcatgccaaatgccatgtccaatctgggcccattttcaaattctaatcccgacattttcagaaattgagtgaacgaattgtccaattgctttcaccggccgatgtccaattggtcgcggatttaaacagtgccgaaattggacgactgttagccgaactgctcgaaaagggtgacgacagtggtggtggtggtggtggtggaaaccttggtggaatagcggaggaagacgaagatgaagcggcggaggaagaagaaaatgagggcaatgccaagagggaggaggagagggaacggagagagctccaagaagcgattgccaagtcggagcagtccttgggacttgccgaactgagaagcggctctctgccggtcaaacatcatttgtactag

SEQ ID NO: 79755 - DNA, 1500 bp, Heterodera glycines
  Genomic contig location: Contig_ID=SeqID_15480; Location=679..2178; Strand=-
  SCN-specific regions: Sequence locations=1-109,138-889,924-968,1030 -1062,1092-1279,1301-1500
atgaacgacgggggatcaaatgctgatgccaacaacaatggaaacagcaacaataatcggaacagttttggcaccgagagcagcttcagcgccgggtcttcgtccaccattgctgctgtttctgttgttggtgatcagggcctccattacagtgtgactggcgtgctcaaccagcagtcaaacaacaatgtggaaaaaattggtggcattggcaccggcaccaatcgtccccagcgtcggctgtcactggtcggcaacggcggtattgcggtgaaattgccggactaccaacggttgccgatcagttcgtttggctgtacaaccgatggccatggtcgagaggggcgaatttatgccacagccggcttcgttggtggcaccaacaatgaaggaactctgaagaagggttcatcaaaagcggcatttttgccatcatcgtactcctcctctaatgccgtcggcggtggcaatttaattgttggcccggctttcaataatggagggccaagcatttttggactgagaaatggaaatggcatttcaaccgccgcctcacacatttgtctgaatggcattggcattagtggtggatcgtcgtcgtcggcatcggtggtggcggacggcaaatcgacgctcagccgacgggcccaacggttggcacaaaaagcggcccataaactgacgattggctcactgagctccgagctgagcagctcggcatcggcactctattcactgtttacttcgtccccagcggaaaatggggcgggctttgctgcgatgaatggtggcaaaactgtgccatcatcgggcacttttgctggtgctgcgaacggagtcggcggcatttatgccgaaacatatttggggcacgaacagttttatcatgtgaataaagaaaattaaaattagaaaaataatggtagaaagatgattcgttttgaaaagggttgaagaatatgtattccattattttttttttcaaataaaattttgagaattttaaattcatttttttaatgattttaacagcaggggtcagagcaagtcggaaaacaacagaatttaaaattattttttagttataaatagcttttttgggatgtcggaggtgagattttttctagaatattttaaaattggatgggaatgaattaaaaaaaacaaatgcatatcatttttcctatttaacccaaacaaaattaatttttttttttactgttaaacacatttttacgtatatatattttttgtttacattttttaactatctaactcgaatttttagccgttaaaaattcattaattaaaccgcgattattaggctaaattcatttgatcaacatgtatttaaaatcgtttcaggacaaggcaccgtttgtttcggcacacacttcgcgtggcattgactttttggaacggttcggccaatttgccaaggaacgcgcactcatcgaggaggaatacgcgtccaaattgaagcaagaatcggaagattaa

SEQ ID NO: 79756 - DNA, 1257 bp, Heterodera glycines
  Genomic contig location: Contig_ID=SeqID_15481; Location=345..1601; Strand=-
  SCN-specific regions: Sequence locations=1-830,852-1202,1232-1257
atgcggacgatcgtctacttcaaactgttgcaaattgtgctcggtttggccttcgtgtggcaacttctttcatttcaccaattttgcggcacatttgtctgtccaaaggtgtgctgctgctcattttcaattttttttaacggtctttccatgcttttcaggccttcctccatgacatctctgttggccactgcaaacgctttacgctgatcggaaaggactcaaagacgggcgaattcggcgctgtgttggacgagcgcaaatggcacaaccaactgttcatgagcagcaccaacggtctcccaatcaaagaacagcagcagcaattcatggacgaattggccgccaaattgccgtgccctggacgccactgtattccgattacgacggtgagcaaaatgccatcagaaatatcgaaataaaatgccattttgttttttcagccttcgttttttttctggactgagaagaacagaaatctcctcgacaatgttgtggacttcttttccggccaactgttgctcgcattgtgctcgcttctcaccattggcattggcttcgcccggatgttacgccctgcggcagaatatgaagtgagttcaatgcgtgaacacagacagcacatcagcccgacaaaaacgcgaacaaattgcttttcagttgaaatccggtggaattttgaccaaattgtgatcagttttgcttttacgcgaccaaattgcttttcagtcgaaatcctatgctttttttgatcaaattgtgatcagttttgcttttgtcgggttaggagttgcaaaaatttgcttgttttccattgagtcggttactaattttgtttttcatttttaagtgcttcgactattgcatggccctctattctgtcttttgctggtgttgctctgcttgggcctcatcgtgtttgctgctctattggacatcttattggtcttgcatgaacttccgtgcggatgacacaaatgtgccgttggtcacttttgtgagttttgccgcccatttgattctgcattttccaatttctggatttttcaggtgttcgacatcgtcatggtgtgttcgttcgtcttcgagatgttcttcaacaattcgctggtgaaaaaacggcccgagaatgcttcattcgctgccgctaatcgcaaattgcgcaacgatgtcgccacggaatgtgccaatgtcgccattcatcgccagcaacagcagcagcagaagaacggaagtgccatcatcatgcaaacttaa

SEQ ID NO: 79757 - DNA, 1965 bp, Heterodera glycines
  Genomic contig location: Contig_ID=SeqID_15483; Location=79..2043; Strand=+
  SCN-specific regions: Sequence locations=1-23,45-1024,1046-1145,1168 -1266,1288-1513,1536-1965
atgccgatgccagtttttcatccgcagcctcagttttacaggggtcaaatggtaccacaatcccccatccaaaactatgcaccgtttttaaacaatcaaatgcctgcaatgcttccacaccaacaaaatatccagcatgctcaaatggctataaacgccgcacgtcagcaggtgaaccagcagccatttcaaaatgcacagcaacaggcggtcctacaccaggcgggcctgagtggacttgaatatgcgatgattttggatcgtctgccggatataaagggaaacgaaggcagcgatttgattcgcaatttctttaaaaagtacagtcaatacacgattgattggcctaacaagaagcgtatcgaatcgttggaggcaaaattaagtggccgtgctgaaagagcctataatgccgctctggccagcgaaccgttcgcttacgaaaacatcaaaagaagtattttacaacaattggaggagacggactgcagagaaatgagtgcattcaatgatttgatgaatggggtactcagaaaatccggtgaaaacctggacgatttggccgatcgaatttcgagtcttgtacgcagggcgtatccaggactaacgcgaaatctggcagatgaatactcgatcaaacatctgattagaagtttgaataaccccgaactcgcactgagtttggagcttcatcgccgtaatggaatgtcatttgatgaatttgtggcgttggcttcgcgcgcagaaacaacccaaaaagcggcaaagatacaaaacggggagcgctcaaaaccatattatgagcgaaacttccagcatacgcaccagggtgaaagaaattccgaaatgatttctaaaaatttttcgccacgccctatttgttacaattgtaacgagcccggccatatttcgagaaactgtaataaagcaggggcacagtcgaaccgaaatgcacccgcattttttccacggaatcagcaacaacaacagcttcataattcgccagctacgggagcgaaccgaattgttcaacattccaaaaatggagtaaccccagcggtacgctcacaaaactttcttaagcaaaattgcataagaatggaagaggaagttaaaaccgacgcaaccgacgcaaccgtcgcgggtgttaaactggaaaaggaagttatagagtatttgagggatgagttggagaaaagcgaaactttttgtagtggattcgaaccgaatgcaatgattggaaaaatggtgacggtggaacttggagtgatgggaacccaaaccagaggaatgcttgacgggggagcccaaatttccttaatgggtggaaagtttttctatgatttgataaccagtggtaaattggatcttcacaaaaccggatttaaaggggtttcagcccgaatttcggatgtcaatggtaaagagttggaatgtttgggaacgacttctcttccagtcgatcgaaaaggttgcaggacaacaaatgtctgcttccatattacgagtgctccttttggttttgacttgttaattggtaccaatgcattgcgttctctgggtttttgtctttatgacattcccaataaagaaatgattaattttgaggaagtgaaccatcaaaagaaaaaccagatcagtgttatttatcaaatgacattaaaaccgcatacaatgcaattcgtaacattgtcagcaggaaatgaatggaatggcaaagatgtgttaattacggctgccaatgagaaaacttttcataaattggagccaatcgtcggaacagttcaagatggaaagataatggtgtccattttgaatacatcagataaatttgtgcagatttttgaaaacgaaataattgctgaactaactcctgcacttttgatgtgggagactgaaaattcgcttgcttccgtcattgttagtgaataataataccgtttcttcgattgatgcacaaagaga

SEQ ID NO: 79758 - DNA, 736 bp, Heterodera glycines
  Genomic contig location: Contig_ID=SeqID_15484; Location=556..1291; Strand=-
  SCN-specific regions: Sequence locations=1-265,289-418,504-736
atggcggagacaacgtcgccttcactggccgcgaacattgcggagaaacagcaccacaaaagcgggggtggtggcgcagggagcagcagcagtgccgcggcacacaaatgccggctgatggtctaccacgaggtgttgaactcggccgacttcaagtgggttcacatttttaagtttttaataatttctaactatttttcttcgtcttttgaaatttttttatttatttctttttttagtttattgaaaaggtttctccgttttgataattaaaaaaaatatatattacttcggtatcacatcgattgatgttggccatttgccctcttcccccgcattcccacaaaaaaaaatgtaaatttttatttttctaactttcatagagatttttccataaaatttaataaggtatctttccaaataaattttttcaattttttttctagaaaaaactacaaaaacttaaaattaaaaaattttcagttttattttttaaattttttctggtgggaaacaatgcgagggagtgaacgtgttgcacccccaaattcacccccacttttctcccctgggcaggggcagtgtcgtgtcgctgcagtcgtgccgctcctccttcaactcgttggctgctggcgagtcgatgcactcggtgtactccaacccgtcgccgaacgtaaagcaacgtaaccacaacaacaataacatcatcgtcactggacaaacggggcataataaa

SEQ ID NO: 79759 - DNA, 1903 bp, Heterodera glycines
  Genomic contig location: Contig_ID=SeqID_15485; Location=400..2302; Strand=-
  SCN-specific regions: Sequence locations=1-280,303-340,363-364,397 -646,668-673,696-930,994-1108,1139-1387,1409-1437,1459-1701,1724 -1747,1769-1774,1813-1903
cgacgaactgatgcgcgagagtgcggagaattgcctgaccaacgcgtacaccaatgtgacggtgaacagaggcgcgccgtatgaggtgggaaacccaaaaaaactagcaacaaaaccaatggccaatgaatgggtggggccaatgccctaactgaaaaaaaaattttttgggttaggataggctttttggaaagttttgtgccacttttctttaacaattttaaccgtttttcaaaaaaaaaaaaaattctggatgctgtatattaggactgcccagacattattcatccacccagtcaatattaagctacctaaatgatgtcacagagaaatcttttggttgtgccccctcccctaaaaaacctaaaaaaattaattttgtaaaattaaaaaaatgatgcgaggggaaaatttttgatttttttaaatgcctaatttgttaatgaaaagcgcaccaaaatttcaaaaataataaattctctctcgaccaattgcgtttcccagatttacgtgtggattgaccatgccgggtcagtgctcacctgggactttgacatcacaaagggcgagtgcgagttcgtcatctaccgcacggaaaaggtattttttgggtgcacttcatttccctcaccgttgtttctcccagaaatttttttttaaataatttcaaaccttgaaattttttataaaaaattcttagggaatttcttagtaagaaaatttcaagaaaaaaactttgaaaaaatttcagcgattttctggaaattttttgaaaaagcttacaattagtagttaatcacaaaatttcgaaaaaatcgcagcaaagttttccaaaaaaaaaagtttttttttgaaattttcttaccaacaatatacgggagtctttgttttttgggttgaaaatgtttcaaaatttttcggctgccggcgtttttaaaaataaatatttattctatgatttttttttttaattaaaacacaatttttattaaactacgttctttagggaaaattgagagtaggtatattgattgatttaggtttttttttcgttttatttcatattttttggaaaattttagacatgtgccaaaacatgcaaatttggaataaaaaaaatttaattttttcattttttcaatcactcagaaaatcgctgttcccctccactctcaccaacagcagaagcactcgtccgcctccttttcggcaacagctgcaccaccaccaaacgcggcaacttcttccaatgcggcaacggcgggcggtgccggcgcggccgtcagtggcggcggttcggcaacggtgtcgagcagtatggccgccaccgtaatgggcccggttgagcgagtggtggacgaaatttccaatttgttgtcctccgccgccgggggcagcagcagcggcgcgcatgcgcctcaatttcatgtagaaaaaataacaatatcaatttaaaaaagctcaaattcaaaaaaaatatgaattatttccaaaaaatgcaaatttttttgatatttgcgctattttcaaaatttatagcgcccgggtgaaaaaacaggaatttgtatcggtttgcgccaaaaaatgacaatttttgccatttttgggtcaaattttcaaaaattaagttcactgggaatcagccggtaccatttggcgccgccttgataagaaagttgtgcataattttcaaaatttacccctttttcttaaaaattttttcatttcacgggggggaggtacacatacccctccctcccccctgcttttttggatttttacaatttaattacttttttattttatttttaaggcaataattggcgagccgaccttccgtgttggcgttgaactcttcttggcccagcaaccgctgagctttggagaaggcgactcgatgcag

SEQ ID NO: 79760 - DNA, 637 bp, Heterodera glycines
  Genomic contig location: Contig_ID=SeqID_15488; Location=219..855; Strand=-
  SCN-specific regions: Sequence locations=1-44,66-220,270-298,338 -370,392-515,537-637
atgaataagaaatacttttattctgtatgggaatcgaaccgaggcaaaaatcaaataaagtctttgcaaaatattttcaaaaaaaaaaatatgtaagcaaccctcaacaaattttatttctttgttcttgctaattgttagtttggatgatcaaatatatattaaaacaaataataggtgaaattacatttttcttcaaaatttctcaatgaaaaatggcatttattttttttaaatataattttaacaattttttatttttataataagaaaaacctaaatcctactgatgtcttacaaataaataaaaaataataaaattttattattttttattctactgagcaattattggcaagaaaaagtaaaataatgattaattttttattaatccattaatttacattttattagagtggccaccggaaatgattaattttccttcaccttgtttagatgagaaaaacagaaaaacatctttttcgcgcggaaatcctccaatttaaatgcattaaaaattatttacggaatatgttcaaattaatagcaattaaataatttttgttcacatttttcttttcttttccgattttgattaatttggttgtgattcataaaaaattacttaaaaaataaa

SEQ ID NO: 79761 - DNA, 845 bp, Heterodera glycines
  Genomic contig location: Contig_ID=SeqID_15488; Location=2116..2960; Strand=+
  SCN-specific regions: Sequence locations=1-186,241-251,302-332,354 -417,439-451,474-588,612-642,665-803,839-845
atgaatttaattttgttggttttactgcttctccattccaaaattgatcaaacacattctgctgatcatgacaacaattttgaatgccgcaatgttccaactgatcaaatgaaaccatttcaatacaaatcggaccgatgggaagagaaaatggaaatcaaaatttctggaaccaaactccaccagggaaaagaagtacaaataaaaaataagtcaagaaaaaacatagaaaaggctttaacaacaaatgcttcaaagcataattattttaaaagtggaattagtttaaatgttttaaaattcaaatgattaaatagaaaaaatttcgctgagttttaatgggatgattatttgtttttttttcatatatttgagcattggtggggccagagaaccaaaaaaatgctccgaaatcctaaatcaatttatgaatcttaaaacattaaatatttcaaaaaacaccataatgtttttgtttgtgcaattgcattttttacttttaagcatgattttaaacattaaatccagaggtttagactaggaatttatcttgaatttcattgttatttttcatttaaaattttagggattttaataattaaataatatttctttagctttacattggtttttctaccgccgaaaatgacaatttacccaaaaaccaatgtgttgtcatcaaaatttatggtgatgaactgaacgaaaaagctctctatgataatagcatcaaattttttcatctattaaaagaaaatgacccggagaatgagcacattatcaacttaatagaccagtaaatcaaaaaaaattcaaaaatatgaataattaaaaatttgttggta

SEQ ID NO: 79762 - DNA, 329 bp, Heterodera glycines
  Genomic contig location: Contig_ID=SeqID_15493; Location=250..578; Strand=-
  SCN-specific regions: Sequence locations=1-23,49-329
atggggaaggggtggaaaatgccgaggaattgggggagggtggaaaattttggaaaagtgccttggttcgaagcttttcggtttgattttataactggggacgagaacccgagtaagtccgaagagtgcttgttcagatccgaatgataagattttggaaagctgctttaatccaaatcttttaagcgtccatttcgacggtaggcgagcgaaagtatcatttgttggactcggtgaagcgggacacactgtctcaaaaaggctcagggacattaacatctccaaagaccagatgctggacgtgcgaaaagatgtgggagaaccagtga

SEQ ID NO: 79763 - DNA, 93 bp, Heterodera glycines
  Genomic contig location: Contig_ID=SeqID_15493; Location=1215..1307; Strand=+
  SCN-specific regions: Sequence locations=1-31,53-93
tatacacggcgagtcaattttgggctccaagtacaattaagttggttttttcgtcttagtggtctgtgagttagtcaacaaaaaggggtctca

SEQ ID NO: 79764 - DNA, 565 bp, Heterodera glycines
  Genomic contig location: Contig_ID=SeqID_15494; Location=582..1146; Strand=+
  SCN-specific regions: Sequence locations=1-244,274-565
atgggtgtttccggttcttcattgtctgcttacgtgcaagtcgcagtccacgtacgaaaagatgtttgacatgatcagaaaccgctggccgacatttgcaccgaaaaacgcatccatggacttcgaacaggcgatggtcaacgccctccgcgcaaaacatccacagtgctcaatcagcttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcctttgtgccgcttgaggacattacaccggcgctggcagcgctcgaagatcatcttctggatgagcttgagggcgttctcgattggttggttgagtttaattttttttcaatttcattagtaattttaaaggtttgtaatcaactacgttggacggcttcgcaacaacggcacacgcactcgccattgtttcggcccgaagaatggagcgtgtatgagcgcacaatga

SEQ ID NO: 79765 - DNA, 1333 bp, Heterodera glycines
  Genomic contig location: Contig_ID=SeqID_248; Location=931..2263; Strand=-
  SCN-specific regions: Sequence locations=1-260,282-894,917-1215,1237 -1254,1276-1333
  Gene Ontology: Cellular component=ubiquitin ligase complex; Biological process=protein modification
atgttctcatcggagaacgccaaacgcggcgcatttgctaagaaaagtttgaacggaaatgaattggagtccgaggccaacgagggggacgcggaggacattgggaagagtttggaggagcagtcgcatcagttggcactgccacggcttttcaaggcacttctctcttttgagtttgccaattactcccgtctgaacggtaagtaccgtatgcatacaatccacgccaatttcaaatgttctccagaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggggcataaaggtttccccccctccccggcaattaattactttctttttgcttcttcggatgccatttgcgttgtttctaatgtcgacgaccttttcactggcccttttcattataaattggtggaccgtcctttcgatcgtgaacattttacgagtaatctcttcttccggactttggccacgatccccgctttgtttcgcgaatggcacggcactctcagcaaaacggaagcgaacacagtcaatgagtaatcacaccctttttaaccaaatctacatttttaaattatttaagatacacccaaaaatatttgagtcatttgcttattcaacgtgaattgcgcagtttggaaaatatgaaacgtgggcggttagaggtcataggcatttatcacatttactttttctaatttatttaacgcttatgacttttgggatactttttgcaccgctttttcaatctgacaaatggcacatcaaaagcggacattttgaaattggttgttattttcaggtccgaattctgtccaaagtgcgtgagatcgaatgcacttatcggctggaggagacgacaatgactttgacaatacttttgcctgaaaattatccgatcaaagcgccaaaagtggagacggggcggagcatagtgaacagagaattgcatcgcaaatggcttcttcaattgggcgttttcctaaacggacaagtcagtcttcaagagtcaaatacgacggagaaaaagcaatgccgaaattttcagaacggagtgatgatggacgggattttgcaatggaagcggagcatcgaccagcacctgcagggcgtggaggagtgcaccatttgcatgtccaccgtttcctccacaaattaccaattgccaaaaattcggtgtcgccaatgtcggaaaaaattccatggcgattgtttg

SEQ ID NO: 79766 - DNA, 370 bp, Heterodera glycines
  Genomic contig location: Contig_ID=SeqID_251; Location=128..497; Strand=-
  SCN-specific regions: Sequence locations=1-250,273-343,365-370
atggcactttttggaactaaaaacaatgcaataggaggagagcaacgaagaatcactgcaggaataattggtaataatttctgaatgtgggccttttcataagagcaaattcagctattggagatgaacttttaaaagggacgacgcgagacacaaattctcaattcttgtgcaaacaattatttgagaaaggagtttgggttaaaaaggtaggcagaagcataataattatttgtcaaaatacctctttacccaggtttctattttgggggatagcataacggaggttgccaaagaagttcgaaacttttgcgtggaatttgacattgtgttagcagcattcctttgtttttcatggaattttgattaa

SEQ ID NO: 79767 - DNA, 733 bp, Heterodera glycines
  Genomic contig location: Contig_ID=SeqID_252; Location=762..1494; Strand=-
  SCN-specific regions: Sequence locations=1-231,253-256,278-364,386-733
atggacttttttttgcttctgtctgcgatggccgcgctttttctcttttttctttattcaatgaatgcgctcttgtgcgttcgccgtctcagaaaatgccacggaaaagaaaaagtaaatcatcgcagtgaatggccaatggcacactttttttagcataatttcttcattgcctcaaatcggtcgagcaacgaaagccctttgagtgatcacttatgtcaaaatgtaccatcttcattgggagaaagaaagaatcaactcaaaaataaaaacagaagtcaatggccaaatgaatgggaagaagaaaagtggcgacaaataccgataatgaagagagacagtggaaaaaggagggaaagaggtggagagagtgtgcgtagggagacacggcgagttcgggcagagaaaaaggggaacaccgaattcgaaatggacctggcgatttggaggaggacggggaaggaacaacggcagtttttctagcgtaatttttggctcttacaattagcacgaatctgacatttttttagaaataatatatttacagtgagttgcgcgagaaattacgtgaccttctaaatctatgatcaacaattcctgcccaaaaagatatttgagctcaaactataacataacctaaaaaggagattaatattagagaccggaattttcaaatttgcggatcctgttgcaggattggaatttaaaattttttacattctgtattaataaa

SEQ ID NO: 79768 - DNA, 674 bp, Heterodera glycines
  Genomic contig location: Contig_ID=SeqID_253; Location=640..1313; Strand=+
  SCN-specific regions: Sequence locations=1-104,140-140,162-220,242 -248,287-591,660-674
atgatttggctggtgctgatgaaggtgagatgttggtgcagcctatgcacatgaacggtcatccggcggcggcgcaagcgggctatgtgaacgaccacgctgcacaccatcaccaccaccatcatcatcaacaccaccagcagcagaatgggatgctcatcgatcacaacgtgtggcagcagattcttgctcccgtacaacaacagattcagctgacggcgcaggattacccggccatccgtcgagtgggaacaacaaaaacatttaaattcaaatttatgattttccctcatttcagctcatggcgctgggctttccgcgaaatttgtgcatcgaaggtggggggggggggggtggacagttggaatttcaattgtttaattttcaaattcccttctttttcagcttacattgtcagcgaccgtaatgaagtgggaaactgaattttgctatttcaattaaatgtctgaatgcctatttttaaggagcttgctgccgagtacattcttgaacggatggcggaggggaacgggccgtgaccgcgttagaagagaaaagaaaatgaggagaggacattgatatatcgaatactgtattatattgtatgtattgtatatatgtatattctatatttcatatgtacatattgtatgtatttacttacgcaacattta

SEQ ID NO: 79769 - DNA, 790 bp, Heterodera glycines
  Genomic contig location: Contig_ID=SeqID_253; Location=2479..3268; Strand=+
  SCN-specific regions: Sequence locations=1-522,545-621,643-790
atgaaattctacgcctacggaagagtccgaatcgacgccacagcccacagcacaggaaaagtgagacgaacgggcaattttaagatctaatgagcgaccaatttcaactgttttagggaatatctacccgagtttgaacggcaacactcccatcacttcgttgtcctttctcgggtgcggtgcgatgagtacgcccaacgacgaagtatcatagaaagaacataaacaaataattgatataagcgaaaagtggattaggagagcactatgaacctctattttggccatgttgagtgtgaacgccaaaaacggcaaatttgttgggaaatcaaaactcatgttttagtatacagaggaattgggcatattattcgccattattatacaaattgatgattccatgcgtttagcccggcggcatgaacttcaacatggccacagcaacaccggcgaattttggcattcgaaacgaaaacaatgacgcggagcagaacatcgaagcgttgttccggacgcaaaatgtgcaggaggagacgccacttgcgggtcccgcgttctgtcctacgacgccttaccttttcgcaatggcgggaggcaacagcgaaaagtgagggacaaaagaaaaaagcaatttcagacaaatcaaacaaatttaggcgcacgggagtaacgccgaagtacttctgaactggtcgaatgtaataagtatattgtgcttcttttgttcgatatttgtgaaattcattcatattcaccggcgttgtataacatatacacatttggtatatta

SEQ ID NO: 79770 - DNA, 1581 bp, Heterodera glycines
  Genomic contig location: Contig_ID=SeqID_253; Location=5990..7570; Strand=+
  SCN-specific regions: Sequence locations=1-166,188-706,729-1311,1336 -1377,1402-1581
atggagcagggcggttttgaggtaaattcactcagggtatttgatgggcggggagttctgctgatttctttgccctttaactttgtgaatggcattcccatgacccattggcatgcatttattgaacaaagagtggcaaatcccttcccatacggcaaggcggggtcattcattttcatcccaaacactccaaaatggggaaaaatctgaaaaaaattcctgttgaattgctttttgaaactacaaaaagtcttcgatttgacatccgctgggccactgttcgggtgtccgcctcatttgaccactgtgttattaagtgccaatcagattggctcttaaaggaaattgggcgtctaatgattttgcatcgaaaagtagtaacggctggagggaacatatccaattctaattaatgacaattacaggctttccaatttattaaggttgagttcgtggcggaagagaaagcgcgtctgttccaagtcgtttctcagctgaacagcgaacgccgttctattgtccatcgtgccattgcgtcccattttgcggttgacgaacagtatggggcgaaactggtcaaagacggtgccactgaccaccagcaattttgcgagaagattaatgctatgattggcaatttggttgatcccaccgacgcagcaaaagttgcagtcgcaggagactgtatgttggcgagcacagaaaattttgaactttttatagcatagcaatccctcaagaaatcacaaaagtgacactttcttattttggttttcgagctcatcaattaaaatctgacgtccattttgtttgaggattggtttcatcaattttaacagtactaattactacatttatcactcagttttgcaccaacaagtccagtgtgcgtacggatctctagcggatatgaatcagatctcgaacctgaaggcgcacatttctgaacttcgtgctcagaacttgacccaacaggcgcaaattggtgcacagcaggttcagattgatggccttcatgcccaagttggtaatcagcagaatcgccttcaggctcaagttgttgctcaacagaatctgatcggtggccagcacaatcagatcggtgctcagcagaatctgatcggtggtcagcacaaacagatcggtggccttcatgttcaagttgctgctcagcagaatatgatcggtggccttcatgctcaagttgctgatcagcagaatcgtatcggtggccttcatgctcaagttgctgatcagcagaatctgatcggtggccagcacaatcagatcggtgacctgcaggctcgaaatactgctcttctggctcaggtttctgatcatctgtcactttttgatacccctgctcagaattcttccctgaggaagaggaagttggtttcggacgttgaaaagctgccgagtcagacgtcgagtggaccatcgaaattggccatcggagtttcggagacgaccgtcggaccttcgacgtcgatcgttggagcttcggagacgaccgttgaaccttcgaagtcggccgatgatttgtcgcagacgggcgaatcattgccgtctaaggattga

SEQ ID NO: 79771 - DNA, 5007 bp, Heterodera glycines
  Genomic contig location: Contig_ID=SeqID_254; Location=1..5007; Strand=-
  SCN-specific regions: Sequence locations=1-180,235-346,383-810,849 -861,883-1712,1757-2585,2607-2772,2794-3281,3311-3911,3933-4048,4092 -4364,4386-4613,4652-4929,4959-5007
  Gene Ontology: Mol. function=G-protein coupled receptor activity; Cellular component=integral to membrane; Biological process=frizzled signaling pathway
aaattagggttgagcggtaccggtaccgaccggtaattaccggttatttggtaccggtaccggtaccggttttttcaaaaatcaaagtatcggtaccggtttgtctagtaccggtaccgccggtaaaaatttgcactggtaagaatgggggtctgggtgagaaaagagtagggaatggtgaagaaggagaaattttttgagaaaaaaaaattaaattatttattttcatttaaagcatttgttcatatgcataagtggtcaagtggctaaaccttctgattttattatttctcggcttgggttcaattccccactgggatagaatattcttcatattttctttaccattattttaattgaaattttaattaaaaaaaatattccaactttttttctttcattttaagcatcctaaaaacccaaaaattaatcaattggtctttttttacaaattctgttaacaaatcgcattaaaaaatacaaaatttttcacggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaaaattaccgagtaccgctcaactctactttattcttcatttggcaaaatcaaaaaataaaacaaaaaaaatgtataaattaatgaaacataaataagaccaaaatgtccaaaagtgaacataaatgtatgtataggcctatttatttgttagcgtagttaatgccagcgtagagtctttttctctatttcttgttcttcttcgttttgtgttcgctgcctgaaatagaaaataattatgaaaggaaattccataaaaagacgaagtgcctggtaaagtttcgtctcgtcttttcgtccctcctctccgcgactcttttgaccctgaacagagccctgaacagaagcggaagctttcggcgaattgtcggacgcggacaattgcttaaacataattaatttccttcaaaaatgggcggtttccccgctttttacttctacttggactcagaatgaaaaacgacccaaatgactgtaacttgagaaacatgcaaaattcgaaccagaataaccccttccaaaattttcaatattagaaatatcaaaatttggcacactatttttatccaaaaatttatataattttttcgcggtttttgagtcattttttagtggttccgccagagaaaatgcaaattttgatcattggaggcgatcatcgaatgtgtgccgttaaccccagtgccacaaaatttagagatttttccggttggattttgttatgtcgatttattcttgcgctgatctgtaatccataatcaatattgaccaattccaaatcatttccgattatttgtttttttctgatcagagcaccacacattgatcacttatcatccatcctgagagtgactgatcaaattttcccttcaaattcagctgaacatcagcgtcttcatcaccgtcactgatctgaacgacaacgcgccccaattcagcgcccgccgcttcgccgtgcaaatcgccgaagagttgcccgagggcacgccgatccgattggacttccgggccaccgacgcggaccaaccggggtcaaatagtcgcattcgttaccgaattgtgcgctcatcaccgccagcagcagcagaaacagcagcagcagaggagcaaaagcagcaggcgagggaatgttcgcaatcagatgaggagcatacggtagggtagctggcgcatggtacggtggtggaaccatttacttttaccgtagaaaccctgacaaaaacacttttgcgaggggaattatcagcagttttcactataatttctagagttcgatattttgaaagcctggacctgggtttcctgaacaaaaaccaaggaaaatcccacccaggaaaaacccaggttgaggaaaagtggcctgtggactttgacctgccccaagaaaattttttgatagcctcggctcagaatttctaaaaattggcggcttttcaatgcatttgtcaacaccaaaaggtttccggccaaggctcctccgatgatcggcatccgtttgaagtgttttacaccgattctgatgacgactgtgccgctttgcttctgcacatcccggacccgttgcgacccgaactttttgttgccggacggatcgattttgaaaaaatgccaaattttacggtgtttatcgaggcggaggaccagggcacacccaaactgcgcactttcgcacgattggacgtgacagtgatcgacgtggacgatctgaacccgaccttcgaggcacagatgtacaaaagcagtgaacacagagtaaaattgggagaggattaaatgacctgtttcaaaattgttgcacaatgccaacaatcccaaaaaattggcataatgccaatctttcagggcttcagcttggccattgagccgtcaccgatcagagcgtgggatgccgaccgctcatttgatgagccaatcatttactcactttccggaggttggaagaaacgcgaaaacaaaaaactgatccttgatcagagcgatcaattagtccacatattgttgtaattaagaacacgcggtgaactacgcaattgatcagctaccggtgaggtcaaactgctggccgaaaagctggtgccggcgaatctgatcgtacaggtgaaagccaaaatgtcggcagaaaatgccctgctcaacaaaatttctgttaaaatattctcaggatcataaattccgattccaaaaaatcagagatgatcactttgaaatttgaaaataggcgcgacaagcaaaccgatcggagcgcaattccaccgcctttttgctggtccaacctccgacggagggggacgaagaagcaaaaggggagggcaaaagcagcgaactgatcattttgagggtgggtttttatggaatttacatggatgaagcattgatataaattccaataaaattattccgtcgatcagttgtcgcaaaacacggccattggcaccaaattaatgcgattggtggacgacgaaaaatgcggcacggaatcagcggagagaggagaagcaatggcattggaaatagtgatgccgaacgggcagcagcagaagcggaacaaattgccttttttcatcgatcagaggacgaaatggctgagattggccaaacggatggcaattggccaatacgccggtgagtcattcgttaacgatcgtttagagtttattttatttgatcaaatcagtgaaattgggttcaaaagttatgctcagcagaggaccgatcatgtccataatttaatcaagcatttcttgctgaaagttatgttttaaatctaaattcgttcactagattgacctgttcatactctaaactttggtcactgattagtcttaagccttagcttttggatgattattttttaatgatcactaaaatgatattgatatctgatcgctctggcgaatggtcagtaagtgagtgatttcatttacctgctgtgaggacaaaacatgatcagaataagccacacctgttgacaaatctcataaaaagcaaagcctaaattaggatagacaaaaagattaaacagatgtattgcgtttgctcgatggttttaatgatcagagcaatcaatgttttccaactttttagcaaatatttctatcaaattgacatgcccaaaacggcctccgaccatccgatcactggatatccgtctgacagtttttgatccgatcagaggacaaaatttcgcatttgaaaagcaattttacggatttgaactgccaacggtgggagagaatggacgagaacaatcggttgagattggacggatcaaagcaaaaaacgcggggacacggggaaatggcacggcacgagaagaagcggatcagctgatcacttatgcgttgttaagcggaaatgagtgcgctttttacaaattagctaaataatcccggaaattgggcaccgattttcaaaattatttttgtttataaagattttaatttattctttaaatccatagagacattccagtacaatttcggtgctcatgtttcgcttctttaattaatagccaatatggcatttacggcacaccacaaaaaactacagaaattattctaccgtacttactggtattttcaccccttctcaaagggagggggggggggctataattcagggaggggttctatttcagtaagtacggtaaattgggcacttgccaagtctccggctttttttggcacgccatgcgtttatttaccacaacatttatgatgacaatttgccattttccttcccccaatcagcagtttgttccacatccatcccattgatggtgtgctgcgccttctccccacaaagtccgccgaactttttcgcctcccgccggccaccgaattggtggcattagccgagaattcagccggaggtcgagactttgcgctgtgcattgtccgccgatcgacgcgttcgggtgtgccaccgccatcgctcggcacagtttggccgccgtcgttgacgccccccgatacggcactttgccttggcctcctctgctttctgttgctgctgacaaattgtgccactcttagcctttggctgggcaaaaggcgcatggcaaatttgtgagtgctttttcaggcgattggagtgacaaatcggagcccttatttaagataaaaatgaatgggtggggttctcggcactttggaatacccaatattgagcattggtgcccagatcccttcagcgtccccttttaagccccataaaaacttttgcactttattcctctcgtcgttccccaaaccccgaatttttcaaaatgtttctaaaaatcgctgaaatcgaaaaattttaaaaaattataaatttttttggatgggaaacgacaggagggggggaacggccgctccataccaaattgg

SEQ ID NO: 79772 - DNA, 1035 bp, Heterodera glycines
  Genomic contig location: Contig_ID=SeqID_254; Location=3302..4336; Strand=+
  SCN-specific regions: Sequence locations=1-824,846-858,897-1035
atgagcgcacaattcggtaacgaatgcgactatttgaccccggttggtccgcgtcggtggcccggaagtccaatcggatcggcgtgccctcgggcaactcttcggcgatttgcacggcgaagcggcgggcgctgaattggggcgcgttgtcgttcagatcagtgacggtgatgaagacgctgatgttcagctgaatttgaagggaaaatttgatcagtcactctcaggatggatgataagtgatcaatgtgtggtgctctgatcagaaaaaaacaaataatcggaaatgatttggaattggtcaatattgattatggattacagatcagcgcaagaataaatcgacataacaaaatccaaccggaaaaatctctaaattttgtggcactggggttaacggcacacattcgatgatcgcctccaatgatcaaaatttgcattttctctggcggaaccactaaaaaatgactcaaaaaccgcgaaaaaattatataaatttttggataaaaatagtgtgccaaattttgatatttctaatattgaaaattttggaaggggttattctggttcgaattttgcatgtttctcaagttacagtcatttgggtcgtttttcattctgagtccaagtagaagtaaaaagcggggaaaccgcccatttttgaaggaaattaattatgtttaagcaattgtccgcgtccgacaattcgccgaaagcttccgcttctgttcagggctctgttcagggtcaaaagagtcgcggagaggagggacgaaaagacgagacgaaactttaccaggcacttcgtctttttatggaatttcctttcataattattttctatttcaggcagcgaacacaaaacgaagaagaacaagaaatagagaaaaagactctacgctggcattaactacgctaacaaataaataggcctatacatacatttatgttcacttttggacattttggtcttatttatgtttcattaatttatacattttttttgttttattttttgattttgccaaatgaaga

SEQ ID NO: 79773 - DNA, 952 bp, Heterodera glycines
  Genomic contig location: Contig_ID=SeqID_255; Location=370..1321; Strand=-
  SCN-specific regions: Sequence locations=1-18,42-859,881-952
atgtcagccgaccaagtaagttgaatttaaattttaaaaaaccacttgagcaattttcattgctaatcttttggcattatgtctctttaaaatacccaaaaatgaaaaagggtactcatgcactttgtatccacattttttttttcgcatttttcaattttttcactcggagaatttcaaggatcctgtctctggtcaacatacgaatacaattgaatcgacgtggcagaagttcaagcagcaacacaaaacgagatttggcacgcaaagatcacttttttccacatacatttccgattttttgtggcgtaggcaatttggaggaccggacattttttttaatttgtggacccaaatcgcggaattgtatccaataagcacataaatctcctttatttgatatttaaagcaattgtgacaataaaaaagtaaaaaaaaattgaaaaatgcgaaaaaaaaaaatgtggatacaaagtgcatgagtacctgaaaaagattacctacatattttaaagtttgcgaacccattctaaagtcagtcccattaaaattgtcccctcaccgaaacacgaaaaattgcccaaattcctaccacaacaaataataatatgaaatatttgccgcctgaacttttggacgaaatgactttttacatatatcctaaccaaaattgttcgagaattctgacttcttcctggctactcatggaatttttgaggccccatatcgaaagatggaaaaatatatttaaattagtatgttacacaatgcaaaaaatgggaattgacccttattgccattttacttttttcagcgccgttacgagttaatcgatctgcacaaactctgcaaggaagaaatcccttggcgcacatttaccgccctggcaaaaacggacaaaaattgcaatgcctttgttgccgcattacaggaactggttaaagaggcatga

SEQ ID NO: 79774 - DNA, 1036 bp, Heterodera glycines
  Genomic contig location: Contig_ID=SeqID_2445; Location=445..1480; Strand=+
  SCN-specific regions: Sequence locations=1-149,174-285,340-357,477 -499,522-532,580-640,789-1036
atgcgttttctcactgtggacgaactcaacagaaaatgcccccgggagggattggcaatggcaccatttgccaaaaatggcaacggcagcacaacggaggagcaacgacggtggctgaaccaaccgttcgacgaaacttgcattagggtgggagaaggggaaggaaacccagcgattgattatgctcatgctttgatcatatgaagctcttttttaatccatctctctctctaatccactttatccgcttatccttttcctccctctatttcatcctttttcacttctctctctctctctcgctctcgctctctctctctcgctctctctctctctctcatcccttttcacgcttcatccctctctctcatcctctttatcctattatcctttttcattcctctccctctatttaacccttttcactcctttctcttctctctctctctctcttatccgcttcatccctcactctcatcggctttatccgcttatcttttttcattcctctatttcatcccctttcattcccctctctctctctcgctctctctctctctcgctctctctctctctctcatcccttttcacgcttcatccctctctctcatcctctttatcctattatcctttttcattcctctccctctatttaacccttttcactcctttctcttctctctctctctctcttatccgcttcatccctcactctcatcggctttatccgcttatcttttttcattcctctatttcatcccctttcattcccctctctctctctctcttatcacattttattctctcctcattattcgttcagtctttcttcctcggactgagtgcccaattgcgtcgttatgagccttgggaagagtggttctacactgtcatgtacacgctgatctctgcgctcgctctgctcggcaatggaatggttattcttgcggtgattcgtaagcgcggcatgcgaactgcgcgaaatgttctgatcgtcaacttggcactttccaatctgatgttggcactgacaacg

SEQ ID NO: 79775 - DNA, 1640 bp, Heterodera glycines
  Genomic contig location: Contig_ID=SeqID_2446; Location=1..1640; Strand=+
  SCN-specific regions: Sequence locations=1-265,288-307,329-774,797 -986,1016-1640
ccatcatccccccccccctcctttcttcaggtcatggccattgatcgctattactccgtccgttccctcaacatcaattccccttccggccgatcgggccaatgccttcgtgccgtgctcatttccctgctcatttgggttggcatttgtttaattgcttccgcccttctttcattaacttttctctttcagcttttctcctttttgctttcatttcctttgcttgtttattatcgggtccatgtgctctatgtgattaaagtacattaattacaacatttttaattaatccgaatttaataaatttgacaattaaggatatttatgtgcacgaagaaatcgcgtgggcaaaggaaacgaatgccgatttgattgtattgcgcagttacgggtggcgacagtgtcggctcagtaccggccaatttgaggagggaaaagcacaaattgaaatggttgaagggaggaaggctggggtgtcctttcaaatattataattacccctcgggcattggtttgggcattgtcttttcccttaattaacagtttggctttggtttggctattaatcactttattaacccattagggtattggttcgttatctgatcgtcgtctattaaacccttaaaggcttccccagcaaatgcacaaaattcgtcctctctgatcgctgtcgacgatcgcatggtccaacttggcatggccgcgatgcaaggggcgatgctttacgctgttccgcttgtcgtcctttccattttcaatgtcattttgtgtttggaatttttgaaaaacccttacaatgaagatgaaactgacgcgattcctgaagatgaacaccaaacagctgaaacacaatacggaaagagaaggggacagcgtaattgtgacgacggaacgacgacagaggggcgggtcgaagacatcgtcgatgggaggagtcactcaacgggtacaacagacgaacggggggattaattagccaaatgaggagaatggggaaaggaaacgggaaaacaaaagttgaaaggggtaattagggagaggcaattaattagacaaatgaggacaattggtcaaggggaagcgatttgcaaagagaagttcgaacttattggttccgtttgttcagtccagcatcgccactgccgatttgatgctgccccggcaagtgtccattgttacggtcggaacttcgacgagggcagcggaaaagcgcaggaaccgaacgacagtgagcaaatgccaatgccaaattgcaaattggcatgcgatcgcgcccttcccctccttcttgaggtgcttctgatcgccatggccggctcctacgccgtcctttggcttccctttacgttcgtttccattctgatcgacttggattggcttggcgtggtccgtccctttgcttcaaaaagtgaccgattaacagcaacacttttcaggagagtggctctccaattgtcgaacgcattgatcaaacttgcaaattggtaggcattcgctgaatctgatcagttgggtttccgcttctcttctccttcagttgtccatcacctcaatttgcgtcaatccctttctgtacggctttttgaacaccaatttccggcacgaattcaatgagattttcctttattgcttcgctt

SEQ ID NO: 79776 - DNA, 2658 bp, Heterodera glycines
  Genomic contig location: Contig_ID=SeqID_2447; Location=482..3139; Strand=-
  SCN-specific regions: Sequence locations=1-86,108-1093,1115-1174,1196- 1538,1560-1619,1641-2070,2092-2227,2250-2287,2310-2658
aggtgaagcaatgaaataaaatggggaacgattgtgaatccattggtacttttgaggaccgacgagaaatggacagcgaatggcaccacggcggggggaaaagccgcgccaggaaatctgtgggcccctgaaatggctctgtttcgccgtcaattttttcatttttgtgagtttgactttttgtttttgttcacattttggcttactttgttagaaaattggcacagaaaatgcacccaaaacactcaaatgaaaatcatatttttcatttgcttatccataattagcatttgtccttgaaatggacagtaaataatgaatgggctttctcttcccaaatggaaactgacgacaaatcttcaccaaatcctcctaatccccaattatcccccccccccccccccctctctgatggccttaattttcctccccaaggcaaaggattttgattgataagcgatgttaatgcgagcagcaggaacaaatagatatatgacaaaatgacaatcagagccaatcagcggatgaatgattaattaacaaataatttggggcgctggggagggaaatgactgaaggattaattccagcaagaaaagtgacatcttctgcattaattgtaataataattttatatcccaaattttatctgacactctcttcccgttggaattagtgtggcaaaaaatgggataacggataaaaagtgggataaatgggataaaggatatggggcgggggctctaaaagggacggccttagctcagtcagtcgcataatcttttacgatattcctggtcatcataatccccaagttcttgccagctcgcttccgtcgcttgccttgcgcttggcgtttatctctttctgaccgaccctcgtcccatcgatgagtttgtcgacgttttgctcaacccggctgtgctgctcacttccgccggtctcttctcgggcaccgtcgcccttttcggccttttcggcgccctcagggacaacgtttgtcttctcaaattggttcgcttttcccctccccccttttttgcccggcttttcccctccaaattcaccccttctcttcgttcagttcgctctgttcgtcttcctctcttacctcgttctggtggtgttcacctgttttctgttcctccttttttattccgacgcctccggggacgaaaaaggcaaaataattaaataattggctgttgttttagctaatgaccgatctgatcagattgggcaaatgcccgtcctttttatccgattacccatcgtacgttaaggcatttccgctcagtttcttctccgttattccatccgccgttatcacatcaatcgaaacatcgcggatttcgtggattatatgcaggaacaggtgaaatggcagctgaatttcatccgaagcatcattcttttgacatttgtttagcttgagtgttgtggcagcacatccttcagagattggaacatcagcgagcagttcaaatgcaattcctccaatccgtatcccgaacggtgggcgtttgtttgcacattgctttccttttccattttgatcattggccattgcttttcccattttccgctcgttttccgtctcttctatttgacgtccatttccttttttggtttattgctttttgtccctctgatcagttgcggtgtccctttttcgtgctgtcgccgttctgtcgccggcggtgccaatggtggtcagaatccgcttgtgcctgccattcgatcgcttcaatgttggcaaaatgcacagaagaagcgtgagcaacagctcgactcggtttgccgtttgtctatgctgactaagactaatcattgaagtgattaattcgttttgaggacatttacgtcgccggatgtctccaaccgctccgaacacttttcgacgaccacgcgtttcatatcggatttgccgttgtgtcggtggttttgcccgtggtcagtcaaatttaattcgattaattcgttcttctcttctcgtgagtcttaatgatttgtcagttactgacgttgttttgtgcattccaacgcttagttttgttcagtgtatggccgtgtttctctcccaatgtttggcccgtcaaatcgattatcagcgatttttactccgaagggaagaacgacgaattgcgcgagcggaacggagggaaaggcgttttcgagagcaacaacagaaccaatccacgggtcaattagcaacgcaaatgggggaccattcggcgccgaattttgggtaattaattagtgaaaatttgtggatgttcgctgatttcagcggcaatgggaaagaggaaaagcgacgcagaaataaccagcaaaaggagaagaggaaaagccggaccaaaagttcgtcaccattgagaacagcagcaaaagtggcgaaaagactttcggtgaatttggaaaatgggacggcgacgagagaggaagggaggaaaaacagagtggggacgagtgaggacaagcagacgacgagagagggcgcgagggataacgggaggcggggaggggcgccggcgaggggcgcgagagaagcggcggaggccaattcgcggaacagcgcgtcaccgcggaagaatgtgccgcggggcacgcgggaagagacaaaggcccagcggaagacatccgccgcggaaccgacgg

SEQ ID NO: 79777 - DNA, 778 bp, Heterodera glycines
  Genomic contig location: Contig_ID=SeqID_2447; Location=1561..2338; Strand=+
  SCN-specific regions: Sequence locations=1-20,42-384,406-465,487-778
atgggaaaagcaatggccaatgatcaaaatggaaaaggaaagcaatgtgcaaacaaacgcccaccgttcgggatacggattggaggaattgcatttgaactgctcgctgatgttccaatctctgaaggatgtgctgccacaacactcaagctaaacaaatgtcaaaagaatgatgcttcggatgaaattcagctgccatttcacctgttcctgcatataatccacgaaatccgcgatgtttcgattgatgtgataacggcggatggaataacggagaagaaactgagcggaaatgccttaacgtacgatgggtaatcggataaaaaggacgggcatttgcccaatctgatcagatcggtcattagctaaaacaacagccaattatttaattattttgcctttttcgtccccggaggcgtcggaataaaaaaggaggaacagaaaacaggtgaacaccaccagaacgaggtaagagaggaagacgaacagagcgaactgaacgaagagaaggggtgaatttggaggggaaaagccgggcaaaaaaggggggaggggaaaagcgaaccaatttgagaagacaaacgttgtccctgagggcgccgaaaaggccgaaaagggcgacggtgcccgagaagagaccggcggaagtgagcagcacagccgggttgagcaaaacgtcgacaaactcatcgatgggacgagggtcggtcagaaagagataaacgccaagcgcaaggcaagcgacggaagcgagctggcaagaacttggggattatga

SEQ ID NO: 79778 - DNA, 94 bp, Heterodera glycines
  Genomic contig location: Contig_ID=SeqID_15495; Location=1049..1142; Strand=-
  SCN-specific regions: Sequence locations=1-94
cttggcttgttttttaaattatttggacaaaacccatactgagaaaccgaatttatcaactgttttaatttaaaaacatgaagtgaaatcagtc

SEQ ID NO: 79779 - DNA, 950 bp, Heterodera glycines
  Genomic contig location: Contig_ID=SeqID_15497; Location=876..1825; Strand=+
  SCN-specific regions: Sequence locations=1-52,74-101,135-201,232 -266,288-379,403-809,831-950
atggccaagcaatgcgacgagcgggtgaacacattgacaaatggtgagaattagggggaaaagcaaaaggaacaaaattaattttttttttttcttgaacgatttaaatttactaaaaaatttaaaaaaaatttcagcagcgaatttttggggtgcttccatcaaaaagcaaaatgtttccacttacttgtaaaaaaccaatgaaacttgttttaaaacaaattttcttgtcaaaattccggtcagtcactgtcaatcatcggcccggttgaaagtcggttcctagcttttctgaacctgtttttttttgtaatggttatttcccggtccctggctactcatataattaaatttcgtcaaaatccatgctaaattaaaccaatttttctagcaaattggaggcctgccatgccctcactcgaatttctaatccgagttccagaattttctttctttttgcgttttttcccttttttttgctattaaattttgaatttccgacccaaattctaacacctcccccccccccccccatttccccggcagatgtcgcctttctgaagttcctgcggcgtcgcgaggcggccacggcggcggacgccgacggcggcggccctcggcgggtgaccgacttcgacgagttggtccgccagttggaggagaagcagcgccgtttggaggagggacaagtgcaggagacgccgctcaccgagttcatccgacagatggcactcgaaaaggtggcacctcccgaaaattttttttttaattttcaaacttatgttagaagtaatccaaaaaaaattgataagaaatttcttaacaagaaaatctccaggaaaacttttttgaaaaaattttcagagatttttttattttccaaataatcgctgaaagatttttcggaaaaaattttttcttgaccaattgctgtccgaaatttaaaagaa

SEQ ID NO: 79780 - DNA, 1386 bp, Heterodera glycines
  misc_feature (1246)..(1246): n is a, c, g, or t
  misc_feature (1324)..(1324): n is a, c, g, or t
  misc_feature (1376)..(1376): n is a, c, g, or t
  Genomic contig location: Contig_ID=SeqID_15499; Location=54..1439; Strand=+
  SCN-specific regions: Sequence locations=1-89,149-155,350-354,405 -845,880-884,967-967,990-1072,1094-1161,1183-1316,1370-1386
ttgcgtgttcccattattgcaatgtgcaatctacagcagaaactctcaaaaattgaaacacttcgtttggccaggtagaaaatgaatggataatttttatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataattgcaattataatatgtatacaaataataaattacttatttttaacaaaaataagttaatggaagctctttttcaaatttttgttaacttaagagaaaataatttttgaaattgtttttgtctatttaaattttcgaataaaatccttttttccccattttttgtcattatatataattaatttaccgtattactaccacacatcacaatgtcaaattaatttccccactttttttccggattatattttacttacacaaatctcaagtgactccgttgagtagggaaggttctgctgctggtgctcctactcaatgtttgattattggacaacaataaaagcgcccaatttttggccctcaaaagtgagggccctcaatcatgggaatttctccggaaggtcgagacacacaaattttgcatgagaaaatgatgggggagggaagagcaaaaataattgggcaaatttgcaggaacaaattaaacaaaaaaggaaatacaaaaataattttttgataaacaaagatttattcgaaaaaattttaaattaaataatattaaagtaatatatttttaaaatttatttaatttttgtgtgaaaaataaatttaaattacccgaaaatagacatttcattttcaggaactacatcaaagctttgaaccaaatggcagaaaaaggcgcccaaatgatgtccaaggtggactatgcgcgaattttgtgcgaagagctgagtgccaccaccgcaaatcaaattgccacttgccttggcgttccgccaattttactccgagcgatgccaacgcaacgccaacaacaacatcaacaagagtttgacgggacggcacaatcacagaccgccaattgcactccgaccaactttaagactcaatcgngaaaaggatgttttagtgggaccattgtttgaccaccaaatgccacgaatgagcaggaccgaatgtcagcaataattntgtttttaaatttgaaagtaaaaatattcatttaattaataatttccattanattatttgca

SEQ ID NO: 79781 - DNA, 612 bp, Heterodera glycines
  Genomic contig location: Contig_ID=SeqID_15500; Location=1112..1723; Strand=-
  SCN-specific regions: Sequence locations=1-218,240-494,516-612
atggctataattttgcatgaaagtacgttagcacaaagtctgaagcctggaacaggacgggattttgtgggatcaatcccttgggatatcatcccgcaaaattaagttttaatcccggagtgggatcagaaaatttgaaattttcggactctaataaggactaccagcctacaaatatttatagatttgaagtacaagactcaaaacctaccccaaaattagtgaaattttttgttaatttaccaaaaatgtgtcaaaatcaaattttcacacttttttcgctttgacagatcgctgcacgggtgcagccaccttttgttggcactgaactcctttttcgagttcctgcaccagagcggccattacattttcctgttcaccatattcagcgggcgcaatttcatcccctattttgccagtgctgtctttcagcttcaatcaatcttcggctacaatgccgcaattttcacgatgattggcacggcggtggaccgactgttgtccgtgctggtgcctgatttgtaagcgatatgttggcaaaattaaaactttaaaatctctctttatcagagagaatttctctcaaattttgtgtaagctattaataataaa

SEQ ID NO: 79782 - DNA, 1928 bp, Heterodera glycines
  Genomic contig location: Contig_ID=SeqID_15502; Location=1995..3922; Strand=+
  SCN-specific regions: Sequence locations=1-272,294-343,365-589,612 -1314,1365-1527,1549-1663,1686-1928
atgccaagagttggagatcgagtgatggttgaggcaaattataacccgtctatgccatttaaatggaatgctcggtcaattgaaaagatacaaaatgtggaataccgtcaggtatcacatttttacttccattattgaacgttatcttttaggaaacaactcaacaatatcaacctcaccaaaaccgacaggtccaacaaccgcaaaacgggacgtcgagtcgttggaatgatcgtccgccacgtgatgaatttcctcgtgaaccgcgacgtcagcctccaatgtccattcataggactcctcctcgggatgccggccgtaagttacgttaaccaaaattattacattttatttttaagaaaaacgacctctttcacgacagcgttcaccacttcctcgtaaaagtcctccacgtcgtcaagaaagcacagtttcaaaaagggagcgggaggtccgcgatgaaaccgaaacccgagagaaggaccgagagtcgactcgcgcacgttctcctcagtcgggcaagcgagacactgcttcaccacctcgacgtcggcagcgcattatcccccgttaccattgtaacgtgtcgaaacaaacaattccacagtacacgcttttttttctatttttttcgtgtaattgtcaattaagtggcgagttaaaatatgcagaattgcgaaaacgttattcgagtctttacataccgtccgactttattcgctgcaagttcagctgggttgattctgtgaaactcgagacgcctcttcaattttcgccacacccaatcaaatttcatgtgcttcataaggatgtcgatgttttgttggacgagggcaaacaattgccgttggaaaaccctccagatgctgacagtcgttttgttgtaaaggtaatctttcaaattaaattagtttatttggattgattttctctttttccggttaggttttacttatctcacatcctggacttactgcgcttcgccgaaaattgagcggacttatgccggatgggagcattgatgaatccacagaaactcaacccttatctaagagtatccaaatacttgttggtaatatttttaactgttttttttaattagtcgtttaatttcagggtatcgtggaaagggcgagtttatgtgcatcggcggcgtgtggtcaccttcgttggatggtacgaatccacttgacccgcaaagcatggtcaatactgcgattagaacgacactttctttgactgggattgatttgtcaagatgtgcaaaatggttagtcgtttggtttttcaagttttaactttctttggtaaatttctctctctctctctctgtctatgatgctctctctttctcttactctctccagcttcatttaggttcacttttgcgtttgattgttatttccgtttatttctctttttctgttcttgccacacaccctttaaacttctgatgcaggtacaagatgctgcatttgcattactttcgacccgagcgtagtcgcgttgactcgtgtgtgctgatgttgcctgataccagcaccattactgactttcagctctcagatgagcaataccaacagactgtgcagaaactccaggaccaactggcgtctaaattgtctgcaatcgatgcgcaggattttgtctcaccaaggcgggaaaatgagaaggggttaaatttggattctggcgatggtgaagctgctgcggcggaaaccggcgaaaaaataaatcaggaggagagaagcggtagtggtggaattgatcagtcgcccaaacagccggcggttggggaccagcatcagccagaaatcacaaacaccatctctgctgctgaggtgctttcatcaaagcgatttataaaagttgtcagctcgacctcaatgtgttcgggagttgccggcggggtcgaattcttgtcatag

SEQ ID NO: 79783 - DNA, 831 bp, Heterodera glycines
  misc_feature (18)..(18): n is a, c, g, or t
  Genomic contig location: Contig_ID=SeqID_15503; Location=323..1153; Strand=-
  SCN-specific regions: Sequence locations=1-131,180-336,359-439,465-831
atgcaattgctctatttntcatctttttattctgcagtaatttccagggatttggtacagacgagtatgttctaacgaatattttggtcacaagaagcaatgagcaaattcgtgccattcaaaaagtgcgcatatttaaaaatcaaaaattatttttgtttaaaaataataattttatagccctaaattctacattttaattcctcaggcttacttcaaactgttcaccaaggaactgcaaatggacattgtggacgacaccagtggcacttacagacgactgttgtccaatttgtgtgccgccactcgggacgaaaccggcaaagtgaacaaggacaaagcaaaaaaggtgcaatttgtagagttattagattttcaaaatttatagaaaagtacatttgaagtttttatatatattcgtattattaaaaatcttggcttcttaatacaatttgtgtttagaatatttataagtccttaaatttgttcaatttaaaaaacgtcagatgaaaacgaaaaaattaatagaagttaaatttcttaattttactagggcccggatttaggggcgaaaaagtccaaaataggaacctaaaaaggggcagaaaaatcgcgaaataggggcaaaatagaggcgaaaaagtttcaaatgtaggggtgaaatttattaaaaatgctgttttttctatgtaaataagttaaaattaaggcagacaattttattcattgattagagatacaaaaaattatttttattcgaaatttttgaatacatttttacaaaataactaaaatttcaaaaatctaaattttgaaaagaaagaaaataaa

SEQ ID NO: 79784 - DNA, 450 bp, Heterodera glycines
  Genomic contig location: Contig_ID=SeqID_15505; Location=300..749; Strand=-
  SCN-specific regions: Sequence locations=1-53,75-208,253-266,288-450
atgtgcgaaacccttcgaacaataaacggaggagtgcccatctgcaaatcgaacttccaggaattggatgttgcctgtcaatctattctccgtgaacgtcgaattcaactggcagatttggcatgtggagcagtagtatctaactgtcaaagcaaattggcgggtacgattttttctgagaaaaacatttggctgtttgaaaatatggaataattttttaatgtaataattttatttgctttttaatattttctattagttggacctttttaataatgaaacttttacaataataaaaatatttcattcaggaagcctcggcgaaccctcaaagctcatacatacgcaaaatttgggtggcagtgacggtggttttataaaaaaaatcggtacttccgggttttgtcaccccccccccctgaaattttttttctaataattctaggctaa

SEQ ID NO: 79785 - DNA, 889 bp, Heterodera glycines
  Genomic contig location: Contig_ID=SeqID_15505; Location=1337..2225; Strand=-
  SCN-specific regions: Sequence locations=1-148,171-442,465-599,643 -707,730-889
atgtatgttcccattggcccttgggaaaggcgttttttaaaaaaaattggaaaggggtgtactgtacataaaaaatatattgtgattttctattgtcttgtggttagcagggctatgctacttccttgcggtgagtccggaaacagagttatttttaaaaatattattttgtttttcttgcaatgcaatggaattatctggctaaagcaggctaaatttgtccaatttttgacataaaattaaatttttaatcccaaaatgtcgggtccccaaatgttgggttccctaagtgtcggatccccaaatgacgttcgatccccaaatgtcgggtccctaaaagtcgggtccccatatgtcgggatccccaaatgtcgggtccccaagttgcaaatccccaaaagtcgcaccacggccctagccatccctattatatagtattcagtttatataaaaatattaaatttggtggttattttaaaaaatttttagccgatcagcacaaaaggccagcggcttcaatgaacgctaccatctttgtgccggcagccgatcattgggtggacttgaagtgtttttttttttactttaaatcagggacgtaattattatttattaataagtgtgaaaaatattatattttaacaaaatcgatatagttattactttttctttttcctataaatttaacttaaaatacatatttatcctaattattgaaaaatagtagaatttaaactaatccaattaaaactcagggagattctggttcggctcttgttgtggacatttcttctcgttcttacgcagttggacttttttcaatgcttaccactaactcgtccttccgcaacgttcaggcaggcatgtttttcaaggcttttcaaataaa

SEQ ID NO: 79786 - DNA, 1215 bp, Heterodera glycines
  Genomic contig location: Contig_ID=SeqID_15509; Location=1129..2343; Strand=-
  SCN-specific regions: Sequence locations=1-716,743-950,987-1167,1189 -1215
atggccagcagcattagcagcgttgacatcgactcgcaatcggaaatggcgtcgaattcgagaaaaactgttgatgatgttcagtcctttgaagaatttcccgtctattcttccaaagtgagtgtcccatagactcaatcaatcaattcgaactttgaatgaaaattggaattgaggtccgttcttttttggcccaagtcgatgactctgaaatgcttcgtcccgactttgatctgacgacttacataaacaccattttccctaccgaacaatcacttgtccatttggattcgtttgtaaagaaaattgacgaagaaattgtaactttttttataaaaaaatttctatatgtacatttccgcatttaaaagttcaggccaattacgaccgtgaactgtccgaggctgtcgctgaacacgggcgatgtgcccttgaggcaaacaacgctttgctgcaggtccattcagtcattttgacaattattcagcaatacaaaaactaactatttccaattttaggcccagacaacaataacggaattggagcaaaaagtgcaggaaattcgtgacagaacgctttgttctgagacttccgtgcacgaactgacaaaagacattcgacaattggacgttgccaagaaaaatctgaccgaatccatcgccactctccaccatttgcaattgcttctcaacggagtgaatttgctcagtaaatggctttgaaaaacaaaaatttctgtcacttaaattaatttaatttccagctcaatgggtcaccgaaaggcgatacaatgaaattacaacggaactgccggctgtgctcaacgttctgttgttatttgaggactatcagcacattgaacacgtcaaacagctgacggacaaagtgcagaaaatccgcgaacaattgaccgtccaattggcagccgatttaaaagcggcttttaaggcaaatttattatttaagttatatttcaatttttaaatgccaatttagacgggccacgtcgaccaacaaacctctgaaatgtgtcgggttgtggtaagacaatttagagcaaatcgccaatttttcatttattttcagagcgttttgggtggaaaacttcaagacgatttcatcaattggtttatcaaccaacaattggccatttacactgtcctttacgcggactctgaagacgtcgcctggttggacagaatcgaagaaaggtaa

SEQ ID NO: 79787 - DNA, 1120 bp, Heterodera glycines
  Genomic contig location: Contig_ID=SeqID_15511; Location=474..1593; Strand=-
  SCN-specific regions: Sequence locations=1-654,676-703,725-809,831 -1120
atgttgaagaaccgcacgcaggagagggacgacctcagggacgacatcgccaacttcacagccgaaaaagccaaattggaacgaggcgtggccaagttggaggaggacattggaaaactgaagcgcgacaggacgaagacggacgaagacatcatcagactcaagcgggagcgaacaaaggcggacgaagaaattggaaaactgaaaaaggagcagaccaagtgggaggaggagcacgccaggctgaaggaccagcatgccaaactcggcgaggaaaaggcagatttggagacagcggtgagtttgcaaattgtaatgttgttttgaaaccaaattgaaacatggttttaactgtgggagacaggtgggtcgcacggtgccgatagactcccccggggaaatttgtccaaaaatgactgaatttacaattttaggctcattggaaaaatttaaagaatttaaaaaaagtgttatcaaatcagtagaatttttcagaaaaatctctcaaaaaatcatttatataacattctaacttttgttgaatgttttttctttgtacagcttgctgaccaacaacaacaaatcgaacagctcaaagaggacaaaaaccaatggacgcacgatttggtaattttcttttttttaaaatccacgaaagaaacatttaaaaatttagactcaatatttcgacgccaatagtcagcaaaacgaagcgtcgatggcggacgaacaaggcaaaatggaagcgaaggaattggacgagcaaaaccagtacttttatgaccagcaggtcagatacgttttcaaacgaagggggaaaaagttaaaatttgaacaatttccctagcaaaacgcatacaaaattcaaaaacttttcccggcggcgcctgtcggcaccgccggaccgccacaccctcttcccacgaagtttttttggaaaaacgcaccgcaaaaaaagatgatttgaatagcaaaaaaaggtcgtcagaaaagtgttcagaatagaaaaaagtcgttgcggtgaaaattgggggccttcgtacgaaaaattggtcctggcgcaccccccccccccccgggacggcataaaaaatgccgagcaatgctgaaaaaaaataaa

SEQ ID NO: 79788 - DNA, 1920 bp, Heterodera glycines
  Genomic contig location: Contig_ID=SeqID_15512; Location=135..2054; Strand=+
  SCN-specific regions: Sequence locations=1-148,170-593,627-838,860 -1633,1657-1745,1778-1883,1907-1920
atggaagtgccaaaaggcggaaacaaagctcttcgacgtgccaacctcgattcggcccaatcaattgacggcaacattgggaacaagcgccgacgaacggtttgcccaagacttttcgggggggggggttagagacatgccaccaaatgcctaaggcctttggggcttctaatacaatttaaaattatttggcagctttactgtgccctaatatttctaggaagatccaaattggcattcttggtattatttgggagcaccaatttacaaacaattttggtcataattttttaaacaccatgaaattttttttgaaatttttctggctaatagaggaggaataagaaaatgtttaatttggacactttttagaaaaattacaataccttaaatctgtcaaatttttgacactcttactgaaatgtccattttaatttttccaattttagcgcaacgagggcaatcagcaacaaaacccgcaaccgcccgagttcccaccagtcattttggccgcacatcactcgcaaccacaacatcaattactgaatgtgagtttttcatggttgcatatttcaaccgattttgttaagcgtaaaaatatggaaaattttaaaagtttttctccctttttagcagggacattcgacaggcgcctttccatttgttgaccctcagcaacagcaacaattgacgccgcagccattgggcacgccggcccgggtttcagtgacggtgagggttttttagggaatcccccccccttttttcacgtttcgaccccttccccttttaagtatacgaagccgtttccgatgctggagcaacaacagccgcagcgcacccaaaatttgcaacaaggcgatgaagcggcgattatagagcgcgtccgtcagcgacagctcgcagaactcgctgcaatggaagcagctcgacccatcccggacgatctgcagtactgtgccccgtacaatgcctatgggctgaccagcatcgggtggcttttgatgggatggcgagaacagatggtcataaggtcagaaaaaggggcatttaccggggaacggaaattgagacagattggacacccgaaaattatgtccaatttaggctgtccagttttcggtgtcaattttgccagattatatttcgctctctcttccagcagtctgatcggcgtggtcacccaaagcggccccatggggggtgacaaggccaaattcaagggccgaaagctgattctacaatttgacaaggatgcatctcagcttctcaccgtcaaggaatgggagagggacgacggccggcccagcgagttggccagagcgcaagccagagaccgagtgcatttgcagcgattgaacgtcgtccaacagaagggtgccattgcaacaacaaacgaaaacactttcattttcactctaaccttcggccagttttcaaccatgaccatcatttcgcatgcggggaacggtatgggggggggagggggccggaagtggtcgtgcctttgactactaaagtttcccgatccccccaatttagagtgggccgcaaacgcaaccgtaccgcacaacttttttggcattgttagcaatcgcgccggtaagagctcaatgaattttttttgcactacaatttcccccaccccaaaaaacagatggaaccgggagtgccaatgtccaacagcaacaatcacaacagcatcaacagggaacatcggcggcgctgcatgcgcaagtgggccaaaatgaagaagaagaagatgatgaagaccttttgctgtgcattgaaaatggccaggaattgtccggcggtgatcggcaccagccacaccagcgcacctcgaccccggtgagctgagctgcccgggggcgagcaaccgatgttgttgttgttgatttggaatgttttaatgaaata

SEQ ID NO: 79789 - DNA, 655 bp, Heterodera glycines
  Genomic contig location: Contig_ID=SeqID_2450; Location=723..1377; Strand=+
  SCN-specific regions: Sequence locations=1-255,278-285,307-655
atgatgaatgagttggaatgccgaatcggtttatcaattatggtaaaagcacagaaacagctaaattggaaacacaaaagagtcacgtgcgacccaaagagcggaaaaaagccattggcagaagaccatggaaaacgaattatcatggaaaagacaacgggtacaaaggccgcccatttgtggtcatttctgaaggaaatgtcagcaggcgaaaaggccacgccattcaaagtgaagtgaaaatgttttcccaattaaattttaatttgctttttaattattcaatgttttgttaaagtgaaaacaaattgacactttaaatttaattttatcacttcgccgtgcccattttccagcaaaagcgtcggccattcgccgcccccgcaggcgctgcccaaaggaaaagagcgatggaaaacggaggggggggggacgggggatcgatggaccgagtgacttttgccccttcttttgcctcatttcattcttttattccacgcattcattatctgctcctgctgcaacatatccacctctttttggctctaagttcagtttaggcatccaatcaatgagaccatctttagtttctttgcccataatttttatggtattcaattgattgtgcttctcatgcgactaccaatagaaaaaa

SEQ ID NO: 79790 - DNA, 1488 bp, Heterodera glycines
  Genomic contig location: Contig_ID=SeqID_2450; Location=2248..3735; Strand=+
  SCN-specific regions: Sequence locations=1-212,234-236,258-281,303 -469,491-755,778-1488
atgagcttcacttttcctggtggtgccaggcggccggtcatcgacatcaatagtgaaaatctgatgttcgtttggaaccttccaagatggatcgatatcggtgaaattaagaggtcggttacattttatccaatttgtcttttttgctaaacatttcattaatttttcagaagcctgcagccaaaatatggaagggttcgtccttttgaccgtattcaaaatacttagacaaagcgtttctcattctgttactttttcagatcaaatttgtggagacgtttgaggcgtggagagaggggaggcgcatgggacaaatcattctcgacttcggcacgtacagttctctctcagcgttcactaaggcactctccaacaaggaggagttcaactacgagggcgtcgagttcatgtgttttgattcgaaagtgatttgattgccatgccctatttttcatttgctttttcccttttcagattggtcagaagccgtttttcaacttcgtccgtcagcagaccggggtcgacttgttggcatgcgaaggagtgccgccaacattcgaatacaagcgaaaggtcagcctgatcagaatcgagtgatttgctccaccaacttccgcactgtttcttatttatattccttttctgaagtgctcaaataaattcttatttttcttttctccgttttgtctttgtttttccattctttacaattagtgcgactttttctagggatcttccttcgaaagagaacagcaaaaccccaacaccatttctctgcgacctcgtgttagggacagggatagtccgaggggcaccgaacgcagtcgctacaaccgtgacgacgacgacggcaacaacggacgacccaatggtgcggcacaggccgtgccttctctgcggggtgtgggccgtggatttggacagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcagacgaaaatgagtctgagcagagaaatggaaggggcgacgagaatcgtcgcgttcattcgattgttgaacagggaaatgataaagtcgaagatgaacaaactcaccggaccgattcgccgcttggagacttcggaagtaatccaccgagtcgaaactttgcccggcgaatcagtcgcccgaagccgtcatttctcggcgaaaaacgctcggagggattctttgctgctggtaaaattagcgggacgcggaagcgtcgagcaattcgaaattga

SEQ ID NO: 79791 - DNA, 611 bp, Heterodera glycines
  Genomic contig location: Contig_ID=SeqID_2451; Location=11..621; Strand=+
  SCN-specific regions: Sequence locations=1-60,97-233,256-611
ggcccaatgaggagaatgacgacgaaattggacaagaaaatgacgatgaagttggacaagagcagcagcagggaaaggaggagggtgaagagagagacgatggcaaggggacgccatcagccgacgacgacggggagggcgcgaacaaatcggacggacgcaccacggactcgtctttcacacagtacagggagaagtcgcggtcgcgcgaggactccgtttctgaggatcgggacggacatggcggcgccggggtgaaaaacacgctgaaaataacgcaggcgagtgacatggggaggggaaaggaataaaccacaacactccacggttcagctggacttcggttttgacatttcgaagattctcgaagcactgcaaactgtcggggaagtcgtccgcttcgaacgccttgggaaagttggtaccttttgaatttccgacaagcaatttcacgtacaatcagtgtcttcccttttcagactagcgccgctttcactttcgacgacgcggctgaggcggccaacgcgagtgttttggtggtggacgacttggcggcaccgaatgcctattttcaactgatgacagccgaagaggcgtaccaataccaataa

SEQ ID NO: 79792 - DNA, 789 bp, Heterodera glycines
  Genomic contig location: Contig_ID=SeqID_2452; Location=199..987; Strand=-
  SCN-specific regions: Sequence locations=1-109,146-352,374-539,561-789
atgcaaaagtcgaattcccctgtgctctcatttgtcagaatgttttgtcgcccggttcgcccaccaccgccaacggcgccgttctgacgccgctggcgaattcgggcggcgccgtcgccgccgcccacccgccgctgcaacaacgggcggcacagcggcaaagggactgtctgagactgcgcggactgccctatgaggcgcaagtgcagcaggtggcatgccaaaactgtcttatatactgtaatacagtaataaatgagtcttttggcataaaattacaaaaaaaatcagtcggtgatttagaaaatattacataatgttttccgtgtttgcttttgctgctgaccaaattcctttggtttggaattgcaaaaagagaatatatttatttaattggccgcgttatctccgtcgaatcgcataaattattttgcggtgatttgtccctttttttgctcactttttttcgtcactttgtccatttttgtgtccatttgcataatttgctgcccattatttcacatttcactccttttttgagtttattttcccaatttttaggtcatcgaatttttgggcccccacgcgcagcgagtgatgtttcaggtaaaaggaaaagtcccacttttttttgctagaattccaaattttccagggtgtccatatgatttacaattcggcgggtcatccgagcggcgaagcgttcattcaaatggacagtgaacaggcggcggccaacgcggcgcaagaaatgcacaacaaatacatggaattgggcaaaaagagacg

SEQ ID NO: 79793 - DNA, 1407 bp, Heterodera glycines
  Genomic contig location: Contig_ID=SeqID_2453; Location=372..1778; Strand=-
  SCN-specific regions: Sequence locations=1-304,581-1407
  Gene Ontology: Mol. function=heterogeneous nuclear ribonucleoprotein; Cellular component=nucleus; Biological process=EGF receptor signaling pathway
aaaggtgggaaaaggaggggggggcaaaagagaccgacaaaagcgggagatttttcgggaatttttgattttttttttaatttttggggaatccccattggttgtttttcccaccctacgcaggtggccaattctgtcccaccacgtggcgttttgttctgctctcgcgaggcaatccgccagtccatttatccgctgtgtgctaatgcgatgattgcgcaaatggcggcggaggaaacggaccgatgcggcgaaatggggcaacaagcgcaagacgtacaggtggagagaagagaagatatgcggagagggggagaggagagagagagggagaggaagagagatgggggagagagagagggagaggaagagagaggagagagatgggagaaagagagagatatggggaggtggagaggggacgagagaggagagagatggggagaggggggagaggggcaacagagatgagagagaggtgaaaggggagagagacaaagttggggagagagggagtgtgagagagagagaaatataaaagagagcgaggggagcaaggagggaagaacggcgggagaaaagtgcttaagggaagtcaagagttggtcttgaattatgtccgtccattgctttgtcagccgcaactgttctccgcccgtcttccgctgccgccccttttccacgcgtttgtccctttctcttctcccggcggcgctgtgtcgtcatcccacgcggtgtccgccaatggtgccgaatggagcggaggagaagagacgccgacagagccaatggacagcggcggagacggcgaggtgcgcagacagttggaggagagagtgcgacggatgtacggcaaactgtgcgagaagggaggtcagcgcgccttttgagcggcggggcgagcgcagacgccttttgagtgccaaaggctatttcagagagtgccgtggccattttgtcacggttggagcgcatcgcccaaggctatgctccggcagtttggtagaaaaagcggggggcgagacgctttgaagcggctaatcgatggaccaaaaatagttccgagttgcacgtcgactcacgctgtgtggtgcgagcccgcgggttgccttggcacgtctcggacttggacgtggcgatgtttttcgccggcctcgacatcccaccgtacctcttccaccccgtattaccgtatccttctgatttcggtgcctttcccctttccagcggtggcgtcgccctctgtttggggccggaaggacggcgcagtggcgaagcgttggtgcgcttcgcgcgcgcggaccaacgcgacttggcactgcaacgccaccggcggcatttgcacgcgcggtacatcgaagtgtaccgcgcctcgggggacgaatttgtgaaacacgccgtcggtga

SEQ ID NO: 79794 - DNA, 1826 bp, Heterodera glycines
  Genomic contig location: Contig_ID=SeqID_15514; Location=1..1826; Strand=-
  SCN-specific regions: Sequence locations=1-108,142-468,492-636,667 -680,704-954,976-988,1010-1324,1346-1719,1761-1826
  Gene Ontology: Mol. function=cation channel activity; Cellular component=membrane; Biological process=olfactory behavior
ctgaatagtgtaaatacacgaaatggcaacgagtggaattggacacccacaaatgggcaccgacaaacaccaaaagttataccaagtgagaggacaaaagggcgacagacaaagcaaatgaaaaggggcaaattggaggacggaaagtgtagcaatgctaacttaaacatatttgaaagcttgtggacatgcatgggggcggagagctgatcaaatggatgcgatatgctcggaaaggcggcgactattccatcgtggatggatacttcgaggtgggatttggacaatcgacccattgattgggccgatcgatggttttgactgatcggattgatcccttttcacgtatttgtcagacaacgatcaaacaggcgatgtacaattcggggaagggcaaattggaatcggtggcagaactggtcaaaatgcgcaacaaagaacggaatgaacggcttggcgctttttcccgcaaaaaaggaaagggaaaaagcggaccgaacattttggacgacttcaatcaaaacgccaatcaaaaccagggggatttgaagaaaggcaacgaaatgccaggggcaattcggggatggaagaatcattggtattttgattaagcattgaaactgcttgacgggggaaggggcgggaaaggtgagaaaagagaaagagggacaatcatttggaaaaattttcaaatttaaaaggtgacgcgaagtaccgagagattgtgtggaaaattgaggagagaggtggggaggaaaagcagaaagcaaaggaaaagccgaccaattagggcaaatgggcgagaatttggttggctgttgtctgatgcagggtgggcccatccacacggagttggccatccgactgctgaacgagttccccaagttggtgaacgacgtgatgctttccgaggattattacggtacacaccaaaacatattggttactgtatgtacgaaaatgggcaaaaataaagcaacaaacaatcaaaaatcgaagaataaataatggatctgattaactaacagtgagtgttagccattattacagtccatcaaaaacactgtacattaatcaccgtaattagtaatgaccatttgcaaaggtctctcgcctctgcaccaagcaattgtcaacgaggacccttctttgtgtaactatttgttgcagcatggagcggatgtgaaccaacggtaagcgatggaattacactctcggcaccaaatgctatggtcactgatttgttaggacaattattctttaattgcctttgctcagatgcttcggtgcttttttctgtcccgacgaccaaaaagttggcaatttattccattttcaatggccaaacaatttacaatttgttaagggcagtcggacggattccttggaacacgaatacgtcgaactgaatctcaagacggaatacgcggggtaaaacaaaatgggcgtgggagggggatcgggaaatcgaaaacggacaccgcccaatcagacggatgtatttcggcgagtatccgctggcgtttgccgcgtgcacaaaccaattcgactgttatcgcctcctccgtgccaaaagggcggacccaaatgcacaggacacgaacggaaacggtcacagaacgaaaagcggataatgaatagggaatggattagggattcaatccattgataacaaatagcttttgaacgagggaattgatcaaaaaagggattaaagccaatgaatgaatgaacggattaatgaatgaattgaatgaatggccattcgtttgtcctttcttttagattgtcttcatatgactgtcattcatgaaaacatggtgagg

SEQ ID NO: 79795 - DNA, 2300 bp, Heterodera glycines
  Genomic contig location: Contig_ID=SeqID_15516; Location=384..2683; Strand=-
  SCN-specific regions: Sequence locations=1-103,125-425,476-726,750 -1896,1919-2300
atgggaatgtcttcagtgataatgtccaaagccactgtacaaacggcggcgaaagaacgtgaaaatggcgaagaaatgtgaggacaatgtaactgaaagtagaaaatgtggaagaaacatttcaaattaaacaatttttacggtgtctgtgtgcttctgaatccgatgactttattcggcaacggattttgagggattggcaacggattttgcgggattggcaacggatttcgatcggatttgacaatttgcatttgcttcccattgaattagcaatttgtttctccaatctccatttgcgtgtgttgaaatcttcgtcgacgattcagtcaaagcagcggctgaccagtgcaattccgaggccgagctgagaaggcgcaagaaaattgaacaccaaaagccaacaattgaaagagatgaagctgaaaaatttaagaatttttatgaattttattaatatttatttatttatttacatttcttttttgtgagggctcgtcgttttttgacatggtgaaaaagaaccaaagaatgatggcacaaaatgaaaaaacaattgggaaagcatcaaaacgagggaatccaaaacagaatttctgaagacattctcggcatcaaaatgaccggaaattatagggagaaatgagagaattgcataaatgagtaagagaaaaagaaaaaaggcatttttatactaaaatattagcgcagaattctttttctttatttgcaaagcaaatttattaaatcccgacttttttccttcaaaaattcgtataaaaaacaaagaaaatgtcaatgaatatcacattttttctacaaaaatattgtgcttacaattcagacgcttgccttccaaatgttgaagctttgcttttgccgccccccccccccccctcctcccaaacttaagcgcgtgccatccaaatttgaaaactttgcttttacccctccccaccccaattcagacgcgtgccatccaaatttgaaccttttcacaaattgttttttgtctgttggctttagccctgaatttagctatacaaaaacttggctaaactccaagctttcaattgatacccaaaaatgtgggcattgaccaaatgagaaaaaagttttggcctaagaaattaaggatgatcactgattggacgcttaaacacgggaatagagtcggaatgctaatttcacataatttttcaatttttgttaagcaaatatacataaaccgtcgaaaactgtcttaataatttgctatggaaattctgccccattttaaaattgtaagaaaaattggacaaaatgccgaaattgaaatgcaaattgttaatctgcatgggcaaccgatgccaattccgcaaattcaattgcccataaattttgacggatttcagcgaattgacgtatggtaagttgggcgattatgtaaaaaacttagacaacatttccccatcccattttaagctttatcaatctcaatgccatcgcttttcttgacagtttgcgtccacttttcgccgcctgtccaattaatttgaccatcgactctaacaatcccgcaattttgaagtctgttgtggacaacatttggccaatgctcaacgttggtgcgatgctgttatcagagagaattttgtgtggtttgcgcaaatcaaattcctcaattctcaattcctgtccaacacttcgcgttctgtgcctttatgccactgacgatttcttcaccgaatttcctgccgacgacagtgcctcggcgtcggatgaaaaagcattggcaaaatggcttttcacgccgcatccaaatgatgtgccaaaggtgttgaaatgctctattggtcgggaaagattttggaagctgaaaattgttcagttcaaaacggtgcgtgccaatcaatgattaattttatttttaaattttcatgttttaggcttttgccaatgcttcatctcatgccaatttcatcgttgtcatttgcataccgttgtgcttcgttgagccatttgaattgatcaacagaattggggaagaattgacgctgaaaataactgcggatggcgaaaacgttttgttgatccgttgtccgattgagcgtgacgcgagcgaatggacaaaatgggaagaggaggcgattggctggcgaatttcgaatcagaaaaaccgaattgacgtgggtatttatgatccagccgatgtcggcgatgggtaagagaatgattttttttttcatcaaaagtccaatttatgtattgctttttaggcttctcaaacccgctcccggcccgagtgttcagcaacagaa

SEQ ID NO: 79796 - DNA, 628 bp, Heterodera glycines
  Genomic contig location: Contig_ID=SeqID_15517; Location=144..771; Strand=+
  SCN-specific regions: Sequence locations=1-371,393-439,461-628
atgaaggattggtctgatcatgttggtccaattattgtttgtaaaatttttgttcagacttttgtaccggataaaatgagattattcatatttggtacgggataactttttaaaatttatctaacaataagattgatccatttcatctttttgcgcattaaaaacgcacacataatgaggataatttatgcatttgaatcatttgtctattcttaatccccgaataactgtcaaaatccacgtttttaaaggttcgggattctttataatataaattgggcaagaagtcagaaatttgtgctgcaaattacatagttgccaaattgcaaaaaaacataaacattttcctattttttaattaggaatttacatatttattaatttgtttgtttgtgcataaatcaggggccgtaatttgaccatgatggttggtgggttgcgaaggcgcagcaaaagaacatggttgatggttacttaaccatgttaccatggttaaacttttctaatcatcaaatccactcgaaaacctaggttaattataacactagaaagtgaattttcatagctgctcttttaatcatggacggactgacctccactgagccattgaccctcacaagtttaaaaa

SEQ ID NO: 79797 - DNA, 303 bp, Heterodera glycines
  Genomic contig location: Contig_ID=SeqID_15518; Location=694..996; Strand=+
  SCN-specific regions: Sequence locations=1-138,179-303
ggagagctcagcagaagtgaacggcccttctgtgcccggccttccgactgcttttctgcccaatcgccgcctccgtccgcaatgtttctgactccgttgggcaatgtgaagaacgaattggtcgtctgtcccaccgatttcggcggagatttcgtctttggaatggaactcgaaccatccaacagcgacttttgcgcgtcaactgccgcctttgccccttcgatctcaatgaatggccctttcccgccgatgcaaacacaaatgattagaatgccaatgccatctttatcagcttcaatcacg

SEQ ID NO: 79798 - DNA, 481 bp, Heterodera glycines
  Genomic contig location: Contig_ID=SeqID_15519; Location=1..481; Strand=+
  SCN-specific regions: Sequence locations=1-481
  Gene Ontology: Mol. function=thyroid-stimulating hormone receptor activity; Cellular component=transcription factor complex; Biological process=histogenesis and organogenesis
attgaatgattggtagccaattctaagcccggcaccctttgagaagggaccaaccaactcggccgcacttactccccgttacttcccttgtccatggtggaacggcaaaagattgtgcaactgtttcacgaagggtggaagatttgtgatatttccaagtaaatgctcattcgaatcgcatccgatgcatttgcgtttttggcagatatttgtgtgtcacgcacagttgcgtctccaaaattctccagcggttggtcccatttcgcaaacattcagcaaaaaaatgcacagattccgcgcgaccggttcagtccgcccgaaggatgccaaagaaggccgccaggagtcgcctttggtcgcggccattagggactaccggcagagacttggcattatgcggcagtcggagattcgggagcagctgatcagagacggactttgccgtcgcgaaaacgcgccctcccgctcgtccataaatcag

SEQ ID NO: 79799 - DNA, 2147 bp, Heterodera glycines
  Genomic contig location: Contig_ID=SeqID_15520; Location=108..2254; Strand=-
  SCN-specific regions: Sequence locations=1-70,114-134,158-184,294 -541,563-614,636-658,681-813,836-839,861-882,952-1058,1080-1091,1129 -1239,1315-1470,1506-1544,1596-1797,1824-1837,1864-1867,1899-2147
  Gene Ontology: Biological process=N-linked glycosylation
atgttaacaccagccacagcagtcggcagatgtttggagctcaagaatgtgagtttttacatggagttgctaattaatattgaaaaaataattaaatgttttaattattaaatcctttttagaagggacttcaagaaaagttgaagcagcaggaaacgaatgcactgctggagaagatcgaagcggagaatgggaaaatgaaaaatgaaattgagaaaatgcaggcaaaaatggacgagaaggagaaacaattggagaagaaggaggaacaattggagaagaaggagaagcagtacatggacaagttggaggaattacagaaaaacgtaatttaaaaaaagaattgaaacttaggcattcgaacccgaaatttcggactccctaaacggagaaccgagttgaagcatttaaaagtgaagcgaattcaagcgatttgaaattttatgcatttaaatagctaaatttaaattcctttttaaggtgcttcaagtgaaatgcgattccgaagaggaaaataatcgaaaactgaaaaatgaacacaaagaaatgaaggaaaagcaggacaaattggaggagaaattggggaaaaaattggacacggtgagagtgaaatattcttattttctctttaatttatttacggcaaaaattatttttgaaaattcatgaaaaatatttggccctaattttagagtttagtcaacatatttcatttggcaaaaatacctttaattccagcagaaggcattccaagcagagcacgagaaaaagctcatggagcaaattgagacattacaggcgaagattagcaaaatggaaatggaaaagcaaaagcaaaagggtaagggaaaattggataaggattactgtacataccgtaacattattattataattattattactgattttaaatatattcaattaattaatgaattttttagtttataacgaccaaatggaacagttgcaaaatgaacagaagaaaaagaccaatgcattggaaaagaatcagcggaaaatggtgaatgaataatgggaagaaaaaagaaaaattattagtgaatgatttttattatatttgaaatgcgaatttaaaatataaattatgactaattttaattttaaggcgcttcgaaacttccgccaaaatcgttgggatgccaacgcttgtcactataacatcaaaatcatcactaacaatcagttggcaatttattgttatgagggaacagattgtaatttttttttaaattttaatttataaatatgaatttttttaaaatttaaatttattatcattagtttaatttaggcagagattgcactgtcttcgctacccatccaattttgttgtgcaagaattcttctgagattttttactttgaaattccgtaacagatttatatattaactgtatgcaaaatttcaaaaagctcgttaattaacaaacttaaaaaaaacctcaactttttataaaacttgaaaattaaattttataaaaagttggggatttttttataaatttgtacgtgaaagaaacctttttaaaattgttaatttatttatttgctattctttttaaatttattttagtaacccttacgggtggcttaccttcggatttgccatcaaacagcaggataaattggaaggagcaattgctaatgacttgggcacttatgcatatttaagcggaggcgattttaccgttaatggcgaatggaaaattcaaaaagaggactattcctttggtagtgaagatactgtcggttgtggcattaatttggccacccggcagattttcttcaccaaaaatggatggcttttgggtttgtaaataataataaataaaaattattacacaaaaatgccaatttttgttgttatttttaatccaaagacacaaaaaatctgcaaatccctttgacctattccaaaaccacaagtaattccttaattttctgatcacagcttcctacgatttggttgatcattctccatttgttgatggtcttgctgaattgttcccattcctttctttgttgtgcagtggtgaagaaattgaggcgaactttgggccaaagttccattacaatttggcaaaaccgaaacaatggaagagcgtgatgctttcatctaattaa

SEQ ID NO: 79800 - DNA, 556 bp, Heterodera glycines
  Genomic contig location: Contig_ID=SeqID_15522; Location=70..625; Strand=+
  SCN-specific regions: Sequence locations=1-318,340-556
atgaatcggtctttcatttgtgcagaccgaggtgcgcaatgggaaggaactcggcttcaccgttttccacgactgcgctttgccgccggacgatttcgtgtcgaactgtcgcatcactttcgatcacctcaaactgatgggtgtcaacgacatttgggccgacttagagccccatggccaactccatctccaaatcgaactgcagggcaaaacggccgaggaagaattcacgggcaaagagccgcgggtgttccaggaacggtcgggcgcttttatggaccgccagaggaggggggccatgcgacggaaaatccacgaagttttggggtagggagaaaaacggaggaggatttgatgaatttgggttggtattcagtcacaagttcatggcactttttctgccacaaccgaccttttgtgcccactgcaaagacttcatttggggcatcgtaggcaagcagggataccagtgccaaatctgtacggttgtcgtgcacaaacggtgccatttgggcgtcgtgtggaaaagtcccggcagcaaaacggacgcttttga

SEQ ID NO: 79801 - DNA, 846 bp, Heterodera glycines
  Genomic contig location: Contig_ID=SeqID_15523; Location=44..889; Strand=-
  SCN-specific regions: Sequence locations=1-93,115-419,441-846
  Gene Ontology: Cellular component=lateral plasma membrane; Biological process=RAS protein signal transduction
atgaaccgtctttacaaactcccccgcggcttcggctccttcgcaaaattggaattgctcgacttaacgtacaacaatttacgcgagcaaagtcttcctggaaattttttcttcatgccaacgcttcgggcactttatttgggttggactggcgtaatctctaatgaacgataaaaaaatccgatttcaggggacaatgactttgagtcgttcccggaggatattggccatttggtaaaaagtttcaactgatcatccctctgaaaaatttgtcccttccttcttcagaccaatctccaagtgttggtactgcgtgaaaatgatctcattgatttgccacgacaaatgggcacattgcaaaagctgaaagagctgcatattcaggcaaaaatgggggtggagtagccgagatcattttatccgaactgggcagatttttatagggaaatcggcttcaagtgattccgcccgaactgggccaacttgatctgattgacccgaacgacgaaaatgccaaaacacttcgagtggaaaacaacccgtcagtatttgcgggcattggaacattaaattattttttgatttgcccaattatcttttccaatttaaggtggatcgtgccattgaaagatgcgctcactcgcggtgcccaaggcggcgattggcaaagcgggtgaacgaataatggcacagggacagaaaatacaaccgaaaaattcaaaatttagcgttgagtctttttggaattacattcgcagtgacaattaccgtcggttgtacgaaagtcatccggtgggcgtggggtcgacgccaccgaagcgaaacaaagagaagaaagtcagccgg

SEQ ID NO: 79802 - DNA, 340 bp, Heterodera glycines
  Genomic contig location: Contig_ID=SeqID_15523; Location=2464..2803; Strand=+
  SCN-specific regions: Sequence locations=1-45,68-340
gcataatatatttgccgaataatcaaaacacaaaaagtacgtatgaactcaaaacaaaacaacaaaaggctgatgaaagatgaagtacacgtcaaaaccctgttttggaacaaaaacattgagagatctgagaatgtttggaccgtaagcgtatttaacaacaaaatgataaagatcaattaattatgtttcattcatccgccagcaaactgcgcaccaaatcattgatgaactgagtgcaaatgtgaagcgcaacgcgaaatgcaacgaggcgttcctcaggcgacaatttcattttgtcaccattcgccactccgatgacatcagaaagagcattttt

SEQ ID NO: 79803 - DNA, 1240 bp, Heterodera glycines
  Genomic contig location: Contig_ID=SeqID_15524; Location=502..1741; Strand=+
  SCN-specific regions: Sequence locations=1-308,473-496,520-1240
atgagcacggagcagctgatcgaagtgatggaggagttgcgaccctgttacaaatgggctgattacaatttgttcaaccacaattgcatggacgtaagcggaagaaaacgctaattaattaattaatggggatacatttaattaaacggttttaagtttgccatggattttatccgacgcatttcggcggtgaatttgccatccggcaaatttttttcttggacccaagaaatccgacagccgctcattttattgccgatcagaaaaatatgcgaaactgagacattcaaacggacagtcaaatcactgaagagaaaagaggagaaagagcagggaaaaggtggagggacagagaaagaaaggaaaagggagcgaaaaaggacaaagaaagcaaagagaaagtcggagaagcagaggaaggagagggacaacgccggggagggagggcagcagacgaaagagcggacggaaagcgcaggcgaaagccccgcggaaaggtgggaaatggggtaattgtgggaatcgaacttaaacgaggtcgaatccatccatatccaaagttcgtttctgttcgaaccctttcttccatttgtttcccccaccaattttgtgccaaattttgttcatttgtcactttttagtgccattgaaaatgcccaaaacatttcgttaaggaagaaaagttctgccgcagaacaacagcaaatacacattgagcaccgcggtgccctgggcttgtatattacaactatcagaatattgccaatgacggaagagatgggacagaaggacgaataacgaaggacgaatgaccaaatgcgaaggacggacaaacgaccaaccccccccccggccgggaaaatgccatttaccattcattggtggcacacttttggccttcggaatggcatctctccccaattggtgctgttttatttgtctcatattttgttccttcaaattattcattcatttcaattaggctcagttttctttttattttccccattttaattaaatttctttcaaatatgtatttctgtgattgccttttttcttttcctttcatttcgcttttcaaattttgccaaattttaatgtttgatttgttgtgcattttgtgctttttctctccgtttttttctcattttgatgggaagtgttaattattagtaataattaacttcttaattaatttgaaagtttggaatgaaaaaaattccgcacataaaacgaacaa

SEQ ID NO: 79804 - DNA, 1011 bp, Heterodera glycines
  Genomic contig location: Contig_ID=SeqID_15526; Location=20..1030; Strand=+
  SCN-specific regions: Sequence locations=1-46,68-122,144-224,246-1011
atggttggacagaaaaaacaattggataatcaaacaaattctggcagagttatttctactttttctgttgctgaacatgggaggcacaataacgaatgtggagaagcaatttgttattctgaccaaacgacaacaaaacaaaagtcaagcagtctaatgcaacagcattattttgagaccaatggttccaaggaaatcacaaccaaacaacgactacagaggttgaggagaaaaagcacatcttcacgcaagaacatgtcactgtcgcaccgatacactgcccccttttcatcgagcaaaggatgtgccgggtttattgttccacccgtttttccaaagacgtgttccttgtacgatgaaagtttcagcgggggagtgtttgttgaccatcaagaagacagacttttggttgaggcagttgatcggattcgaaaacggaatttctcatgcaaggagaaagaacacgacggatgcttgcagaaacaacagacatctgctgacgcttcccaaataaacggcgattttattaatgaaaattcggacatcgacagtggaaattcttcgatcacagaaggtcgccaatcgcctatatgttctgaatttactcagaattttggtcgaacagaggcgactcaatttaaaaaggctgcagaaaattcggatgttgccagtgacgccaattggaaagacaccaatcaacgggacggcttcctaagaaaaaactgccgattattgcattttgtcaagaagaaaggcagtgaatcgttggacaacgaacatatgcaaaatgacgaccgagagaacgacaaattgccagcacaaaggcagtgggaaactgacacaacaaaacgaaagtcatggagagccagactcctccggacattgtcagtggggagcccatccgtcggaagagtcatgaaagacaaagaaaagcaaagaggtaattaattaggttcatttctcaatcaacgctcctcaatgaaacgctacgcaatgtgtgcatcaatagaa

SEQ ID NO: 79805 - DNA, 1051 bp, Heterodera glycines
  misc_feature (50)..(50): n is a, c, g, or t
  misc_feature (65)..(65): n is a, c, g, or t
  misc_feature (97)..(97): n is a, c, g, or t
  misc_feature (100)..(100): n is a, c, g, or t
  misc_feature (106)..(106): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (127)..(129): n is a, c, g, or t
  misc_feature (133)..(133): n is a, c, g, or t
  misc_feature (140)..(141): n is a, c, g, or t
  misc_feature (144)..(145): n is a, c, g, or t
  misc_feature (176)..(176): n is a, c, g, or t
  Genomic contig location: Contig_ID=SeqID_15527; Location=1..1051; Strand=+
  SCN-specific regions: Sequence locations=1-239,276-788,810-945,968 -1051
  Gene Ontology: Cellular component=nucleolus; Biological process =response to oxidative stress
tttgatagtcgtaaatttaactaaaatagatattccatctcccagtgggngaaaagccgactagncacttcgcgaatttctaccgggaacgggaggnggngacggnccgcgaacncngncgncgncnnncgcnggacganncanngcaaccctcggaaatgcctctgcccgaaggngcgctgcactcgcaactgctggacgagtttatgatcagacaggtggccacggaaacgaaattagaaataaaacaatgcatttttactttatatccagataatcgatattctgccgccacgagcagagggttatccttgggttcagatttacaattccgaaaagcacggcttctctttgactacgctttacaggtatagtcaaggacactctcatcagaaatggatatgaggtgacaagtggcggaggggggaattcgtcaaccactttcaaattgctcagggggagagaatcttttcactcccagtgattaattgacaatttgtccatattactattgtattgcttccatataaaaaaatgcgttcaggaggatggcggaatgggatgaggaaatgtcccccgtccttctggtggttagggacgtgaacggacatgtttttggggcggtgtccagcggcgctttgaagccgtgtgaccattactacggcaccggcgactcgtcccttttgtttcggttcaccggcgaattccctcacacgcggtgaggctttctttgcggattcgcttaagactgctcttctctttctcaacagggagttgagaacattcacttggaccggggaaaaccaattcttcgtgaatgccacccgcgaatcgctttcatttggggcgggtggtgggcacttcggcctttggttggacgctgacctgaaccacggccgatcacaaaagtatgtcacaacgaacggctagtgaaattgatctttggaattattcctttctcagatgtgctacctttgacaatgaaccattggctggtggtcaggaggaagacttcgttgtgcagttcgttgaagtgttcggcttttgtatg

SEQ ID NO: 79806 - DNA, 429 bp, Heterodera glycines
  Genomic contig location: Contig_ID=SeqID_15528; Location=881..1309; Strand=+
  SCN-specific regions: Sequence locations=1-313,335-429
atgggtaccatccctatagccgttggtatagggatgggtaccatccctatagccgttggcatacggatgggtaccatcactatagccgttggcatacggatgggtaccatccctatagccgttggcatacggatgggtaccatccctatagccgttggcatacggataggtaccatccctatagccgttagcatagggatgggtaccatcactatagccgttggcatagggatgggtaccatcactggcgtgttattcgcctggtactgaagtgtactttttgagcacacttcagttttgcggatttttgggctatttttattttattaaatatcttttcagaactgagtagtgaatttttttctgaaaattcgaaaatttccagaatttctggaataactttttttatattcttcatagaaataccaa

SEQ ID NO: 79807 - DNA, 333 bp, Heterodera glycines
  Genomic contig location: Contig_ID=SeqID_2454; Location=920..1252; Strand=+
  SCN-specific regions: Sequence locations=1-160,182-333
attatgagccacccaatttggcaaatcggtcttttaaaacgcattaaagaagattcagtcgattgcttggagtgcaagcaaaaaaacattattaatttttcatcttcatcattttttggtttaaaaatatatttgaatacttttttatactttgaaagacttttttattaatacagaattttttgaaatttcctaaaatccgcaatcctgcgcaggatcctgcagattttaaatgcaggattgcaggattaatcctgccggatcctgtcctgtaaaaaattttgaattccaatcctgcaacaggatccgcaaatttgaaatttccggtctcta

SEQ ID NO: 79808 - DNA, 2153 bp, Heterodera glycines
  misc_feature (55)..(55): n is a, c, g, or t
  Genomic contig location: Contig_ID=SeqID_2456; Location=1..2153; Strand=+
  SCN-specific regions: Sequence locations=1-74,96-108,130-137,175 -235,292-718,742-745,767-1187,1209-1368,1390-1426,1455-1475,1498-2153
tgctctttacgcttcttccaaatgcaaattccctttggacagtccaacaaatatntattgtaaatacaatgtcgacacattcattcattctcctctttcggcccttctctttccaaatattttgcttatgctaaacctttaaaaaataataaataaaaattaattaaaataattgctcagcttttcctttcttccgcttcttctctctttgcctttcgtttgttcagcatttgcttttccttttcttcgcttttccttttcttcgcttttccttttcttcgcttttccttttatccgcttttcccttgccattgttttgctttttcactttgccaatttgaacaattcttcgccctccccccccccccgacaaaacaaatcacttttttgtaaaaatgatttcccactaatttacgcgtggaaacgaacgatcgatgggcgatttcttcgagttgctcattttcaatatttcttattaaatgttcagcttcgactgctggacaaaataaccttttattaccgtatcactttctctctctctctttattttgtctcttcgatcggattaatgccgcggatttgtcaatattaatcacgattcaatcgattattatctgctacctactaaatggtttttttaactttttccgagtattttcttttttacttggcttttcctccgatcgttttatgcttctcgatctcgatttaatttgtaccccctccctcccttttctcctcatatttatttctaaacttctcctttactctccccctgtaaagccattgcattgggcgcactatttgatattattacatattccctcattttttatatcttttttgtccatcattctttcgtctgtctcaaccaaagtccattttcaccatcgtgcgaattggattcaatttattgaatgaatggatggatgggcattcccccccccccgtggacagaaatggtgagatgagcgaggagggggggggagggtgttgcgtaaaagcgtaaaatctgcgggataaatttcggtcgagtatcgatcccctccatccattgaaagttcgcatcagccgcctttcccaaaaaaggccaaaaaagcatgttttccaattggaaaatggcaaatgatgcgaaaggacagcggagtttctgccgaagagagtttattctaatggccttcaatgctttcttcctttcttctgtgtctccttggtgaggagagattgaaagagccgtgccaacaaaagttgggggcgggggggggacgcggaatttgtctccccggcacggcacagccgcacttaaagtgccgaccgacggatgagctttgtgatcgcaattggcattttttttttattcttttctcattttgttaacaattttgtttgaccaatttttagtcgctttgtctttcgtttgttaatcttttttaattaattttatttaatttttagtccttcccctccgaatattcctcgccttcacccctcctccccgtgctttcctctgctgctaatttcagtacggcaacaattccgcgccatcaccaaactccaattgaggcaccaacttcagcacagcttaaggtcctaaaaataaaggccataatttaataaatgaattaacaataattaggccgccggaccgaagccgcgactttgcgcacttatcaaaaaaaggtgaaattggagtgaatctgacaatgaaagagtttcgaattcatttgtcacggccaatgtttgcttttgaagcaacagtttaatttgctctccttcagtcccattgacgaattcggcttcaatttgcacgccgaaaggggcaaaggtcacttcgtcggtgccgttgacaaaggcggcatcgccgatgagttcgtccaattgactgtttccgttctttgcgttttattcgatttgttcagtgccggcctcgaaacggggcaaagaattgtcggcgttaacggccgtttggtgtccgcgcaaacgccacataaggtgaactcggaaaagcaacaaaaacccaacgatcggacaatcccaaaacaggaaatagtgaaattgatcaaaagcgacccattgaaaaccgttttattggtggcctccgaagaagcggacagattttatgccgaaaaaggacttggtgaagcgactgacaa

SEQ ID NO: 79809 - DNA, 891 bp, Heterodera glycines
  Genomic contig location: Contig_ID=SeqID_2457; Location=191..1081; Strand=-
  SCN-specific regions: Sequence locations=1-362,384-465,526-664,687 -808,830-847,870-891
atggaatgccaacagcgaacttttggaagagttcaaaagggtcgcattcgtaaaaggaggagaaagtgagtgaaagcgatggagcaattgaattgccttttttagcggcgttccttcggaattgtgcccaattcggagtcgaagctgcgaatcgcccggggcgacaacggccgacttggcacttctccgttgtgccgttctcttctcggcgtttgcccttctcctccatttagtcctttttcttttttaaaattggttttatccttcactcgccgtcttttgacccaattaattcattctaaaaacaatgcgaaaattcggtttgatcaaattgagaaaacaaattagcccaaagtatgtaaaattttaaaaaattgattatgcttcaaaaaaagttatccatgaagtttttcaaatgaattccaaaaaccaacccttgccccccccctccggcggttaggggtgctttctctctctgtttctctctctctctctctgtgttgtctctctgtctatcgctctctcccatccgctcgctctttattgtgatcgcttctcgcctcaaccagctctacttcacccaattggacatactgcgggctctcccaccgattttttaattttcaaaatacagtattatctacaacgagtatcgtatctttttatatgaaattattatttttgatgaaatcacatgcctattcattcgttgttaattttgtcctcggaaatgtctttttgtcctttaccaattgagcatttctgtgattttattaattttgcagtaaggttgacactttgacagtttaataaacaaattttaatttatggtcaaaataattgccatacttttgaatttattttttatacataatattttgcaaaaataaa

SEQ ID NO: 79810 - DNA, 735 bp, Heterodera glycines
  Genomic contig location: Contig_ID=SeqID_15529; Location=239..973; Strand=-
  SCN-specific regions: Sequence locations=1-223,250-302,325-404,426 -466,488-689,716-735
atgcaaggcggcgaagatgacctctatttgtgctgtccgactggacagggattcaccaagctgaccaaaaactgccactttgtgctgtggcgagagtgagtcggctttgccaaaatcagacaaattaatgtgccaaaatggaagcatccataaaacgatcgattggaatggcattttcagagcaacgccaaaataaatttttaaatgcttggatgcttattctggactaaaaaatgattcattcctttgtccgtcattttggcacatttaaaagtgtcgttggcatttgaatttaattgctaattaaaatttcccacttttaattgtcttcccccccccttcaggaacaggtgagtgccgttcgtgctgtgtcgtcccattgttttgtccgttttcttccgttcttccattttccacccttttcagtcgtaattttgccttggcaaagatcgaccaaaaaactgtggccaaaatgttgcttttcgctgaggaagaatccgccgtcactgttagcaaatgcattggtaaaacggtcgaacggacggagcgatggccgaaggcgggcagcaaacagtttgtgcacgcggtccgtccgtttacttttgccttttcatttttgaaatcgttttcggcactttttcagttgcgcggcatttgtgtggaatatttcggctgcaaaattggcatttaattttgttattttaatttcttatttttccaaatcgaattaataaa

SEQ ID NO: 79811 - DNA, 1104 bp, Heterodera glycines
  Genomic contig location: Contig_ID=SeqID_15530; Location=695..1798; Strand=-
  SCN-specific regions: Sequence locations=1-186,216-737,764-817,840 -922,944-984,1006-1104
atgtcaaaaaatgccgcccaaacattcgtcgagccgcggacaggaaattattggcattttttggcgacagttgcaaaagagggaagtctgattgaacatcagaagagttttgggcttatgaaaagaaacggaacttcagagaaaaagatatggttgaaatgtgagaagaagcagtgcccttataggggcttatatttgaaagagaagatggcactttttgatcgatacgaacacattcataacccattggaggacgagctgaaattggcacggcgaaaaacaggcgaaattggcacaatgaagctgcatgggccaaaattggcacgacgaaaaacatgcggaattggcaattgtggaaagttggcaccaccaaaaaaggacttggcggagacgaaaggaatacgaaaaataggcacaaaatcggagggaccgaaattggcatcacgaaaaacggacataaatttgaggaacagagaaaaggaggaaaagccgaaaattgctgaaagcaaatgcaaaggaggcgaagatgacctctattttgtgttgtccgacttggaacaggaattcaccaagctggccaaaaactgccaacttgtgctgtggcgagagtgagtcggcttttgccaaaatcagacaaattaatgtgccaaaatggaagcatccataaaacgatcgattggaatgacattttcagagcaacgccaaaataaatttttaaatgcttggatgcttattctggactaaaaaatgattcattcctttgtccgtcattttgacacatttaaaagtgtcgttggcatttggcatttaattgctaattaaaatttcccacttttaattgtcttccccccccccccttcagcaacaggtgagtgccgttcgtgccgtgtcgtcccattgttttgtccgttttcttccgttcttccattttccacccttttcagtcgtaattttgccttggcaaagatcgaccaaaaaactgtggccaaaatgttgcttttcgctgaggaagaatccgccgtcactgttagcaaatgcattggtaaaacggtcgaacggacggagcgatggccgaaggcgggcagcaaacagtttgtgcacgcg

SEQ ID NO: 79812 - DNA, 321 bp, Heterodera glycines
  Genomic contig location: Contig_ID=SeqID_15530; Location=2817..3137; Strand=-
  SCN-specific regions: Sequence locations=1-321
atgtcgtccattgaaatggaagtgccaaaagtgaacaaccgcaaaaagcggcgaatcacgtggacctttttgatgcgcgtggacaacggagagaaattcattgaattttgtcggcaaaatgggctgaatgggcaatcgcttcacaatgccgtcggaggaaagtgccgaaggatgtgccgaaggtattggtttgaaagtgccgaaaagtgcccatacaaaatcaaattggacatcgccacgggggaagtgtacgagcggaaccagcacaaccacacaacgccggaggggaatggcaatggaaaaggtgcacaacagccgtaa

SEQ ID NO: 79813 - DNA, 2403 bp, Heterodera glycines
  Genomic contig location: Contig_ID=SeqID_15533; Location=131..2533; Strand=-
  SCN-specific regions: Sequence locations=1-481,504-1086,1108 -1603,1625-1669,1691-1693,1715-1771,1793-2403
tccatcaaagaaagtgccgaattgagcgcggaggacaaaaaagcgctgaccaatggttatgcgccactcaaacaactctcgcagacactaatctcgacaattatggcacagaaaggtaagggaaaaaagaactcgttgttttcatccaattctttgtcttttgttagaacttccttctgtcgaccaacattttggaaatgctttcatggaattgaaagaacgcttctttggtccgtgtaaaaagtgaataaaattacactgattttgaataccttcagttgcttatgcctaccatttccgttatgttgagcaaataagtgtcatcgtggaaaatgtattttcccttctttttttgtctcatctctctctctcttaggaggaggatgaatcactacaaaatgcccttcaaaagtgtttgttggccatgcgtcaaaagggctccagcgttttcgacgtgcctaccgcagtgtcacgtccaatccaacggtgtctgaagtaccccctttacgttggcgagttgctgaaagtcgtgccgcaccgccagtcaccgttcctcagtttgccttttagaatacgcccatccatcacccggaccatcccaaattgatggagtcgctccgacaatttgggactttggcgtctcgtatgaatgaatgcaaacggcgaaaggaactcagttaacaagcgctttccgtcgaatttgcttcgtgtaagccaatcttttcagttcgcaaatatcgcagccaagaacagctgtcgttggccgaccgtctcttgcgaattaacatgcactcgctggtgaagaagagcaaccggctgaaatatcgcatcaaccgttccatcggactgaacacggcacggtacacggagttcgactacctcgtgcaactgttggaggaagcggagcgaagactgtgcaaattcctttactgtgcccaactgtacaaaaaacacatcgaacagtccgttaaacggcacgaagacacttataaaggcaaacgagaacatataaatgaaaaaaacagttaaatgtaaacgaatgccatcattataaaatatgggggggggggtgaaacggcgagattagcaggaaagagctgctcttgggtcatcgacctccgatcacaaggttgaaaaagcattcgtcttacttttgcagggatttgtcatgcgcaagacgaaaatgttgtgaaggcttttgctgttatgtttcggcatttggatgagctttgtcgacgccatttgcagacatttgaccaagaagtgatcacagagggaaagaaacttgtgcgcagtgacctcgccaaattggtgcacaaacgtttcgacaaattagcagattacgaaacagcaaaagcgacacacaaaaatgtcttcaaaaagcgtaaatcgaaaattcgtctttttaattcagtccgatgaggtggaaatgcggcgtgccgaattcgaagcgcttaacaatcaaatcaaagcgcagctgccacgtgtcatcggctcaattaacacggtcaggcggaaaggccaacttgcgattaaatacgaatttagcgtgttcgtgagctaatccaacgagtcaataagcttgacgaggcttttttgtgccggatggacgaatggtttgccagagaacgaccggaggtaaattcgccttttcgaaaaatataagccctattttcaacactgaaattttgtgcttttttccatttcagaaggtgcgtgactgtttcagcgccgcccttcctttccgcgctcatctgtccgcgtcccatcgccacacattggctgagctgaacaaaattgcagcgcatctttcgtccgggtcgaatccattgcaaaaaagtcaatcattgtgccaaattgggaaaagattgagtttaattttcgcagaaaagtcgcttcatctttctttccgaggaacgaaaagcactcatttctcaaatgaaagggaagcgcaaaataaacagccaaaaacgcataaacgacgaccccaaacgacgaaagagcgggacgcactggtgaaaattggacgaataataatgcataaacgattttgaaaccagacgaagatttgccatgctcaaaagttgacgcagcaattgcgacgtgtccaaagcgactgggaaagcgcgtcgatggttctgagaaggggcgacgcagtggtggtgaaggcactccggcaggacggtttcaggtgaaggacgacgacgactttttcaccaaaatgggtcttcagtctctgtgacaacgccgtttcctccggactcgtccccgtcgctcttttgggtccatttgacgagagtttcaccgctccgttctctcccgagtctccggcctccggaaatgagcctcacgcgattgatttggctgttgaatccgccggccataaacaaaataattccgatg

SEQ ID NO: 79814 - DNA, 1156 bp, Heterodera glycines
  Genomic contig location: Contig_ID=SeqID_15535; Location=250..1405; Strand=-
  SCN-specific regions: Sequence locations=1-293,315-346,368-433,482 -623,645-676,698-763,812-953,975-1006,1032-1069,1099-1156
atgataactagagatcgacattttgaaaaaagcctggacctggattttttgaaactcattttaaaatcaaaaaaaggtttgaaaaaatcaattaattgcttgggaacatctaaaaatatctaatttacaataataatgagttttgaatctatttaatctgttttaaaaacttgaaaaaacatcggtcacttgaaaaaataaattctaaaattttgtccaggaaaatccaggttttttcgtgttttgcctcgacctggatttttttcacatttgacctggaccttgatttcctggacaaaaatccaggaaaatccaggtccaggaaaaatccaggttgccgaaaaatggcctggacctggacctggattttttgaaactcactttaaaaatcaaaaaaaggtttgaaaaaatcaattaattgcttataaacctctaaaaatatctaattaataataataatgtgtttttaaatttatttaatctgtttttaaaacttgaaaaaacatcggccacttgaaaaaataaattctaaaattttgtccaggaaaatccaggttttttcgtgttttgcctggacctggacatggatttttttcacatttgacctggaccttgatttcctggacaaaaatccaggaaaatccaggtccaggaaaaatccaggttgccgaaaaatggcctggacctggacctggattttttgaaactcactttaaaaatcaaaaaaaggtttgaaaaaatcaattaattgcttataaacctctaaaaatatctaattaataataataatgtgtttttaaatttatttaatctgtttttaaaacttgaaaaaacatcggccacttgaaaaaataaattctaaaattttgtccaggaaaatccaggttttttcgtgttttgcctggacctggacatggatttttttcacatttgacctggaccttgatttcctggacaaaaatccaggaaaatccaggtccaggaaaaatccaggttgccgaaaaatggcctggacctggacctggatccaggaaaaatccaggcatggatccaggtccaggtcgatctctaattaaaataattttctaaatattaaaacaaccgcaagtgaaaatttttgacatcgtataattcgaaaacaactccaaataataaa

SEQ ID NO: 79815 - DNA, 141 bp, Heterodera glycines
  Genomic contig location: Contig_ID=SeqID_15535; Location=1755..1895; Strand=+
  SCN-specific regions: Sequence locations=1-76,98-141
gcaaagcgattgctggaagaaaaggagcacgagctacaaacattgaacactgaattggcatcagagagagctgtaaaaaacatttttcaatcaaaatacagactttgttggacacggaaaattttccgtgactcgaaatag

SEQ ID NO: 79816 - DNA, 400 bp, Heterodera glycines
  Genomic contig location: Contig_ID=SeqID_15535; Location=1416..1815; Strand=-
  SCN-specific regions: Sequence locations=1-70,93-169,191-360,382-400
atgccaattcagtgttcaatgtttgtagctcgtgctccttttcttccagcaatcgctttgcctgcaaaacaaattaaattaattttttttaagtcaattgtatgtaagatgtctttttttaaatcggaagattttttaattttgacgccatctttagcgtcatattcttaaaaactttttcttaagaaaatttcaaaagaaatgattcggggaaaaagctgtccgcatgacatcaccacctcattcagctcgtaaatttgatcttccaggcgccgaattcgcccttgtgctacttccaactcacgctgcgcactttctatctcttccttcatggatattcttaatttttttagattttggtaaaaaaaatttaaattttttcgtggtgcgacaaaataaa

SEQ ID NO: 79817 - DNA, 619 bp, Heterodera glycines
  Genomic contig location: Contig_ID=SeqID_15537; Location=617..1235; Strand=-
  SCN-specific regions: Sequence locations=1-250,273-619
ggcaatggttgtttgacggtctataataatagagtctgttattgtcgtaacatttctgtccggttagtctcaaataaaatgttggatgtctaattctgttttttggttaattatcaaaaacataataatcaacttaagcttcagtctcatttcttttttgccatcttacttatgtttgaatgttttatatactcgagcaattattagctctaaaattatttgatatgagtgcctaagcagtttgttctttccatttttggccctcttgttaacacatgagatttgactgccttagtgccgtgtaatactgcgggggaggggtgaatacggcacacaaagcaaacacttgatgaaagagggagaagtggggggggcatcgcccgaaggattgcttatgccgtgcccagcccaatgcccccggcaattcccgtcgcttaattgcatttccattcccttctcatgtctctctctctctctctgtccttttcctccgtcaattcaatggcaaattctgatcaaacacaaataaactttccttaattgggcgtgtcttttcattgctttgtccttttgcaatttcggtctctcattagttaattccattgatttgcctttccct

SEQ ID NO: 79818 - DNA, 75 bp, Heterodera glycines
  Genomic contig location: Contig_ID=SeqID_15538; Location=104..178; Strand=-
  SCN-specific regions: Sequence locations=1-75
atgccagaggcaattccggaaggcgattacgagagaggaaagaagattttcaagcaacggtgcttgcaatgccat

SEQ ID NO: 79819 - DNA, 857 bp, Heterodera glycines
  Genomic contig location: Contig_ID=SeqID_15539; Location=1462..2318; Strand=+
  SCN-specific regions: Sequence locations=1-27,50-344,369-857
atgaatcgacggtaagaaaggaatttaaaaaattgcaaattttcatttttccctatttcccatgtttcagttggatttgtgcggatgtttggatggacattctcccatcttttaatcgtccccaactcggactcaaaatggcattgctttccgaccgtttcgatgttttggtggacaaacatttcgatggaaaaagcgaattgccaatttggagttacatcataattttcaaggaccaagaatttggaccaaaaccaatgctatttgttgtttcgaaatatgtaatctcattgccggatcatccgttgccaaacaaaatccgctttaaggaccttcggattgagtaatttaaaaaattatacagaaaccaattaatgtggttggtcattttttcccttttcaggtacattgaccattctgtgctcgcatttatccgttccaacaaacaaatttgggacagaatgggcaccaaatttgagttgaaagtgtattcatacgaaacggatcaaatttgggatgttttggcccgagaaatttggccaatttttgcgccaaacattcgccattttggctttcactgtggcgatcatttggacaatttgcttcgtttggtttcaccgacacttctcactgattgcgaccaattgaattcaatcgattccggttatctgtcttccagtgcgatcgctgttgatgggccaaatgcaatttctgcttggcaggcgttggccaaatggttacacacgccgacaaaaaatggacaaccgaaggaattgcgttgcgatgatttttcaaagtccatcaactatttcaaggaggtgaccgaccataatttcattaaactactaattaattga

SEQ ID NO: 79820 - DNA, 992 bp, Heterodera glycines
  Genomic contig location: Contig_ID=SeqID_15540; Location=101..1092; Strand=+
  SCN-specific regions: Sequence locations=1-102,124-569,744-950,977-992
atgaaaaccgaaccaaaatttggtattaaaggaattgtagtctagaaaacgaaaaaaagttagttgtttgataaaatttcaatttattttcaatgggtcaagcccagtgtcagacaaaattgctcataacgccaaatatttaaattggcgtaaatttttgcgtgtttacaccggaacccgtcagttcggccccaacacgtttcgcccccagcgggatttcgcttataacttttttctttgtcatccaaatccaacattgttggtatcattcgaaagcccttcagatgctctattagcctgcaaatttccaaaaaaattcgtcaattttgaacaaatttatggccaaaaaagttggaaaatctggttttttgagttcttcaggccataatttttttgaacctttacaaaatttttcaagattttgcaggctagtagaggacacttaggggtctcgaatgataccaacaatgttggaccgaacaaatttggtatttaaaaaaagtttttggaagggagaatctttttctaagcaattctatatataattttcgtaatgtatgtcacaagaggagagagagagaaagagaagaggagagagagagagagagaaaagaggagagagagagagagaaagaggagagggagaaagaaagagaggaggagagagagagaaaggaggagggagtgaagaggagagagatagaaagaggagagagagagagaaagaaaagaggagggagagaagaggagagagatagaaaagagcgtggtgagtcgaagtgcaaaaagtccgagtgtggcgaagtgcaaaaagtccgagtgtggcgaagtgcaaaaagtccgagtgtggcgaagtgcaaaaagtccgagtgtgggcgaagtgcaaaaagtccgaatgagtgatgatcagaagaggcgggtcatttcagtaccgaagatttattctaatgattaattattatttaaatttataattgaatgataagctaata

SEQ ID NO: 79821 - DNA, 447 bp, Heterodera glycines
  Genomic contig location: Contig_ID=SeqID_15540; Location=1409..1855; Strand=+
  SCN-specific regions: Sequence locations=1-447
atgccaagattgtttaatttggatgcttctagaaaaagttatggcgctgatcaaaaattgatcatttttatggtgatcaaatattcaaccaagtatatctttttatgtaaaagccgtagccccattattcaaaagtcaaatcagtagagaattttgtgctcttttcagtgggcttgcccattttttctagaaaagatttcccaaccccctagggatttcgaaaatttccccgattttcagtgtattttgggtgtcccggtcactaggaaggaatgatctgatcaagttggtgtaagagacttttttgatcagcaccaaaagttgtgcgagcatgaattatttcaagtttttaaatgaactataagatagtttttcaggtttgagtcaagacttttttggggcactgtatttctctcgcaaaaatgtaatttgtttgggaaatattaa

SEQ ID NO: 79822 - DNA, 225 bp, Heterodera glycines
  Genomic contig location: Contig_ID=SeqID_15541; Location=522..746; Strand=-
  SCN-specific regions: Sequence locations=1-225
ttttaaaatttcgaaaattttcaaaatttttcgagctaggcctaaaaaacggtttttgggtttttgaattttaagaatttttaacgaattttcccgggaaaacgaagaccacttccaaaacatagtttttcgagctctatcgaatggtattttttttgaaaaaatttcgatttttttccggaaatagaaaaaatttttggcctaagcgggacatttgagtcccgg

SEQ ID NO: 79823 - DNA, 1916 bp, Heterodera glycines
  Genomic contig location: Contig_ID=SeqID_15542; Location=109..2024; Strand=+
  SCN-specific regions: Sequence locations=1-158,181-204,228-345,367 -1025,1047-1181,1210-1215,1237-1287,1314-1916
catatttcattgtgtggcaaaggggatgttatgctggaacttcaacacatcataagcattgctcaatgttttccaaatttgttgtcgttgaacctttggaagtgtttgaaggtgggactgaataaaagaaaataaaattgaattcgccttcaattagcaaagaattttcggcaattctttgaatttaataaacttatttttgtaatattccaacaaaagttttttaattccaaaacttttcagttcgaaaatggcttaaatccttcacagaattcgtcacatgccctttccgaactcctctcaaagtgtgctgcaatcgaatacttgtcactttgtcgtgccacgaacattggcacaattctttttgagccgacgcttttgccctcaaaattggcatttcttgaaacggacgacacttttgaccttcaagcgatgttcaaagttgctaataaaattgaattgttcaattaatgctgttcattttcgcagattgccaatgaacagtgccgtaacattcgctgtctttcactgcaaattttgaagccaacaattccgtcgttggattttgttcacgaagacacattgaaaaggtgcatttggatatctcttaatttacattatttttttatccataatttgattttcacgtttttgctaacatgggatttttttttttgtatccgatttcttttttttcagacttgttcacctcgagcttgactttcataagacaccgcaagcaccttttttcgagaattttgtcaaaacatccttgggttttcttgctaatctgagaatattacgacttgctaaagtcacgggtgaggtaatgaataattaattgtttgggttttataattactattaaatttctgttccgtccacaggctttgctggcggtgattgaccgttgtccaaatcttcaagacctcggatattccgcttataatattgacattttggctgcctttttgtctctttcgcgactgaaaaatttgcgctttttggtcattcgccattatggcaaagttcttcagcaaatttctactcaaaaatgtgttaaatgttccgagaattgcgatgagacatttgttggccgttcgcttaaacaaattgcgcaaaatgagaaattggaggtggaaatattcactcacaatacactaatgagcaattcatttgacatcattaaaaataatttggaataatttcagttcctttctttgaactttcccatttctgttggtttaatgtgcaaattggtgagagagtgcaaggcaagtttttcttcacaaatgttttattttttattaagtgtccattctcaatccgaaattctgggtcttttttttgtttaaacggctctcggacaattcatcataatcgaccaaagcgacaaagaatcttttccataaaaaacaccaccggctctaatgttccgcaaaaaatttttgtcaagtgcacagaattttcagcggagcttcggcaccctcccaaaattaaatcatttcagaaaattaataccaattcgaatctacgcttagaattcatatcctgaatttttctagattaaacatcaaaaatgtttaaattttaagttctataatagaaacgattctttgtattttgttatgtttgctttttggccactcttcaaaatccccatttctttttcagtgtttgaattctttgttctgtccaattgtgcgttaccaaccgttggcttcgctttgccaatgtttgaccgaattgaaccagcagatgaacagcagcagcgaaagagtggacgacgttcagcagcgaaagcgcacattgaatatcagcgtcaactttcaaaaatcccgcacaatgtcccacccgttcatccgttttttgcacacgccagactttggaagcgatgtcgtccgacaaaactttga

SEQ ID NO: 79824 - DNA, 172 bp, Heterodera glycines
  Genomic contig location: Contig_ID=SeqID_15542; Location=1031..1202; Strand=-
  SCN-specific regions: Sequence locations=1-48,70-172
aacaaatgtctcatcgcaattctcggaacatttaacacatttttgagtagaaatttgctgaagaactttgccataatggcgaatgaccaaaaagcgcaaatttttcagtcgcgaaagagacaaaaaggcagccaaaatgtcaatattataagcggaatatccgaggtcttga

SEQ ID NO: 79825 - DNA, 5142 bp, Heterodera glycines
  Genomic contig location: Contig_ID=SeqID_15543; Location=10..5151; Strand=-
  SCN-specific regions: Sequence locations=1-41,63-235,258-393,415 -479,514-1807,1831-2936,2958-4109,4139-4685,4707-5074,5097-5142
atgtggttaactgtctcatttagttggtcgactgtctcaactgaatattgttatctttttatgactaaaatcatgtcacaacatggtagcacaattatgctaagtccccttgggtcagtgaacaattgccaattcaaggcaggccaatgtgaaatggaagacaagacattgcttatgtgggacaccaacactacccgggcctgtgaattttcgaaaattggcacatggaaaggactacaacttgacaatatttggatttctgatgaagtcagttttcgtttgacatttttgaacaacacaaagaaagtcaactcatgtggtctgaatttgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaagtaagagaaatgctgactctttccttttctcagacaattaaatcgatttgtgattatatgttggagacgagaagatgggcagcgacggcacttctctcagatccaacaacttttgccagaaaattattccaatctggtaaactggtggcaaaggtggccgggcccgaattgattaaagtgtggccatgcatcgaattgcaagcacatgactacgaatttgccaaaattgggaactcagcggactccgaattcgaatgctttgacaaaattccaattaaattccgagtgaaggacaacaaaagaatggcatttattgacccaaggacaatgattttgagctccgacgcgagactggcaccatgctcagaataccgcaaacagctcatttttgtgcgtggttctctttatgaagttgatcaaatcgatgctcaggtcaaacaggtgaatgccaatcgcattgacggtttcagccttaatctgtcattggcaccaacttatgctcgccattcctttcttcaccttgccctagtgaatgtgtctgactttattggccaattttacgacgccaatttggcaagagaaagcgaactcacattccaaatcaaaagtgaggacgctatagtcacaaagactttgtctgaacaatgggagcaggtgagtgagtccattcgcaacaaaatgtttgggaattgggaacaaattggaaaaattgtcatgtccatgatgataattattgtttttgcagactttttgatccggtttggattaatgattaaagatgaatacgttggcagaggaaaaacacgacgcatgacttttggtggaaacaaaacgcagaaaattgtgaaatctccagcacacctcaacatgatggatctgaatgcatctgtagaatttggtaacgaaattgagctcagtcccgttaagctcattgaacccgcccaaacccaggcacacaaaatcgcaggaaaacgaaagagaccggtaaaaaggactcgcttcagttttcgggcgccaaaagtactcattggacttttagtaatttttcttcccaatgcttttgcaaatcccgatgtgaataaccaaatttcaattcaattcacttctccatcaatgatttatctgcttatcattccatttctgatttttatcactatttcagtactgctctgctcaaaacggaattcagaccttccaatgctcccaaatctgaatgcgatttcgccgcatcacgccgtggtgcagacattgattaattccacacccgtccgctgcttaatggacactggcgccagtttgactgttgcaccacgatcagttgcggatgaactcaattgtcgaacattttcatctgatctggaggcaatgagtgcctcaggccatgtcattcgcctcaaggaatatgctcaggtgaatttgaacattgctgggtacacagtccgttcattaatttattttgtggatgattccgaatttactgtggcccgggactacagtgtaattgttggttgggatgtctttgaaaaattgcccccaataaaattcgatcatttaaacgggaaattttttgttggggacaacgaatccaaattgtgctatcgttcaattcttttactgaacgatttgcgcgtgtcggcagagaaaaacacactcattccggccgactcccaaatattggtcgatgcttcaatcgaatcatccccaaacccaaaaaattcattttgcattgatcgacctgacataagtcttattaagaagggattgacagtcattaatagtgtctcgcctgcgggccagaaacaaattaaagtggcagtggtaaaccctaccatggaaccgaaatggatttggaaaggaacacatttggcatttgccaatgaattgttatgtgaccgaaatggatttttgaaggaaaatagcacaaaagaaattcttacgttaaattctgaacgaaagaaaatggaaattgacccaacatttgtagtcgacttttctagggccatggtcaaagacaaagatttggaaaagctgaaggcattaatcgaagaattttcagatgtttttagcaaattcaggtacgatcttggacttttcacagccgctgaacatcacatcacaaccacaactgaggaaccaatagcatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaacttaacgaagttacggtgcccgacaagtaccctctcccacgccttgatagcatcatggaaagggttggaaattgccaattttacagctctctagacttggccagtggctattttcaaattaaattgagtgaagaaacgtcaagaaaatgtggaattataactgaagacaaagtgtaccaaatgattacgatgccatttgggctgaaaaatgcaactgcagcattttcgagggccatggctatcgttttgtctggattggaggatacttcattggcctacgttgatgatgtgctcattttcacaaaaagtccgaacttttcagaacacctaacggcggtaaggaaagttttggagcgttttcggctttataatctgaaacttagcccgaagaaatgcatttttgcctcaaatgagatgaattttcttggatttgttttaacagctgaaggttttaagccaagcttaagtcgaatcgaaattctcaaagaaatgcctgtgcctttaaatgttaaggaagtaaagagagtgctaggacaggcaggcttttacagacggcacattgagaactttgcaatggtcgtagagccattgctgaagcttacgaggcaaggcaataaattcgaatggggcagggaacagcaaaacgctttcgacaagataaaagaattacttacgcaagccccgagtttaatttttccagattacgacaaagcatttcacattttcactgacgcctcatcgactggacagggaggagttttaatgcaaaaggatgacgtgacgggcacattttctgccatttcctattgcagcagaaccctctctgctgctgaaaggaagtggccagcagttcaagttgaaatgagtgccattatttatgctttaagggaatttagaccgttcattttcatgtcggacattgaacttcacacagatcacaaacccctcgcgtttttgctaaaaaaatctgaaaccaatcagcaattggcacgatggctcattgaattacaaaattatcaggtcaaaattgtccacgtggcaggaaaagccaacactttggctgatgcactttctcgtgccgctgaggacaagcccttgtcggaaatatacaatgtggatgaactcgaggacattatcgaatttccggtctgtctcgctttggcagcacattccagggtggtcgcggacccatttttgcatactttgaccatccgacacgaggatggaaacacttacgaagttaatttgttggaagaacaagcagctgatcctgaagccgcggcctacatttcgtttgtcagggatggggaatttccagctgatttggatgagaaagaaaaagaattatttgctgtaggcactgccaattacaaattaatttcgggaattctttattttgaggacaagggttcccccccaagaatttatgtcccaatttcgttacgtggactcatttttgaatcatttcactcgtctcttttgggtggtggtcatttgaattacaggaaaacgattgccaaatgtaaaaaatatttttggcccaaaatgtactctgacgttttaacttgggtcaaattgtgtgtcacctgccaattgagacacaatccaacacccgcgtaccgggaagagatgctcatagtgccagccaacacactttttgccaaagttgggctggacttggccggcccctttccagtcacccaaaaagggaacaaacacattttaaatatcgtttgttggttcaccaaatacgtgatttccgtcccggtccccgacacaaaagcacaaacaattgcccacgcttttctcaccaattgttacttaaaatacggcggttgtgttgaattgatcaccgataatgcctctgcctttacttccgaattttttaaggaattttgctccatgctttacattgacaaaaagtatgcctgtcctcattggagtcaaggcaatgcgtcaactgaacgcacttttcggacatttcacaacatcttggccaaatacatttcgaagactcagcccgacttcgatgaatttttggatgctgccaatttttgctacaacacgtcagtgcatgcttcaacgggtgagactccattttttcttatgtttgggcgtgacccaattttctgtgttgatcagatcattgatccgaaagttcgtgatccgatagcgatttcggaccgtaatgaatttaaacagaagctggtcgttgccataagacacgcgtggcacgctgcagctgatgaatatgcaaaagcccagcgaaaaatgaaggaacaatatgacagaaaggcaaggccacagcaaatcacaattggtgaacgagtgctgatcagaaactacgacggacgg

SEQ ID NO: 79826 - DNA, 516 bp, Heterodera glycines
  Genomic contig location: Contig_ID=SeqID_15543; Location=4661..5176; Strand=+
  SCN-specific regions: Sequence locations=1-77,99-234,257-429,451-516
agcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcaaattcagaccacatgagttgactttctttgtgttgttcaaaaatgtcaaacgaaaactgacttcatcagaaatccaaatattgtcaagttgtagtcctttccatgtgccaattttcgaaaattcacaggcccgggtagtgttggtgtcccacataagcaatgtcttgtcttccatttcacattggcctgccttgaattggcaattgttcactgacccaaggggacttagcataattgtgctaccatgttgtgacatgattttagtcataaaaagataacaatattcagttgagacagtcgaccaactaaatgagacagttaaccacattcggggtgacaaatccaatttctta

SEQ ID NO: 79827 - DNA, 5974 bp, Heterodera glycines
  Genomic contig location: Contig_ID=SeqID_2458; Location=10..5983; Strand=-
  SCN-specific regions: Sequence locations=1-617,639-1861,1883 -2177,2201-2422,2444-3656,3679-3739,3761-3766,3797-4015,4037 -4079,4114-4169,4191-4634,4656-4919,4961-5246,5269-5839,5861 -5912,5935-5974
atgatcaaaagtgctgtagtgcgagccttaagcttatataaattgaaagatgggcagctagaagttagcggtttccacatcgattcaccggtcaggctggatgccccgcagtatgagctacatgtcgcattggaaaacggcaaatctgaaaaaatagtagcttatcgggcagattggatagtcaaatctatccgtcgagccgaatggaagaccggaaatgtggaaataaccgatgaggaacccgatttactcattggtatggccgaattctggcgatttttccagcggtgcgaacagataaatcggaacttattccgcatttacacttcagtgggacctatcgtatgtggaaaagatatcccacaggaaatcggagaaacgagacaaatttgcgcagtcatgtaagcaaaagctgattgtgaatttgcagaaacaggcatcgacactgcaaaaaacttttgggacctacaactgataggaataaaagacgacccaaaagaaaatgatgacgacacagcgatggaaatcttcgaaaagaaagccaagagactcgctgatggacgttatagttcgggatggccatggaaagagttcccgcccgatttgccatcgaattacaatatggcatataggagattggtcaacctccttgaaaaactgcgcaagactcccgagttattggacaaataccacgagtcaatctcgagagagttcaatctcggattctttgaacttggcgaaagaagggagggttttcctgaacacttcctgccacatcatggagtagtaactcataaacttcgaattgtttttgatgcttcagcacacccacggggagagaaatctttgaacgagtgtatgttcagaggacccgtgatgattcccgatctcgtgagaatccttctaagatttcgtctcccaataattgcattatgggcggacttagaaaaggcctccaatgccatatctttggacaatgaagacagggaatttgtgaaattcctttgggtgaaagaccctaagaagaaattgtcgacagacaatttacagatcttccgttgggctcagattccttccgttcggagtaatttcttcgccatttattttggctgcagttgtccagaagcatctgaaggagaaagcttcccccttggcgttggaattcgctgggaatgcctttgtagacaatctaatgacttcatgcaaagacgctggagaagtcttaaagaagtatcgagaagggaaagcattgtttgctgaagcacaaatgaacctgagggaatttatttgcaactcaatgaaagcgatggagcaaattcccgaagaggaccggcttaataaaccagggactaaagtacttggcatcccttgggacattcaaaaggacgaattgagcattggattcccaccgacgaatgaagccgggaagatttcaaaacgcattgttttgaaaacattagcaagcatatttgacccattgggaatggtcgcaccttgccttctccaagcaaaattgttcctacaacgattgtgggacagaacccttggatgggacgaaattttaccagctgatgaaacagcagaatggtttgctgtcatcagagaatggaagaccgaaccattcaaatttccgagacgatccgtgctgcaaggtgaaatggtccaactccatgcatttgtggacgcgagcaaggacgcttatgcagcggcacttttcataaggtctcagaaaggagaagaaaccaatgtacagttactctatgcaaagagtagaatcaagccccggaaagctgaagtaacaattccaagaatggaactcttggcaatgctaattggggcgaggatgctgaaatttgcggaaaatcagctgagaatcccaataaatgaaaaatttatttggggagattcaaaacccgtcttgagctggattgagtcaaaagattcccagcccagatttgtggagaatcggttgagagaaatccggaggatatcagaaaatgccagatttctgcatatcagaacgcacgaaaatccagcggatgtagcatcaagaggatgcactccagaagagctgagatcccatcatctttggtggaatggaccaacatggctccgagaaccaatgaaaagttggccgatcgacttcgaggtcaccccaaagggagccatgaatgatggacaagaaagttcagaattggacaatgtagttgcagtgccagcaacaacgagtgaagacaatccatggattgacccttgtcgatttagcagttggactaaactacgccgcactgtggtttggtttctccgtgcaataaacaagatgaggaagactcgaatattcgagatttcagagggtgttcctatgagcagtgaagattaccagtacgccgagatcttacttgtaaaaatggcacaaaaatgttggccaatgtggaaaaagcaatcacaagaacttgtaaagacatcgaggaaagatggtcttgtccgactgtcaacacggctcgcaatgagcaatgcatcagaagatatggttaatcccattatccttcctgagaattgtccaataacccgactaattgcacagtcggtacatgagtcccttgcccattctggagttgaatccactttgacagaatttatgggaaaatattggacacccagagcgagactgaccataaagaaggtcattcgagcatgcggtcgttgtcgcaggatccaatgcccggcatataaattgccaacgatgcctcctcttcctgaggaccgcgtgaggcggacggcaccatttgaaagcattgggatcgattatcttggaccaacgaataccaaaattaatggtaagcttcagaaggcatggattgctttgttcacttgcctaagtacgagggctatttatttggaaccagtgcttgacttaagcgctgaggcattccttcaagtgttccgtcgattcactagtaggagaggaactccaaaaagaatcatcactgacaatggcacacaatttgtactggcagctaaagtagttgcagcattagaagctgggaagacacccacatgtccgctcgaagagcacctggccaacgaaggaatcaaatggcgatttaatccatcactaagaccttggagtaatggatttcttgaacgccaagtcgctggagtaaaagcggccttcaaaagagtccttgggcgtcgaattttgccctatgaccaattgagaacgtttgtcgcagaagttgaagcgacaataaatcaaagaccgatcacctacgttgatgaaggaccaaatgctgtccagccattgagaccggtcgatttcataatgccaaaggccatattgagtttggatgtccggaggaaccaacaatcgtcggacacggagttcgaaaatgaacctaaaaatctccagaagcaattgcagatgcgctgggaaggtactctagccacattggatgaattctggaccagatggaaaaaagagtacctgttaatgctccggaacagattacaatgggagcataaaggaccaagaagttgcctggcggaccaaccaaaaatcggagaggtagtaattatcgaagaagaaaaaactccgaggaactgctggccgttgggcagaattgttgaactccaaggatcggacaatattgtgcgaagtgccaaactcaaaataccaaaggcaaatggcgagcgaatttcatggcgtgaaatttcgcgtccgataaaccgtctgtataggctcgaagtaccaaaagttgacgagtctgaagaccaagaagaagaagaagttccgaacggaaaaataggacttcaagggccaatcccaaaaaaggatgggaagcaggcggaaagaccgagagatgtccaacaaggacagatcagaaaccacggaatggtgacccggtccatgacgaaagcagcttccatcttgggattaatgttcatgctggtgatttggacaacatttgtagaaactcgatttgttccaaacccaccggatatcccgaagttacataggggaagacaatttcctccttgtaaaatgtgcaagttagagtgtgctgagagaggcattaaagtcactgtaccaagaaaagtgaccaaattcgaagtatgttgtggtgcaaccagcagctgtttggtacaccgatatactccggataaacttatttatgagctgcctcgagagcaactaatcgcggattaccagtgcggggcaacgtattggctaagagatggaaaagtcaacattggagaagtggaatgcccaccacaggacccatgcacattgattgactgttggttttgtattgaaaggatagccaacccggactgccgtccagatgtgtccacaggagtgtatggattgttcactttcactgggataatcgcactctgtaggatactttcaatactgcggcaagttacctcaaatctattttggcttattcgatggatcatcataactccaataaaaatggtcatccaaggcattggaaaaaggctacaaagagatgatgccagagtagtccaaagggaaccgaataagcggaagatgaccccgaacagagccaaaaaactttcgaaaatgggcatgagcttactcgcattggcggcaagctcactgctaattgagcatgctgcaggctcagcccgtgttgtttcgataagcgcagtagcagaaaactgtctgagaaaggcaaatggctcggaatgccggattgaaagctcgacagatgtcactctactgccagtaggacaaccagttcgacttatccttagagacccggaagagcgagtcatgggagtcgttgagatgaaattactgtcactcagcattgtatgtatcccaaaaactgagagatggttacggtcatataccgttcggaccacatcagtgaagagctgcccacgagaaggcagttgctttggcaaattttgccagagagtgcatgaggattacatgaaaggatacagtgcatttgtacaagaactgggaagtgttcaaaaaggtcctggatttacaagttgccgagaatcgtgttcattttggaactgtggatgcaaacttccgactgcgagttgcatattctacagagtacacgctgtgcctgagtcgaaaattatatacgaattaatttcgtgtccaacgtgggagtatcgaatcaatgcgaaacttaaagccgaatccggaggaaactttaagggtgaaatggagatgtcgttgataccagggattaccttcaaatggaaggaggtgaaactgacaccagttgcggtatcacaagcaccagttcctatcttagggcataagttcctgtcagatggaacatctttctcaatggtggaccaagttaatacaaatcttctctgccaagatagagaaatagcaagcaatttttccggctgtactttgtcgaaagaagcgtgcccgaaatgttgggtcgatgaagaggcccagagagttgattgccaatgccgcgactcaatccttgagaaggaattcaacaacccggaaaaaaggctaccgttaagtctgcgcaatttgaatatccgatacaaagatggcgaaattttctcggaaacccactacacaccaatacaagtgatggtgcaattcgagggtctccgtcttggcatcgaggaagacttcaccaagtgttgggcacaaacaaaaacacttaaaggttgttataagtgtcagtcgggagcccaattgaagcttagatgttggacggaatacggttcagcattggcagatgtctactgtgttgatggaacacgtttcacggtaccatgccggtcaaaagcggaagatcagaacgtgatattatcctttgaccaggcggaaatcgacacaaactgcacaatcgaatgcagtggaggaaaatcgaaattccgtatgaaaggacatttgatatatgtcccaatccagcaacaaattgaaatgggcgttcggatttccgacacgtga

SEQ ID NO: 79828 - DNA, 772 bp, Heterodera glycines
  Genomic contig location: Contig_ID=SeqID_2460; Location=72..843; Strand=+
  SCN-specific regions: Sequence locations=1-718,740-772
atgcgcttttgggtcaacggagttaaggtcgttcctttcgaagtcagagaatgcaaatcatcactttattgtctcaggagcaattgttcagccggtaaaagcactttcaaatccgtgccgggggaccttccataaaaatcgaggacattggcttttcattaacctgtcacttttctaaattcatttttattaattttgaaacatttagtaaaaaaatgaaaaacataaacataataatactgtaattgaatactgtgcgtttattcgcataccttgtcccgggtcatccgaatccagaatcccaactcgatatttttctcgtcccggaacaacgctgatgccgcgcactttcaaattggccccttacaaattagcctcgaaaaaaaacaataaaatattgaattttattttcatttagcttcaaccaatgaacactactttgttttgggctgcaccttaacgaacaatgaaacaattaacaaggaatggctgattagtgattatatcaagccaaattctagcaccaaagattggaagtgccatttcgaattcggcaaacgcgaccagccaatgccattcccattgcctgaaggtgcaattttgccaaaaactgaaaatactcaaccttggcaataaattacaaaaatttcaaagcttaattaatttaatttaggtataaaaaacggaaaaaaaatattataaaaagataacaattaatttgtgcattttaatttgttttgcattgtttttgagcagaatatctcaatgtaaa

SEQ ID NO: 79829 - DNA, 351 bp, Heterodera glycines
  Genomic contig location: Contig_ID=SeqID_15547; Location=1712..2062; Strand=-
  SCN-specific regions: Sequence locations=1-140,166-351
atgacaccggcggaggagcaacagatgggcaattatcatgcgcaggttgcgcgcgcaacggaggaattccaacagcaaatggcacaggcggtgcaggcaccgttccgcggcggatttggcattgtgggggagagagattaatggatttgacaattttttaaatttatttagccaagcattggccaaacgccccaactccgtttgccccagctgccatgcttccgcgtggacagcagcagcggcggagacggcgcgcaatcgtcgcaaaacgcggcggcacaaaattttagcggaaatgccgctggtggtgttgacgaggaaaacgatgcctctgtttcggttgaagaatga

SEQ ID NO: 79830 - DNA, 533 bp, Heterodera glycines
  Genomic contig location: Contig_ID=SeqID_15548; Location=1390..1922; Strand=+
  SCN-specific regions: Sequence locations=1-54,76-533
atgacccaatgtaatgaattatgttcggaattgctccaaaatggaagtccaaataattacaacagcagcaacactaccaattgtgacaacgatgccgattcggcaaattcgctagcaacaggcacaaaattagtcgccgcggggcgaaatttttcaaataaaaaagtgcccgtgtcatccccaaaatgtgtgccgaccactgctgaaaatgtcatcaaacgaccgccacttttctacgattcgaaacggcgtcgggttgacaaattctaccaaaaacagagcagcttggtggaatactttgaacaagacagcaaacagattcaggttcagaaatggccaaaacctgtctcactattttacattggctgaataattaatgaattcggacctgaaagcagtgccaatctcataaaaatgagaaaaatatggcaaatgcataaaaacaaaggaattttttttaaactgtttggttttgcggtggccatagacacaatcggggaattttgaaagcgattaataattggacaaattta

SEQ ID NO: 79831 - DNA, 196 bp, Heterodera glycines
  Genomic contig location: Contig_ID=SeqID_15549; Location=65..260; Strand=-
  SCN-specific regions: Sequence locations=1-27,49-196
atggacagcgaaccggacaaatgggaggccaatgctttggccaatgttagtgtcaaattgacaatcaaagaaagtaatgtgagacgacgcgatgcacgtgccgattcagtattgcacgaagtgctggaagcctcggacattgcgagagaagggcagtgctgtgcagcacagttacgcaagcttaaaccagaaaaag

SEQ ID NO: 79832 - DNA, 1995 bp, Heterodera glycines; identical to SEQ ID NO: 15549
  Genomic contig location: Contig_ID=SeqID_15549; Location=1..1995; Strand=+
  SCN-specific regions: Sequence locations=1-212,234-983,1005-1071,1184- 1402,1424-1559,1581-1683,1706-1833,1855-1879,1952-1995

SEQ ID NO: 79833 - DNA, 731 bp, Heterodera glycines
  Genomic contig location: Contig_ID=SeqID_15550; Location=1713..2443; Strand=+
  SCN-specific regions: Sequence locations=1-528,551-559,587-628,651-731
  Gene Ontology: Mol. function=DNA binding; Cellular component =cytoplasm; Biological process=mRNA metabolism
atgccaaattcgaccgtcaaaaatgtcgctttgatgaacggcacttcccccgccccctctgccgatcttccgcgtttcaatcatccaactccgtccgcttctttctccttccccaagggcagctttttctcctccgcttctgcttccgttgagtcgccaatgacggcaactaaaaatcatcggccaacagagccattggcaacggcatttttgggggccagcagcagcagcagcaacggcacaattgaacatgccgaaaacggtggcaatggccatcaaccgatgacagtcattctgacagtgcgaatgctaatgcagggaaaggtggacaatttgggcatattagatttgttggctagagcgataagtgggcacggataggctgatcaaggacagatcggcaagaatgctagaatgatcaattattgatcaataattcgaaggttgatcaatagtaatactatgagaaatttgctcagattatgcatggacataagaaaataattgaactcattaaactcacgggcggaaggaagggggaggagggggattaatccccaaaataaaaataattattaaataaaatgttatctaattaacctaccttttttgttagtaaaataattgcaggaagtcggcagtatcatcggcaaacgtggcgattatgtgagacaaattcgggagcaaagcggcgccaaagtgaacatttcggacggttcgtgcccggaaag

SEQ ID NO: 79834 - DNA, 198 bp, Heterodera glycines
  Genomic contig location: Contig_ID=SeqID_15552; Location=718..915; Strand=-
  SCN-specific regions: Sequence locations=1-198
attctttcggaccagaaaaaggttattcggtcggcgaaaacgcctccaaattgaacgccatttcagttctgccaggatttggagctttgccccgcgggcatttcctcgccgagttcggcccgacgccccacggcccaatcaaaggcccgcaaggtcagtcgccatttgttggccccgcgcggcgagtgatcgatcaaa

SEQ ID NO: 79835 - DNA, 123 bp, Heterodera glycines
  Genomic contig location: Contig_ID=SeqID_15553; Location=122..244; Strand=-
  SCN-specific regions: Sequence locations=1-123
atgaagctcttttgcccttttgtgtttctcgttctgctgtccgccactgcttttgcgttctcaaatctgaacaaaacgccaaagactgtccattgggaagacgcgtgcgacgagtgccaattg

SEQ ID NO: 79836 - DNA, 1020 bp, Heterodera glycines
  Genomic contig location: Contig_ID=SeqID_15553; Location=827..1846; Strand=-
  SCN-specific regions: Sequence locations=1-336,358-687,710-745,768 -907,942-1020
cgccttttctcccgccactcattcactcacttctcagttcattctcgtcaaaaatggcaacctccgcaaaaatgtaagctttttggtcatttgtgcatccaacagctgttttcaatattgtgtttaccgcattttctctcttccgcttttgtcttctaccgtatctcaatatcttctacttctatctcctaccatatcccttttgcttctcactcctaccgtatattttacgcttttatcttctaccgtatctcatatcttctacttctatctcctaccatatcccttttgcttctcactcctaccgtatattttatgcttttatcttctaccgtatctcatattctctacttctatctcctaccatatcccttttgcttctcactcctaccgtatcttttacgcttttatcttctaccgtatctcatatcctctacttctatctcctaccatatcccttttgcttctcactcctaccgaacttttttgcttctatttcataccatctcatatcctctacttctatctcctaccatatcccttttgcttctcactcctaccgtatcttttctgcttctatttctaccggatctcatatcctctgcttctgtctcatactgtatctcttccacttcgatcccctaccgtatctcttctgctttgtaagtaccataccccgtctagttttgttctcctcttcgtccttcttacggtcgctttactcgtcgaacaagccacggcacaggtaaaataaaagctctgtttgaagaacactgtgcgtgacatgtcttttcccttaagtggggctactactacccgtactacggcaaacgcgaggccgggttcgccccccagggcaatgccaacggaaacgccgaagggcccgcggccggcggagggcacgcgatgttcagattctgaagaagggaggaaggaagaaacgatcaaagagtgatcggattgactgatcagcaagcaaatggtccatttcaaaacatgcgataaataaacggaatgctt

SEQ ID NO: 79837 - DNA, 189 bp, Heterodera glycines
  Genomic contig location: Contig_ID=SeqID_15554; Location=832..1020; Strand=-
  SCN-specific regions: Sequence locations=1-189
tgttgcaccgccaccaatggcaatgggcacgatgccggcgacgacggcaccgccttccaaagtttgcccgattttgccgaaacggtggcatttgtgcaccaatttggcccactgttcgagctcagcccgttcagctttgacgatctcgcccaggcactgcaacagcttcaccctccaacagagcaaaag

SEQ ID NO: 79838 - DNA, 97 bp, Heterodera glycines
  Genomic contig location: Contig_ID=SeqID_15555; Location=74..170; Strand=-
  SCN-specific regions: Sequence locations=1-97
atgacttctcaagcggcggaacaggaactcgacgaatgtttgaaggataaggttgttatttttgtcattttaaatcaaatttttatcagagataaag

SEQ ID NO: 79839 - DNA, 92 bp, Heterodera glycines
  Genomic contig location: Contig_ID=SeqID_15555; Location=587..678; Strand=+
  SCN-specific regions: Sequence locations=1-59,82-92
atgatgaacattcggtccaacggcaaaattcggtttgctgtcagttgctcgtcaaacatgaaccgcagcatggaggcacactttttcttgca

SEQ ID NO: 79840 - DNA, 975 bp, Heterodera glycines
  Genomic contig location: Contig_ID=SeqID_15558; Location=1470..2444; Strand=+
  SCN-specific regions: Sequence locations=1-351,373-526,548-975
atgcgcattcaatcagtcgcgcgaaccggggatcccaatttggggaggtcattaatccagggcccggatcattggctcattcaccctttcccccgaatacgaattccccttttcctctcattctcgttcgtcagctgggttaggacatcagcaccttcactggtagcaccggaggtttgctggcacgccgctggctgtccatccctcccggagaatgagatggagatacgcgtggagaaagaagagaatggaatgaggtgcgcaccgctctctcgggagtcttgtcaaggaccggtccacatttgaatggccaaaacactttcttgaaaagccaaattgcagcccaaattattttcgttatttcatcaaatgccgccactcgctcacatggtcaaattaatgacgaacatttaagggagggcattcgagccatcaaaccataattttgtttattttcgcagatcaattaattttgtttgacatcatatttgagggctaagattcttatgtaaaaacatcatttaattatatatatatatatatatatttcctctttttctctttttcttcctctttctctcgttagaacgatttaacagcttagtacttctgcataaaagtcttagccctaattacgcaaatttttttttctttggggatgaaattttccctatacaaaagaattttttttttctctttctcagcgctctcgccgattcaccggaagtacattacagctgccgcctgagaatcagagcccatcggccgagaattgcgataaacacgtatcatgtgaatactacgccgctgtcaacagttctcataatcgctcgagtaatcgtagattaaatgtcgtagaattactgttaatttataaggagatgccccgcaaaatataagcatttattttccctttgtttatgggcactcactttcagaaaattcaatattttcaattttaaccgcactatttaa

SEQ ID NO: 79841 - DNA, 1120 bp, Heterodera glycines
  Genomic contig location: Contig_ID=SeqID_15559; Location=463..1582; Strand=+
  SCN-specific regions: Sequence locations=1-59,84-249,272-371,414 -540,565-935,959-1120
atgcctcgcattccttggccacgtggactgatgtggcggtatagccttcaatataaggcgttaaattttaaacaaagttttccattttcaataacttctgttttcaatgcaacgctttttactgattgcctttatcatcggcttttgttcggcaacggactgggaattggtcgacaatcagcgatgctcgacgaattgtacctcgtcgtttacatgtttcaaattggtcggctatgtagggccatttatatgccttaaaaaaggctacattctcaatcgggcagagatgtggcccgattggccagagacgggagttggaaaaaataggtcttaaattctatatatataatttattttcccctaggtctaattcattttaaaatctaaattaatgtcaatttattattattatgtatcaatttgtagtgatggcttttggcgctgggcattatctggagcggccgttgtttccattatttggcttggaattttgactgctctaatggtcgccggtaagaaaagtttatatatttctttataatgaaggggtaaaatttttgaaatctaaaattatttttttcaagccctattgttaattttccttcaagtttttaattaaccaattattttgaaaattttctaaacaggaattaaattgtccattgggccaaaactgttttcaaatttgccataaagtttcagggaaaatttaggaagcgcatggccaaacattttcaaaatattcaaaaatatttctcttcctattactcaaaaagacaatgaaaaaatagtgtattttatgctcaatacatgacaaatttgatgaaatagtgccgacaatcagttttgactattgttttttgacccaaaagctttttttacagtttctgtttctatttgaaaatgtcagattggagtcctcataaatttgaacctaaggataattaaatatttttaagcgttcataagaatgaagaccatcgctaccgcgaggaccgtcgatcgaatcccaatgccgacgttttaattgatcgggaaatcaatggccaaatgcttttttgaaaattacaatttaaacacataaaaacgaatattttcaaaaaaatggtaatttaaaaaa

SEQ ID NO: 79842 - DNA, 830 bp, Heterodera glycines
  Genomic contig location: Contig_ID=SeqID_15559; Location=1613..2442; Strand=-
  SCN-specific regions: Sequence locations=1-511,550-564,587-796,818-830
atgcctccatatcatcggttggccaaaagcctgtctccttcttttaaaagtgtgccgtttttacggcaacgttgttcatcctttgaccggattggagctgtattgcctgtaaaaacggcacggctttacagtcggctttatgatgcccttaacggaaacgccgggaatcgtcgaaaggcttcaactccccatcctaatatatttgatgatgcaccctttaaccccttaggttaccttcccgatttccaaaccttctaaataaatagtatttcagattttattacccaacaaaataattcttccgtaatggaaaaagggtttttcgcaccaaaattggaggttttttttgccattttccataaataattaacattgaattaataggagcaaaaacgcaaaaaacaaagtgctttccttaaaaaagcattacgtctaaagattggagcattatggaagcagtatagatcggagcgggcaaaagtggttgaggaatacaccgcggctataggtcaattaaatttagttttttttttaaattttgattttaatcacttatttttcagcgatcttgggaccacaagaaaatgtttggtcttcgcctgatcctgacccaaaagtgccatccacaagtgcagcttgggagcacaactacgtgccaatctcgccggattatgcagctactttaatgtagcgatgcactacaaatgtgatggtctttaattggtgatattattttagtttaatgcaattattttttaattttgcttgcgttttatcaatagatatgaaatacgaattaatacgcaaatatttgttaagggataaataaa

SEQ ID NO: 79843 - DNA, 398 bp, Heterodera glycines
  misc_feature (50)..(50): n is a, c, g, or t
  Genomic contig location: Contig_ID=SeqID_2463; Location=2580..2977; Strand=-
  SCN-specific regions: Sequence locations=1-77,100-398
  Gene Ontology: Mol. function=RNA binding; Cellular component=nucleus; Biological process=locomotory behavior
tgtctgccacctgggcgggcgtccgcgcgagcgcctttccgaataaatgnacttgacaatcacacgcgcgcgcccgctgccacggccgccgcgcatgccgcgcgggggccgattggtggaggacagcccgggcacattggtacgcttcggcaccaccttgatctgacggcccaggaacagcgagtcgttcaacgaggtggacgtgttcaccgcgtccacgtccgcgaattggatgtacgcgaaactggaggaaatgtggcaaacatatgaaaatgtgttagcaaaagggctataattagtaatgtacccctctcattattataatcagtcccgcccgcccccttccgcttttcttccccgaaaatttaaaaaaaaatttcagaaatttttcaaaaaaa

SEQ ID NO: 79844 - DNA, 2404 bp, Heterodera glycines
  Genomic contig location: Contig_ID=SeqID_2464; Location=1955..4358; Strand=-
  SCN-specific regions: Sequence locations=1-301,328-1369,1391 -1425,1448-1666,1689-1808,1830-2079,2103-2404
atgtcttctggttctagtggtcccgaagaaggtgaaattggggccgaactctttgcaaatgaagcctttgaagaagcagaggaaccagctggtcttgtccaattttttcaagcagaaagcaagcgtggccgagagttaatcagaagcggcggttttgaatatgcctttgaagcggacagcggacttcaagaaggtgcaaaacttggaattttttgtccaaaccccaaattagggatcgaattttggcgctgtatcaatcgccccccgtattgccctgggagagtgcatgtcagttcagcttggcaaatttatgttgaacaagacgaaaatttgctcgcgctttacaacacacgtgaacagcgccatccctaccaatatttaagagctgtggcctatcgaatgccggacccaatttaacttttccataaaaacggaaataattcgaaacaaaaataattattttgcttactaaatgaaatagcattgtcttttttaaaactaccatttactgtcgaaaagtccactgtcgaaaagtcctccccttaaacaaaaattttttctgtcgaaaagtcctttactgtcgaaaagtccgctgtcgaaaagtccttctgtcgaaaggtccgctgtcgaaaagtccggcgccccccccctttcattctcccacaattgctcgccgtgctcgtcctcgtcgtcctcgcatcatctctcgtaccagagtcggatcgcatggccaattgcagcactttccaatgagcactcagcgaaccggatggaagaaaatcgcgcgacaaatcgaaggaagtccagtgccattaaactcgatcagattcgattctcccccgaagtcctccgccgcgcggagtgtcgcaatttgcgaaagttatcccatgaatcccccctcccattcccaaatttttcctcaaccaaacatttcacaatttcccagtattgttcttttgccacaatcaccagccatcagcttggccggattttcgcacgctctcccccgcttccaatgatcacttcgtgtggtatattaatatccccccgccccgccccgttcgttgggatgatgtcgtgcggcgatcgcttttcgccattccttggttttttgctgctgacttcatgaatttttatcgctcacacctttttcccatttttactcagtgacaataaattctcgtgattttgccgtccaaagtttgagtcaaatttgggggcatatttcccaattacgagacatcttttcctatctcggcgtttacctcaaatttccgcccgatgattgtgccgatgcgtcggatggccaagcgttggccaaatggctttttttgcctcgtccggacgctgtgccgaaggtgctcaagtgctcatttgaatttgatgaggagcaatggtcgacaaaaatcaatggactaatagcggtaattaaaaccagctcattttgggattcacaatgtttttttttcactttttttaggcattttccactgcttcatctcctgttaatttcatcattggcattgcctattcgtctgctattgatgctttcaatgtgccgtttaatttgaccaatgaattgactggggagcgattgacgctgaatactgccaaaaacaagtacagacattatttgttgattcgttgtccgatttcacgagatgagaacaaatggacaaattgggagaaggaagcgcttgagttgagattttgggaccaatggaacataattgaaattgcaattgttgaggaagaaaccggagaatggtcagcttgaaattggcaatctttcggttcattggctccgaattttctttttaaacaaaattatggaaacgcattctaaggctattttgagctgctgagtacgaatctgaccacctttttgaccaatttcgagtcccgaattcgaacatttaaaaaattcaaaaatttcaatccaaaaatgcttacatatgcacgcctagcaataagcactgacaacttttttttccgttgaactatcgccatatatcttcgtccaaataactgggcaacaattggcgcgttgtccggacatccaggcgtacttatttgatgaaatttaaattttttttttaaatgttcgagttcgaaattggtcgaaaaggtggtcatattcgtactcgcggctcaaattagccttaacaatgtgtgtccagaattttatttgaaaaaaaaattcgggaccgaccaatgaacgaaagattgccattgaaatttcccatttttttggttttagtcttatcgatggcacttctgctgatccaagcgacccaaatggtcagcgtaaatgttatgttcagaagtgaatgatcctgcgtgttattttgttgtattccataatcatatgtatgtgtcattttaagtggtttctttgaataaa

SEQ ID NO: 79845 - DNA, 383 bp, Heterodera glycines
  Genomic contig location: Contig_ID=SeqID_2464; Location=396..778; Strand=-
  SCN-specific regions: Sequence locations=67-69,97-104,134-156,180 -255,317-383
ccaccaggagtggagcctgcggattaatttgactcaacacgggcgaaactcacccggcccggacaccgtaaggattgacagattgatagctttttcatgattcggaggatggtggtgcatggccgatcttagtgcgtggagcgagttgtctggcttattccgataacgagcgagactctagcctactaaatagctggctcattgcttctgtgggcacaacttcttagagggagtgtcggcgctcagccgcacgaaattgagcaataacaggcctgtgatgcccttagatgtccgggggtgcacgcgcgctacactggcaaaatcagcgtgcttgtccttccccgaaaggggttggaaaaccggcgaaaatttgccgtgattgg

SEQ ID NO: 79846 - DNA, 2643 bp, Heterodera glycines
  misc_feature (139)..(139): n is a, c, g, or t
  Genomic contig location: Contig_ID=SeqID_2465; Location=214..2856; Strand=-
  SCN-specific regions: Sequence locations=1-216,239-365,387-610,632 -1118,1140-1238,1260-1366,1388-1699,1737-2017,2041-2050,2072 -2265,2287-2316,2338-2395,2440-2643
atgccaaaatatggacataaaatatggaccaaaatgccaaaatatggaaatatggacataaatcgcgaaatatggaaaaatatggatatagaaatccttcttttctgtcttcatctctgcaggcttttctcccaccaantatatcgatttttagcaatggtcatttatccgggagttaatacccgttcagctcaccggaaacttctttggaatcactttggcccatttaaaattttggatctcactgattcgacagcgtcagtcataccaatcgataaaccgaattttgagcctataaaggtcccaatagaacgccttgtaaaagtgcctgaaggtgtaccaaacattagtacacttccccggggtaaaaaccccttcaaaaatcagttaaatgcgctgataagtgtcgtgtgtttgatcagtcgcgaaatggaaaatgaaccgtgtggaaaaagtgcggccatggaaaagatcaaagatcgggaaaccgaaaatgaaaccacaaatttgggcaattctcaaaaattggaacacttgggccgtcatttaattgggcaattgaggacaattgcaaattcagttggtggaaaagtgatggagacggaaaacagctgcgggcctttgctttgggacacgcaatgcggtggactcggcatcgaacaccgaaactgcgtacaaatgacagcagccgacctcgacccagtgcttgaaagagccggtcttggcctcaaagtgatcagaaaatggaaaaagatccaaaatggggatgaatgtggcgattttaaggtgatcggcaccccaatgaaagcccttcttagcaatttcttgctaaaatcgaatgccgtttcatcagtcgccggcggtcggaaattgacacagctgatcgtcagtgctccggttggctttgaactgatcacttactccggcgcacgcgaagaccaagtgaaaatcggcaatttcccaacggaaaatgacatcgaaagtgcctttacggcgtgggtcgaaagatgcgcagtgacaagggacaaattgctgaagactggctacactccgatcgaagtgccaatgccaaatgtcgttgccgaattgccggaatcggaaaaactcggatggaacgaggtgctaaagaaggccagcttcgtactaggaaaagtacgcgcaacgacgatccaccgcaagccattgttcgtcgagaagccaagagtcatcgtaggcgactcatcggccaaacaattgttaaaaatgtggccaaaatcccaattcattggcactgaagaaggcacaatcaccgaagtgatcagagctttttatggcgcaattctatcatcaaaagtgaaggccgtcattgtgatgatcggaagagattcgatcagaggtgaagaaacgatcgaaaatgtgctggaacgtgtggggcgactcgaacagctgttgaagcgctttagccatgcccctgtgttttggctgcgacctcctttcatcaaagagaaaatgattgaatacgaagaactgatcatacgaatgaaggaacattttgggacggcacaaggcaatgtcaaatttgtaaaacgacaacgccggcgggacgatcagtgctggaactgtggcgctatggctccggtttcaataccgaccatgtgtcaaacgatggcaaaatgacggaaaagggcttattggttttgagggcctgggtcatgtcccaaatcaaagggatgccaaaggaggacaaaaaagaagagtcagaaccgaaaaagaagagtgaagaggggccaaatggagggacaagcagaattggaagaggacgtggacagttcaaccagtcagggtcgcgtggagctcagcatgttcaccagcaccacccgtatcgccgtcagttcgcgcagtcctttccgagtcgttctcgttttggagctgatcgccgttgatcttgacctcgccatcgcctttcgtgaagccaattgcactcccgattcgccaagcaagctctgtggacatcgcttttcaaagggcgaagatgtgcttatataattaatttatttatttcccatttttgacttatttaatttggttgtttccttctcaatttttcatctccctttgctttgaatttgtatttcccgccaattctatattactgtaatatcgattgtgtttctgctgctgaccagcagccacgtcattcccttctcattccattcggtttttgttttatgatattattcgtttttgttttctgctgtgaatttaatttgctgcctcggactttaattgtaaaagtaaattgtttggattttggattcgggatacaattctccatccccatttggctaattgtgtgtgcggtaattgcttcttctcgccaattcaccgccgaagcctttctgtgtgttacgacggcttttcaaaaactttttgaaaacttggggttggggaggggggtgtccggcggtgccgataggcgccgtcgggaaaatttttgaaaatgagtataatttgttaagagaattttgtttgataaaattttccatttctcaggggtgtatttttcgtttttattgcatttttgttaataatttttttcaaaatagcagaaaatattttacaaaaaattcttcaaaatgaaaaagagcacaaaaaagcaataaa

SEQ ID NO: 79847 - DNA, 120 bp, Heterodera glycines
  Genomic contig location: Contig_ID=SeqID_15562; Location=2306..2425; Strand=-
  SCN-specific regions: Sequence locations=1-77,101-120
acatctgaaaagtgcggatgaaattgaaatggggtactgtacaagtacactacagtactcgcaatactgtgtaatgggaaataaaaattgtaaattatcaataatgccttacttgtccct

SEQ ID NO: 79848 - DNA, 2987 bp, Heterodera glycines; identical to SEQ ID NO: 15562
  Genomic contig location: Contig_ID=SeqID_15562; Location=1..2987; Strand=+
  SCN-specific regions: Sequence locations=1-149,173-332,361-379,405 -592,614-1252,1274-1429,1456-1459,1530-1837,1867-2004,2026-2161,2185 -2325,2349-2987
  Gene Ontology: Mol. function=DNA-directed RNA polymerase activity; Cellular component=mitochondrial matrix; Biological process =mitochondrial genome maintenance

SEQ ID NO: 79849 - DNA, 843 bp, Heterodera glycines
  Genomic contig location: Contig_ID=SeqID_15565; Location=105..947; Strand=-
  SCN-specific regions: Sequence locations=1-352,374-688,710-727,749-843
atgcaaaattttcttctcaacataattgtgaatgaagatggtaagttgataaatcgaacaatggattttattctaattttttgaagaattgccttgctcttcaaaatgagtgggcaccatcttgaagaaaagctctttggttaaaggaatggaatatatgttttaaatcataatttatttattgacgttctggcgttccttttttcggaccaaaatattgttaattttttgttcatgtttttgttatctcttttcttcaattgttttgtatttctattaatggtgatttcttgttctttgattgccgtggtctcgaatttttaattactgttgcgtattcaaaattatctttgtaaattattaatgttttgtcatttactaaattgtttgcgaatttgttttgaaacaggtgctgtaaagtcctttattttgccatattattgaaattggattaaggacgcttcaaaaaatcctttttgtaagcaattgatttttttttggacaccaacaatttatctgttcctttccagtttcagttgtttgcatatcgtcggaaatggaataaaggcgcttcaaaaattcctttttgtaatcaattgttttatttttggacacccacaattatctgttccttttcagtttcagttgtttgcatatcctcggaaatggattaaaggcgcttcaagtgttgcatattgttggaaatgaattaatggcgcatcagaaatttcttattgtaagcaattcattcctttcagacatcagtaatttcattatcctatttcagtttcagtttttgtcaaattgttggaaatgaaaaaaggcgcttcaaaaatttcttag

SEQ ID NO: 79850 - DNA, 461 bp, Heterodera glycines
  Genomic contig location: Contig_ID=SeqID_15567; Location=1114..1574; Strand=-
  SCN-specific regions: Sequence locations=1-103,126-461
atgtcccaccaaccatttgctaatttcgaaattgtacggcttgaagcgatgatcattgggttagaaatcgacaaggaccaactgcaacgagatgtttatcatcttaaaaataggaaaacacaaatccataacaaaaaaatcgaattgctacaacaaaaggaacaattaataagagaaataagtgtgttgagagagacaaaggcaactctggtcaacgagacgaaagatttgagagaagaaatattggaattacgagatatggatggttccaaagacgacgacccactttgcgccgtttgctataccagaaaagtcgtcagcgtttaatgcaaaactaattttggatattttagagaaattatgcatgcattccatgtggtcatcgtgccctctgcaaccgatgcgccgaaactgtttcaattgatgggcgttgccccttttgccgtgaagaacttattggg

SEQ ID NO: 79851 - DNA, 356 bp, Heterodera glycines
  Genomic contig location: Contig_ID=SeqID_15567; Location=2758..3113; Strand=+
  SCN-specific regions: Sequence locations=1-356
atgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaagcgccactcgtggttgtacaaacagaggcatcagctcaaggacatgattgagaacaaaccacaaaaggtgattgtggaaaacgctacaggcacagcgccaaaaacattgccccgtatatgggcatacagaaaccaaacctcaacaagcttgaagaattgaacgggcaggatggcaaaaaa

SEQ ID NO: 79852 - DNA, 786 bp, Heterodera glycines
  Genomic contig location: Contig_ID=SeqID_15568; Location=15..800; Strand=+
  SCN-specific regions: Sequence locations=1-42,69-125,148-148,172 -425,447-505,527-786
  Gene Ontology: Mol. function=ATP binding; Cellular component=myosin; Biological process=leading edge cell differentiation
atgggcatgacggagatgaacgagagtgtgttcggcgtgcgcaccaagaagggcatgttccgcactgttgggcacatgcacaaggagcagttgacccgactgatgcaaacgttgcgcaacacgttcccccactttgtgcgttgcatcgtccccaaccacgagaagaagccgcgcaaaatccaatccatgctggtcagtttttcagttttattgcatgcgcagtgccgtaacatggtgcggagagagaccatttttatggcattgaataatgaatggtacatctatcaacaaatttgtaagggattgaaccgaactccggatttggtttgggatggggatattaggtagaatggaacaattttgcatttttttcgcacatttcgttttccctcatgttgtcccctgagtttttaaaacatatttactaattaatataaaccaagaaattttcatgaaacccgatttggatgaaaatcttggaaactaataatcgttgaaaaatcctaaattttgataaattatttctgccctactaaaatgttcggccactttatggcccttcaaataataattattaaatggttgtacgtccatcaacagttcgtatcactttcgcttcaggtgcttgagcagttacgctgcaacggtgtgctggagggcattcgcatttgtcgtcagggcttccccaaccgaattccgttccaagagttccgacatcgctacgaaattctgacgcccaacctcatccccaaggggttcatggacggcaaagaggcggccaagtaa

SEQ ID NO: 79853 - DNA, 2598 bp, Heterodera glycines
  Genomic contig location: Contig_ID=SeqID_15569; Location=994..3591; Strand=+
  SCN-specific regions: Sequence locations=1-234,265-347,385-392,414 -553,598-779,803-837,859-1024,1046-1541,1564-1867,2051-2456,2488 -2497,2519-2598
  Gene Ontology: Mol. function=motor activity; Cellular component=non -muscle myosin; Biological process=cytokinesis
atgtcccgtctttggcactttctttgtgctctcttcgcctccgtcttcttcacctcttccccccttcagacggagtcggaggagcgcgcggacgcggaagaaatggccagcgatttgaagcagaagaacgtgaacatgcaggagatgctcaacgactattggatgcgcattgaggagaatgaggacacgcagacgaagctggtggaggagaacaagaagctcaacgagaccaacaaggacctggaggaacagctggagcaggaggagcaggcacgccagaagttgcagttggacaagaagaatgtggacctgaagctgaaggagttgcaggcaatgaatacatttcgaaatttaaaaaaaataagaaaatttcattaaaaaaaagttttggaaacttttttgaaaagacattaattcatcataaaaaaaatttaaaactaaaatcatacttcttataattaatgctgttttccaggacttgtacgcccagttgcaggacgcatttgcgaagctgcaagcggaaaagcaaagtttggaggcgcgcatcggactgttgtccaaccaactgcaggaagaggaggacaagaacaagcaaagcgtcaagtaccggcacaaggtaaaaaattgtaaaatctaataaaataattacacatccatcgccaccacataacagttggaggcccagttgaacgagctgacggagaagtaccagtttgagcggaaactgcgcgaggagttggaccggaacaagcgccggctggagttggacatgggcgagcagaagacgcaggagcaggagaagcacaacaaaatggagagcatgagccgggagatggccaagctggaggcggagctgagccaactgcgcaacaagtgcggcacatttgaattacagtggaaagaaacactatttgtagaatgattggactctgtattttcaggatgaggttacccgtgacatttgtgtctattgccgaaatcggacattttgcgcccggacttatgcgccccatttcttaaagggcattcattcttttagacatttgtatagaatccaggattggtaggaacactttttcttacgaagcattttttgcgcatccacatttgttcggtggcttaaatgttgctgtccacagtatatttatgtgcagtttttccagtcagaaaatttaaaagtgcttggtccagagaattaaaaaatcgaacaacgaaacagtagtaaaagaagtttaatttgttaacagctttttccaattttgcgattgaccctttgagaaaattaactcaataaatgtccgaaagtccttttgaaatgggttgcacaatgccggagctcaaatgtctgtatatgttttaagaggggggggggggggggaggcgggcatggcattagtggccaaataaatatgcatggaataattgagtgtcactccataaacaaaattccagcgccgacgacgatgccgccacaattgccgccctgcaaaagcaggcccggaagttggagtcccagttggaagaagtgcgcgaggactcggagaacgagaagaagcagaagcttggcttgcagagcaaagtccgccagctcgaacaggaactgtccggttagttgggcgttggctggtggattggctgggtccccattacattcatcggtcactttggaattccattgatcacgcactattttcctattatgcaattttttcattagtttttctatggctcactttttatgtcattttagtgccccttttttaatttaaattcttttttctgactctttctttgcttgccttttcacctttttcttcgtttagttttttctttcttagttatttccacaacagctctaaatttctagtttcttactttgtttcaatttttctttctattttaccctattttttctttctaatctcttttcctttctttatctctcattcccgctccattttactctgtcctgtctttctttctattctctcttcctcctctctttctcatgtatctctcatatctccaactctctgtctctctctctctcatccattttttactatattctatcccttcctcctttgattaggcttgctggaacagcaggacgagcaggaagcagaacatcgccaattgctcaacgccaacgcgctgctcaagcagcaattgaaggaggcgcagaagaagacggacgatgacattgttgcccaattggaggagcagcggaagcgttcgcagaaagagttggccgaagcgatgcaggcattggccgactcggagcaggcacagaagcgggcggagcagtccaagaagaaagtccaacaggaggtgagagcagcagacgacgtgcaatttgaaggaccaatcgggggggggggggataattcaaggaagtggcaaaagaatttcaaaaaaggaatggatagcgggcacgcgtgcctctcccccaccccaccaataaaattaaaatttccagtaaaatgtgaatttgtttaaatttaacccttaaattttctcggcggcgcctaatgactctgcgggacccctattttcatgttttttaaatagttttttggctgtaatttgtacttgaaa

SEQ ID NO: 79854 - DNA, 162 bp, Heterodera glycines
  Genomic contig location: Contig_ID=SeqID_15570; Location=112..273; Strand=-
  SCN-specific regions: Sequence locations=1-162
atgtccgttgcaagccgacggtgccgactgtcgccgatgatgctctcccagccaactgtctgcgtgatcttcttcggatgctgcatgatgaactggagcacgcgcttgcgcaagaactgcgctccgtacctggtcgggcagacaaatgatgggggatatacg

SEQ ID NO: 79855 - DNA, 1359 bp, Heterodera glycines
  Genomic contig location: Contig_ID=SeqID_15571; Location=767..2125; Strand=+
  SCN-specific regions: Sequence locations=1-1326,1351-1359
atggctggcaaattgcggcagcattccctgtccagtgttcggaagctgcaagaagttagtaatggaaatttttcaacaattcttttcaattttggaaaatttgcgttcctaccgtaatcctaccgtaaaattccaatgaaactaattaaattgacaattattggctcaaaaatagaaattttgtccaattgttgttttacagctgctccatgactgcaacgtgcagttggctacagtccgtagccaaacgcagcaaattggcaccgcggcggacagtgcgcaactgcggcgagagttggacaacaatgccaaggtgggcttgccaattgccaccgagactctcgaagaaaacagcaagggcacaatttggcatttctatcgaagtgccaatgcttcccgattcggatttgtcatcatgaattgcataaaacggcaattcgttctttgctctcaacaattactgatcagttatcattttcggttccgatcgtcacccaattttacgcctgatcggcagacaaaaaaatgcatttgcatttgttggcattaataagctaatgaattttgtgcatctcagagttttgggttttggcatttccgaaaacttcggaatttctggcattttattgccacaaatccggtcactaattgtcagtcttccgccttctgctaattggtccttaaatttcccatttaagggctgttttcgtgcttatgaaaccacaaagaacagtgtgttgccgcagcttaagcgcgaaggtgcgttcactgatcaaatttttgattctatattttttagtagcactttgttttttatttctcattgatgacgttttttcatgatatttttgatcactttttttaaattgggtcctttttgaaattgaaatccctcgttattccctgattttatctgatctgatttgggttgatcaacgcattttaaatataatcaattcctccagagagactcttctaattcaatcgctgctgctttgatcacaattgttgaccaaaaatcctaagggggcttccttatcactcccactcatcagtttaataatttggactttcattctgatcagctcggttcgagtcggggttctgatcactttatcaatcactttgatcagctcattgatcagtgatcactcgtcctccttttcattgtcacagggaatgcgttcagtcaatgtgtgatcggcttcatcggatgcgtgagcgcctttttgctggagatcaaacggtgcggcgcgttggaaaaaacttttcgcatggacgaggcgccaacaatgtaaaaaaagcaatgcaaatttaaaagcgccgaattttttaatttaaattttaattgggtaaaaa

SEQ ID NO: 79856 - DNA, 1006 bp, Heterodera glycines
  Genomic contig location: Contig_ID=SeqID_15572; Location=384..1389; Strand=-
  SCN-specific regions: Sequence locations=1-74,96-167,210-446,468 -485,508-532,555-646,668-673,695-735,770-1006
atgtcggaatttgcgggagagtctgacgggagaagcagattcagtgatgccgtgtatataactggatctcaatggaaaattgaagcaaaaataagaaaaattacggaaggcactgatgagaagaaatatttgggattttacttatggtgcgatgcaaaagaaggtccaattttaattactattttaaaaatataatcattattaaaataggtggaccatggaactgcgttttttcggcaacctttcgaattgtgtcaggaaagaccgaagcggagaattctattgggaaactttgtgactatgttattaatagaccatgtgtcggctgtggattcaaaaatttcattacttttgcggtgagtgacaattgaaaattttaattgacataattatgggcaattaaggaattgatggatccgaacaatggattctacaacagaaaagaggacaaattgacattgaccattgatgttacagtggaatatgaaaaaagggagaaattaattttggatcaaagcaaatccaatggaacaattgaaatggaaattgaaaaagtgtcggaatttgcacgagaaatctttttgagtgaacgtaaaagcgaaactatgcacatcaaaggattgcaatggaaaatattggcagaaatagaaaagaaaaatgaaagcactggcaatgagaaatgcttgggcttttcccttttgtgtcatgcaaaagaagaaggtgcaaataaaatgctaattaattaatagtattaattaatttatttttagacacaaattggaattgcaaatgtacggcaacatttagaattgtgtcgcaaaagagcggcgtgactgatatcaagagggaattcagcgaagaaagaacttttaacagcgaatcgaaggccagcggattccctgatttcatttcatttgctgtgtgtcacaattaaactttccctgaattgacccaattatggacaattaaggaactgatggacccgagcaaaggcttttacaataaa

SEQ ID NO: 79857 - DNA, 466 bp, Heterodera glycines
  Genomic contig location: Contig_ID=SeqID_15573; Location=15..480; Strand=-
  SCN-specific regions: Sequence locations=1-76,109-286,315-466
atgttgagcttcatttacacggatgatttgagcgaattgaacggagacaatgcaatggcagtgctttacgccggtgattttatttttaaatttaatttattaattattcaattccctaattagccaaaaagttcaatatccctggccttgtccgtccatctgtgcaaattccaatctctgaattgcgcaatattttcttggcatataaccaggctctcattttcgaattggaggtgagaaagacaaatttatttttaattcttttattttgattatccctttttggaataattttataatttgataatttttaaggattttgcctgcaaatgtttgcgttacatttgtcaaaatgcggctcacttgttcggatcagatcaatttttgcagatcaccagaatgtgttttgcaatcttctctagagtgatcgtttgttactcaacgatgaatttgaatttggaaaact

SEQ ID NO: 79858 - DNA, 803 bp, Heterodera glycines
  Genomic contig location: Contig_ID=SeqID_15573; Location=994..1796; Strand=-
  SCN-specific regions: Sequence locations=1-287,309-633,677-688,729-803
atgactgaactggaacggatgcagagaatgaatttggaaaatgaaaacggtataaattttggcattatataaaaatactaaatgaattcattgatcatgatgatattcattttctaccgattcccaatccctaacccaaattcgaataaaaattcaaaaatcaattttttgatttttgttagcgattcggaattggtgtaaatagatattagatttcgatcacaaaatcaagttttcatgactttttcaagtataccgtgcttttagctgagttgatttgaaccattaataaatattttattccaaaatttttgttttcgaattgtctaatcttcatactttcagataatcgacaaaggtctttttctcctgacccaacaattactgaatttacagctgatcagggtaattactcaattaattggattaataattatagttaaaaggttgctcagaacttaaaatttatgttttaaattaagcttcgtatcaaaatgaatgtctgacgccaaccgatgaattgcgacgaatgcgaatcacagaaatggaacggatgcaaaaaatttcgtcgccgggcagatacggtagaaaattctttgctgtacattttgagattattattagaaccttcacaatttattattattagcatatttttaaatttatttaaatttttcgccgtagacaatggccacaaaatgggcatggctaagccggagattttgacggatcgaatgaaattgttgctgagcacggccaaaggtgccgatgcacattttttggttgggcaaagtgacaataaa

SEQ ID NO: 79859 - DNA, 847 bp, Heterodera glycines
  Genomic contig location: Contig_ID=SeqID_15574; Location=1734..2580; Strand=+
  SCN-specific regions: Sequence locations=1-755,777-817,839-847
atgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcgacgattcgtcaacccagccaaaatgtgacgattcgtcaactcaatcaatattacttaaaaaatggaacttaaagcaattgacaagaatttcgagggatgcttaatttttagtctttatgtaatgctttaccaggcgaattgtaggcgcatttgacattgcatcaatttcaattttgtttttcagttttagcaaatcaatcgaatttcaacaaggaaaaacggagaggggatcattatgcatttggcatcaaggtcgggtggttaaatttttcaatggcttcgattttttgcagggttccgtttcactcgcatcagagggcggtggtaccgctgttccaaccgggactgtgaggtaactgcagcattgagtaaagaaggcggaactaatggtgtgctcggaagaaaagagcacaaccatctgccggacccagcgtgtttccacgcggaggtaaaacgcaacggaattaagacgacaacgatggaaaacccgcgccaaaagccatcaaaagtattggcagaagtccgtgcaaacgccaagtgttagagaaggaagtaattattgattaggtgtatgaccccacgccacttcgccatcttccccctcccattcccctcattcagtttgttattgtgcccaccaattttgacctcccaatttattctctgcatttatttattattttattttcttcggcaa

SEQ ID NO: 79860 - DNA, 360 bp, Heterodera glycines
  Genomic contig location: Contig_ID=SeqID_15574; Location=314..673; Strand=-
  SCN-specific regions: Sequence locations=1-13,35-183,224-360
tgagaaatccatgcattaaattgacaaattcatagtcataaaatcataataatcttcaacatttgaatttatggtcattgtttgttattccattatcatttggttgccaattgtccgtactgattggccaattgtccgtattggttggtcatttgtccgtccgattccgattctttccccttctgttgtctattgttgttgttgttgttgttgttcgtcgttgcctcttcgcctccatctttttcatcaacggctccaagtgtttgtactggtcgctgtcctcgtcaatttgcatgtccgggtccatgaacagactttcgaaccgtttgtccaccattatgttgcgcaacagtgcgtgct

SEQ ID NO: 79861 - DNA, 569 bp, Heterodera glycines
  Genomic contig location: Contig_ID=SeqID_15574; Location=2970..3538; Strand=+
  SCN-specific regions: Sequence locations=1-406,428-569
atggacgcgcaacagcttcaacaattgctaaatgctctccagcaaatggtcacaaatgccgcaccgcaaaacgccacaccggcaaatttgagcaatgccaatttggcaagctccatcgatgctcgcctttcaacgttccattacaatccggaggtcggcacaacttttgaatgctggttcaaacggtacggaaaattgatcgaggacgacggaagcacactgccggaggcctcaaaagtgcgacttctcctcggcaaactcggagaggaggagtacagcaaatatcgggacacgatcagtccaacccagccggaccaagtgaattggaatgacaccatttcgcacctcaaacagctttttgccgagacacgttcgctgtttgtccgccgctacgaatgcttcaaaattcgacagcaaccaggacaggacgtgtcgtcacttattgcgcagatcaacgcgtcatgtgaaaacgcagatttgagcctgacaaaggaacaactcaagtgtattattttggtcatcgcgctcagcgatgaacaccatgatttgcgacaaaaggcattgaaaat

SEQ ID NO: 79862 - DNA, 540 bp, Heterodera glycines
  Genomic contig location: Contig_ID=SeqID_2466; Location=682..1221; Strand=-
  SCN-specific regions: Sequence locations=1-213,235-540
atgggaaaattgaaaaatgagagaagtcttaacttcatggtcaagaaaagtgagttgagaagctaattgagatgtggtgacaagactgtcagcacttctctttgaacgaggttgatccgtgggaagaaattgaacggcaaaattttgatatgagagagagagagtttgattacagtcctcgatcaaagttttggtttggggaaaggaaagagcaagatcattttcttctgcaacccaaatgttggacagaaaagttcctaaaaattttccgaggttaatgaattgacagagtttcttgggagagggaatccacatgaggatggaattatcgtcgaggcggcaattccctgctgtatatttacaatttgggtgtcctagagatgttctgatatgatcttcggaatgatgcacaaaaatctcagtttgaaaagcgaaacaatttgtggaattgtgtgctttccaggaccagccaaggaagggataccgtttttcatagctgattggattattggagaaaaggagctccccactttggattag

SEQ ID NO: 79863 - DNA, 5430 bp, Heterodera glycines
  Genomic contig location: Contig_ID=SeqID_2466; Location=382..5811; Strand=+
  SCN-specific regions: Sequence locations=1-606,628-840,862-1279,1301 -1644,1677-1774,1807-2142,2176-2311,2334-2500,2522-2685,2708 -2782,2805-3575,3597-3655,3677-3706,3746-4242,4264-4456,4478 -4582,4604-4892,4918-5409
atggtttgtcagacacacgttgagggcacaatttggtctcttcccatttggctaccatgtccaaaattaaagcatactccttctgacaccccgatcaaacaacctattcgccttttccgaccgaacccattcgaacaaaaatccaaggcatgggtgtgcaggaaggtaaagaaatccctgattgagtacaccaatccatggaatgatgtaatcattaagcaactcccgtccgaaaatctcccagtattattagatgaatgtaagcaaatggttcaggaaaagtcatgttccgaagggattctaatccaaagtggggagctccttttctccaataatccaatcagctatgaaaaacggtatcccttccttggctggtcctggaaagcacacaattccacaaattgtttcgcttttcaaactgagatttttgtgcatcattccgaagatcatatcagaacatctctaggacacccaaattgtaaatatacagcagggaattgccgcctcgacgataattccatcctcatgtggattccctctcccaagaaactctgtcaattcattaacctcggaaaatttttaggaacttttctgtccaacatttgggttgcagaagaaaatgatcttgctctttcctttccccaaaccaaaactttgatcgaggactgtaatcaaactctctctctctcatatcaaaattttgccgttcaatttcttcccacggatcaacctcgttcaaagagaagtgctgacagtcttgtcaccacatctcaattagcttctcaactcacttttcttgaccatgaagttaagacttctctcatttttcaattttcccattccctcacccagctatgtaactttattgatgaaaataaacactggacctcttctgccctcctctcaaatccaactgctctagcacgcagtattttctcaaatccctacctttttgccaaacaattaacaattgactcaatcaaaatatggccctgcgtaccaataaacagctctagctaccaatttaaggcaactgagcttcaaacttgttttgatcttctcccaatccaattttccactaattctggcccaaaatcagcatttttaaaccccatttcaatgattgtcactccagaggcccgaactgctccctgctctgagtaccgcaacattcccattcttatcaacggctccctagtccaagtggaccaaattactgggtccgtcactcctctcaaagttaacaatcttccactagaatctaattcattgtttgaaattcccaaaatcaaaactcatgcatttcatcacttagcacttaccaatttgtctgacattatttcccattctttcgcagcaaatattttccaggttagtaaacttacttacctgattgaatttgatgactccaaagtgaagggagtcctctcctctgactggaaagaagttagagatgaaatggtcaaacaaataactggagattggtcccaattaagggattggtttattctaattatttgtgccctctctgcctgtgatattcttattcgtatccttgcacttgttttggaaaagtattttaacaatctttccttattacaaaccttctttggtcttacaacaaataacacaaatcaatcacgccctccgcctccccctcctcctccttccccttccaatacgtgctctgtgcaatcacccaatttttcgaatcatcatgttgttcttgaattaggtgaaacatctgaaggaaacccaacccaatggcctccctcaattacccgcttttctctccttcccaaatttgagtcaaataattcccctaggcttctcaatgctatgtttccattaaattccaaatcctttgtcacaacaattcccgcccacgcagatacaattcctctcattgcattaattgactctgctgcctcttcttccattgctccgattaaacttaaggacaaattcatctgtcaaaatcttaactcatcggaagtttctatcactactgccgttgggatcccaatacctgtcacgggctcagtcccgttctccttacacatggcaaatatgctgtgcagtgcacatgttcatttcgctcccgattatttggatatttgggatatttgtgatatcattatagggactgaaactcttgaaagattcccaccaattctcttcgattttcataataaattcctaacctttggctatggtcctcctactcttttccaatcaaaatcacaaaacatttctgactgtcaatcttccccttcaaagaaccttctcatctatcaaaacaaagttcattttcatccacatattccttctcaaatcaattcctcaatttctccgtgcatactttcacaaacttgtgaaaactctcaacatttcaacgttccacctccatccagtaatttttgggctgatattaaccctccctcttcattatgccattactgcaaaaaggacaaacatcatataacggaatgtccctttgttcccaaactctcaaaaccaaccatattcagaaattcttataaaaagtccattatgcctacccttcttcttcttatagcgctattcccctctgtacatgcttcattatccaacgaaaatgttaacaattttgaacagtattctcccatatctttcattagcatttcatttatattcactctcatggtcatttcaattataattattctgttcatctatccattacaaatattttttcctcctggaacatcatttcgtagctttaaaaaacaagtaactcaaagccctcctttcccagtcatccaacttaaagtcaactctgttttaattaactgcaaaattgacctaaaatctgacatctcatttactcatgtccgaatggcatgttatcaaaagtccaaattttactccttccccaaacccctatgtgttggtgtgtctttccttccattgcaaactatcggcgaaatttcaactaacattgaaatagcgtctcaaactcactccttaaaattactcatcacagaagaagactcatgggtctcggaaaataactttgatgttgtattgggttctgactttctttccaaattcccagcaatcttatttgatcctcttctttttaacatacaaatcggtgaccataattatcccatgatctcgtccaaccgagattatattttcacacaatataacccacataaaccgaaacttgacgcaataatctctgcctccctcaattccgttgagctccgctctcttgtagacacgggagcaacgctcacagctgcccctatctcccttgctgagacaattgggtgctctcctagaaaaaccaatcttcgagctataagcgcctcgggtcaccaaatccccataattgcacaagccgaggccttcttgtctattggtaccataaaagaaaaagttttaataaattttgttgatgattctcgcttcatcagacccgactatgccctcattattggttgtgattctcttgcctgtcttcctcctgtaactttcaactttcagaatctcactctttcccttgccaacatttcagtccctatgggaaaattttccaaactccaatcgaatattccaatttttgccttacgttctataacattagcccctggctcgcaaacaattgtccccataaaaattacaactctcccaaaaatacgttttgcagtaattgactcattaaataacagactcaccagagatgacttgggctggaacccaactcttatcgaacccattaatggcatttctgccatcccaatttccaatccctcacaatccccaaaaactatttttgctaatatgacaatagccacagctaatgaggtgagtgaagaccctgacttacatttcttttatgaggacccagaccatgctctcttcagtatttccccccaaagtgatgaaggtataatccctgacccctcattcaaaattgacttttctaaatcttccgttagtggacctgatcttcaaaatctcaaaaatttatgtgaagagttctctgacattttcagcaaatctcaatatgatctggggtccagcacagctggagcccatgaaattgtcacctcaacgcaggaacctattacctgtaagccacatagaacccctttcaaatatcgggatgagctcaaaaagcacatagaacaactccttaagtctggtgtcatggtccaatctgacactccgtgggtgtctaacatcgttcttgtccagaagaaagatggtggactctgtccatgcattgatttccggaagctcaatgaaataactatccctgaccattatctccttccccgtctcgacacaattatggagaaaattggccactgccatttttactcttctcttgacctttcttccggttatttccaaatccccctcacaaaagaagcctcacgaaaatgtggactaatcatagaagaaggtgttttccaaatgacacatctcccttttggtcttagaaatgccacttctgcttttgccagaaccatggcccatgtcctctccggacttgatgggtttgtcgttgcctacgtggatgacattcttgtcttcaccaaacccccctcattttctgaccatctctccgcccttcaaaccatttttgaaagatttcaacgattcaatctaaaactctctcccaaaaaatgtacttttgctgcctcttccatgaactttcttggtcatactgtctcatcaaaaggttactccccatcactctcacgcatcgaagtgatcaaaaatattcccactccccaaaatctaaaacaagtaaaacgaattgttggcatggccagcttttatcgtcgtcacattcccaatttttcaactattgttgagcccttaacttctctcaccaaaaaagaaaagaaatttatttgggacaaggcacaagaagatgctttgaccagaattaaggaacttctctctcaaaatcccattctcacttttccggattattctcaaccttttcacattttcactgacgcatcagtcattggtcaaggcgctgctctcatgcaaaagaaaaatgatctattttctgctgtagcatatgcctctcgcactctatcagcccccgaacgtcggtggccccctgtccaaatcgaactcggagctattgtctatgccctcagaactttcaaaccatatatttatatgtctgaaattgagctccacactgaccaccgtcctttggcatacctccaagcaaaggcacaacaacatgcccacctggcccgttggctaatagaactccaaaattttaacattaaaattgttcatatttccggtaagaaaaacgcacttgctgatgctctttctagactttccgaatctgatcctcctcagattccaagtgactctcaagagttacaagacatcattgaatttcct

SEQ ID NO: 79864 - DNA, 1208 bp, Heterodera glycines
  misc_feature (24)..(24): n is a, c, g, or t
  misc_feature (27)..(27): n is a, c, g, or t
  misc_feature (33)..(33): n is a, c, g, or t
  Genomic contig location: Contig_ID=SeqID_15575; Location=24..1231; Strand=+
  SCN-specific regions: Sequence locations=1-103,125-161,185-474,507 -657,699-990,1057-1106,1146-1208
atgtttttggggaaaaaaggaaanaanctcttngatgaaataaaattaggtaaatgaggaagaattaaattttgaaattaaagagcagaaaaattggtcccataaaattaaacaaaagagaaaacaaattttaaaaggacaaacggacactgaaagaattcgggaagaatttgagcaacaaatggaaaaaatgtgtgaaattgctgaagaaaatgccaaagaagaaaaggcaaaattggaaaaagcaattgaaaatgcgacaaatagtgaagaaaaggaagttctgggacaaagaatacaatgacaaatttggcactttcaattcatcgccatttattgacgaaatttgacaaatttggcactttcatttcgtcgctctttcataaatcgttccttctttcccatcagatccatggcatttctgatgatgtgtactattttttcttgtaactttcattcatagtattatttttagtgtttgatttactgttttatttctcttatacttttgtctttatacggtgtaaatttaactatttccactgtagtggaaatataaaagtgtcaattaattgtttatttcttaaaatcatttaattccattgtttttctgattatttctttctttttcttttcatttaaattgtatttgagaaagaaccatattttccagttttttgaaaaatattagttttagcatttttgaaaatttcagttcaatcctgagttggaggtgggcaatctcaaaaatagaaaaggtcctgatttttacgatttgtcctgactttttatcattttgatattaaaatcagagagaacctcacttggaatcaaatgccggcttattttcttaatatttaaaccctcttccgggagcttggcttgtcatcgttaatttgatgcgatagttgaccaaaggtaggggggggggtcaaagtgacagatgacaaattaaaaccaaaacatttagggttgttgatgatcaatcactattataaataattgcataataattacataataatatatatatataattttattaagtaaaaaatagatttggttaatcctacttatggtcaatcaccattttcaaaaattgcatcataattaaataatatataaattctattaagtaaaaaatagattcagataatcctactaatgatcaatcccaatttttaaatattgcatcattatttaatata

SEQ ID NO: 79865 - DNA, 803 bp, Heterodera glycines
  Genomic contig location: Contig_ID=SeqID_15575; Location=2011..2813; Strand=+
  SCN-specific regions: Sequence locations=1-92,128-720,742-803
atgttgattaattccgtttttatgattcctttttttattagtatttttcaacaatttttaattacattttcaattgcaaattcatcggtgagttaattataattttactaatttatttcattaattaggttgaggacaatatgctatttgcatttttgaaaggacagaaagaaattcaattcagtgagtattcaagacaaaaatatgaggcacaccttggcattatgcattttatgagaatgaattggcaatgtgacaaaattgcggtgaagtttgaagaatatgaacggacaaaatgcccaaaatatcgcaaatatttggacattttgcacgaatatttgtacagagaatacatcggaatccccacagtgaagccaaaatttgtgtttaaaaaacgaattgaaattaatggaccactgatttatgcggtgaattgtctcgtcgaaatttggctattttattttaaatactattggttaaacacaaatttcagaattttcatttttaatcgttttgaactaaaattgttgaatgagaagagattaaattataaacaaaaattgtcaattaatgaaatgattttggaattggcaattgacacagcgaatgaatggcaaacaaatgaaagtttagacggaataatccaacaaaattgtggagaaaaatttgaagaatatttaaaggaaatgttcaaaaaatcggaagaaaaggcaaaaaaagataaacaatggaaagccaatgaaataaataatggcaaacatttaataattaagcattcgaaatttgatgatcaagggacatgg

SEQ ID NO: 79866 - DNA, 700 bp, Heterodera glycines
  Genomic contig location: Contig_ID=SeqID_15577; Location=1732..2431; Strand=+
  SCN-specific regions: Sequence locations=1-56,94-111,133-223,246 -583,607-700
  Gene Ontology: Mol. function=single-stranded RNA binding; Cellular component=transcription factor TFIID complex
gtataaaagcggcactccgaagcctgacaaatgcagaaacattcacctctcaaaccaaatattttattttttttatatttttaaaattaatttccgcggattttttaacataaaaaccctttcactttcaaataaaagctcgtgaaaaatgaattttgctctgatcactttgccctttgtactgatcggagttgcttctgtgtgtcttggctcgggtaataattttttaattctgtcccaatttccctggggtttttttcaactatagtaattaaagggctctacggtgacgactacggtggctacggtcaccatgacccgcaccacgacggacaccatgacggaggctatggttatgggcacgaagcaccccattacggtggcgactatggctacggtctgcacgacagacactacggcggttatggctacggttacggtggcccacaccatgacgatgggtacggtggctaccgctacggatacggtcacccaggatcgcacggatacggtcacggatttgcggggttcgcactgtaagagacggaaacggaaagcagcgaaaggagagggaagaagctgtggggagagaaagaggagaaaaagcagtgatcgtacaggatcagcagcatgttaccgtattagcaaatgtccaccatcattacagtaatcagcattttcactttcatttcccaacgaa

SEQ ID NO: 79867 - DNA, 3735 bp, Heterodera glycines
  Genomic contig location: Contig_ID=SeqID_15577; Location=1..3735; Strand=-
  SCN-specific regions: Sequence locations=1-29,51-471,493-1398,1422 -1759,1782-1872,1894-1911,1949-2625,2647-2911,2937-3270,3292-3735
  Gene Ontology: Mol. function=structural constituent of muscle; Cellular component=cytoskeleton; Biological process=striated muscle contraction
gaagaagaagcgaaaccgatggaggaggaatagccgaaggaagaagaagccaaggtggaggaagaagcggaaaagccaaaagcaattgaagtggaaaagccgaccatcagacaaggcatgcaggatcaaagcctgccgaaggtatagggaggacataaataactttaaaaagatttaatttcggcacagggctctccgcttgtgctggacattcaagtgggcggaactccgaccgacgtgcaatggttccgcgacggacgtccgcttgacgaggcgtcgggagttattgcggaggatttgggcgatggtcacttccgtttgaccgtgccggaattggccaatgacggcgattttggacgctacgctgtcaaagtgagcaacgaagcgggcgacgcggaatcggtggccaacatcacggagaaaggtggaccaaaagcacgtttatatagtaggattgccaggtttatggtacaatgaaaaaagattcttctgctcatcccttccatcatttgatcagtttgtcagtggtattttgatcagtttctcaatggcatttgatcagtttctcaatgatattctgattaatttatcaatggctttgatcagtttctcaatggcatttgattagtttctcaatgatattctgtcaatggcatttgatcagctattctgatcactttctcaatggcatttgatcagtttctcaatgatattctgtcaatggcatttgatcagctattctgatcactttctcaatggcatttgattagtttctcaatgatattctgtcaatggcatttgatcagctattctgatcactttctcaatgccatttaatcagtttctcaatgatattctgattaatttatcaatggctttgatcagtttctcaatggcatttgatcagtttctcaatgatattctgtcaatggcatttgatcagctattctgatcactttctcaatggcatttgatcagtttctcaatgatattctgtcaatggcatttgatcagctattctgatcactttctcaatgccatttaatcagttctcaatgatgttctgatcggtttcgcaatgatattctgatcagttttgtttggcaggtgatttttgtgactaatcaatctttgaatgaattatttgcccagttgttttttgttgattgaccctttaatcatttgcgtgccgtccctttccattttcattaattggctttgcttcagtattctttctactaattaatttgcttggtgtgttttaatattgtacctctgttttgttatgcctatcagccgtttatttcgttgggaaatgaaagtgaaaatgctgattactgtaatgatggtggacatttgctaatacggtaacatgctgctgatcctgtacgatcactgctttttctcctctttctctccccacagcttcttccctctcctttcgctgctttccgtttccgtctcttacagtgcgaaccccgcaaatccgtgaccgtatccgtgcgatcctgggtgaccgtatccgtagcggtagccaccgtacccatcgtcatggtgtgggccaccgtaaccgtagccataaccgccgtagtgtctgtcgtgcagaccgtagccatagtcgccaccgtaatggggtgcttcgtgcccataaccatagcctccgtcatggtgtccgtcgtggtgcgggtcatggtgaccgtagccaccgtagtcgtcaccgtagagccctttaattactatagttgaaaaaaaccccagggaaattgggacagaattaaaaaattattacccgagccaagacacacagaagcaactccgatcagtacaaagggcaaagtgatcagagcaaaattcatttttcacgagcttttatttgaaagtgaaagggtttttatgttaaaaaatccgcggaaattaattttaaaaatataaaaaaaataaaatatttggtttgagaggtgaatgtttctgcatttgtcaggcttcggagtgccgcttttatactgtgttctgtcctccctttctgctaaactcgttccgccgcctttggcaaaatgcgccgttttttccattccccgcaattttcgctaaaggggggggggggagaagcggtggatatcgaacatgataattgtgtgtattttgctgtgattagcctattgcacaacaatgtaattgctttgcccaatattcgctccgaaaagtgccaataattgcgcaattaatgcgataattgtcaaagccgccaaaccaaagcgtaccccgacagaatgaatgactgactgacattatgccaatcattccccttcaattgttgatcaaaaatgttcttcttagcaattgagtcatcgaatcgaatttcaaaataatgcaatttccgaataaattttagcgccggaagagcaaaagccggaaattgtgcgtggtttggtgccggtcagcgttcggccaggagagccgaccaaatttgaagtggaggtgaagggaccggtgcgatcggtgaaatggtacaaaaacggacgggagatggaacagccggagacggagcaggacgggaactgttaccgactgatcatccactcggctggtcctgacgatgaagcggattataaggtggccggaggcaagggagggaggaaagacggggatggcacacaattgggacaatggcactaagcagggatggcatggattagaggataacgaaaactggcattattgaatatttaattaccctttactatattaattcgcacgaaatggcacaggtggtgctgtccaatttgggcggcgaagcacagtccgaagcaccgctgaagctgatcaaatcgttacgctttgtacgtccgcttgaggatgtaactgtgccaaagggtcatcgggcagtgctaagtgaggcggacaaataattaaggcaaaacaattaaattaaaattagtggcggagacggaccgctcaccagcgctcgctgtcaaatggttcaaggagggcaaggagctggtgccgggcgaggcggaaaccaaagcacaaccaaagcgcgtgtcggatacaaagtttcggcttgaagtgccggacacggacgcggacgacaccgcccaatactccgtagggagcagcaattaaagcaataattaattgtcctgctgaccacagatcaaagtgtttgaccgcgaggacgagcccggcgtggagtgcagctgcgcactgaccgtgctgttgccagaggaaatgccggcggaaccgccgcggtttgagcgaccgttgcgcgaacagaccattccggaagaggacgagttggtgttggaagtggaaacgcagggaaagccgcacaccgtccgatggtgggtacagcagccaatccactgaccattaattaacatggcccacccccgccgctgcaggtacaagaacggccagcagttgtccccgtcggatcggtcgcgcatggaaaagctcggcccggaccgcttccggctggtggtgccaagcgcactgcaggacgacacgggcgactacgcgtgcgaaattgccaacgacgcgggactggcgcgctgcgaggcgcgccaaacagtggagccgttctcggagtttatccgaccgctgcaagacctttccgtggtggagggcgaacgggccgaattctggtgcgaaacaaacagaagatcggtgcgtttagtgcataatgcagcatacagggaggacataatcaaaatgagactaattactgatgaaaga

SEQ ID NO: 79868 - DNA, 1339 bp, Heterodera glycines
  Genomic contig location: Contig_ID=SeqID_15578; Location=58..1396; Strand=-
  SCN-specific regions: Sequence locations=1-75,146-240,263-488,520 -688,711-888,919-953,1030-1161,1210-1242,1266-1339
atggctccggcgactgggccttcgagcgtggcagctatcacttggaatggtaattaaaaatttgagcattttctgataaaaagataattattttttaattaaaaatcccaaattatgaaaatttaaatattaatttttttttaaacttttagtgctcgtggcaccgagtcgggagcatatttgcaggtgtggaaaaaaatcaacggcgcatggctgatccacaatgattgctttaatgtgatcaaatcagccagagaataataagaagctgatttgtgaggcgaaagaatggagcaaaaacaaaggggaagaaaaattgaaaatgaaatttggaaaaataaaatagtaatttagaaattgtccccttgtcgattaattgtgttgtattgaacgagacaattgcataaattggcgaaacatcaataaagtgttgctttttaaagaagaaatgcatggcggataccccaaggaaaaatgtaaaattgaggaaaaaaatataattatattttttctatttttgaggctcggatttttggcctttttcatgagctgttgcaacttttcaaatttttgccccatttttgggtttaaaaaaattgcgcttgcgccggaaattttaacattgaaaaattgacagccggaaattcttcgtcggatgttgtttttttttttaataatttcctcatacattctgcaactttatcataagtaatatcatggtttggcaaaaatatttaatattaatgtgaatttcatggccaattaattgcataattgattttttcatatgatttcgctgtcgtaggttaagcatgatgaaaatgaaaattaaaacgtgtgcatataaacgcgaaaagcaaaattgggcattaaaacgctgaaaaacgctttaataaaaatgaattatataattttatagtcattttacaattttatattggcatttaactctctaaattatataaaatgtttgatattaaatataaaaatgaatgaaaattattttacagatttgatttaaaaattattcccaaattttccatgttctccaaagcttatttcattctcgtcattttcggaagcattattggcggaacatttggaaccgacaatgaagacgaacaatgggaagggtatgagaaacaagtttcaactcctaaatatttttatcttatttttattttaatatatgttattatttttagttttgagttcatgaacaggggcgaacggatttctaagttttttaaaaatttattttttatgcgtatagcaagcatcttatgcacgaagcataaaatagatagatagattatgactaccaaattttcgaattaaa

SEQ ID NO: 79869 - DNA, 958 bp, Heterodera glycines
  Genomic contig location: Contig_ID=SeqID_15579; Location=120..1077; Strand=-
  SCN-specific regions: Sequence locations=1-318,357-407,429-453,475 -697,720-958
atgccaccaaaatccaagcccaaccggacacataatattcggcaaacagcgaaaataataaggcttttggggtgctgccaatttgggaaccaatcttggcataaacattctcttccatcacaccatgttttcggtagaaatgttaccccaatttgtccgtgccgttttatgtttcctagtgccaaaattggccctttatattgggccgggccgttcctttccgggcttattcattgtaagacggaaaacgctcatttttcatgagattttggaacctcttaagcgtttcattttcgtaagaaaattgcttttgaagacaaatttttttaaaattatttctatatacaataatttttgcgataaaatattttttaacactaattaagattcgtaaaagatttttatttaaatatttttccacataaaaactcctaaaatttgttatttcttaaatgacatatttaagtgagctcatgtctgaagggtacgcagatttaatatcattatatttcgccattattatgtgaaaatggcacaattttcatctcatttcagcagctcttcccttctcttttaagtgccctcctcccccactttttttttgcattttactcaaaccgtcgaatatttcagcgccagctgaagtgaaatttgaactccaaatccgcaaaacgatgtgtaagtttttccgtggaatatttccaatttccttcttttttatgccatttgcgcgccatgccattttctcatcaaaatgtgttgagaagagaggggaggaaaagtggtgcttagccccttcttcgcggggttgtaaaagctgtcggtacggcaccgatgattggatggcactgacatatttgggaatgcctttttgaaaaaaccttttatttggctcgcctacgcaacaaacattttttttaattccagaaaaatatatgacgaatttaccggaaataaa

SEQ ID NO: 79870 - DNA, 1348 bp, Heterodera glycines
  Genomic contig location: Contig_ID=SeqID_15580; Location=280..1627; Strand=+
  SCN-specific regions: Sequence locations=1-175,197-372,394-423,471 -520,550-821,844-1348
atgccaaaagaggattttacaaaaagcgttggtaataaataatattttgatgattagagagtttgctatcttgaaaatgcttgaacctggcttggattccttgttggacctggacctgtaatggttccaagtctggattaagggcttttcataattataccgtatttcatcggataaaacccccttcaaaatggggttatactcgagggtggggctttaatgttcaacccttttttacaaaatttcaatgtttttatgcaaatttttccaatagcaaatttttattagtttttgaaataggtcaaaattattgctacaatttaaatcttaacctgaaatttttaaattaaaaagatttttcattttttggaaccttggaaatttaggcgaatgcttgaaaattcataattcacttcgaaatggatcaattaaagtgcaaaaaagcactaaaaatagagaaaaatctggagaatttatactttttttaaggattttctagcttaaaatgaagaagttagctgataataaattttggaaaaattcgtttttcggaaaataattaaatcactgttatgaaaaggtatttttgaaagaaatatacgaaaaaaaatctgcaattttttccactataagattgtctttatttcttatcgaatcggaatcaaatttttattttgcactaattataattctaataacctaattccatagacttaaaatttaaaagaccgtatgtcgtttttttaatattacaatgcaccaggtcaaggccaaacttaattgatgactcattttatgaatgaattaattgtctaattaattatccatttcaatcaaatttcagttccaactggtgtgttaacaattgaagaagtgaacagcgtgtatcagcattattcccatcaaaatttaagtgatgccactgggcttttcccattgaaatttccaacgcaccgacggaacaaaaacgaaggcacaattgagatggaaattgaaaaagtgtccgaatttgcgctggagccggtgggaagtggccgatttagcgatgccatggacattgggggatttccatggaaaataagggcacaaatcaaaacgaaaaacgaaagcaatgagaaatggttgggcttttacctttgctacgatggccctaaaaaaggtaaaaacaaaagtcattttcgtaaatctgtcagggaaaaacaaaaaaaatattatttcttacttgttttaagcggaggaatacatttactaaattcttttttccagaggtttttaaatattatttaaatcattcgaactaaataaacgattatgtagacaattttctacaaaaatagaaattcaaaaa

SEQ ID NO: 79871 - DNA, 1529 bp, Heterodera glycines
  Genomic contig location: Contig_ID=SeqID_15581; Location=405..1933; Strand=+
  SCN-specific regions: Sequence locations=1-565,587-753,810-990,1022 -1154,1181-1529
  Gene Ontology: Mol. function=ubiquitin-specific protease activity; Cellular component=nucleus; Biological process=pathogenesis
tttcaactggtgtgttaacaattgaagaagtgaacagcgtgtatcagcattattcccatcaaaatttaagtgatgccactgggcttttcccattgaaatttccaacgcaccgacggaacaaaaacaaaggcacaattgagatggaaattgaaaaagtgtccgaatttgcgctggagccggtgggaagtcgccgatttagcgatgccatggacattgggggatttccatggaaaataagggcacaaatcaaaacgaaaaacgaaagcaatgagaaatggttgggcttttacctttgcaacgatggccctaaaaaaggtaaaaacaaagtcattttcgtaaatctgtcagggaaaaacaaaaaaatattatttcttactcattgttttaagcggaggaatacatttactaaattcttttttccagaggtttttaaatattatttaaatcattcgaactaaataaacgattatgtaaagaattttctacaaaaatagaaattcaaaaattaaaaatgcatgtgaaaagtacccgttcaacttaataagtaccggatttaatgataatggtaattttattgaatatttatttattgtgcagaaaattggtcttgtaaaagttcggcaacacttcgaattgtttctcaaaagaatggcacggaggatttaattggaagaattggtgatcgcatttttaataaggaatggaacaattatggatttaattatttcattagttttgcggtgagtgggattcaaataaatttaataaacttcatattttgaaattaaaatttttaaaattttaaaaaagaaagtgacaaaaaattgaatagaattttttgaaattttttggttataactctttgtaattttttttctagattttaaaaaattaaataagataggatttgataggatatgtaatgcatcgcgtaataccaatttttattaatttaactaaattcaagctaagttatgctttcttattagcaataaaattaaaactaataataaatttaaatgtttctatcattgacacttttgtaactttggctcaccatgattttatattacataattgatttaaaattaaagttataatcggaaacattgctgattttcatgttaaaaaaaattaattacaatatttgtcaaatttttgtattgcaaaataaatcactaaaaattaaggaattgttgaatccgggcaaaggattttacgacaaagatgaggacaaagtcacattggccattgatgtcattgtggatgagccaaaaactgagaaaattatttccgatccaaacaaatccaacggcacactttctatggaaattgaaaaactatcggaatttgcacgagaagtcattagaagtgaccgtataagcgaaactgctgtgtacataaagggaatgccatggaaaatatcagcacaaatcaaaacgaaaagcaatgagaaatgtttgggctttttccttttgtgcgatgcttctaaaaaaggtttggttataaaattattaatagaaatataa

SEQ ID NO: 79872 - DNA, 802 bp, Heterodera glycines
  Genomic contig location: Contig_ID=SeqID_15584; Location=468..1269; Strand=+
  SCN-specific regions: Sequence locations=1-155,177-189,213-222,246 -405,430-459,501-618,640-681,703-802
atggagcaaagccgagtcacccattttgcggtgcagaaccaaatgattgaggccatattgaaggtgagcaaaatgagaaaagcagaccaaaaacaatttttctttttttagaattaaaaaaatttggtttttctaattatttttgacggcttttgaacgaaatttttaaagaaaaatcgaatgaaatattttgttttggaaaagtcccttttcatgggtattttaagaaatttggagggccaattcttagtgttttatgtttaattaacatgataaatcataaaacaatttccatctgatcaatcattcattgtcatttttagatcttcgaccgcaacgatggcaaatgaatgtgcttccgcgggggcggatttgttattattaagtgccggccttttaattgccagccattgtttgttgcctaattaaggcgatgttcttaactaattaattttatcacttattatttaactttttgttgtcttttttaaatatttaatctcatttcgggcaagccataagctgcttaacaatcttttattcttttctcatcataatatcgctttttgttttttttccattttgtttcatgttggataatcaaaattttattcatttttgatttggtatcataaatttaaaattcaaaatgcgcggggtggtaattagagaaaatacggtatgtgtttttgtttatttagagtcccggagaatgaatggattatcattcttttttaaacccattgccgcttaatgtgatggtcagaagttttttgctgttctacagtagaatttaaaaata

SEQ ID NO: 79873 - DNA, 794 bp, Heterodera glycines
  Genomic contig location: Contig_ID=SeqID_15584; Location=1317..2110; Strand=-
  SCN-specific regions: Sequence locations=1-93,130-209,231-577,604-794
atggcaaaaggacatataattggaaacagttctgggtgtacggtatgattgaacggagcatcatacggtcactgctttgtaatttctttttgcaatttataaataaaaatgaatatttaattaaattttgtctctttaaatagacaatttctgattggcttcaagcaaaacacagatgacagatggataaactcagaagagggaacgcgaattaaatatataaatttggtaaatgaattattaatagggctaaattattttggggttcacattttgaaagggattaaatattgtcggcaccatttgattgaaacaatttcagtcttaaataattgaatttggtattttaaaaacgaaattaatccgttataaatcggacaaatgtacgggaagctttaatggtcaattagcttatggattacaatagatataaatgagactaaacaggcgaattattgagacaaaaaaaaaatttaattagtgttaattacccaaccttaattatccaaaatatggtaattttgtaaaatggcgaattgaaaaaatgtcaaaattgtgtcaccaagtcggctcatttattttctgtatgtttctcagtttaataaaatattttcagtggttattcacctcatcatttgatttgattggtcattaatttgttatgctgctcaacccaatacatatagtatcaatcgaaagctcacaaatcgaattttgagctgaatttctcgagcagaatgaaattggggaaattcaaattaaatttcaaattaaaaaaagtttagtgaaataaa

SEQ ID NO: 79874 - DNA, 1199 bp, Heterodera glycines
  Genomic contig location: Contig_ID=SeqID_15584; Location=2281..3479; Strand=+
  SCN-specific regions: Sequence locations=1-48,76-164,194-348,370 -410,432-654,691-989,1017-1145,1171-1199
atggaaaagcagcagcagtcaaaaagtgatgatcaccagcaaagtgatcagaagcagcagcagcagaaaaaggccgtcgctgttgtggtgccgcgaatcgtgcggaaggaaaacggtgggaattttgtaattatgtacagtaccatttgggcattttctaagacataaaaaatataaataattcaaattaattgctaagggaattcaactgccaaatatttttttactaaatagcatttaaaaaacaaaatgaaaagaaataattttggaaaaagcaattagcagaaaagaaagaattttgtttttgtttataacagactttattaaacatcattttgctgtttttacaaaaataattaatttgaaaaaattttcggcatttgacttattttacaaatccatgtttttttgaaaaataaatgataaaaatggaaaattgggggattttgaaaatgcttcttctcctcggacaatccctcagaaaaaaaatttaaccatttaataaataagaatctaattaatgaagggccttaattacggcaaagttaattaatggaatttgaatattcaaaccagccttaattgttcgtttgtttgtgttattttgacttattgtggtcatttactgtgcgtgcgtgcgtacgtctgacccccctcactctctctctctctccgtcccgctctctctctgcccaattaatgatctaattgaacgcccgcccattggacgttctttgatactctccctccagctagacacggcacacagtccaattcctagcaaaatgtacccaaaagataatccccacctgctgaactgtgatgagagaaaaacaaaaaatgaatggaatgagttgagcggggcggggcggggtcaacgccctcacttcactttttaccgcacaatcatcattatttagaacatgttaagatgcatgttcccacaaaataattattttctttagttccatacaattgaattgttttccatttaaatttaaattaaatttattaatgctttttaaaaatcatttagtcctcccccgcccgtcctttccaattcttccgatgtttggccaacagcccatggaaattgacgccgagtcaccgaagggcattcggccaacaggaccaggttggatggcatatatatatatatagatatatataaatctgagagtatctgggttgggcgggaa

SEQ ID NO: 79875 - DNA, 793 bp, Heterodera glycines
  Genomic contig location: Contig_ID=SeqID_15585; Location=30..822; Strand=-
  SCN-specific regions: Sequence locations=1-108,257-672,694-737,759-793
atgaaattattaccactattctttttaattgtaattttaattatcaaaattgaccaatttggagcagagaagaaaaaattgaaacaaaagtcatttgacgaaatttttggagaaaaatgggaagaaaaggaagaagaaaggcgaaatgaactcaaaaaaagagaaataattgcaaaattttataaaataaaagagaaaatcaagcaaaaaggaagaaaatacccaagaaaagaatggaaaaaaattgaaagaaaaatagctaagaaattggggacaaatcgaaacaaaatttataaatggatcaaagaatttggtcttcaaaaacgcaaatcttacaaatcaaaaactgatgaagaaaaacgtcaaattattcaaaaattcattgaaatgacaaatgaatttaaacaaaaaggaaaatattctttaaaagaatggaacaaaaattatgccgaaatttgcaagaaaattggagtaagcaaagggacaattatcaaatggaagaaacaatttggcattagcaagaaaataataacgaaggaagaaaaaatggaaaaaataaaaatttattgggaaataaaaaaagaaaacccaaaaatgagtgaacgggcaattgcaaaaatgatgaaaattgatagaacgaacatttcaaaatggaagaaactgtttggataaaagaatcattgaagattgaaaggatgattataagaaaaattggataaatttgccgaaaaaattatcagaaaaactatgacaatttctagttttttttcaaattttttatagttgtattaaa

SEQ ID NO: 79876 - DNA, 575 bp, Heterodera glycines
  Genomic contig location: Contig_ID=SeqID_15587; Location=207..781; Strand=+
  SCN-specific regions: Sequence locations=1-253,276-315,337-483,534-575
aactaattaattccattgacaatgtgcgctcaaagttgatctcggatggagtgttcaaaaacacgtttaatcgcaatgccaaagcatcaaatgaatttcaacaactcattaacacgttggagcacaaatttgtggaacaaattggccaacaaaatgaggaggatggccaagaaaacaaacgctacagcctcgtggacaaagtcactttttggcaaaacagtgtccgggtttcggagaaagccggcaccgaagtgctggatgaattggaggaaatgcgtgctaaatttgtacagaatgcggacgaatttgatcagcaggaatggatttttaacagcaaaaaaggcttttggctgatctgagtgttctcccggaaaatgcgtcagtgaaaaaagcatcttagaaatttttaagaaaaatttcagaccttttcctagcgtatttttccagatttttgaaaaaaaaagaattcttcatacaagttcgaaaaaggttttaaaaacttttcacttgaaattttcatataaaaaattttttcgaggcggggggggggggaacagtaaatttttcaaagtcta

SEQ ID NO: 79877 - DNA, 231 bp, Heterodera glycines
  Genomic contig location: Contig_ID=SeqID_15587; Location=1581..1811; Strand=-
  SCN-specific regions: Sequence locations=1-46,91-178
atgggggtctgggtgagaaaagagaagggaattggtgagggatcagaaatttttgataaaaataaattaaattatttattttcatttatagcatatgtccatctgcataagtggtcaagtggctaaacctttttacttgcattatttgtctcttcggttcaattccctgatggaacagaaaatttttttatattttctttaccattattttaattgaatttaattaataaa

SEQ ID NO: 79878 - DNA, 742 bp, Heterodera glycines
  Genomic contig location: Contig_ID=SeqID_15588; Location=364..1105; Strand=-
  SCN-specific regions: Sequence locations=1-158,192-214,248-376,421 -472,496-742
atgtgtcaatcaaaaggcagaaaaagaaaaatggtggaggcaaaaaaagaaggcattgatgaaaagaaagctgcgcaatgttttactgtttcaaaaattttggcaatgttcgtcggccgggacaaaagtcaattttactatattgattggggagaaggtaatttaattagtaatttttaatattttaaaaacaaatttgtgtgctgataattggtaataattagaaaaattaaatttaaaaaaatttgtaaattgtgaaaaaaaaaacactcctaaaaacccctaggttttcgaacattttggcattactttttgaaacaaaaatatttttttttagaaattttacaagcaaatagagaaaacttagggctaccccattttttaaaataataaatttgtaaacaaaaaaaacaaatttttgttgcttttacataaagttcatatgaaaacgcgtttatttttataaaacggttttattgaagtattacaaaacacccctaattcccaggacaattgtacttgaaaaatccttttttttatagaatatgtcggccaggaaagttgggagcctttgagttatattaatgcgcttgaaatggtggcggaatttgtcgaacgttcaacgatcgattgcgtactgaaagcattgttaggtgaacaatcagtgccggaacatatagcaaaaaaactacgcaacagtgacaaattcaaggaatgtacggatgaatttaaatatttttaa

SEQ ID NO: 79879 - DNA, 1850 bp, Heterodera glycines
  Genomic contig location: Contig_ID=SeqID_15589; Location=245..2094; Strand=-
  SCN-specific regions: Sequence locations=1-772,794-858,880-1148,1170 -1605,1628-1811
atggcaacgggaatcgcactgacacttaccgattgcgttatgtggttcatcgacgaaaacaccggcaaattcagtgaccgtttttccgatgatcagttctcattgttcgatgcgatccatcaacctcgtccgctggtcaaaaacaacgtacgagaaatcattgacatggcaaacaatcgacggcttactgttgtggaggcggaggatgcgaacattttgcgtatgcgggtgggaagattcatcgatttgaacggacgcaccgaaatgtctctgcatgatgcgtaccaactcaaattggttcaaaagccgcagactttggccgaggtcattgatagtggctcgctggacaacgatggtcgtttcatcgatggtgttaaacctcgcactctgctcgaggcgatttgttcgggaatgctcgacccggatgtggcgcacatcaaagcgggaccaggcgatgagctgatttccatcggagaggcgctgaagcgaggccgattgacgccgaaaggagaaattgtgttgactctgggtgaagttggcatacacagaggagagaaaattaatttgttcatggcgcacgaacggggccttttgaccagccgtgttcgacacaccatcttcgatgtaaaaggagtgagaaatgctgcggatggttcaattatgagcttcaaggaagctcgtgatgcgggaatccttcaggtgtggtggtggtttacggggcacttagtaatgccagtcgatggttgaaatttaaaaaacttacaaaagtggacaagtttagtttttgattttggtaatttttgtgggtgaaggggcgaaggtcaacagagagagacggatgggccgatgcaatcgatgagttttttgttgatatttcatttgttcgttttcttctgcagcttcaattcgatgggctggaaaccagactgaacgaagcatcggcccggggagagatcaattcgggactcgccgaaattctcgtcgctccatgcggcttgtccaacaatggtctgccattgtcattggtccgcgcgtttctcaaagtacgttttgtttgctgtgcctgtaataatataaatggtttaaacacatttttttcatcattttcagtaccaggtgagaactccccgtcccagcgaaataaaatttagtttatttgggtgattccaccttacgagatcagtcagtcaaggttaggtaactggcaaaattctgtgacaagtgacggtctttttatgcgtcccgaaattcgttccgaaaatactgtcaaatttgatgatgttgcttatttacactaaagggtcgcgtggacgatgtcaatggagaagtcattgatccggccaccgggcttggaaagtccattctcgaggcgtacaatatcggctccgttttctccacgttgcgtgccgccatgcgtcttgctgcactgctcgacgttcatccgtcgctttgtcagtgaaagggcgagaatggttgagtcatctataccatcccactttaattgattctcaatttgactttctgtttatttttaaattgattcttactttgacttaaattatctgtttatgttttactgtattcgttgatttattaattttttgcttaaacttgatatggagaagaatgaaatacacctagtaacaggcaccgtatatttactgtatgcgctcattacctttttttagtaccttatttttgaaaaaaagaattcaatgatcagttacaacaaaacgaaagccaatgagaataatcctgcgggaaaaaatgatggagatggattggcttttatacgaaaacactttagccacaaaaaaatatttaaaaaaatttattcaaaattaaataaa

SEQ ID NO: 79880 - DNA, 1170 bp, Heterodera glycines
  Genomic contig location: Contig_ID=SeqID_2470; Location=1265..2434; Strand=+
  SCN-specific regions: Sequence locations=1-72,156-275,297-334,356 -478,521-669,692-718,751-768,800-1170
atggttaagccttctgtctttcgttatttatcccttgagttcaattccacattggtacagtaggcttttttcatattttctttaaattactttaattgaaattaaattaaaagaaaattttcttacattaaaaatattttctttattttttaaaacattagctccataaattaacaaatgattgtacattttttggacaaatctgttaacaaattcattcaaaatttttcctggcggcgcctatcggcaccaccggaccgccattttacataattttctgaaatttggaccacaaaatggcaaaaaatagcccctttttggcgcaaaaacggctaaaaatccctattttttctctccgtcgatgataatgttggtccaaaagacttttgttcaacatcaaaaattagcttatttgttaaaagaatttttttttctatataaaatagagttttgattaaatttaagaaaagtttgaaaaattttcttaggaaatttacttaaaaattaaaatttttccttagagatttctataaattgctctaatttcctcaaaaaattggctcaatattgtaaattttgacatttttggacaaaatctgcggcaaatcgcattaaaaattacaaattttttcccggcggcacctattggcgccattgttccctgtactcgaaaaattttttggaaaaaacacgccgtaaagaagcggtttatatggtttgttttctttaaaatatattttgtttatttttccagcgattaaattcccgttttttattaataaattgaaattaaaaaaatcattcagaaaactttttacaatcacggctcacggatcacgggaatcacggggtttttggggtgtcatgatcacggatcacgggaatcacggggtttttggggtgtcgtgatcacggttcacggctcacggatttttttgaaagccccgtgatcacggctcacggatttgcgtgattggaaactcaatcagggccagctctgctgctgacacattcctccgtcttttttaattccaatctacagtactaccttatcgtaccaacccatcaagtttgttgacaatatttgtactttaaagcatttaaattcgaattgaaaaacgtacaaaatgttattaaaaatcatttgaaaaaaacaagaaattgtttcta

SEQ ID NO: 79881 - DNA, 775 bp, Heterodera glycines
  Genomic contig location: Contig_ID=SeqID_2470; Location=3209..3983; Strand=-
  SCN-specific regions: Sequence locations=1-290,312-579,606-775
atgaattgcaaaaatgttggcactgatcattggccaaatttcgtgaaaagtgaactccaattttcgactcaagctaacgaagacggacaattggccacaagaagtgaaaagtcgttgaaaaagacggagaaaattgatgacattatggtccatgaatctgaaacaaaagccaattcaaactgtttgggagttatgaattatggccggctttcaacccattaattcccattcccttttgctgttcggctctactttatgcaaatgcttttgaatgcgatgactttgtgcggcaccggcttttgcggaattggcgccgattgtttccatctgtaagtgccgaactctctgatagaatgtcaaccatttccggcaccttaggcaaaagatggacacatttgtctcaattgccgacggatccaattttgaattggtaattgtcatctcatcttttatttggccatccttttcatatgtgcgacgaattccaatttcgtccaacgcccaacgccgcgatttgaagtgttcgtccaccaatcggtcaaaccggtgactgagcaacgcaatgccaaggcccagctgaaaaggggggaccaaatggaacaccgaaagccaattgtcgccagtgatgaagctaaacgaacgcggaattaatgaattaattgaaaattgattctatcaaaatttacattgctttttccatttgttttcccacttttttggactttccgacattttatggccaaaaaattaggaaaatttcaaaaaatataataaa

SEQ ID NO: 79882 - DNA, 1235 bp, Heterodera glycines
  Genomic contig location: Contig_ID=SeqID_2471; Location=293..1527; Strand=+
  SCN-specific regions: Sequence locations=1-7,29-128,152-196,219 -385,414-467,494-745,770-960,985-1235
atgagagcaaatgggccaaatgggagaaggaggccaccgagtgggacttcgatgaacagtggaaccgaattattttttcctattggtaggaaaactataaccccttttttattttattttgcggcgaatttggcattttccaccattaataattgtaccaattaatgtttaatccccatcatttgcccaacttgcattttgcctttgtaataattatttgtgcccttttataatttgttcttttatttttttcaaaaaaatatatcaaaaagcatatgcatgttaactaaggcaaatacgttctcaatttttgaatttagcactctaaaaaattaaattaagatgcaaaaattgaaataaacccaaaaaatgcaagttcaaaatctgttacaaaatttattttctaaaattaacttttcgaaaaatacttatttttttgtattctgctaaattttgctaattttttccaaaaaatccttaaaattaaaattttgtatgaaaatctgttaaaacatgttattccaattttttttcctggcggtgccggtcggcactgtcggaaccctttccgttcccaaaagtttttttaaaaatgctgcaaaagggccatgcccaaattgacatcatctggatcatcggaaattgtaggaaaacattgagaaagtgatgatcaatgaggttttaatctcaattatcaatcaatcaatttatacgcaaaagcgtgacaccgacataaataacaatataaataaatttggtcactgaatgagatgaggtggtttcaaaagtaaagaatcaacatcataggtgtcaagaagtttagcaaagtcaatggaattaagtaacctcgcctctttaggcaaacacctatagaggcgagaggtacgaataaaaaacgaatgataccgaacattggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttggaggagttcgttatacccgggtatatcatccttattattattacgtctaaaaacaatacgtaaaaatgttttttgaacattttcaagagcatcaatgtcttttttcatgtatggattaaaaatcggagaaccaaattccaaaatggatcgaca

SEQ ID NO: 79883 - DNA, 1417 bp, Heterodera glycines
  Genomic contig location: Contig_ID=SeqID_2471; Location=1153..2569; Strand=-
  SCN-specific regions: Sequence locations=22-131,155-230,264-366,388 -626,648-782,804-900,943-1293,1318-1417
aataaactagaaaacaataataatacttccattgacagcatcccgaatatttttctcaaaaattgtaaagaaaatttggtttatccgctatttcatattttttgtttttcaatgatgactggccaagtcccaaacatttggaaaaaatcaattatttatccagtaccgaaaatacccaatccaataaatcctgttgattttcggccaatttcacttttatgctcaatttcaaaaattctagaagaaaatattacccagaaaaactaattttgttgagacaaataatgtacttccgaattgccaacatggctttaggagaaaacactctgttacaactcaacttttggaagtcattgatgactttagtttagctttggaaaacaaaaaatcaattgatgttatatattttgatctagcgaaggcatttgatactgttccgcacgaaagattagtttctaaactcaaaaatattggtataaatggtactttactaaaatggcttcaaaattatctacaaaatcgtacatttttcgttagagttggctctgcgttttctgatgaattcccatgcttaagtggtgttccgcagggatcaaatttgggtccgcttttgtttttaatttatatttcagatcttcctaatttttgtaaaactgaaaacgttgaaattaagctttttgccgacgatcttaaggcctattctatactatcaaaaaatactatttctccactccattctttcattaataaatttctgaattattgtgaattaaatggccttaaaatcgctcctaataaatgcttagtttcacatcttgggcctaaaaaccctaatgaatgttacttaataaataatattccaattttaaaaaatgaagaaggtgaaccagttagagaccttggcatttatttttcaaataacttaaaatgggaaaaacatatagaatttattactaaaaaagcaataagaacatcttttgctttactcaagtcacttaaaactaaaagcccaaaaattctcataaatatattcaatgtttattgtcgatccattttggaatttggttctccgatttttaatccatacatgaaaaaagacattgatgctcttgaaaatgttcaaaaaacatttttacgtattgtttttagacgtaataataataaggatgatatacccgggtataacgaactcctccaactctttaaacaagaatccctcttaaaacgcagaataaaaatagatttaaaactcttccatgatataattttggaaaagatccatattcagcataatgattccttttcaaaaacatattcagaactgaaaaatgattttattattaaaaccgcttattgttcaaccaatgttcggtatcattcgttttttattcgtacctctcgcctctataggtgtttg

SEQ ID NO: 79884 - DNA, 931 bp, Heterodera glycines
  Genomic contig location: Contig_ID=SeqID_2471; Location=3740..4670; Strand=-
  SCN-specific regions: Sequence locations=1-236,264-323,345-829,851-931
atggtgtacggtcacatcacattaggattcatttggaccaaagcaaaatggaaaaaacaggcaaatcgggtaaaatgattccaattcggcaggcacatgacaaattttcaaaaaatgcaaccggattcgaaagaatttaaccgtcatatttggagacaagtaattgtccaattaagattataatggcaaccgatattaaaaacatcttaaatcgactgtcttcaattgaaaccttattatcaaacaacaacaacaacacattggcatcccaaatggctgaacaattcaacgcaattgctgaacgcctcagtgaaattgagcgcaaaatcaacagcaacaacaatgccaatgacagcgcggaagagaaagaacgaaaacggagcctcgttttgatcggacttccggaggctgtggccgaaaagccatcagaacgcgccaaagaggacgcggaaacagttgcggaagtgttggacgctttggatgtggaggtttgcccacagatggtgtatagaatggggcggcggattgatgagaagcgaaaggggccgcgtttggtcaaagttgtcttgccagcgacgacgttccaacgttttgcactggcacaatgggggcgcaaccggacggaactgaaacagcgtgtcggttggcagcgactgctcgtcagaccctccttgacgaaggaagaattggcggctgagcgggagacacgtgaacaaaggcggatgaattatgaagaaagcaaaaagaacgaaatggtgacgacgcggcgtggaggcaaaatggaaaaaaacttttgaggtcacaaaactttctcaattgtttttactttaactcaagaagtttagtaaacaaaatggatgagtttaggcttttacttttagaaaataggtataaaattatcgcaataaccgaaagctggttgaacaataaa

SEQ ID NO: 79885 - DNA, 666 bp, Heterodera glycines
  Genomic contig location: Contig_ID=SeqID_15590; Location=80..745; Strand=+
  SCN-specific regions: Sequence locations=1-666
atggcattgctttccgaccgtttcgatgttttggtggacgcgcatttcgatggaaaaagcgaattcacaatttggagaacaatcagaattgtaaaggacgaaggaccaaaagcgaaactgtctgtatggaccgatggcaatgtatcgatcgatggcaaaagggtggaatttccattgccggaccattcgctgcccaacaaaatttgctttaagaaccttcagattcagtcagtcttaacttttgtgtacgctaaagcatttttatctttcttcagttacattgaccattccgtgatcaaatttctccgttccaagaagccaatttgggacagaagaggcaccaatttggaagtgcttgtggatgcatttgatacggatgtccaaccgatttgggatgtttttgtcagtcaaatttggcctatttttgcgacaaacattcgccatttatgcattcctaatggtgctcatttggacaatttgcgtcgtctgatttcaccgacatttctcactgatcttgatcaattgatttcaatcgattctggtgctctgttacgcgatggaattgctgacgatggaccaaatgcaactgctggccaagcgttggccaaatggcttcacactccgacaaaaaatgggcaaccgaagcaattacgtttccttgcttat

SEQ ID NO: 79886 - DNA, 1320 bp, Heterodera glycines
  Genomic contig location: Contig_ID=SeqID_15591; Location=929..2248; Strand=-
  SCN-specific regions: Sequence locations=1-18,42-151,182-526,566 -1091,1113-1218,1240-1320
atggaacagcccaatcaggaaataaagacaaagcgaaacaaggagaagctggaacatgagggttcactttatgttcttcacaaactcagtgacgatgaacttcggaagtattggcgatgcgagtttttcggagctaacgacaaatgcaaaggtaaatgcataaaataaaataaaaactatttttcaaattcagggcgccttcacactgacattaatggtaatgtcctcaaaataattggaagccacacatgcgacatgagtgccgcacaagtggagtgtcagcgacgtataacccagctcaagcggcgtgcagttgagacgtgcgaagcgccggctacaatccgtgcgcaggtattgcagaacactgcaacccccgtgttggctgcttttccgaccaaagctgcgactaaaaaggtcaacgtttgcaaatttttatgccaaaggttggtatttctcgaaattatgaaatgcgcccgtaatttttcaatgcttgttatttttttttgttgttaacacattaataaatatgttatgttattaattttaaacattttttcggaaaaaatcagtagaatctattttggacaaaaacagcttgccgtactaaactgaccctcgtactaaaccgacccctcgtactaaaacggccgtactaaaacggccgtactaaaccggccgtactaaactgacccggtccgctcaaaatatgtaaaaaataagtataaaacgtcgaaatatgtaaaatatgtaacaaaccccgaatatgtaaataaagtcccaacttttggactcaaacgagagttgaaaattaaatttccgacaaaattctcatttatacaccaaaaaaggtccattttttgtggaagtttccagcttgaaatttcgaagctataaaaaggttgtttcgtacattaattcccgttttttttgtaaaattctgtaatcaaattggttttatcaccagtcatttttaacaatgtaattggagactgggggattaacatgacaaattattaaagaaggtaccagcctcaggaaataaaaaaacaaaaaaagtaaagaaaattttcgaattcgggttcgggattcgaaaaatggatgtttggaacatatccgaccaatttcagtcgtaaacaggcactcacgcgaaaacgtaccccacgcgaagacggccacgcgaaaacggaattccaatcctgcaacaggatccgcaaattgaattttattttatttatttatcgataaagaaaaaattgccaattctgatggtcaaaaattgagcaaaagaaatgcaaaaagtcagaaaaaagaaacaataaa

SEQ ID NO: 79887 - DNA, 153 bp, Heterodera glycines
  Genomic contig location: Contig_ID=SeqID_15596; Location=892..1044; Strand=+
  SCN-specific regions: Sequence locations=1-153
atgcagcgacagcagaagcagcacattttcggggccatgccagcacaacagcagcagcagcaaatggacgaaggcggaaacgccgaatgtggcgaatacgatgaggatttgcaagaaattccggcgccggtccaggaacaacagatgaacatg

SEQ ID NO: 79888 - DNA, 94 bp, Heterodera glycines
  Genomic contig location: Contig_ID=SeqID_15601; Location=125..218; Strand=-
  SCN-specific regions: Sequence locations=1-94
catcatcgatggaaaatgcgcaaacaagtcacgaatcagaaggactttcccgacagggccaaggacgcctttgcccgtctgccagtttcggaaa

SEQ ID NO: 79889 - DNA, 1476 bp, Heterodera glycines
  Genomic contig location: Contig_ID=SeqID_15602; Location=280..1755; Strand=-
  SCN-specific regions: Sequence locations=1-214,239-267,290-376,398 -1051,1093-1476
atggccggccaaagggtcgcagatgagcaacaggggtaggtcggcttgttcctgacacaagctatccaatatctacaggggatttctttgggagaaatccaattggaaaagtgtgtatggacactcacatgatcacaaattgggtcttcgcccgtgtaaaaaaactgcaatgggtcatcaacgagtggcagtactgatttgtccgagttgacagaactgaaaaataaaattcaaaaatgagagcaaactgtagaccggacgtaataaagaaacaaaaatttaataaatgctgatgacctcgcgtcctctaatttggcaggcaaagaggcggcgatttgcggtgactcattctgttgagtgaaaaccgactcggcacaaggactgagaatttggcaagaaaattcgatgtcctcggccgacccttctgaatgtgatgggattttttgttaccatgttccaaatcagtcccatttttggtacttatcacaccgagtcaattttgagccactagttcaaaaagtaaatgcatatgtggcgaagtggtttttgtaagatagtaaagggacaaagggtggtggtggttcgagtccgttgtgcaacatgaatatttttatttatttttgtccaaaaaatttaaaaaatagattttcggaaattattttggaagctttttgccaactaaattgaaagatcttggtatcattcaaaagctcttgatgaggagaagctttttctaagcaaatgttgaacagtttggtgagttagaaaaaatatatgggtgttctaaacttgcaagttttgaacttgagcatagacaattaataaatcagcatagaaaaatgaagaatttttttctctatcgatatgcaaaatttgaagaaaatctgttaacgggaaaaaaagtttcttagagagaagtaaattcggtttttctctattaacagagataaagaaatagtacgccaaaaagagagatgtttttttctctgcactctctatttattgacacatgtctcgttttttgactcggtgtgttatgcactatacgaccataaaaaaataaatttattttttaaatcatataaaaaatttctaggggtttcggggtcgctaatcatgaatctgacatctatttctgccaaattcgaatcccgaacccttattcgagttattttcgcaccataaaatgattttttgaatatttgttcgaatacgggttcgggattcgaatttggtcgaaatggatgtcagattcgtgatcagcgatgcttcctaaattctgagagtacgtcactgttcccccttttcgatacccgtgaagagaatgagcgaaggcatttccgataagcggtggacagtatgctcagtgagttcgtagagtgcctttcttctccagggatatccgtgggggtccgacaaacaaacgcttcgcccgtttcgcgttagcagtgaaaagttctcatcgacgagaataaa

SEQ ID NO: 79890 - DNA, 1447 bp, Heterodera glycines
  Genomic contig location: Contig_ID=SeqID_15602; Location=1..1447; Strand=+
  SCN-specific regions: Sequence locations=1-242,264-663,705-1130,1155 -1358,1380-1447
  Gene Ontology: Mol. function=thioredoxin reductase (NADPH) activity; Cellular component=nucleus
ccttggcttgcgttttccatatggtgacgaaaaactcattcaaaaaattgcgaaggcttacgacatttgcggtgtgttagaaatgattttaaatgtcaagtgattatgttacttatatttcctcggattcgagtcggggttcattgttcgcaattgacacaaatgaattttatttggtcaatccgaaactcctgaccaacgaaatatcccttacacaactaggaacccaaaccaatcaagcacatttgtgcatgcattttatttgaaggcattccttcatttattctcgtcgatgagaacttttcactgctaacgcgaaacgggcgaagcgtttgtttgtcggacccccacggatatccctggagaagaaaggcactctacgaactcactgagcatactgtccaccgcttatcggaaatgccttcgctcattctcttcacgggtatcgaaaagggggaacagtgacgtactctcagaatttaggaagcatcgctgatcacgaatctgacatccatttcgaccaaattcgaatcccgaacccgtattcgaacaaatattcaaaaaatcattttatggtgcgaaaataactcgaataagggttcgggattcgaatttggcagaaatagatgtcagattcatgattagcgaccccgaaacccctagaaattttttatatgatttaaaaaataaatttatttttttatggtcgtatagtgcataacacaccgagtcaaaaaacgagacatgtgtcaataaatagagagtgcagagaaaaaaacatctctctttttggcgtactatttctttatctctgttaatagagaaaaaccgaatttacttctctctaagaaactttttttcccgttaacagattttcttcaaattttgcatatcgatagagaaaaaaattcttcatttttctatgctgatttattaattgtctatgctcaagttcaaaacttgcaagtttagaacacccatatattttttctaactcaccaaactgttcaacatttgcttagaaaaagcttctcctcatcaagagcttttgaatgataccaagatctttcaatttagttggcaaaaagcttccaaaataatttccgaaaatctattttttaaattttttggacaaaaataaataaaaatattcatgttgcacaacggactcgaaccaccaccaccctttgtccctttactatcttacaaaaaccacttcgccacatatgcatttactttttgaactagtggctcaaaattgactcggtgtgataagtaccaaaaatgggactgatttggaacatggtaacaaaaaatcccatcacattcagaagggtcggccgaggacatcgaattttcttgccaaattctcagtccttgtgccgagtcggttttcactcaacagaatgagtcaccgcaaatcgccgcctctttgcctgccaaatta

SEQ ID NO: 79891 - DNA, 1285 bp, Heterodera glycines
  Genomic contig location: Contig_ID=SeqID_15604; Location=1..1285; Strand=+
  SCN-specific regions: Sequence locations=1-50,72-133,155-421,445 -543,566-605,663-754,776-941,963-1105,1127-1285
gaaagacaaatttgaaaaagggccattcaccgtagattgatttactcagatgcgaattccattccacccgatcagccacatttcccgatcactgggttttgtccggcagaatgcacacaaaaagtgaacagcgagtgccaaaaaatacactgaaattgctctttttccgctcagtttcccatcgatggcatttacatttttgcttcacaattgcactcccatttgacggggcgaaagttgcacagttcggtgatcagaggagggagcaaagtgacggagatcaaccgggacgaccactactcaccccattggcagcacatccgatcacttcggccttttgtgcatgttcgacggggcgatgtgatcagcaccacttgtgtgtatgagacacgggggatgaaacattggacatgggtgagaacaaaagggaaaagggaagaaaaacagtgatggcacacatactgtaatttgaagggcggatacggtattgaggacgaaatgtgcgtcaactacgttcactattacccggcatcggaagtgaattttgacaaattaatttttatttttctcaacttttcaggtcgaagtttgtaaggtaaaaatggaaataatattattattaaatattttaaaaagatattttaaaatactataaatattttcgcttttttcagtccgccgtttccaatgcgtctctccacgcgttcttcgcgcgactgtgaattttttttttttacaatattttcaaactcaatttttctttctctctcccaaaggggcgtcaaaaataagcagatgaatatccacgagaagtattcggcggttaaatgggtgagaagaataaacaaattggcagtttatcatttaccgttaattggacggaattgggaaaggaattgctgaaaggcctattatatgcgtaattaataaactcaattttgggatatttgtttgtttcttgttgtattccaaccccacttcagacaatggctaagttcgccgcgttgcgcgaattgtacgccgttgcctcgctgaacgtcgcctgtctccaacattcgggcgaccttttccccgtaaaaataatcagtgggggcagacgaggattaattaatttattattgcatttgattaatggtaagataaccaaccgactgtccatttacagggccaccccacaaattggagtcgcgtgccgaggcccgagtacggcacggaatcgtcgacaaacgaagggcaagcgaacggcgacgaatgtttggcactgaacgactgacttttgtccctt

SEQ ID NO: 79892 - DNA, 1197 bp, Heterodera glycines
  Genomic contig location: Contig_ID=SeqID_15606; Location=600..1796; Strand=+
  SCN-specific regions: Sequence locations=1-398,420-525,564-751,787 -802,847-879,901-964,986-1197
gcggtagctcttctccaagtgcaggcggttgctcaccgccgttggccattgcactgtacgtctgctccatgtttttgattgtaagtctcgtcacggcggtcaattctcgattttatctacagtatacttttttcagctcatcctcttttacgtggcctttcgttgtgctcgcgggcgcaacaacgagtacattttggccaacaatggacccgtgcgtttggcccgcgctattgcgcctcgaggtggggtagggggggggggaagggattaccctcttaattatagtaattaaaatttgtaatcattttcaagtggcttttcgtcgtcagcaccccgagcctttggcgattgccgtgcgccgtcgcgcgcctgcggtaaaataataagaatgtggggatgtaatttatgaaaataattcttgaaaattacaggcgccctgatgtgtcggacggaaggaaggggcgtgaaaagaatgaatgactaatgaaaattaacattaacaataatataattgatcttttcagattttgatcttttacataattttaatttgggattcttttaattgggtcaataaattgcacatatatattatttattggctgtgcgttccatcaaaacaatccattttagtggcgggatttgtatgtaggtcaagaatttgtgcgggatttgatgggttaatgtgataaacagaatgggtgtatttaacgcaaatggactatcccgagttcatcagtcgcaatttcacttaaataaatttttataaaattaaaaaataattttcacatatccttttgcctaatttaaattaaaaatataatgtcaataaatatacaaaattttcaccccagtttttttaagcctaaattttctcaccttatccattgctgtataaaatgtccaacggtactcaaagcatttcagcggatgcagatggacctgaaatgccggatgagcgccaactctggttggaaatgtttgagagcggtgactatgaagtgaagccgcgctaatttattttttctgaacacatttcatcattccctcagctcctcagctggtttggtcgtgaccgggccaagcaaatcatggaggatctgcgcaagtttgccgaagagacgggccgagaatgcacccatgtgaaaatgttgttggacaagatcaatcgcggaatgattaatgggaagaaagagg

SEQ ID NO: 79893 - DNA, 62 bp, Heterodera glycines
  Genomic contig location: Contig_ID=SeqID_15607; Location=1432..1493; Strand=-
  SCN-specific regions: Sequence locations=1-62
ttcgacgttgtggtcattcgatgtgtgattcccttagggatgatgagtaagtcgccatactc

SEQ ID NO: 79894 - DNA, 535 bp, Heterodera glycines
  Genomic contig location: Contig_ID=SeqID_2472; Location=577..1111; Strand=+
  SCN-specific regions: Sequence locations=1-2,25-51,92-316,338-352,374- 428,455-499,521-535
atgtctggaagtgaaccaatgtctaatgagatcctaaacaagtcagtaataacagttgacagagaagaatggcaaatttttaaaattttatagctaatgttatcgggagaagtgccatttttattcggaagttttttcagaagattttggggctcgatgatgttaaaatttatatccgatataaagcattgatcaatttctataatattacccaagcatggattgcttgggtcggtttcactattattaaatgaattggcaaataaggtggcaaataattcagatttctcagcactattatgatagcatttattttcataaattagattaggtatttcaaagggattgacattgaatttttgtatatatttataaattgaatttcttccctttgaaatagcctttttctcaatttggctatggtatttatttgtttgtatttttatatgtaaagaaatgctatcgtatagtgctgttttggatgggtcagttttagcttgcctgaataatttagccttttctttgatggatgcta

SEQ ID NO: 79895 - DNA, 713 bp, Heterodera glycines
  misc_feature (690)..(690): n is a, c, g, or t
  Genomic contig location: Contig_ID=SeqID_2472; Location=1..713; Strand=-
  SCN-specific regions: Sequence locations=1-46,87-113,136-152,174 -257,279-713
aaaaaacttccgaataaaaatggcacttctcccgataacattagctataaaattttaaaaatttgccattcttctctgtcaactgttattactgacttgtttaggatctcattagacattggttcacttccagacatctggaaagaatcaattgtttttccgctttttaaaaagggtgacaaaaataatcccgaaaactataggccaatttcattaacctgctcactatgcagggttatggaaagaattttaagcaaaaatatttacaattttctattaaaaaacaaaaaaatttcggaatttcaatttggttttgttaggaataggtctacaacgagtcaactaataacagttgtggaagattggtacgaggcaataataaatggaaaaaatgttgactgtatttatattgattttcaaaaagcatttgactcagtgccccatgaattatttttatacaaattggaaaaaataggtataaggggcaaacttttgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtgaaaataaaatttatatgccgatgatgnttaaattgtatatttgttataaa

SEQ ID NO: 79896 - DNA, 790 bp, Heterodera glycines
  Genomic contig location: Contig_ID=SeqID_2473; Location=703..1492; Strand=+
  SCN-specific regions: Sequence locations=1-78,100-206,239-295,338 -364,419-624,681-790
atgatgagggccacccgcgtacgcttcgccttcttgtccgtcgtgaggtgagtgtgaacgcacccccccccccccccattttttcatttccttccttttggataatctttggcaattcagcgttcgtttgatcatcgattgccggccaagagttccgggcgagagcgcccaattggaacggtgggggagggggatgggaggggatgacaaacaaaacaaataaataaaatcacaaattttcacaggcttcaacggaatttgtcggtggtagattgtccccaattgaggaggtggcaaattttaaaaatatcaatttataaattaaatttttttatttctaaggcagacgagtccgttgagaattgagaagtgaagagaacaagagaagagaagaggagaagaaaatatgaaaagagaataggagcacaaaggaaaaatttttaaaagaaataatcagggatcattataagtttgtccatttatttaaataatttggtgaaggtcatttaaataaacagttaaatcgaagggttcaaaatttattattgaaattttatcaatattcctcggtccttctctttcaatgttggtatatctcaacatttccagagtttggtcattccctaaaaattaaaattaatcaaacatttaaaaaatagtaaaaattacaatttaaattaccaaataagccaaaaaatgaaaatgaatgcagcagcgatcaacgatcgctgccataaattattgtagaactgcggcttggaattttcataaaaaatcatctaaatagtga

SEQ ID NO: 79897 - DNA, 1174 bp, Heterodera glycines
  Genomic contig location: Contig_ID=SeqID_2473; Location=1803..2976; Strand=+
  SCN-specific regions: Sequence locations=1-321,344-425,461-796,818 -1174
atgagcattaaccttcgtgacaaaaaatcccttatggaaaatattttgcccgctgtcgacatcagccacaccattaatggaattactgtgagcagcgaacgcattgccgtggcaagaacaattcctttcgacattgtcggcaagtgcaaggagtgcaaggcaaccgaatgcgagacggaatggtgtatctcaaaggagggtgtgacaatttggtgcactcgatttaaaatcagcccccgttttgtgccttttgatgtcatttacgagcttcccggttatacctttttcaaggtattttcaacaatttttcttaccacactacattttttaaatttgtagatccgtaacaagagccgagtttttaacgttgaccatggcagtcgcagcgatgcttgcactcagacgcccacaccgctctaccacttaccgcctccaccacccccaccaaaactcccaaaaagaaaacaggaacagcaacaagcggacgccccggcgttcttttccgctctttcggcagcagtagtatagaaccccaaaagcgcactttcgcatgggtgtttaccgcacaatcccgtgcctatgggaggggtgcagccctttgatgttgccgcacgagcccgtgcctatgggaggggtgcagccctttgatgttgccgcacgaacccatgcctatgggaggggtgcagtcctttgatgttgccgcccgtggacccatgcctatgggagggtgctgccctttgatgttgccgcccgtggacccgtgcctatgggaggggcgcattcctttgatgttgccgcccaaaacccaaacctattggaccactttcaagttgccgcccagaaccaaaatctattggaccactttgaagttgccgcccacccaaatccgatttcccaaaaccgcacgggtgctttttttttgcccaacccatccctcccggccgatgcatcgccgcgcaaattaatcgataatgacaccgccctaccctccccatcgatgtcgccgccgcgcaaaaaaaaaatcgataaaattaatcgataatgacaccgccactctcatccgctccgtcgatgtgcagcgattccgagtcgtgaaaaaatcgataagcaccaaaattgttaatgaaattcaattaattctaagatataggaatattaattgtacaatagttga

SEQ ID NO: 79898 - DNA, 1959 bp, Heterodera glycines
  Genomic contig location: Contig_ID=SeqID_2473; Location=3424..5382; Strand=+
  SCN-specific regions: Sequence locations=1-80,102-117,140-614,658 -694,716-806,828-1050,1072-1495,1524-1802,1832-1959
atgacttcaaaacgcaacgggactttgcaaaaaggcggtccgtcgaccaaaaaatgggattttcgagctatagggtaagcaatttttaataatatatttaagagacaagtgtaatcaataatttttcaggaacaattttactgaggaaatggaaaattataaattaattgacgaacggtcgacgatttgcgaaaaatttggattcacgaagaacattacggaatttcggatcaattcggatgtgagacgtcctgacgaagcgatgagggacgcaatcgacacaatgattaaggcggcttttaagactacggaagaaaggatgaagcggaaagtgcggatgtttggtatggcaataacgggtgccgggcttgcttccccggtttgggtaccgtacagggcgtacccgcagaataatgcggatgttattatgcaggagattaataagttggggcagagcggggacggagatgaaaataagaaaacgcttttgttgtcggagcctattatgatgaaaattacttgcgtgacactgcccagtggagaagggccgaggaatgtacataaatttgatttcggatttaaggaacaccaacggataaggtaagttttttgagaaaaaaaaagaaaaaaaaggaaaacagaaaaaaaaagaaaaaattataattatttattaaggatttcgaatgtggataaattttgtttgttttatgctttggtggcgtcaaagctttatttggaagtgcatcggaatatttttaatcgatttatgaatagcatcgtgagacaacgagaggcagcatacggacttttaagaaattgtggaattgatattaacgaatatagctatggagtggagcacttatcgagggttcagaattatttggtgggttctaaaatttgggaaaacgtaaaattaatggatttttaggatgagatttaccccggtaaataccgggttgtggcatttgaaaagtctgcggatccgcggaaatcgatccgtgttttatggaagggccctatgggacgcgaaaatgtagtgccgatatttttggagaatggccattgggatggtctgaagaattatgtctgctttttcaaccgtgggagaaaattctgtattgattgcgagtgcttttacgacaaagatatttaccatactttcgactgccgggcaaggtgttattattgtaacaaagtaggaggagtaccatgccaaaaggagagtggagtgaagattgagtgcccgaagtgttgtcgttacttttacaatttggagtgttataattaccatcaggaacatcagacttgtaaattatggaggctttgcgttatctgtgacaagacttatcgatttaacccgaagaaggaccatgaatgtggagagacttattgccaactttgtagtgtgagccatgaccccaagcggggttgttatattatgccgatcgaggagaaagaggaaaagtccgtctaccgaattgtcgtttgggtaagatttaataaagaaaaagacaaaataaaacctaactttcaggattcggaaacatcgcaggattcgatttataagggggaccagaaagagcatgtgatcaattatatttcggtgagagttacgtgtacggagtgctgtgatgacaaaaataggacgaattgcaaaatatgcggggaggagaggaccaaggattggagcgaggctgaggggcatgagccgacgaaggcatttgtggagtggattttaacggcattttcaaattacgatacgtacatatttgcgcacaatgctgggcgttttgatggtaatgaaaaaaaaaattaatctaaatttttaaatcctaaaatttttaggtcattttgtgtttaactacctctgccgtaccgggaagaacccgataccgcttatcaatggactcaaaatttatgaattcaaagtgcgaaactcgaagaaacattcaatgctga

SEQ ID NO: 79899 - DNA, 1337 bp, Heterodera glycines
  Genomic contig location: Contig_ID=SeqID_2474; Location=64..1400; Strand=+
  SCN-specific regions: Sequence locations=1-218,240-672,695-1337
actcacggcgaagagaagaacaacaaattcccgctgacattcagcaggaagaaccctttcaaccagccccacagccttctattcctatacatccacaacttaacagaaaacggaaggcacagtatgctttgaatgatgttcaagaatcaaaaaagagtcttattggcttggaagagctaagacctccatcgcttcaacaagaggcatcccttcgtttcaaacaaaaaaggacaaacaaatcccgagtaaccctaccacagcactcgaattcattgtccttggcaaaactgcataatcctccgagggacttactggccgaggcagcctctgcccctttaccggatgatgatgccgatgattttgaactctcacaaaaccacgggagcgcttctcaggtccaacctcccccacctgcacctccgttgcctagtaaagccaaaaagcgaaaaagcaataaagttgatgaagatatcgaacgaaaaagaattagaattggttctcgaaagagggatttactggcagaagcagcctctgcccctttgcctgttgatgatggtggcgatgattttgaacctccacagaaacccggaacgtcagctcaggtccatcctctcccacctggacctccattgccaagtaaaaccaaaaagcggaaaagcaacaaagttgaagaagataccgaaagaaaaagaaccagaattggttcccgaaagagactgtcatcaccaactgttcccaaaaatcaaccaaaacgtcaaaagaattcgggaaccgaaagacaatcagaagaacagcgtcgtcagtttgcggatgatcaactccttttcagcatcccaaattctcagcttaccaatgaacaaaagagaaggcggctccaattcgtatttaaccgaaacccggtcaagtatggcgtacgcgaagacaccattttaaacaacgctggaaatccagtaacggacagcagtgtgacacaagcacttgaatacattattgaacgcagagcggggagagtcccacggtttagacagccgccggggacaaaattgattcgagaccggattaatcgagaccttattctacgaacatggacagccccaccggtaccaccgaggggagccaagcggaaattgccacaaacagaccaagaggaggaattaaaccaaaaatcacaaaaaatcagaggaacagtacagccgagaggcagagcacaggaaggactgatgcttccgtttccaacgagaggagtcaagcggaaaacaacggccccaccagaagcaacaatagaaatacctccgaaaactcaacgcctgagaccacagaaatggaaaaatcaatag

SEQ ID NO: 79900 - DNA, 832 bp, Heterodera glycines
  Genomic contig location: Contig_ID=SeqID_15609; Location=107..938; Strand=+
  SCN-specific regions: Sequence locations=1-592,614-624,648-658,696-832
atgaaaattggagcgccaaagaaaaaaattgcaacaaaaaaccatttaaagaaatatttggagaaaaatgggaggaaaaagaaaatgaacagaaaaagagagaaattgttgaaaaattcacacaaaattaaagcgaaaatcaaacaaaaagagagaaaatattcagcaaaagaatggaataaaattgaattgaaaatcggaaaaaaattgggcacaaatcgaaacaaaatttacaaatggatcaaagaattaggattatacaaatgccataacaaatcaaaaacggatgtacaaaaaattgaaattgtgcaaaaatttaatgcaatgaaaaatgaatataagcaaaaaggaagaaaatattcgagaaaagaatggcaccaaaattatgccgaaattgggaagaaaattggagtaaattatggaacaattcaaaaatggaagaaacaatttggaatgaatggaaaaagaataactgaaaaagagaaaatggaaaaaatgaaaatgtattggcaaatgaaaggagaaaatccaaaaatgagtgacgagaaaatttcaaaaatattgaaaattagtcaatggaccattttcaattggaagaaacaatttgagaagaattaaatgaggattaaaatattattgagataaaattgcattttccatttcttagagcctatttttggggatttttaagacatatagcctaaagctacctttcgagttattagtgtctatttcctaagcttttatttttagacctaaaagcctaaagaatttttgaaagaacctatttttgcctattggcgttttgtcgaaatttattaacaaaaatgca

SEQ ID NO: 79901 - DNA, 2149 bp, Heterodera glycines
  Genomic contig location: Contig_ID=SeqID_15610; Location=74..2222; Strand=+
  SCN-specific regions: Sequence locations=1-1390,1412-1878,1900-2149
atgaatagagacagtggagcccaagcaacagtcatcagcttcaaaacgtggatcaaattgggtcaacccaaactctctccaacggacatcgaaacccgcaactgcaatgacatcgcattttcaaccgaaggaaaatttcattgcaccgtcagttgcttcgatcggccatccaaaacactgatcgcttacgtcagcagtgacttaaagcatgatttgtttggccttccgtggattgaggaattcgagctcatcccaagagaaattttgtttccaaagagcaccaaaggaaagccaaacgcgtcaatcaacgccaatgtcgtcaaggcaccaaacccggcgattggcattacggatgaatcctcgctcaccgctgtgttgcaaaaagattttgaggaagtttttaagaacggacttggccattgcgcaatcaaagcgcacctgattctaaaaccggacgcccgacccatcttctgtaaagcacgaccagtcccccatggtgcaatcgaagctgtcgacaccgaactggaccgcctcttgcagattggcgcagtcaaaccggtagaattcagccattgggccgccccgattttggccgtcaaaaagaaaaatggaaagacccgggtgtgcatcgacttttcgaccggattgaacgattcgatcgaactgaatcgccatcctcttccgagacccgacgtcatatatgcagctttaaatggagccgcatttttctcaaacctcgacctgagagacgcctacctccaaatggaattggatgaaaaatcgaaacatctttgcacaataaacacccaccgcggcttatttcagtgccaacgtctcccatttggcgttaaatcggcaccatccattttccagcacttgatggaccaaatctgcgcaggaattccaggggtcttctcttatttggatgattgcctaatcgcctcaaagaccctggaagaccacgtcaatgcgcttcacacgcttttccaacgcatcaaggactttggcctacgaattcaactcgaaaaatgcaaattcctccaaaaagaattactttttctcggccacatcgtttcctccaacggcatacgccccgacccagcgcgctcagaggcaatccagaaaatgcctgcgccgcatgacaaaacgaccctccgttcatttttgggagcgctcaattattacggacgttttgttaaaccaatgcgagaaattagggcgccattggaccaactcctccgaaaggatgaatcctggagttggggagatgaccaacagtccgcgttcgagcaagcaaaggcaattatggtttcagaacttctgctgacccactacgaccccacacttccgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaaggcatccccatttatgccgccagccgactccaaagatgggccctaatcatggccaattacgattttgaaatacggtacatcaacaccgcatcatttggccaggctgacgttctctcgcgcctcatcgccaattatccccgaccagaggaggatattttgatcgccaacatctgcaccgaaaccgagtgctacatcagcaccattctgcaaaccaaaaccgaacaacttcccgtcactgcagacgaaatcgcagaggcgacaccgaaagatgagattttaaagaaaattttggcattcaccaaatcgaattggccaaagaaaagcagcgacccggacatcgcaccgtattttccgaaaagggaaaacattttggaaattgagggctgtttgctcttccaaaaccgcgtcatcgtcccccaatcgtttcgcaaccgaatgctgaagtccctgcacatggcacatcccggaattgtgcgcatgaaagcactcgcccgccaacacgtctattggccgggcatggactcggaaattgaacggattgtcc

SEQ ID NO: 79902 - DNA, 529 bp, Heterodera glycines
  Genomic contig location: Contig_ID=SeqID_15611; Location=2466..2994; Strand=+
  SCN-specific regions: Sequence locations=1-24,46-184,206-344,366 -374,396-529
gtaacacccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccaataatttttcaaggttatgtgaacggcaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgctcccgtcataaacaaaatctgagtttaagacgggggcgggcggaaaagttactccaatcggagtaaggctgatgttgttccatttcagtgttcttcctggatagaggaacacctgagttgacttgggtttttcgctcaagggtttcccaggcgaattattgcat

SEQ ID NO: 79903 - DNA, 1911 bp, Heterodera glycines
  misc_feature (31)..(31): n is a, c, g, or t
  Genomic contig location: Contig_ID=SeqID_15613; Location=344..2254; Strand=-
  SCN-specific regions: Sequence locations=1-172,196-250,272-285,316 -316,351-387,409-693,717-1437,1459-1592,1614-1736,1758-1911
actgaagaaggcgtacgagtctgatgttatntacggaacaatgcaagactttcatctgcacgaatcttctgacgaaatttatggaacggtcagtgagtaaataaatgaggacttttcgttcttcacacgaattcccccccccctgaaaattttattttcataatgaattcacaaatttttaaattaaaataattagaagttttctgataaagttggaaacgttgcaatggaaatcgaaaaattatgcctatttaaaaaatttaaatttctgcttttagttttctgatttgttttatttaaaaaatattcatttggagaaataataatttttctttctttcgttttgtgtgactgacttggaattacgcattttcattatcaattgacaaagtgtaagccaaataaattcatttagaagtaccaaagtggccgtgaaattgatgatctgatcaacgacgagggcgatttttcaaaagtaacagatattttttgttgggtcgacatcggtgccaaatcaactcacaaatcagggaaatgccacaacaaagagagaccgactaactatctgtctacatttagctgaacaaaattttcgcagaaatcccttaaatttttccggcgccgcctttccataaattcttatttttaaaattaactcaaaaatgtcgtaatatttttatctattttatggagaaaataatttttaaaattaaaatctgaattttagacataaaatcttgaaagtaattcctgaaaattccttaccgaggttttttggtttgcggggccatgagtggagttgggattacgctcggctattttccactttttttcattttctgggcacttaattattgaccgattaatttttgattgtggctattatgttttgtttttcaagaatgacgatgtgacgcacgagcgtgagcttcgtctggcgttcaattcgccgggaatggaaaatctgaacgatcagtttcttttgttgacgaaagttgctctacccttggccttgaaagcattaaaagatgccggaggaatcatcggaaaagatgggccgacaaaggaacaggaggcagctctcaaacagtacctggtcggtttgcgagcgtacgataattgcactaattagaaaaaataccgtattcctgcgaattctcacggcctctttttgggggaatgaaaagtgccgtttggaaacaaaatgatgcacgggattcacgcaccctaacaggcattttacccataaatatcgaactgtcggcattttactgtacctttttgaatttgttaattataaaatgatattgttccgttagtctcaattaaaagtctattttcagacaagctttctccgctggaatgttgagcagtcttccaaagcgaggagcaatcaaacggtaaatgaacataattaagtgctaagcacaatttgtgcttggataattggttccatttgttcacacctcagaaacactgaaattaaaatgagaaattttttttgaatttatttgataaattttaaagggtttttaatggaatgccccttactttggcgccctgcttaatttgcgccaaaatcaaccaattgattaaaaaattaacattggctaaagcagacaaaaacacgcaaaatggcaacgcgcaaatgggacagttccttctgttgggctattcccgtcggaactaattgtccaaaaaccgattcaattttaggaagcagagagtgccaatgcggacgaagaggagggggaggagtcgagtgagatgctgaagccgcagatttccaaacacttggaggaattcatcgaattggaacgcgaaggatgggtcaactcggcactgcaatcgttgagcttaagcgaacaagtgcactacatcaaacaggcggaggaattggacaacagaatg

SEQ ID NO: 79904 - DNA, 1827 bp, Heterodera glycines
  Genomic contig location: Contig_ID=SeqID_15615; Location=195..2021; Strand=+
  SCN-specific regions: Sequence locations=1-183,229-414,456-742,764 -787,809-870,893-994,1016-1198,1227-1432,1454-1504,1527-1535,1558-1827
  Gene Ontology: Mol. function=structural constituent of muscle; Cellular component=striated muscle thick filament; Biological process=striated muscle contraction
atgccatttacattttccctaaattttctcagtgccttcgccggcggcgctccgttcggcgccatgtccgtggctgacctgggcagtctgacccgtctggaggacaaaattcgcctgctgcaagaggacttggagtcggagcgcgagctgcgcaaccgggttggttttttgatggagctccccaatttttgaaatttaaaaaaataaataaatttaattcaaaaatttcctcgtagattgagcgtgaacgtgccgacctcagcgtgcagctgatcgcgctcactgaccgtcttggtaagttgcatttgttggcggggcatggccaccaattgatggcattatgccaacattttgctccatttttcttccagatgatgccgagggcacaaccgaccaacaagtccgtgccaattcaaattttaaaagatataattttgattttttttttaattttagatcgaagccaaccgcaagcgtgaagcggagctgcaaaagttgcgcaaactgttggaagagtcccagttggaggccgaagacgcgctgaacgtgctgcgcaagaagcacaacgtaaagcatttaggggcattaagctgagagaaatttgatgtgccattttgggtgaaaatcggagactaattaaccttcattaatatacatttcgttttgttcgcttttcaggatgcttgccttgactacaacgagcaaattgagggattgcaaaagaaaaatgcgaagtaacaataattaattataggtgtaaaaatttattggatttaaagcggcttacttttttgtgacttcttttgcctaattatagcataatttttgccgatttgtacagccctcctccgatgccgaaattaaaatcgcaaaattttacagcaatttgaaatttataccaagacggaaacaactcaaattgggacaattttgaatgattagatatccagatcaacagtgacctgtttgatcgctgttgatcacattcaatgaacccaattctctgatcactttcaggattgatcgcgagcgtcagcgcctgcagcacgaagtgatcgaactgaccgccaccattgatcaggtgcagaaggaaaagcatgcagcggaaaaggctgcagaacgcttcgaggcccaggccattgacttggccaacaagtgaaattttatgaattagaaaaaaatttggaaaaatttcaagggtggaggacttgaacaaacatgtcaacgacttggcccaacaacgccaacgtctccaagcggaaaacaatggtaaaaagttatggatatcattaatttatgatgcaattaggcatgaatatttatatcaatttcagtttaaaatttcatgccaattaatttttgtggcaccttttttgttaggcaattaaatttttcatttttccatgccaatttccacatttcaaattttgcgtgtcagttgtttttatgtaaattcaaatggcatctatttatattgcaaaattagtaaatttaattatttttggtaattagtttctttgtaattaattaattacccatgcatgactaatttggcatttatatattatagacctgctcaaggaagtacatgaccaaaaggtgcagctggacaacctgcagcacgtcaagtaccagctagcccaacagctggaggaggcgcgccgccgcctggaggatgcggagcgcgagcgctcgcaaatgcaggcacaactgcaccaagtgcagttggagcttgacgcggtgcgcaccgcgttggacgaggaatccgctgcgcgtgcggtgagcaattttatttttgttttattttggccaatcagactgatgaaa

SEQ ID NO: 79905 - DNA, 727 bp, Heterodera glycines
  Genomic contig location: Contig_ID=SeqID_15616; Location=391..1117; Strand=+
  SCN-specific regions: Sequence locations=1-176,207-337,359-727
gaagcggagcacaaactgtcgctggcgaacaccgaaatttcacaatggaagagcaaatttgacgctgaagtggcactgcaccacgaggaggtggaggacttgcgcaagaagatgatgcagaagcaggccgagtatgaagagcaaatcgaaattgtacgttggacaaacggtggcacaattagaggggggagaggggctttaataatttggatggacattagggtggtaattagggcccgaggcacaactcgggccgcgcacttgtagattatctaagtcatgatgattggcacatttttacgactgaaatagactttttttggcgtcggaaactgataaaaatttccccgaaaattttcagatgctgcaaaagatttcgcagctggagaaggccaagtcgcgcttgcagtccgaggtcgaagtgctcattgtggacctggagaaggcgcagaacaccatcgccatactggagagggccaaggtcgaaaaaagggaaaccgacactaattatgcctaaatggagaaaataggcattccatcgggactaattaggccatcaatggagaaaatttaggtattcagtcgatattaattcgtcttgactgagggctaattaggtcgcaaaatcatgagaatctcagctatgctaaccatggtccgaatcgagggactcacgcgactaatttatgccagaaataaaccgggagtgaatctagcgactaattag

SEQ ID NO: 79906 - DNA, 1752 bp, Heterodera glycines
  Genomic contig location: Contig_ID=SeqID_15617; Location=54..1805; Strand=+
  SCN-specific regions: Sequence locations=1-527,549-613,637-1266,1322 -1601,1644-1752
atggattctcaaaaaagtccgaaagtaaacggaaaaaatttgatgggaacggaaattaaggattttttgggaaaattcgacggaattgtggcacaattgagggcaattgtttttcaagggaccgaggaggtaatggagacggacaacatcgactttgccttgacctgggatatgcagtgcggcggactcggaccggagcatcgaaattgtgtccaattgacaaccgctgatttggacccagttttggagagggccggattcggactcaaggtggccgaaagcagactgaagccacaaaatgcaaaattcgggcttaaggtcgtcggaactccgttgaaggctttgttggccacttttctgttaaaaaccaacgccatttcttcatctgcagccggcagaaagttggcacaatcagtgattggagcaccagtcgggtttgaactgatcactttcatcggaagccgcgaagaccaaatcaaaagtggccgaattccggtggaagaagatttggaggccatcctcgagaaatggaccgaatgctgtgcagttacacggacgaaattggcaaaatgtggatttggcgccatcaatgtgccgattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaattggaggacttgtggccgacttctcagtttattggcgccacccaaggaagtgttggagatgtaattcgggcatttgacgcagtggccctgtcgtccaaagtcaaagtgggcgtgattataatcgggcgtgacgctctgatcagaaacgaaacggccgacaacgtcatggagaagattggaagactcatccaattgtgcgcccaattccaacatgttcagtttttttggctgcctccgccgttcatccgcgatcaacaaattgaacacgacatgctgatcgaccgaatgaaggaccatttcgcgctgatcaggggaaacattcgctatgtgtcgacaacaccgtcaggccgatcgcttctcgaaatttggcgctatgggaacggctacaacaccgaacatgtttctgccgaaggaacgatgaaggagaagggactgtacatgctcaaggcatggttgatgacacaagtcaacgatttcccgggtgatcgagaattggggatcgagaagaaaagggcggagagcgaagagaagggaagagggaaaacggaagggaaaaacgtgagaacgggagaatcagaccgacaacccagtcaccgccccattcgatcgccatttcgtcacaccggccatgcttttcatcgttcgaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctcattttatttttgattttatgatatttttggcattttgttttaatgtttgtgatttcgtttttgttttcgttttttgtcctcagactttaatttggaattgcctgacataaaataataaggctttattctgtgtgctttaattgtgtgcaagtgctgaactgttcgacgtgctgctgagtaaaa

SEQ ID NO: 79907 - DNA, 2105 bp, Heterodera glycines
  Genomic contig location: Contig_ID=SeqID_15618; Location=450..2554; Strand=-
  SCN-specific regions: Sequence locations=1-218,240-456,479-480,542 -711,733-1311,1486-1489,1515-1624,1663-1788,1810-1831,1853-1889,1911 -2105
atgccaaccctcttaaaaggtccgtttttaaaggaattcccaaacggacgtgtcgaacttgtgccatgggaacaattttcgatgggccaatatttgcatgtgcttgttgcatcgctgcgaaagtatgcggcgctgtacaagcagaagcagtgagtttacttgttttaagggttaaacaccgaaaaaatgcgaggggataatcattttaaaaagagggttctgtttacaataattcatttatcttggtaaaaattatttttttacggaattgttatatgtcaaatgtgtaaatttcatcttgtaaaaacaaaattacgtgtttattcttttcttgtctcaaaaactacctttttatccttgtagagatttttacaattgaaaaatttttggcaaaatcaaagaggaattgaatcttttagcgcttttttcaaaattttatgatccattctaaattttcaaaaaatttgcaaaaattaactcaataaattttaataaattttttcttcgtattttttaaaagatatttataatatttttttttcttgaaaaatatctagaaaacaattttcctggtcggaaacggtatgggggggagggcgaactgctcccatccatggatgccttgtttacagaatatcaaaaaaaatgacaaaaaatttcccttctctccacagatgctatgtgatcattcaaaatgtcgctgaacacagcggcagtgcggaagaggacacggaacggatcaccagcattgtgtacagcgtcgtgtcctccgatgggtttcgacagcgatgcaatcaaatcaaagtagtaataatacgcattttttagggaatttgtcacgactcgatcccaaattttcagcagaaactcgacctgttgaagaactccgccgtggccaccaacgcggccgggcagccgattgtggtggcgagcggccatttgccgctgcgaattgagcgtttgccgcgacgcggcaccggcagcagtgcgtcgcgtagcgcaacaacggtgacgacggcacgaggcgagggccaacagcaacagacgacgacaatgacaacgggagcagataaacagtggggcgaaggcaaaacggcggacggtgccaccgggggtgaacaaagtcggcactttggcaatttttggggagacaattagtttgggttaggaaaatacattgaattgtatttccagaagaatatgactggtcaaatgcaatgggatcgtcgcgtcccgcacttatccgtgttcgcttccgtaatcgtgaggccgcaattgcattctgtcagctgttcagggtgggcagggcgtttttctcttttgtttcgtcttttcctttttccccctcttctctacttctcttttattttctctcctccgtttcctttcctcttatcgcttcctttcacccgccctcttcctgtcttatcattctcttcccctctctcttactctttcttcttttccctcccctccactctctctcactcattttccccaaattttaggaacggcaaatatttctgcgtcaaaagagacagcagcaaccaaaggggcaggacgatgagggcattgtgagacagcacgggacgggcattgattgtggggaccgtgaaacggatgcagggaacgaagaagaaaaagaggagggggacggacagcagacggactcctactcggacttgtccgacttggacgtgttcagcagctgcgatgaggacaccaacggtggccatgagaagacaccgccagtgacgagggaggaaacggcgaccaaagaacacggaaagaaggagggcggagagacgaagacggaaacggaagaaagtgttggtgaagagggacagcagcaaaagacggagagcaaagcgaaggcgacggaggagggagacaccaacaacaacaccaaagccagcaacagcggcatgaagcggaagaagatgcagtcgtcggcttcgcagcgtcaccgtcatggccactgcagcgaacgccgccagaaacacaagcagcacctgttggactcgctcatctgcggtgcgtttgcccaccgggacctgacgccgccggagttggcacttggctacgcactccgtcagcactgccgg

SEQ ID NO: 79908 - DNA, 837 bp, Heterodera glycines
  Genomic contig location: Contig_ID=SeqID_15620; Location=186..1022; Strand=+
  SCN-specific regions: Sequence locations=1-123,184-264,347-674,698 -762,786-796,820-837
atgtccaattctaaggacaagtaaaaattttatcaaacgaaattaaaaacgtgtcaattttattcaaaacgatttgtattgaaaaattcggttgaacttttataggttttcagattttatgacaaaaaaaaaaaaataaaaaattttaccttatatatttttatatataaaaaaaaaaaataagaatgactgaattataaaatgaaaagtaacattactgttaggcatatttaaaagttatcattttccggcaaacccattttgaataattttaattgattttataatttttattttaagaaagtaaatacaatttgagaaaaaaaaattaaataaaaaattaattgttagtgggaaagacatgcgggccatcgacgagtctgctccgtcaatgtccttgtccacggacgcgtccacaccctcacacagcgcaacatatcaaatcaatttgtttttaatttaaaaaaaacaaagaatttttgaatgtttttaaattttgggtcttcttttttattttcgaattaattttcattttttccatttttctttttctgttattcttttaaagctaatgccaaattttgttttttcatttttgaactgtccaataactcatcccgattttcttacaaattaaggttgacgttctggcaatttttatacaatagacccacaaaaatataaaaatttatttttagcttgtttcgtaaaaactgtcattttagctatttttcgacaaaaagatagcatataactatctttaaaagcaacaaattttgcattcttggtaatattttcgatagctcagattttctctattatcctgcaaaatttcaa

SEQ ID NO: 79909 - DNA, 407 bp, Heterodera glycines
  misc_feature (22)..(22): n is a, c, g, or t
  Genomic contig location: Contig_ID=SeqID_15620; Location=1330..1736; Strand=-
  SCN-specific regions: Sequence locations=1-247,305-407
atgaatttgaacaaacaagaanaatattcaactgaagaatggaaacaaaattatgcgaaaatttgtaagaaaattggaatttgctatggcacaatttgcagatggaagaaacaatttggaattcgctgtaaaataacggaggatgaaaaaatggaaaaaatgaaaatttattggcaaataaaaaaagaaaatccgaaaatgagtgacaaagaaattggaaaaacattgaaaattagtcgaagtagcatttttaattcgaaaaatcaattagaaaaagaaagaacggaagaatgaaaggaagaaatttactttttcgcatttttcgatttaattttctgttctttccttagcccatctcgaattgtatagtcaatattaaaaagtagggacactttgcttcaaataaa

SEQ ID NO: 79910 - DNA, 485 bp, Heterodera glycines
  Genomic contig location: Contig_ID=SeqID_15621; Location=40..524; Strand=-
  SCN-specific regions: Sequence locations=1-330,352-485
atgcaaattggttacgtcattagccgaaagggaatgatgtacgacgtccacttccaagatggatatacgggacggtaccatgcaacaatttggaggagtattcaccggccaagtatgaaggacctggatttgtggactccgaatcgcaaatggaagcgatcgccacgcgaactccaatggcaaacgttgaatgccgaagaagaatggacgtgtcggacagacgtgtcgagaaaaagaatggacgtgtcagatgaaaaagatcctttttaagggtgagatgttagggatgggactcaaatggccgccccaattatttatttgtttatgtccctcgcctctgtactctctctcgactttcctccccataaatagtccgccctttgacccattctttcacttgtatcttcacttcatttatttgttgcatcatccccaatcgatattccccattgcttcatttgttatttaattttgtcttcaataaa

SEQ ID NO: 79911 - DNA, 1445 bp, Heterodera glycines
  Genomic contig location: Contig_ID=SeqID_15623; Location=1389..2833; Strand=+
  SCN-specific regions: Sequence locations=1-138,160-305,328-1445
atgattttggcgaattacgactttgaaattcgctacgtcaacaccacatcatttggccaagccgacgttttgtcccggctcattgctaattatccgcgtccagaggaagacatcctgatagcaaacatctgtgctgatacagattgcttcataaattctgttttcgaaaacagaatcgatcaaatcccagtgacaaccaccgaaatttcttcagccatggccaatgatcaaccactccaaatggttcttcaatttttaagaaacggatggccaaccaaagtcaccgaatctgaaatcagtccatattttccaaaaagggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccaggaatggactcggcgattgaaaaagttggagcacgtgcgaagagtgccaactgggccagaaaaacccgaccaaagcgcttctttcgccatggccaacgacggacaaagtgtttcagcgagtccacatcgattttgctggcccctgctcagacggtcaccaatatttgattttgatcgactcattttcaaagtgcccagaagtctatcgtatgaatacaatttctgcctatgccacaatatttgtgctccgatcaatcatttttcggctcggaatcccagaagaaattgtttccgacaatgggacccaatttcgatccgccgaattcgccacattttgtaaagaatttggtattaagcacatcttcacaccgccatttcacccacaatcgaatggccaagtcgagcgcttcgttgacaccttcaagcgttcgatgaagaaaatgtcaaaaagcgaaaaggattggatcgaaaagatgctattctcctacagaaccactccacacgtcgccttgaatggcttttcaccggaccaattatttttcggcaggaaattgcgcaccaaactgacgctcatccatccaaaaggggaaaaagccgaaaattttgatcaaaaatcattcaaaaagggacagtcaaaatacaccgacaaaatggctcaaaattttgatcggaagcatggatcaaaactgatcaatttccttccaaatgatcatgttcttctgatcaattatcggaacaacaagacggaatggctccaagggaaaattgttgagaggctccataaatcgcccacatatcgtgtttatgtgcctgttctgcgtcgcgttgttcatcggcacgcaaatcagctaaggcgacgacatcttttggaagacgaagccgaaaaagaggcacctcaagtcgaacagccgccgccggttgtcgaaccgcctcgtcagccccaacaaattcagccagccaattccccattgaaa

SEQ ID NO: 79912 - DNA, 316 bp, Heterodera glycines
  Genomic contig location: Contig_ID=SeqID_2475; Location=30..345; Strand=-
  SCN-specific regions: Sequence locations=1-53,76-198,259-316
atgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgaccaagagaatgaatcaattgatgaagagcaagaaaacgatgatgaagaagccggagaagaagaagatgaagatgaaaaagaatatgatagtgatcaagaggacgaatcacaagaaatgcattcaagtgatcaaacacatc

SEQ ID NO: 79913 - DNA, 3799 bp, Heterodera glycines
  Genomic contig location: Contig_ID=SeqID_2475; Location=1288..5086; Strand=-
  SCN-specific regions: Sequence locations=1-118,155-219,245-275,297 -298,321-378,400-728,750-1019,1041-1062,1084-1243,1265-1393,1415 -1867,1889-1891,1913-2040,2072-2154,2178-2208,2230-2245,2269 -2275,2474-2532,2571-2639,...
  SCN-specific regions: Sequence locations=...2661-2713,2736-2793,2877 -2883,2905-3143,3168-3177,3200-3406,3428-3799
atgtgtagaccagattcactgggcattaatgcttgtaattataatgataattttatatgttatttcattaagcctccaaattattcgaatactcacacgttttatccattggattttacaatttatttttaattgttttaaaagaaaaccaaaagtaaatcgaactagaatttcaagaccaaggttaaaaagaccattgatttatttaatcacttccagtttaattttatttaaaataatttttgcttgtgatgaagtgacgaatttagtcgctggaacaaatgactgtgctgtaacccaagaaggaaaaattgaatgttcttatgaccaaacaacccaactctctattacacctgaacacttaacctgcttaaaactcgacaatacaaaaactaacaccactatggaaacactacaaattacaatagaaactttaacaataatttgcaccgaaaaatctgattattttacgagaggttacgaattatcttcgacatcacaaaaaagatgctcaggcgctgggaaatgtaccggccaaacttgtcaatcagtaaaaatgtcagaccggaatcccgaagtgaatgatcacgctaataatcaaccaggttattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaggcgacaattaaattgtctatcaatccagaattaacctattctgttgacttgaaacccggaattttaacacacattggtgacgagtctaatagttctatatctgtcacactgacttcgacttcaattccaccgacgccgttatttggttcgacatttattatagttcgcgaagaattaaaagcagcaatagttgcgaacgaaaatttactcaaaaatatattacggtgtaaaaacaaagaagaagcgcaaagttttagttgcacttttccaccagaagcatgtcaatgccacggaggtgattccgttgtacattgtgaatgcgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacaaattttggtaccgcattagccaatgtggaatgtccaagtcaaaaggtccaagtgaattgtgataaagaaggaaaagaacaacaaatccaacttgcatataataagcaaattattacagaaaattgtggagttatatgtcccgatggcaagtctgaaattactttaaaagctaatttggaatacatatcacaacaagatactaaaattatccccgctaacaatactaatgaaaaacccattattggaacttccttggaccaagtaactgatataataaattttgtttacactcttattaaaaccaattttttcaccatatttattattatcatattcatacttattctattttttctaattccatgtctactacctattatatatagaattatgtgtgcttgccttcttcgttcgcgtgggagtgtcgcgacagcgcgaaatcccaaaataaagaaaggaaaaaataaaaaacactagaaaacaaaatggggaaaaacaaaacctacataaacaaaaataatttttcatttaatttggaaaaacatattagaaaaaactatcaaaaatataattataaaaaatgggaaaaccttttgaaatgaataacggaaaattgtttgaaaaggaaaagtgcatttcctcaggaatgaaaggaacgaaaattaattgatattaaatggcgaattctgttaaggattgcgttcgtaaacaaattattaataattaattaaatatattaaaggaattggaattgcaaaggaaaaagtggaaaacaaacaattaatgggaaaatggcaaaacccaaacggatataacaaaaacagattttaattaaaaattataaattggagcgtactatggtttcaaaaaagccgtataaaaggggctgggttttcagtgatttcagatcgctcattggttccctccgaagtttccattccttccccgtgccgtgctctgcgccttccctgtgccgtgccctgcgccttccccgtgccgtgcccgtccgcctttcccgtgccgtgccctgcgccttccccgtgccgtgcccgtgcgcctttcccgtgccgtgcccgtgcgcctgccccgtgccctgctccttccccgtgccgtgccctgcgccttccctgtgccgtgccctgcgccttccccttaccattcccctttgtgcccattttatcatgtcggattatatttgttcattaattaattatggtttaattacccaagtttgagggtacaaaataaagtgaatttttggcgcctttggtctttaatttttgtcaactcgctctgaatacgtccgcccagcccattcaaacttttttgccgtcatcagaacgacaaaagtggtgccacgacccgggaccaacagaaattcgtccatttgctcatcaaaacctgaccaaacgtccgtcaaacattcaacctaacaacaaaacacgagtgagctgaaacagttgacaaaatcaaacaaaaataaaccaaatcaatcaaaaaaaacacacgggtcaccaagcccaattaaaccaaacaagcaaaccaataaacaaaaaataaattccaaaatacttcagtgaaacgagtgacccgcgcaagttctcgcccaccagtgagcaaattgaatcaagaagtggcgaacgaagaagtcccacccataaaaagtgatcaaaattaaatcattttctgatcgtaccgatatcccttaagtaactcgctcagttacaccaaccaaatcgccacaaaccgagtcggcaattgactcggcattaacactgtcgagcgagacacaaaaaaaattaattgagctaaaaagggctgaaaaaatagctcagagcaaacaattaaaaaaggcgataaaaacagtaaaatcaactgttcgtgccaaccagacggacgatattattcaaagtgaaaaagcgatagaaaagctaaacgacattcgcgaaaaaacaccggagtgtccaaatttccacgactccgtcgatccagagactgacggaagtttttttcaaaaattgaagagctgggaggttgatcacaaagaaatttgggatcaagcaattcgccacgccaaaaaacttgaacagaaaagaattgacagtgtggaaacgcaaaccaacaacatattggaggcaactacaaaagctgtgaaaggggaagagtttaaccgaactctgatagaaaaattagttcgtctaattcagtcaacaggctactcaacaaaagctggtcaagaccaagcacttatcagcctacgcaaaattgaaaacaatttgaagcaccaaagacgctaccttaccgcccaagaaaggacgacacattatttaaagaagacttttggcttaccaactgaacagaaattaaaatcgaacaacgattccgacactacgacccaatcaactagttctaatctgtgatcaaatttttaaaattgtgataataattgttaattccataatcaataaa

SEQ ID NO: 79914 - DNA, 1017 bp, Heterodera glycines
  Genomic contig location: Contig_ID=SeqID_2475; Location=5133..6149; Strand=-
  SCN-specific regions: Sequence locations=1-102,124-400,438-857,909 -1017
atgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaaagacaaacatattattaaacgacgcccaccttattgtggtgaaaaatgtaaatgtccagagggattcaaattttgtagttttgcatcttacaataaaatcaaaaatgaatcagttgaaaaaattaattaccaaagcattatttcgttcttcaaaccaaatatctgcgcaccaaataaaactgaaaactgcccaatcatgaaaagaaaattatttaattcaattgttctttatgacaattcaattcacatagtgaaaacattaaatttacttttttcccaaattgactcaataaacaattttcgttgttttggggagggcaatctgacgattggtactccaatttactgtcgagaacatgactgttttaaaaataattcattcaaacaaaaatatggaacaaagttttgcttttatgaaccctatgaaaaaatttatcttgtgaaatctgatgaagaattaattcaaatcaaagcatggggaactattgaaaaaatattttacttgccaaataatttaaatcaatcatttattgaaaatagacggaataaaagagaagaaaactcttcaatcaatgaagaagcaaccattgagtgtttaaaaggaggcattattattaaagcaataaatgatatacaagaattacaaatttccattgaaaattatacaattataaaaaagaacccccaaaaagaggaaataatttatttacccccaaaacttacatcctttgaatataaacctatcattaaatttataagtaatccagataaaaccaatgagaaacaaatcacatgtcaatcatctcccgtatcgtga

SEQ ID NO: 79915 - DNA, 257 bp, Heterodera glycines
  Genomic contig location: Contig_ID=SeqID_15625; Location=2421..2677; Strand=+
  SCN-specific regions: Sequence locations=1-62,90-257
tgttcaccttttgtcaaatccgtcatcaccgataaaagacgcactttgattctgtcgagcagtcaatttttgcatctcatttatccatttttcctcatcgcccgctgcaattggacaacgcatgagcataaaaccactttcatcttcttcattccttgtgatgacattgtcaaattctccccagtcaattcgttgatcatttcaaatggcaaaacggagcccattgaagaggacggcggaaagtaaacgccaatgac

SEQ ID NO: 79916 - DNA, 2228 bp, Heterodera glycines
  Genomic contig location: Contig_ID=SeqID_15626; Location=51..2278; Strand=+
  SCN-specific regions: Sequence locations=1-585,607-1562,1584 -1760,1782-2152,2175-2228
atggaggaagaagtgagagccggtgctactgttggtggcgtaatgcttgaaaagaaagttattgaatttctaaaagatgagtgcagcaaaggccaaacagaatcagagccaatggaggaaaagccgattatggggaaaatggtaacagtggaacttgttattttggagacaccaacaactggaatgctggatggtggagctcaaatttctttgatcggtggcaaattcttttatgaattagtgacgagtggaaagttaaacactatgaaaagtggttttaaacgcgtttcaacgcggatttctgatgttaatggtaaagagttagagtgtttcggagtgattactcttccagtctttcgcaaagggtgtagtacgacaaacatttgctttcacatcaccagcgcaccatttgggtatgatttactcattggaacgaatgcgcttcgttcattgggcttttgtctttttgacatcccaaacaaggaaatgatcaattttgaggaaattcacccgaaaaaggaaaagtctgttggaattctttatcaaacgactctcaaaccgttatcaatgaaactggtaacattgtcagttggaaatgaatggaatgacaaagaagtaattgtcacatcgtcgaatgagaaaagtttgcatagatttgagccaaccgttgggaaaatcaccgcagggaaaataaccgttccaattgtgaattcatcaattgaattcgtgcaagttgacgaaaaagaaataattgtcgagttgtttccgacaaatcttttcgcaaaggcggacgattcgcttggctcaccattgttggtgaacaatcttaaattgacaccaaaaatgaatgaaattaagtgccaaagcatggaaattctcgaatgtttgaaaagtcaggcaaaagacatgtctgatcaagagtttttacctctcgggcgattgataagcgaatttgacaacatcttcgcaattcgtgaggaggaattgacacagacggacatggtcgaacatcgcattgacactgaaaatgcgaaaccgattaaagcaaaacatagacctgtcccgtacgcttaccgagaaaaagtcgccacaatgatcaaagattatctcggaagaggtttgatcaggccatcattttcgccctgggcatcacccattgtgatagtcccaaaaagggatggaactctccgcttttgtgttgattatagagggctgaactctgtaacagttaaagatgcatttcctttaccaaacatcgatagcactttgttagcgctcggcggaaaaaagtttttctcggtcatcgatttcatgtcaggatattggcagataagaatggaccctgaatcggttgaaaagacagcatttgtgacggaattcggacttcacgaattcaatgtcttaccgtttggcctctgcaacgcagttgcaactttccaacgcttcatgacgcgtctttttgaaggaatgattaacgattctgtttttgtgtacatcgacgatgttttgatcgcttctgaatcttggagtgaacatttaaagcatcttcgagaagttttcaagcgaattgatgaagcgggtttgaaactgaaaatttccaagtgccgttttgccgttaaagaaattccatttcttggccatatcttaactcgagaaggtgtaaaaatggacatggacaaagtcaaaccagtcattgaacttccaacgccaaccagtaaaaaagaactccattcactccttggattcttaacttactaccggaaatatatttttggttttgggtctttggcagcaccactgtttcgtctcctaaaaaaggacgtgaagtttgaaatcaaggaagttgaattaggcgcaattaaagcactaaaaaagagcattttggaccacgcaatgctttatttcccggatttcaaagcagcagttgacgaccaaaaacggcaatttgtgatgttaactgatgccagtaaaattggtttagcagccatactttgccagccggacgaaaatgggaatttaagacccatttacttcgcgtcccgacaatgtaatcggcacgaggcgcgatactgcccaacagagcttgaggcgttggccatcagatttggcacaaagaaatatgctcaatttatcactatgattccaacaagagtgataacagaccatcgtgcactcgtttcaatgttcaaaagcaaaaacgagactggaaatagtcgtgtggataaatg

SEQ ID NO: 79917 - DNA, 628 bp, Heterodera glycines
  Genomic contig location: Contig_ID=SeqID_15627; Location=730..1357; Strand=+
  SCN-specific regions: Sequence locations=24-87,229-525,550-628
atgagaaacccagcggaaaaagaggtaaatgtgaaaatgtgggcggaaaggaaaaaacgcaccaaagggaggggaaaggggggggctaaataaagataaaaatgattgcccaaaaacccatgaaaatacaaaccaataaaatacgaaaacgaagtcaaataaaaataggaatatgaatacgaaaatataaatacgaaataacaaacaaaataaaaattgcaaaaaaaaactcaaaaaacggaatggcctgtttcggtgccaaatcaattaaataaataaatcattaataccatttttgataaaagtgaagacagatttctgagtgtttttggggagattgatcactgatcagtcacaaattttgaattcctttggcccatttcgaatcccgcgccgaattcatacaaaaagtcaaaaaaagcagtgaaagccaacattgttttttcctttctttcagctgttcatctccgaaattgtcgaaaagtatttgaaggaggaaataggcgaagacaaaagcgacggaagttcatcctcttcttcttcatcagagtcagcagaaacatcacgggaaacggaggaggacgagcaaatttggggaggaaaagcacgcactgatcagtcccagtga

SEQ ID NO: 79918 - DNA, 1077 bp, Heterodera glycines
  Genomic contig location: Contig_ID=SeqID_15627; Location=2977..4053; Strand=+
  SCN-specific regions: Sequence locations=1-487,510-875,898-1077
atggcacctcccaatccgtcgttgcaccgcgtccatccgttgagtccaccggcggtgcctccccaccacgggaggcaacaatcgctgctcaacccacaaaaagggcatatgccaacattcagtgcagtgcccaatgaccaaaaggagcagccgaagtaagttcagagtaattagtagacaattagcataagccattagcagggacggataattatggcttttgtttttataattgggtcctttctttcccgaaaaggcgccgccgctcgctccgtctgatggcatttgcgtcggtggcatttgccactgtgtcggtgttggccagtgccatcacattgccaattgtgtacagccatgtgcagagcatccaggcatttatgcagaacgaagtcgacttttgcaaggtgagagaaagcgaatcattcattcattgctaaaataattaattggtcaccgagaaaacttttacgatggcaaacaaagagagaatttatttttataaaaaattagagacaggactgaagaagtctcgagaatagactcgggatgagaccaagaccacgaaaccccaaagttttcatctaatcaaaacctagaaaatcgagcattttaggcatctattatattgccattccttttttagacgcgctcgcgtgatatgtggcgcgaaatgctgcacgtccaggcgattactggtggtttgccgacgtcctccgacaacggcaccgccacgctggctgtgaccgctgcacgggtgaagcgtcaaactgttggcaccacgtcatacgatgcccaactgctagcgggtgcagtagcgggtggcggttcgccgccgggcatcagcggaaacccgcagggcggcagctgctgcagttgccaagtgggcccgccgggccctcccggaaccgccgggcagagacggacggcccgggtcagttagccaaagaccaattaggcccggggcagggggataaaagaattgtgccctatttcagtgccccaggacgtcctggaaacccaggacctccgggaaagagatggcgtgctgttgcccggaccggtgagatgtggagatga

SEQ ID NO: 79919 - DNA, 1387 bp, Heterodera glycines
  Genomic contig location: Contig_ID=SeqID_15628; Location=188..1574; Strand=+
  SCN-specific regions: Sequence locations=1-827,850-899,998-1054,1106 -1254,1276-1387
atgtccaaggactcggttggttgtactcagaaaatcagatccttttcagcttttttggccttgacccccaaactgacgagaaaacagctatcaaaattcagaaaactgataaaaaaaaattaatcttaaaaattcactaaaaattccaaacaaaaaaaggtcgccgccggagaaaaatttggacctttatatgaaaaatcggttccgagacacccccccccccccctccattgtctcaatcgtccgtcgtattgcgctttatctgacaatgagacaccccttgcacattatgatatgtgatatgttccattgtcaccttatttatacgttcctttactttcattaagtgtttttcttttttccttgaacattttatgtatattcgggatttcatgtaatttcttccagaaacgacgtcatgatcgcgacagttcggactacgtggaggaatcgaagcggcgatgcgacgaagcgcggaaacggcaaatcgaccgggaggaccgcgcacggaggcgttctcgggagaagagggagcaggtggagaaggagtacgaatactacttgcaaattgcgtgttcggagtccaaaaaggagtcgcaaaaaaacggcggacagcagcacaatgttggtttttgagggattttaccaattcacactttaatagtgccgaaaatcagaaaaggcctttttaattactatggaaatcgacagctcttaagggctttttctggccaaataaggcgttttaaaagttcaatctccaaaaatcacaaatgcttaaaacgcttttcatgggaccaaatgagttcttatctaatggaaaagtcatttattactaatatttattaacaatattactataattagttgtttttttactattgtaatttttccgattgctctttttcttttcccttttttgtgttcgtttcacttcgttctttttccatccttttttcgttcattccctcctctcccttcactcctcattcttttcggcaaaactctccgcttcttaaatttcacccgatcagtgattttctcttcactcatgcttcgccccctcccctccccttttcctttctctctctctcccacttttccttgggatcgccaactgtcccaaacagttgggtcgtccgtccgtccgcaaagcgttgtgtagcaagaaacgcacgaatcgcttccctccttttattatgggtggaagaaacaattgagcaaaaagagaaacttttccaggcgtttagtcaaggaaaaagcaaaacgaaaagggcaaatcttaaagttttttatgcacaccgcttgcccccctccccccgaaatttttatttttaccgacgactctcaagggtttctcttatccactctctgaatctgatttaca

SEQ ID NO: 79920 - DNA, 1767 bp, Heterodera glycines
  Genomic contig location: Contig_ID=SeqID_15628; Location=2230..3996; Strand=+
  SCN-specific regions: Sequence locations=1-542,564-1070,1099 -1159,1182-1487,1509-1767
atggcaacgacccgaaaaattagttctgaatccaactcaaagaacaaattgttcgcagaaaaaggttcggtaaatcggacaacaaaatcatccaacaaaaaacagcagcccatcgttttgataccgaaacgacgaaagcacaaaaattacatttccaagcggaagggcaacaaaacttcggctgcacttcgccaatgcgtctccgacccgtgcatttacaagagtttcgatcattggcatgaattgtggaaagaacctccggacggatgcgatgggccatgccgaaagacgagcattcggcagcgaaagaagctctccatgccaagtcaggaccagcttttctccaaccgaatccaacaattggacgcggctgccgcgaaacttcttgccgttgccaatgcgtcgattgacgaggaggagaaaaagatgatgaccgtttcagcatcagaacaactcgatgtgatgggcgtagtttcttcaacggcaatgaaaacaggacaacttgatcgaaatccaacgaggaatggcgccagggaagaagctgaattcgtttctgagataaatgctggaaacagccgacggaactccaaaaaactgaacattcagccatcacttgatatcactacaccgtcaacatcaaaacaactcgaaaaacaacaaacaaaagctccagtaaggaaaatctctggaaggaggcgcagaattgaggaattgtcgagaataaaagaggaattgagaaatgcaaaactaccatcttttgatgacatttcgaggcgtcactctcgacttcaaaaaaaggaggacattgaaaacgcacaagcgaaaagcacagtcgacgcagtttctgccgcctttcaatccacacaacaagatgccaatgccaagaaacgatccgtcggcgcttttccagcctctttgttggataacaatagagaaaaacaaaagcacaaaaaagccacagtgatggggaagccgccagcatcaccttcaatgcttgcgcgtcatgagctgaacaggttggccgagtattcgggtcaatcggctggacaatctgcggcaaagtctcccgggatcaacaacaacaataacaacattaattctgtcatctcgccttgctctccttctcttaacaattgttcgtacatgcgtctgcggaatgctccgccaacttccgctgttcgtccgccgtcaaaattacctcttgtggcagtttccattgaccaggatttcgacaatccaatgtttggatttgacacggatattcgagtccctcaagagcatcaggctgaaacatcaacaaccgaaacctttgatctgcttgcttctgccgttgatactgatgccaatgaccaatgttccgccgagagttgcaatagcaacactcacaattccgctcatcaacaacgggccaaaaacatcactccattggagttccaggcaacaattgaactcaacaattctccacaaaatattgctgacgcagaagacgaggagagagaagacgaacattacggaacaccagcggatgaaacaactgaggctcgggttcccgtgttgagagtgtcaaggcacggagttggacgtactgagcagagtgatttggatggcaggcatcaaatgccatgccatccgcccgtccctccgcccccttacccgggcagacccaaacccgtaaacccagcaaccgcttcgctaattgcctccctccaacttccgccatcagtttgtgccaaagtaacaaaatcattgccggtgtggatcagtgga

SEQ ID NO: 79921 - DNA, 466 bp, Heterodera glycines
  Genomic contig location: Contig_ID=SeqID_15629; Location=452..917; Strand=-
  SCN-specific regions: Sequence locations=1-180,205-297,319-466
atgattttattattaaaaccgcttattgttcaaccaatgttcggtatcattcgttttttattcgtacctctcgcctctataggtgtttgcctaaagaggcgaggttacttaattccattgactttgctaaacttcttgacacctatgatgttgattctttacttttgaaaccacctcatctcattcagtgaccaaatttatttatattgttatttatgtcggtgtcacgcttttgcgtataaattgattgattgaaattgttcggaggtgtgccaataatccgcttaaaatatttctaatttttattacattttttcagaccccaacgcattgtttgcccaacggcggctcatcagtgttgttggcacccaaactgatgagcacatttcagcacgaaaatggcgggattagcattcgggacacttatgagggcgatttggtctgacaacggacagaaagaaataaa

SEQ ID NO: 79922 - DNA, 1639 bp, Heterodera glycines
  Genomic contig location: Contig_ID=SeqID_15629; Location=1015..2653; Strand=-
  SCN-specific regions: Sequence locations=1-323,365-410,433-451,500 -639,661-777,799-1017,1040-1267,1289-1328,1351-1639
atatgagttggcggttttaagaaacggccttggcggttttaggaaacgccctggcggttttaagaaacgcgcaaagtggcggtttttagaaacgccctggcggttttaagaaatgccctggcggtttaagaaaacgcccaaagtggcggttctaagaaacgccctggcgttttaagaaacgccctggcggttttaagaaacgccctggcggttttaagaaacgccctggcggttttaagaaacgccctggcggttttaagaaacgcccaatgtggcggtttttaagaaacgtcccagcaccatctataatttaaatcactttgataattttataactattttttaataaaaagtatttaaaaatgagacttatgtattcgttgttattcaaaaaagtaacttacagttgagcttttcatttcatatctttataactcacctgaatgatttctttatttatattataaaattaatttataataaaattatcaataaaattgatgtagaaactttaaaagaattaattaaaaatcaaaaaacccttaattggaaaaaatcaattatttatccagtaccgaaaatacccaatccaataaatcctgttgattttcggccaatttcacttttatgctcaatttcaaaaattctagaagaaaatattacccagaaaatcactaattttgttgagacaaataatgtacttccgaattgccaacatggctttaggagaaaacactctgttacaactcaacttttggaagtcattgatgactttagtttagctttggaaaacaaaaaatcaattgatgttatatattttgatctagcaaaggcatttgatactgttccacacgaaagattagtttctaaactcaaaaatgttggtataaatggtactttgctcaaatggcttcaaaattatttacaaaatcgtacattttttgttcgagttggttctgcgttttctgatgaattcccttgcttaagtggtgttcctcagggatcaaatttgggaccacttttgtttttaatttacttcaaatcttcctaatttttgtaaaactgaaaacgttgaaattaagctttttgccgacgatcttaaggcctattctatactatcaaaaaatactatttctccactccattctttcattaataaatttcggaattattgtgaattaaatggcctaaaatcgctcctaacaaatgcttagtttcacatcttgggcctaaaaaccctaatgaatgttacttaataaataatattccaattttgaaaaatgaagaaggtgaaccagttagagaccttggcatttatttttcaaatgacttaaaatgggaaaaacatataggatttattactaaaaaagcaataagaatatcttttgctttactcaagtcacttaaaactaaaagcccaaaaattctcataaatatattcaatgtttattgtcgatccattttggaatttggttctccgatttttaatccatatatgaaaaaagacattgatgctcttgaaaatgttcaaaaaacatttttacgtattgtttttagacgtaataataataaggatgatatacccgggtataacgaactcctccaactctttaaacaagaatccctcttaaaacgcaga

SEQ ID NO: 79923 - DNA, 76 bp, Heterodera glycines
  Genomic contig location: Contig_ID=SeqID_15630; Location=840..915; Strand=+
  SCN-specific regions: Sequence locations=1-76
aattactggagttagcatcatagctgtgcttttccttgtctttttgatgccttcgcaaaatctggtgcgcttctga

SEQ ID NO: 79924 - DNA, 87 bp, Heterodera glycines
  Genomic contig location: Contig_ID=SeqID_15631; Location=2998..3084; Strand=+
  SCN-specific regions: Sequence locations=1-19,45-60
aattttagacaatgctttggtttcaatgaaaaataaatatgagaaaactaacaacagggatattgagaaaagaaaaagaaaatacaa

SEQ ID NO: 79925 - DNA, 689 bp, Heterodera glycines
  Genomic contig location: Contig_ID=SeqID_15632; Location=8..696; Strand=+
  SCN-specific regions: Sequence locations=1-113,136-689
caaatacggtaatccaaaacaggcgaatgaaattgactgggtgatcccggcccggttttgtacggatcgttatgacagcaaaaagatccggcatagaattgaagtgcaactgggcgaggagagcaaggaggagcgtcttgaagctggcgaatcgcagaccaaatggccaaatgcatatgtgatcccgtcaaaaggtcggtccaaaaacaaaccgttatctatccaagagtgatcacagtaacaatttcagatgggcacaaagtccgaataatcgacgcgccgggaattggtgacacaaaaggcgtcaacgaagacaaaatcaactttgacaagacgctcaacttcatcagcacattgcctgaacttcacgccgtttgcattctgttgcgtcccaacaccactcgcgcaacgcccgcaatcacatattgcattaagggactgctcacgtacttgcacaaaaatgcaaccaacatactcactatcataaattggcagaatagataacgattaacacctttttagaacattgtttttgtgttcaccaacgcacgcgggtccaattatgacatgggtaagttttaactgtcaacgaatcagtgaatttatatacttggtaatgattttcaggaaagaccgccgaagtattggagaaactattggcccccattgaacgagcgcataatgtttga

SEQ ID NO: 79926 - DNA, 1089 bp, Heterodera glycines
  Genomic contig location: Contig_ID=SeqID_15633; Location=818..1906; Strand=+
  SCN-specific regions: Sequence locations=1-376,398-414,436-555,577 -1089
atgtccattaaacaggcagaaaaagtggtcttggaatgcaaaggagaagcggatgagaatcttcatgaggacaaactgaagggacttcgagtcagtccgagcggaaaacaattaaatgaaattatcgagctgattgactgtttaattatgctaattaaaattcaaggaatctctccgtctctaccaagaagagaaggaactcattgacaatgcaactgcggacgattccaatggaccaactgttataacggcggagaatgtgaagaagttcttcgatgagctgtgcgaattgcccttttttggtgcagacattcggcaaatgttcgagacaaagcaaaagtcacggcacgagcatcagaaagagtactccgagaagaagacaaatgttggggtgaagttgagaccaaccaaaagtggaaaaggtgaaacagaaagccatagattaaattaatcccactgattgtgaacattaatccgatccctaattaagtcgtccaaccggagcagtgtttgaacgaagagcagcgaaaactcttgaaggcctacaagaagaaacaaaaggaaatggaacagttggagcgggaaatggagaatgagaatacgctgcaacgtcgtaagtatagtagaaaatggggagaagtacggtaacaaatggcgtaaaaagacccaaaaagaatattccgcttttttgactagcgcgttcagtataaacgttgccagaaatgaagtttctctctatctctatgtgtctatttattgcattaatatttctgtactttcatttagcaactggaaattccgctgcttataaccaaccgtcaacgtcgtcatccagcagttcatttttgcgtaagcaattccaaattatatttttttaagctccataaatttacagagaggattcccagctacaactatttgttcggttcgtcttcctcgcagaatgtgtcgtcgtcatcatatggcacacactcgcgcaacagtttcaatttgtcttcaaatttctcttcttatggtgcttgggaggatgatcgtggtgtgatgccgaagaacaaacaatggcacaacccccgctggggaccgaagtga

SEQ ID NO: 79927 - DNA, 2678 bp, Heterodera glycines
  Genomic contig location: Contig_ID=SeqID_15634; Location=178..2855; Strand=+
  SCN-specific regions: Sequence locations=1-269,291-449,480-496,518 -813,846-954,978-1209,1289-1609,1631-1792,1958-2217,2239-2678
ataacagtcatgaacgctacattgacgaattattaaatgatggtgttagccaactcccaaaaacttgcgtcaaaaaagcgattagcacaaatgaacaaaattctaatgctgttgcttcgtcttctaaatctaaaggtattaaatattcgcttcttaaatgcgcaaatttattttgtcaaatcctgacgtatttattgaactgtgaaacaattaaatattttacggttattaaaattgcacaattatatattagccatttaaccatacaaaaattaatgttttacataaattaatgttttatggagacagaaaacttctgctcaaagtgctgacaagagaactaacccgaactataagtgcttaaatcacttatttaccactttttattgtgtagagaagggattgcacggaattctccgatttccgacataaattggcccctaaattgcaaaaaaaattttacaattttaatataaattctgataacaaaatggacttaatttaaaaaaaaatttttccggtggtgccttgcggcaccgccgaatctcctcacccttatcaatttcattttttaagctgctcggaattccgacttccgacacttttgggctcggaattacgacttcccaaaattttttggtcctcgctataccatctctggtctggaatatagttttggctttttttatcctgtatcaaaaactggttttgaaaaaattcattaaatgaaaatgctcacaaaaatacgttaatttaatgcagttttcctttatgtattttaatgaccattttatccgccagcagacagatgatgaattattttgatttttctttaaaatattattccatcaagcatctttttattcacttaatttaattttattttctgttactatttaagcggtaatttttttttgctgataattcaaaaaaaaaaagtttatttgctctaacttaattttttaaattttttttatccattttcgaaattttgatcactttttactgatcagtttggggatcagagacaaaaaagccgaaaatttacaagagcaaatagactatttatgataaatattgtttaaaagttctttaaacatttacagttcggaatgttctttgtcagaggcaataattaatgttaaattacataaaccataaaaaccgatatttcgaaatagatttttgtattggtaacactaaattacgaaaaaaaattttttgaattataaattttatttgctgcttttaatttaattaatttaattttttataagaaaattaattagtaaccaacaatttcagaacacaaaaacgaggaaaatatttcgataccaaaactaatttttctaaagaccaaagcaaattctataagtcacatgacaatagcaaaaagcatacatgcgcatatgcaaaaaatgagaataaatgaacacgcaaatttgaacactgtgcaaagtgatcaggccatggaagacattgatcaaaacattggaggaactgatcagacaaatgtgtcaatgccaatagatgtgatcaatgaaagtgccaattcactgatcagtctattagttatgccaattgcacacagttctgcagctgatcaagcccatccaccattgtcagaaggtacaaccaataccaatttgacaagcgataaaagtgatcagacaggcccagaaacaccaaacagtcaacggaaacggtcaagacagcgaaagcaaagctcaagcaatatccagcggactgaatttttaggatttgcatcaacagaaacggaaatagcagttatcaaacaaaaagatcaaagaaatgatcaaccaaggaatcaaagaaatgatcaaccgagtgatcaaagaaatgatcaaccgagtgatcaaagaaatgatcaaccgagtgatcaaagaaataatcaaccgcgtgatcaaagaaatgatcaatcgagtgatcaaagaaattatgaattcaatgagcaacaaagttatcagatgcttggactttatgatcatgatgatcaaaatattgaaccaatgtttgttgacacaaatgcaccacaaatgatcgatacaagcgacttcgatcaaattgctcaactggctggtgacgatttgatgttcccccatccgatggaggtgtatgacgagccgaacaatgccgaagaacaatttgtgatgatcccggtcggaaacagcacacaacaaattgtagcagaaagtgttggcaaaacaaaaagcaattcaaaaagtggtcacggaaaaagccctcaaagcgctgatcagaacatgcgcgactatgcttctccatcaattcaactgaagcaaaaagcgggtcggcaaaaaaagccgaaaattgacgagaaaatggaaaaggccaaatcaaaaatgggagtggaaaaagcgccgatcaaaccggcaaagcacaaatcaaaaatgacaatgggaagaccactgatgagaaataaatcaataatgattacggaaagaccaccgatgaaaaacaaatcaatggtgataagtgagagatcaatgatgaaaaacaaatcaatagtgataactgaaaaacaaaatacgaaagcggacaaaggcaaatccataatgatagaggaagaagattcagcgactgattcatcagatgaggtacactaattagttaaatcaaattttattgctctccattaa

SEQ ID NO: 79928 - DNA, 1154 bp, Heterodera glycines
  Genomic contig location: Contig_ID=SeqID_15635; Location=789..1942; Strand=-
  SCN-specific regions: Sequence locations=1-430,452-499,521-652,675 -676,699-1154
  Gene Ontology: Biological process=DNA replication
atgccatggaaattgagagaattctttgcattgattttagtccattgcaaccctgccaaaccagaggagctttggaatatgttcaaagactcattgtctgaagattttagcaggaattttagaagagaaatagctaatgctaaagcgtatagagaaattgcacttagtattatgaaggctggaaaaacgcttgccgattttccatcgatggaacagataaatgtagatgatgatgttgaacaagtatttgatctagccgaagaattggatttgggacaaagaaattatactttgatgtatgatgaacagaggaaagtttgtgatgaaattttgcaaagagtatggaatcctgtaaatgaacccgcgttctactttcttagtggaccgggtggaacaggaaagacacatgtgaacaagacaattgtacatatgctgagaggtcagaagaagaaagtttgtacaatggcttttactggcatcgcagcaactttgctgcctgctgggagaacattgcacaatagatttggattaaccttggatatgagtaattcgagtattagtccgagatcaagagtttggcaagaattgaaggaaacagatttgtttatttgtgatgaggcgcctatgataaataagcgcgcaatgagaactttggatgagaaattgaaagagataatgaataatggaattgcatttggtggcaaggttatgctttggacgggagactttcgtcaaacccttccaattcagaaacatgctacgagagctgagatggttagctcaaccataaagagaagcgagtactggaggttggctaaaagatataaattgacgaagaatatgagagctcttgcaacagagcaagaatttgcgagagatttgttagagattggcagtggaaaatggaataatgaaaacgatgagataattttgcccgagaattgtattagcaatggtgatttagcagaagagatttttgcacatgtattgtctctgagaattggaatgaaatggccaaaagtgccattttagcaccgaagaatattgatgttagtgaaatgaataatagagttttagaaatgttgcctggagaagaagttgtttatacgagtatagacttagctcaagatgagaatagacagagagcatattga

SEQ ID NO: 79929 - DNA, 791 bp, Heterodera glycines
  Genomic contig location: Contig_ID=SeqID_2476; Location=105..895; Strand=-
  SCN-specific regions: Sequence locations=1-13,35-431,454-478,519 -528,550-551,573-679,702-791
atgcgcacgggacagaaactgaggaggaggatggcatttttgttgtttggattgagcattggtgtgccatttttgaactcgcgcgcattgccagcgacagttggcattagaagaattggctacgtcaacaatggcttacaagtattagcagtacgagagtgccatcggggaatttttggagagcctaagtgccaaccaaaatcctaaaaaggataaggattttgtgtgggcaggaaaatctggcatggaatgcaaccgccattattcttgtgtttacagtgcccgtgatgtttgaacggaaacgcttttttggcaatacgtaatgtgaaatcattaattctaatataaatgatgccagaaccaaggcccaaattaatcaaaactattcggtgtaatgactaattagctaataagaaaagcaatgccatttaatcaaaatgaaattataaaaaattgcgaaaatcataggtttatcactaaaatttcataaattaaaatattttccttgtggttattcttgctgactatttatagttttcatatttaatacaatggtttcatttatcatgcttaattacttcaggtgagaatatttaatgatggtaatttctatttcaggtgacattaattggcacgttatgccaaagtgaaaaaattacatttctggccaaaaaaaaaatgtttggttttttaatttgtttaaatagtggaaaaatttaattatgcgaaaagcccaaaatggggcttattaattttaattgaaaaaaagtaaaaaggaattctaaaataaa

SEQ ID NO: 79930 - DNA, 838 bp, Heterodera glycines
  Genomic contig location: Contig_ID=SeqID_2476; Location=1386..2223; Strand=+
  SCN-specific regions: Sequence locations=1-94,158-374,416-728,751 -780,802-838
atgatcaaggactcctcctcttccgatgcctcgccttgctcatctccctacaattttcgcctcacttccgccttccgtcgcagttggaccattgaaaatttaaagtaatttttaaacatttttttcaaataatttacattttctatatttaaataatgcatttttggctcttaattaacaaaagcattcgcctcaattagtgagctctttatttattaagtgacaaatgaataggcgacaaattacctcttttataaaagcaccaccactttaattgagcatatttttttaaataatagcaaataattttttctggcctttttttttgcttaaaatgttttatatttcaaatgctataaaatttattttgtgagttataataaataaattaattaattaatataattaaaataatccaaaccagcaattaataaatcactttaaagaaatttgaaatttgctttttataaaactttttttaaaaaacaaattttacaggaaattgaccaatcggacttcaccaagcaacaaaaacagtgccaaggcaagcaatggtaaaatgaccgtaccagacaactcaccaacatctacagtaagccgtcgcagcattttgaagagagggagcagcaccgatgaagtggaacaaacagtcaaaacgttggcatcggagggcaagcagctgaggcggcgtcttctgatcaaaaaggtgaaaacttggagcataattgattttttccaattaaataaaatgacgcacaaatcgggccaaaatatttcgggagtgatccttttgaagctttcactgatcagcccgaagcaaaaattagaagcaaaataa

SEQ ID NO: 79931 - DNA, 670 bp, Heterodera glycines
  Genomic contig location: Contig_ID=SeqID_2477; Location=2736..3405; Strand=+
  SCN-specific regions: Sequence locations=1-239,261-468,490-670
atgaagtgttcactcctctcttacccgttcattggaatttccctcattttggtcgtcggagttgcgtcaagcattggcgcgcctgcggcggcgagtgggcgaaagataaagccgccaataatggagcgcggtgccgtcaacggaggcactaagccaactgaaatgggcaaggaggaggcggaacagtggaaaaaggagcgagaagaagtgaaaaagttgctggcggagcacaacgagaaagtgcagaagaagctgcttaagcaagccaaggcgttggagaaggacgaaaagtatcagcagcggatgaaggagcaaaaagccgcccgggcgcggcttccgaaggagaagcgagtgccggcaatggacattcctgagatcaatgaaaacagcccagaggctgcgtatctgtaccaaggggacattcaactatcgctggaagaagccaaaattttgtttgcccgggacgacgatgttgaagagggacgaccatcgacgagaactcccaatgcttcttctgatgctgttgcctccagcggtcgaaggcggcgcggggcgccaatgaacgctgtcacctttccggacagcaatggcctaatctccagtacccgttcagctttgacgacagcatctgtatgtttttcagtgtggtaataattgtagaaaaaataca

SEQ ID NO: 79932 - DNA, 1627 bp, Heterodera glycines; identical to SEQ ID NO: 2478
  Genomic contig location: Contig_ID=SeqID_2478; Location=1..1627; Strand=+
  SCN-specific regions: Sequence locations=1-1016,1039-1302,1324-1627
  Gene Ontology: Mol. function=zinc ion binding; Cellular component =integral to plasma membrane; Biological process=body morphogenesis (sensu Nematoda)

SEQ ID NO: 79933 - DNA, 914 bp, Heterodera glycines
  Genomic contig location: Contig_ID=SeqID_2480; Location=1140..2053; Strand=+
  SCN-specific regions: Sequence locations=1-396,418-595,618-818,856-914
atgttcagaatcgcggaaatcttcgcaaaaaattcattgagtgttggaatttctatcaacgtcaggtgagcggaggagggcaacagcaaatgcaagaagtgacatacgcccgacagtggttacatttatggttgcagatggtgatggaaaagtgaggaaattattggaatcatagatgatgggcccgggatttatatttgaaaccttattttaaatttcgaaaaaaattcttacaattagcaaaattccaaaattttgcacccaaagttctcctaaaaatgtaaggcgcaaatgtcgggaacttataattcaaaaaaaatggatgctaatcaacgaatttttttgcttcaaatcacctttcggcacgctttttccaaaaaaacgagcaagagggtcgggaaaaattttgaaactttggatctgatttgcgttaacagatgttcattcataatcttttttttcgatttagtgcaaattttttttttaatgaaaattaggatttttgtaggccggcgttgctgccattcattgcaaacgacgcaccaaattttcctccgtcgcttttacgtcggtggacccatcgcttctcaccgaaaataaaggtacgggaaaaagattttaaatttatagtaaaaattgaaaaatgtgcctttcaaaataaaatttttttttaggaaaagcgtggcaacttttttaagcttttgttcaaaaaattttttcgtttctttttaacaggtcttttacatttcccgctaaacgaaccgcgaaagtctgcgcaaaattcctggccttacacttcgagtgagttggccacgacgtacagacaaatcaatttaaaaaaatacgacaaaaaaatttttttttagggagtgaaaggcgacagttcgaaaaggcgccgttcaaatccagcataa

SEQ ID NO: 79934 - DNA, 173 bp, Heterodera glycines
  Genomic contig location: Contig_ID=SeqID_2480; Location=2281..2453; Strand=+
  SCN-specific regions: Sequence locations=1-84,107-173
atgtctatgaaattggcatcaaaaatgggagggtacacagaatacgcattactcccaaaagagtcaggaaaacgagggagggccgttggggctcgggtttgggtttttgcagggttcggttcacttagtcaattggcgatggacttggagaataattatttatttggggacaa

SEQ ID NO: 79935 - DNA, 354 bp, Heterodera glycines
  Genomic contig location: Contig_ID=SeqID_15637; Location=26..379; Strand=+
  SCN-specific regions: Sequence locations=1-109,138-354
atggcccgtggaactctgtggatgggcgaagtaatcatcttacatccttaattagggtgtcttcgcttcaattagtcactaattaatccttttaatttataatttcctatttaaatcatttcaataaagcaattaaaagggttattagagaataactcgattaattagtatctaattaaccctttaaataaatgtaattttttgttaggatccttatgtgattgtgaccgactatgagctgattcgttcaacatttctactcaattacaatgaacaaacgtcgggacgccatttttttcgcatcgctgaactcgtttctggtataagccattggaatgcataataaatattaaa

SEQ ID NO: 79936 - DNA, 968 bp, Heterodera glycines
  Genomic contig location: Contig_ID=SeqID_15637; Location=1154..2121; Strand=+
  SCN-specific regions: Sequence locations=1-200,242-394,417-567,589-968
atgctaattggtctacgtgaaatgtcggctaaactccgttccgacatcaagcagaatggtccgtgcaacattgatttatgcaaaccaattagtgtgctggtcggctcctccattagcatgcttttgtttggtcacccgctgaaagaggtaaataattaacgattttctgaagcaaatatatacataactcataattgtggtttattaataaatttattaaattaataatatataattaatagagactggctggccattcaaaagattcgatcatattgaaaaacccaaaaaaacttcaattaattcgttatttattaggaagacatggatgattttttgaaagtcaaagcgaaaacgaccttgcttttcttgttgttctcatggtaagattttgaatatttttgaaatataaacaagcaaatgaaattgtaccgtaattagagagatacgatcgctaattacaaaaaagagactatttctcacatttatttaaggtggacgacacaaattgttgcttcatcgccactttggtatggaaatatgaaccaaaaaaatgggaattttctgaattaatttatttttaattatcaatgggttaatagcaataagctaggcttgggacgaacagaaatttttccactgtttttttcaacaaaattaatcaaaattagctatttttgggacaccatttttggcataaattttgcaattttcaggtggcttcgccattttcccaccgttctcaacaacttttaaactgatcgatcaaacactgaccggaccatatgatttaattgacaaagaaattgccaaaattgtgaaacggcgccaatttgagtcgaatttatgtgccgtttcgttggtggacgactttttggatacaattcaaaacagtgaacagcgcaaaaagaatggcacaatgccattggcgcaggacaaacattttcagtaatttttttttaatataa

SEQ ID NO: 79937 - DNA, 892 bp, Heterodera glycines
  Genomic contig location: Contig_ID=SeqID_15639; Location=628..1519; Strand=+
  SCN-specific regions: Sequence locations=1-189,212-223,256-336,399 -537,564-703,739-858,880-892
atgaatgacctatgggcaaattgcctttgtttcgaatggacaattggtcattttcgccctttggtgagtttgttggaggtaatgggaaaagcagcagcagaagaatatggaaattgtaaagtaggtcatcaaatgaatgcctcccatttgtgttgcgcataatttttgtttcgtttggggcgtttcggcaaataattaattaataaaaattctggaaaaattcaaccacctgccaaagttttactttttaaatttcacagaatgacaacaaaaaatggcactctcattgagcgaatggatcggctgttgaccaatggatatttcgcggatgtgcactttttggttgggaaaggggaagaaaaagaggcaaatttagcaaatatttaaatcaaaattaatgtgaattttgactttagcttctgtcggcacataaaattcttttggtgacggcttctgaagtgttcgaaacgatgctttgttcggacgacgccgaaaatgaaaagacaaaaaacagtgccaagaattatagacaaattgaaataaaaaatatttatttattttttgccccttcgcatttgcgtcccgtgccaatcactgacatcgatgccaatgtgttcaaggtgatgctgcgcttcatttatacggcggatttgagcggattgaacggagacaacgcaattccattgttttgcgctggtcagaataaaaccaaaaatataaaatcattttgttttaattagccaagaaatttcacctgtctgagctggccaatgcttgtgccaacttcccaatttccaaattgcacaatgtgtttttggcatttaaccacgcgcgccattttgaagaaaaggtaaaaaattattgtcatcagcagagatgagattttttggaa

SEQ ID NO: 79938 - DNA, 1265 bp, Heterodera glycines
  Genomic contig location: Contig_ID=SeqID_15643; Location=162..1426; Strand=-
  SCN-specific regions: Sequence locations=1-186,208-260,289-499,539 -552,574-595,617-643,665-774,819-876,936-1038,1103-1138,1162-1265
atggcggaaatgggtaagtggtcaaaaaaaatttatgttttgcggtattacagaaaatacgctctaataattttaacatttatcaggtaacaatgccacaaatgcgatgccgccgctggcgggagacgaaaattacgaaacaaaaagtggttagtttctgtaattgaattttgacgattttcataatctttaacattttttcagaaaacagttccaccgtcccgatgccactgccatcgtccgggaacagcagtggttagtaattaactaattttaatatttaaattaccgtattcacaagaaagtgtcgaaatactgttaaatgacgccatttagcatatttggctatttaatagaattaacattgaaatttatttaatcgtttggcctatttttgaccttttttcagtgctggaaattacgaagaatgcggcggtgccgtcacgctcggacaaaaacgacattggtaagtgattagcataattagctaaatattcccaaaattatataaaaaataaaaattgaaattaattaaattgaattactttcctcgaaattaatattattaatatagtgtatttaaattagggcactgaatacaaaaattaattgcgcaaatgaccttttcttaaaattgcgctctattgattgtaatgaaaaatttaagcattttttttgaatattattattaaatcgaaatcagtattttgaaattttcttttcaaattcagtacaacatgccttggaattcagatgtttaaaaaactcattttcatttaaaaaaataaattcgttaaaaatattttctatttttttttctttgtacaacattttctgcgctaaaattttttttattttttctcaaaaactgccatcaaattttttaaatattatttttctaatcgaaattttatcttttatttaacaaaaaattagctctgattaaataagaaacatttttttgttcatatggggctgccagttccgattaaagtcggggcttttttagattaatcattccaaataaattgtccacacaaattatataaaaattattaattaataaaaataaataactaaattacaaataaacaattaaaatgtagagaaatatgtataattcaaatgattgatttgcttaaataaaataaatttataaatgcaaattaatcacttaatgtttaaaaattttccagtccactacaccgtttggccaatcgtcgcagtgatcgtgcttctgatcttttactttttggtgaaaaagg

SEQ ID NO: 79939 - DNA, 1889 bp, Heterodera glycines
  Genomic contig location: Contig_ID=SeqID_15643; Location=2298..4186; Strand=-
  SCN-specific regions: Sequence locations=1-10,47-118,216-344,400 -408,430-933,960-1110,1134-1863
atggtaattagcggcgggcggcgcgccgcgttggccgcgccggcgctgcggctgcgagcggacgcgcactaatgccgccattgtacactcgctcatcctcaaacagtgggaaaatagcttttttatatatattttttaaattttctatgaattagaattttgcttttttataattttgtaaaaattgttatttggttataaaaatttaatttattgtaatgatgatattttaatcaggttatagatcaattccaaatttttttggaaaaagacttgcaaaaaatattccctttctatttggcctttttggaatacgcaaaagtctgtccgtccattgggcaatcaaaaatttaaaaatattttgtttttattgaaaagtaatattgtaatttttaatttggttaaacgccttattttttgaattgggctgcagcattaattcgaaaaactgaattttaaacccgaaaccggcatttagggacttcactgtgttctctgcgtgtccggatggattgaggaccgggaggacagcgcatttcggcaccatttggccacctttggatgagcaaggagcgagcagtacacgggagaacaaagtgagtttgatgggtgatcacttaatcaagcagggattcctgtgatgaccagtgggcatccaattggcaccggacaagacaaatgtttagctggtctgatcaatgactgaataacatttttttcatttaatctggcattgataaatttgctatagtctaaactaaatgtgatcgatcgccaactttcccaagcagtacttggaggaattgggccgcagcattgactttttcatcacatctcctttgttttttcctacgccatccaacgttcgctgatggaaacaatgttggccagcctcgtgtccgccatcgcatggcctttggtatgttgaatttcaaaaataaaatattttttttaaatttcctctgtcaggtgctgcttggttcctcctgtgtcattgacaacccgtaaaatatttgcactcgacgtgctcgtcaggtaaatcagcaggaggcgagagtcttgacatcgactcaataaattttctgacatgtcctcccaacatttggcaccaattcttttttaagtaaaattttccgccatttttcggcctaaaattgtgtggaattttgtggcccaagcccaaatcggactcttcggcccggtccctaattaacgcaccagcttaagttgaaggagaatgggtttaggtaaaaatgccgaaaacaaatgtgttgagagaatggcaaagctaacagaaatcaaaatttacgaattaacgccgattaaaaagtgcttgaagaaaattaattatcacactggtgaacaactgatcagtaaccttttgaattagaaaagtgagagatttatttgatcacatttttttgtccaccaaaaatatgaaaattaaaatttttatggaaaaattttatgttccgcaaaatttcgactttaattggggccgcaaatgttctgcaaacatccaatcgattcgtttactaaatacgcttaaaaccattgctaattgtgtcaggtgggtgaacatctcgctgaagtattgctaactcgacagcactgtcgacgtccgattcactctgatcgatttttccgaagtgttcaaatgatcacctctgatcggcttttggcttggcgcccgcgtgttttaccattgtaagtgatcaaaataggaaaacaaagaaaaaaaattgcagagaaatcgatacaaagtgatcagtttccttctttgtctcgagcctaattccaagtctcgaatatcttcaaactttatgttactactaatcattgggtaaaatacaaatgaaatagattttttaaaatattattttaataaa

SEQ ID NO: 79940 - DNA, 2042 bp, Heterodera glycines
  Genomic contig location: Contig_ID=SeqID_15644; Location=574..2615; Strand=-
  SCN-specific regions: Sequence locations=1-81,105-288,310-722,744 -1208,1230-1411,1434-1529,1551-1558,1580-1898
atcgtcgtctgtccgttcaccgtttcaccgttcctttctcctttcgcacaatgtcagcgcccctctcgcccaatatttggagctcgccttccccagccccgcccagcacccttttcaatacgaattgtacaccaaaatgatcgcgcagcagcgcatggaccaaatggagagcgaacttagcaaacttttggaaaacgtcggcggacggacggctggggacgcaaatggcaattcgcaaattgcatttactgaatttgtgaaacggtccgcaatagcgtgccaggtgaaatgagaatattttgagggtgatgggcgaattattttcgattgctaattactccgtcccttccccaggcattttttgtcgacccgcggacgtgcgaaaaggccgaggagataatgaccagcgcaggaaaatgcttccgactgcgcggcggggagcagcgcagcgacggattcgggcacggacaacgcatcattctgagactgccgaagaaattgtacaacccgggggtcaaccaaatgctgaatgacggagtggtggtcaaattggcggagcgcgggaaaggcattgaccacgacatgtacagcaaaaggaggaggggggagggtggacaaattgtcgaaaaaggggacacttggacgaaaaagtggacattttgacgaaaaaaggacggaacatttggggaggaaaaacggaaaatggaatgcgaacaaatgaatttagaaggaaaaggaaaagtatgtgttggccttttaaaatctcttctcaggtcgtttgtgccgtcgggtgtccacgcgatttccccctcacggcaacgcgatacgaattcaaaaattacccgccgcacttcaaatgccgcgaagacgaccccagcggcgtttattcgcgcgtttggtgttttgaggtgcgtccgaagggatttcgattctttcggccttttcgtcggtccgactgagtctcgggactgattttgaccttttcggtctaatcagtgccaatttccctttgcccccccttcccttccccatttccaaggactgtttcatgtcccaagcggaaagggactgcaattgttcgttggccgccgcttctcggcccacgacgccgtacatttgcaccaccagccaattcttccgctgcgtctacccaaagctgtaccgaaagggctttgaggagcgaattgcggtcttttataagcaatttatttgcaaatctgaaatatgtttcaatttcctttttattttatttatttttcttttcgaatttgccattctcttccaaattaaagcgttgcaaaagccattgtgggcccccgtgcaattattggcgcttcgacaaaaccgtcacttactgtatttgattattaatttgtgatggctttcatttcattcatttgtctgtcgcttattattttaatttgccaatttcagcgctttttccctccgaacaagcaaaacattttgtcaacgactcctccaaatgggaagagctgcgcaacacaatcattttggacgtttattacatcactttggactacacaatcattagggtccgtccctccgtttgttttctttttccaattacccccccccccccactaattagcatatgctttcaatgacgccgccttcgtttgttgcgcaactcggaggtagtgaaatttaaaatatttttaacgcccttaaatgttaaaagtatgatcaaaatgatcattaggtaagtaaatttctttccctttcgattaggccaaatttcgctttggatcggcggctcaatcatttcgatcatccaattgctcatttatttgtccagcgctttctgtgcctatttgcgacgtggtgccacaaaacgacggaggacgacgacaatgagaagggacggaataattggccatgaaaggggaggaaaggaaaaatgccaaaggaacacagaaaagaggagacggaaggaggagagaaaaagagatggtgagagataagcaaaggaggaggggagagaaaagggggaggatgagagacaaggaagaaaactaaaggag

SEQ ID NO: 79941 - DNA, 3745 bp, Heterodera glycines
  Genomic contig location: Contig_ID=SeqID_15646; Location=576..4320; Strand=+
  SCN-specific regions: Sequence locations=1-28,51-659,681-859,943 -1253,1279-1291,1322-1329,1360-1405,1437-1479,1641-1669,1691 -1725,1747-2158,2190-2263,2292-2313,2335-2586,2610-2626,2655 -2657,2681-2765,2789-2844,2901-2959,...
  SCN-specific regions: Sequence locations=...2981-2996,3041-3637,3672 -3700,3722-3745
atggtccgctcaatgcttcgtccatcgatttttgccttgctgccgctggtgtgcctgctcagcgttttgccgaaacccgggcatggtaagtgaatacagtaacagaaattttcaagtgattttagactcgatattattcggtagctctaggagttctctgtagcctgaaaaaattcgaaaagttttattaagtttgaacaaagttatggccaaaagtacacaagcacaaccaggttttcgaatttgaaacttgacgaaattttttgaaatttgcaggctaatagaacatttatggctatcgaataatagcaagaaaataaaaaataaaatgaatttttgactaacattttttacttagaataaacaataaattttaattaaagctttcttagaaccaacaaaactacgtgatcttgtgttttctaatccatcaaaatttcaaaaaattcgtttagtttcaaaaaagtcatggccaaaaattttttaaaacgtttcatgtgtgtgcttttggccataactttgttcaaacttaaaacgaaatttttgaatttttcaggctaataaagaactcttagagctatcgaatgataccaagaattaaaaatttagttgtttttgagcaaaattatgtgaagttttttgttgaaaattttcatttggtatttattttataacgctctctttgatggatttttttttataacgacaaagcacttttttttcaaattccacattaagcaactaagtgcaaatatctcgttgaatcggaattaatgataagaaaaccgcgagacagggattgcaacaatgaagagaaatgtttcacgcagttctgttcaacgcaaaatggtaagatgaaaataattataattataataataacactaaaaataacaataataataataatataatagagataaataataaatacaataataaccagggcttctttttttatgtaaatacatgttttttcctggattctccatagcctaattagtaggaaaaacactttattttttgtgtttgcgaacaaaaattgcgacttttatttacatattttgagatttttctacatattacatatgtacatatttttatacatatttaggactttttgcatattttcgtacatattttgcattttttgagaatttttaaggaattttttttattaaatgtccccaaaaatatccaaaatttcgcaattttttcaaaaattttgagaattttttgtgaaaatgtgctccaaaaaaataatttttttttttttttgaaatgggatatcaaaaattaattttttaaatactaaaagatgattctaagtcctatttaggtcatttttatgacaatttatgcctatttcaccatttagaaagaattttttcccaaaaaaatcaccatttaaaaaattttatttacatattttaatacatatttctggatttttgtacatatttcatacatattttagtgttttttatacatatattatttaatttcataaattttatgattaaatatttaaaaaaaatgctaaaatatttaagaaataaaattatttctgaaaacaaaaatttatattcaattttttatagaaaaaattttcatttctattttaaatttcaaataattttctccctaaaattaaaaaaaatgtttgagcttctcttttaaatagacccaaaatttttgcggaagtttctaacatttagaaaaatgataacaaattttctataaaaaatcaattaatctagtttcataaaaaaatccgattttttaaattttcaggcttatttttattcaatgcgtggaactgtattggcatggacatgacacaagagcaatgtgacacactgagtgcgaataaggcaaacggagatcgggcccagctcaacatgtcgaaagttgctgtcagtgattggaaatgcaaatgcgctttgggaaatgccggagaggacatggcgaatgcaaattttgagtcgccagaaggtggggcgccaacagggcggagcaggacaaacaaaatgtcgccggtccaaacgttgacggacaaacaataaaaacttattcaaattcttgagaattaaaaaaatttaaactttttttttgttttttgataaaccagcgaataaaatttgctaaatttcagcaaaacgaaaataaaaaatgttttccttgaaatttaaattttgtcgaattaggctaggtaaggaaaaaatttttctattttattttttctgctggcgaagtttttggcatatttaaaaattctttataaatattttgaaaagcaatttaaaaacccttaatttttaaagaaacaacaacaaaaaaaaaagaaaaatttttatttttccacacctgactgatttgactgatccttacgcacgcgcgcctaaaagtgtttttttgcgcaacatcaagggcacaaagcccgtagccagaaaaaaaaaattcgtaggaggggggggggaaccttctaaaaatcgcaaagatcagacttttttgtgtgaaactcttttaattccagaccgaccccttcgctaacaccaaattttaatcaattcctacttccaaacgggttttcaataaaattcaaaaaacctttaaactagcgccgaatttattttaatatattattttttttacacatttttcattttcattttcacatttcagcaaaaatggcatgcaaatatcgcatggaatcggagaatgccgaactcaacgaacagctcaacaacaagctcaataaaaagttcaataacaatgaaaaaattcaatgcatcaaagaaaagggaaaatgcggcgcggtgttctgtaaaacgaaggacggtgaaataaaaaaaaatatatttatttttttaaatattaaaataaaattttgaaaaaaagtaagtcagaaagcacacatttctcccatatttctacaatttgtccttatttttttttacattttatccttatttttcccttaaatattggtatagaaaaaaaaaaaaatttaaaacattaaagattcataaaaatatttgtttaagaaataggaccataatttcaaaaactttaacggctatacctaatttgagacgaccatatatgtgtatttttaagtcaggtaaaaaagaaattaaatttctgattataaatttcgaaatgacacaaaaatccttaaaattcgcgacttttgggggaaccacttccccccccccctccccaactcgagtctctcggtttttgaaaatttcttttttttttatgggggtatagtttttgatctttatacatacgttaattttttttatgcaaacatttccattttccaggtgaacttaagtggaacaaatgggcctgcttctccgctgactattccaaaaaagtgtgtgccaaaaatgaaacaaatgccgtgaatgatgagcgtgacaaatggagcgattccaagttgccgaaagcggatgattggaagtgccggtgccgttttggtggaaacggaaaggacttgaccaataacaaatttgtgccgagaaattcaagtgagttgagggcaaaaataaatgtggacagagttttttcaaggacgcgcggaaagcgttttaaggacgcagaattttctgctgtattaatttcaatgaaaatttttataaatttactaaaaaaaaaaattacattcaccacaattttttagcggccattcgccatggtgacggaatgccaatgatcgttgtgggaatcatcatgg

SEQ ID NO: 79942 - DNA, 60 bp, Heterodera glycines
  Genomic contig location: Contig_ID=SeqID_15647; Location=964..1023; Strand=+
  SCN-specific regions: Sequence locations=1-16,39-60
atgaacatgctgcgagaaaagagcaaaaacatccaattcgaggcattccacgtttttaag

SEQ ID NO: 79943 - DNA, 1195 bp, Heterodera glycines
  Genomic contig location: Contig_ID=SeqID_15649; Location=1..1195; Strand=-
  SCN-specific regions: Sequence locations=1-1018,1040-1195
ccaggtgtttggcaaagactccaattgcattgtgcgcaattggctttcttcgacggtaattgaccatttcaactgcacattgccatatttggacactgtgtgagtttggcaatgcattcaaatgccgtaaatcgaagtccctttgtgttttcacagcagaggaatatcgaccgaactacccacttgcgagccgttgaaaatcgccaaaaagtgagtgcttgaactatgctccgctggactaggctccccaaaaaatcagtgatcgagtcgctcgccccccccctcccatttgatcagtcgatcggtccctcctaacctttgtttttttcccgacctttctatgctgattgctgtcccttccctttcagctacaccgatatcattcagctggtccactcgggttctgtgcacggtccaaaatgtatcccgggctgcaaccggtgggagtacaggtactgtccgatgccctcgcccgccctgtcgtcaattggactttgtccgtgcccctcccttaagtgtttccctccagcagagtccctctctccaggaattcgctaattatgtcagaaaccctttaattaagctaatagttgaatcaattccatttttagacgttcaatttggaggtgtccttctatgacctgcagtacgagcatctcaaagaagtgactcattgggaccattaagggttaattactcaattaattaccctcttttcccacaaggtggttaccatcacagtgcccggctttatgtcccaaattgggggacaggtcagtcagaagtcacaagcattcgtagtgtgaaactcacaattattcggtttttgtgacattatgccaaataagacatcctttccgattaatatcaaaattcacttcagttcggctttttcctcggcttgtcgatcatcacagtgatacaggtgggaaaggaggaggggggggggggggacgaaaagccacacaatctttctcggggcaaggggggaggtaccccaacggtgtcgtctgattggcactgcctctgcaattgctttttccatgcacccctttttagattaccagtttcgcagtttggtccatttttcgtaccgtactttttcttgtcaatcggaggaaattcgattgggttttttcattaaatggaatttcgcttgaaaagcgagcgcaagaaaatgcagccagaagcggac

SEQ ID NO: 79944 - DNA, 234 bp, Heterodera glycines
  Genomic contig location: Contig_ID=SeqID_256; Location=1830..2063; Strand=+
  SCN-specific regions: Sequence locations=1-41,84-234
atgccgacaaaaactacaaacggacgggaagcgcccgtatgtaatttttattatttttaattttattatatatttttttaattcagctttacagtaatgccgaaacaagtgtcgaaatgttgctggcaattaacagatgcatggaattattaagaccagagttggcatttgccatttttagtggtcaaatttttatcaatatttttattagacgattagaataattaattaata

SEQ ID NO: 79945 - DNA, 256 bp, Heterodera glycines
  Genomic contig location: Contig_ID=SeqID_256; Location=299..554; Strand=+
  SCN-specific regions: Sequence locations=1-76,98-256
tataaaaataaaagtgattttgggattccagaccaaaggggggtgaccaggatttttgagtgaaaaatttttttaaccaaaaatctttcaaaaacatgtcattagggctattttatgacgctgatcacgaatacgtgatcagattttacttttaacatcgataagacctcagaatccctgtgtgattggggattctgaggcatcattttgagggcggagggggcaggttcggatccggacggtgtaaattattttc

SEQ ID NO: 79946 - DNA, 557 bp, Heterodera glycines
  Genomic contig location: Contig_ID=SeqID_256; Location=2132..2688; Strand=+
  SCN-specific regions: Sequence locations=1-101,133-258,280-306,329 -383,405-557
atggccatgttcacaaaacccgttctgtttagtggtgtttatttgtcgtggttttataacccatatgttggctatacggacgattttggagaaattgtaagaaaaattaattatgtaattaataaattttaacaattacagtactccaacacgatagcttctgcacataattacatcgttattattggtctatccagcatttatttgttgtttcctgtaattctttgttggcaaacctacacaatgtcatcaggcggccaccaaacacatcagtcatcttgggcagaaaaaatggcaataaacaaatatattttaatgactataatgaggttttttgtttaagcaaaaatgcaaaatttttgaaaaagctaattatcttttcaatcatttattataaatattcagatttttatccaagtgattatcataagtttgttcaattcaattgcctccgtaatttacatctcaatgcaatttgtcagaatcagcaaaatttacatcatcgttggcacttacgcatgggttttttcgagtggttagcatatttatttttaaaa

SEQ ID NO: 79947 - DNA, 1342 bp, Heterodera glycines
  Genomic contig location: Contig_ID=SeqID_256; Location=3099..4440; Strand=+
  SCN-specific regions: Sequence locations=1-128,158-497,528-670,692 -1015,1038-1106,1136-1136,1158-1183,1205-1342
atgccgagactgggaattatcaaaaaacggaaatgcaggttaaaatcaaattgtacggatgtgagggattcaatgcggacaaaattccacttgaacaacggacaagctgatcggcaaccgccggaaccaatgttcccaaaaagttttttgaaaaaagcataccgcaaaaaagtgcacatgcggtgaaatgaggaaactgatgaacagaaacaaaataataatgaaaaaatactacaatcatttttcattgcatattataatttttttgtatccttgaatttaatgaaactttcacgttacgtccttgtaaattattatacccgtccttggaaagtccttaaccctaagttgaggcaaggttaatgaatttaaatttccccatggcgcccaatcggcggcgcccaatcgtaccggcgcccaaacggcggcgcccaatcggcgtcgcccaatcggcggcgcccaactgacccggtccgcggcagtgccgataggcgccgccgggaaaatttttggaattttaaattaaatgaccaaatgttggttgccttttgaagttttgaggggtcggcggtgccgacaggcgctgccgggaaaaatttcaaaatttaaatgtaatttgttaaaaaaatttgtcaaaaatgaccaaaatttgggatttttaacacattttttaagaaattggagttttggggggctgtcggtgccagcaggcgccgccgggaaactttttttggaatttttaatgaatcttgttacaacatatcgccctttttatacttttatcagagacctcaaaattcaggacaaatctgaaaaatcaggacacttgggagccctggctataactgattggtgagggaaaagggaaaaatgaagaaaagaaaaggggcagagggataaatgaatagggatgcgacttttagtgacgaaaaatcccaaaatagtaaaatagtgaaatgccaaaatagtgacaaaaagtccgaaatagtgacgaatagtgacataattttcagccaaaaattgagcaaaaataatttttattcactgattgcagttgcaaatgagtaggactgggatttttaagacaaaaaaaccaaatagttacctaaaaaaatttttaaaattaaatttttttgccaagaaagtaaatttttgagaaaattttttttcattgcataggagtatattttgaaaaattttagcttgattcttaggggtgtattttttgaaatttttttaggtagattcttaagggtgtataaaatgaatgcatcattactaaaaatgaggtgacaaatttaatggatgtaacggaacgaccgctcggcgtagaatgttgaga

SEQ ID NO: 79948 - DNA, 275 bp, Heterodera glycines
  Genomic contig location: Contig_ID=SeqID_256; Location=4966..5240; Strand=+
  SCN-specific regions: Sequence locations=1-168,213-275
atgagaattggattttcgtgtgagaaaaaaaaagaagttcttatcataagtttgttccacacaattaccgccgtaatttatgtctcaatgcaatttgtcagaatcagtaaaatttacatcatcgttggcacttatgcatgggtttttgccaatggtttgtaggatttcttttaaaaaataattgaaaacttatttatttgtttttatttaaacagattcatattctttaaggttgtcatggtgtatttgttgctgaacaaacgaattcgaaatga

SEQ ID NO: 79949 - DNA, 4140 bp, Heterodera glycines
  Genomic contig location: Contig_ID=SeqID_257; Location=217..4356; Strand=-
  SCN-specific regions: Sequence locations=1-339,362-551,573-575,597 -1033,1056-1951,1974-4140
gatggcccagtgaatttataatcgccagcctcccggggtcatttagacagtaatacctatctaaaacaaactgtaaatggtagatatcgccgactgcattcggaggcagcaagtccaattcgatggtcccttgatcttctaacatgccaatccacttcccttccccgatcggaatccaagcgatcactgagggcgtacatcatacagaaattgagggtcggcagtaccatgacaaaggcgaattttggggaaggagttcagcagatttaagaatgaaaaaggacaaataatgtggttggattggcctttggccggtgattaatttccttctgttgagaattatatgttaaatgtttcttaaattctgtccatttttttgtattaatcatcatttcggtctttgttccccacatttcttctcctatttaaatgcttctcacttctcctgttcttcacttcaccatttccattgacttcactgttctgcattggaataaagcgcacttctctaaccgtctactcgctcattattcccccactctttggctggtcccccgtgttttccgcccattcgtctctccgcccgccgcccttcttagccctttcgttgccccctcgtggtcatcccccctcccggtcgttgtccatcccctttgtgcgacaagtggtgccgttagcgattcataatgtcttctgcacgatgccggatggctgcacttatccgtcttcgccagcacatcacctcagccgagaacttgctggatgaagacgatccggatgcccaatcagtcgactccctgagcaggaacgagaccacatcatccgaatcctgtcaaggatggaagtcgaactggatgcatggggtacaatcatgaacacactccaaggcccggcacgagaggcggaggaagcgctatttgccaactttgtgagagacgaccgtcatctgacggattggttagaggatgcgcgagagctgctggctcacatagcagcagagctcgcaaatccacctaaccaagtcatgccagcgggaggacagcagccagcagctgctgtgaaccaagccattgcacaagtgccagccatacctgtggcgatcaatgctgctgctggtgccaatattcagcagccggctgctgcgaatcatgcttatcagccacctccagtaccggtcgccaatgctcttaatatgccaatgccgccggcagctgctcctcatgccactgctcggcttccgcagcttagtcttcccattttttcgggcgaaccgatggaatggccttccttttggcaaagttttgagagtgctgtcgatcgtgccaccctcgagcccgtcgacaaacaattacctccacgggtgcttacgtggtgaggctgctcgcgccgttacagcctaccgtggagaagaaaattacgtccatgccatcgccgcactgaggcgactcttcggggatccacggaaaattgccgaggcactcagtccgaactgatcaatcttcggtcggtgacgatagcgttggatcactgcaacacttctcgagactttggaacgtgtgtgccgccaactttcgaacctcaacatgccggatgacagcccattcatgtaccaaatcatccacagcaaactgccgtccactggaactcgtcaaatggaacgtgcggcaggcatcccatggggtactcctcagctcagagctggactcgccgaagttctcggagtcagagaagaggttgaacggtgtctgcgcggaacaaatgccgacagacaaacacgatttcggcacgaagcaaggccaaatcgacctcagcgaccagaacggcatgaaaatgcgcgagttttttccgttgctcagtcagtcagaaattctgatgacaagcgagttccttcctgtctgttctgccctggccagcattgcgactcggagtgcaacaaagtgacagatgcagagactcgaaaaagatgccttttgcagcagaaccgatgccttatctgcctacggaaaggacatcagctgagagagtgccgatcaatgttagtatgccgcacgtgtaaagaacggcatcattcggcaatctgccctagtgccaaagggacatcttctgctcgtccaaagcaatcaaagcgctcgcccaggaacaaacagactttcggaactgagcgcaactcgaggtcattggtgtcatccgctgttgccaatgatgctgacccaatttctgagccgacaattgtcactacaatcatggcaattgtctctccattcgtccctcatacggcaactgagccttccgaaactgcaagacgatgagctcgaggtgaatcctatcgacactcggcagcccatccagatgaaagcgccacaacacgtgttgtgcgtccaacgagaggacggtggctacgagacgttggttgcccatcgaacggactggatcgtgccatcagtgcgccgtgccacattcctccagggaatgttagtacctgtggacgaggaaccggacattctcgttggaatggcagacttctggaagttttttaacggcgtccaaagagtgtctccgcaactgttcaacgttcaaacttcaatcggttccactgaatctgcgggcgcgatgaaattccgtctcgtccaactgccgatcatccactgtccgtcatgcccgtcaccgtccatgtttctgccaatgaagacaagatgaccaattcagctgtcagtgggactcagagaaacgaatccatctctgatcttgactcgctacggcaattctgggaccttcaaaacattggcatcagagatgaccccctcgaaaatgatgatgagacggcccaacaaatcttcgaccagacaactacgcgcctggccaacggaagatacagcgtgggatggccatggaagaattttccgccggacctgccttcaaattttgccatggcccatcgccgattgtcttcaattctcaaccgtcttcaacattcatccaaaagggcaaaactctctcaacaaatgcatgttcagagggcccgtaattatgccagaactcgctggaattctcatgcgctttcgcctggctgggattgcgctatggcgtgacttggaaaaggccttcaattcactcagcctgctggaacgcgaccgaaaattctgcaaaatgctctgggttaacgacgtccgtaaaccaccgttgccggataacgtggtcatctaccgatggtcaagggtgccatctcagaagcgctgaacaagtacatgagcagcaagactatgttccgcgcctgtcaaatgaacattcgcgaattcatctgtaactcagacgaagtcatgggccgaattccgaaggaagatcaactcgagaaagaagtgcctaaagtgctccgccttcactgggagttgaaaccggacaaactgtacatcgactttccgtccatggacaccgaaagtcgctgcgttacttgtcgaactgttctacaacagctcgcctctgtttttgaccctctcggactagtgtgcccggcacttcacgatgccaaaatgtttttccaatcactttgggaaaccaagctcgactgggatgttcctcttccgactgacatagttcaaaaatggaacacaattgccgcaacttggaaccagcaaaaggtccgtgtcccgcgccgagtcatcccgttggaagcggcctcgcatcagctacatgcctttgtcgacgcaagcaaagatgcctacggagcatgcatctcattcgggcacaacatggggacgcaatcacggcccatctcatttttgccaagagccgaatgaaaccaaagggatcaaatctcacttccgcgcatggagctcatgggaatgctgattggcattcggatgcttcaatttgccgaaaaacagctcggacttgccattcgccacaaattcatttggtgtgactccaaaccagtccttggttaggtgtcatcttctgagcagcaacctcgttttgtggagaatcggctaaaagaaatccgtgccgttgacctcgttcgcttcctctacatatcgacagagcaaaatccagccgatgtcgcctcacgcggatgcactgtgattgaactcacctcccatccactctggtggagcggcccaagttggctcatccatcccgaagatc

SEQ ID NO: 79950 - DNA, 291 bp, Heterodera glycines
  Genomic contig location: Contig_ID=SeqID_257; Location=7259..7549; Strand=+
  SCN-specific regions: Sequence locations=1-99,142-291
atgaatgcgttggaaacgggaattcttggcattattggtgccgtttattgtgactatccattgctgatttatacaaccggagcattgggagcaggtatgtaatttttattatttctaattttattatatatttttttaattcagctttgtggtatgccgaaacaagtgtcgaaatgttgctggcaattaacagatgcatggaattattaagaccagagttggcatttgccatttttagtggtcaaatttttatcaatatttttattagacaattagaataattaattaata

SEQ ID NO: 79951 - DNA, 736 bp, Heterodera glycines
  Genomic contig location: Contig_ID=SeqID_258; Location=479..1214; Strand=-
  SCN-specific regions: Sequence locations=1-130,160-260,298-358,380 -472,509-516,575-703,725-736
atgaagaccagccgaaagtttttgtgggaccaattcctcagggataaattccctaaaatccagaacattgccgtttattgtgactatccattgctgatttattcaagcggaattttgggaggaggtatgcaatatattttattgtaaaattttttaaaagtttgccatgttcactaagccaattctgttcagtggtgtttatttgtcgtggtttttcaacccatacgttggctatacggacgattttggacaaattgtgcaaattttaattaattttagttaatttttaaaattatagtattacaacaccatggataatgtgaataattgcatcgtcatttttggcctatccacagtttatttgttgttttctgcatttctaagttggaaaatgtacaaaatgacagaaaatcagcaaacatttcagccatcgtggacgcaaaaaatagcaaatatttgctgttaaaaacacattaattttaattttttcattatttatcattaaaatcctaaccctatttataattaaaaaacattaaattcaaataattttaaatgttttaaaataaatattcagacatttctacaagtgattatcataagtttgatacattcaattacagtcataatttacttctcaatgcaatatgtcagaatcagtaaaatttacatcatcgttggcacttacgcatgggtttttagcaatggtttgtttatttatttaagttaaaataaa

SEQ ID NO: 79952 - DNA, 781 bp, Heterodera glycines
  Genomic contig location: Contig_ID=SeqID_258; Location=1485..2265; Strand=-
  SCN-specific regions: Sequence locations=1-275,297-327,424-585,622 -633,655-663,702-781
atgtttatttgctctgccaatttgttatggttttgcagttgtcatgttcacaaaacccgttctgttcaatgggatttatttgtcgtggttttttaacccatacgttggctatacggacgattttggaataattgtgcaaagattattaatacatatatttaaaaatgaattacagtaccacaatacgatgcataccgtacaagactctgtcgtcatttttggcttgtccacaatttatattgttttttctgcagttctcagttggcaaacctacacaatggcatcaagccatcatacttttcagccatcgtggacacaaaaaatggcaaaaaaaaaattatttaaattttcttaattttccaaaactattttaggaaataaattaattacagttttttaatatcatttattttaaataatattcagacgtttctccaagtgatcgtcataagtttgtttaattcaattgcctgcgtaatttacgtctcaatgcaacttgtaagaatcagtaaaacctacatcatcgttggcacttatgcatggcttttttcgcatggtaagtcaaaaatttaagccatgaatttgacaactttgtaaataaattttgtaggatttttaattgaaattttgctatctttaaattaaatcattagtttcatactgtataaacaaagatatcaaattattttaatttctaatatgtgggttatgtttggaattgaaaaaatttgaggaatttttagtaattttttggtgcttgaaaatgcgtaaattaattaaa

SEQ ID NO: 79953 - DNA, 762 bp, Heterodera glycines
  Genomic contig location: Contig_ID=SeqID_2481; Location=438..1199; Strand=-
  SCN-specific regions: Sequence locations=1-259,296-723,746-762
  Gene Ontology: Mol. function=transposase activity; Cellular component= nuclear chromosome
atggacaaggacattatcaattttattgcttgttgcaatttgccgttccaaataatcaaccacaaaactttcaaaaaattgctccgaaatccttcggaaaatttacgcgacgaaagccattaccgaagaaatgttctgcctgaagtttacaaagttgttaaaaacaaaatcaagggagaaattgctgagtttgagaacatttgttgtacctctgacatttggacttcggatacaacaaaggattccttcataaggtttttatttgtttagtaaaatgaaaatattcaaaaatttagcttgactgctgttggtgttagctcaaaattttcacgcaaaaaatttacactcgctattcaaaaatttcatggggcccacacttcggaacgcatcgctgaaattctaaaagctcttctcgaaaattggaatgtaaaagaatgccattgttttgtgaccgattcggcagcaaatttagttaaggttagtttatgaaacatttcatttcaaatacattttttggaggcatttgatttaatgtacattgaacgaatcagctgtgccgcccatgacctcaatttatgtgtaaaggagtgcttttcaaaagaaaaagacgaaatggcacaaattttcgaaaaatgtcgaaaaattgttggaactttaaaacattcggcaaaattgatggatgatttaaaagatgttcaaggcgaacttgggctaccgaaagctaaattgcttcaagttgctaattaccaaatactcatttaa

SEQ ID NO: 79954 - DNA, 7209 bp, Heterodera glycines
  Genomic contig location: Contig_ID=SeqID_2481; Location=2361..9569; Strand=-
  SCN-specific regions: Sequence locations=1-88,110-406,447-470,492 -507,529-663,685-769,846-892,915-1089,1112-1350,1372-1507,1530 -1810,1834-2116,2141-2224,2246-2572,2613-2755,2785-2899,2945 -2948,2976-2986,3008-3018,...
  SCN-specific regions: Sequence locations=...3040-3046,3068-3499,3522 -3525,3547-3728,3750-3781,3819-3929,3951-4024,4046-4106,4128 -4143,4166-4285,4424-4523,4569-4820,4848-5083,5106-5108,5130 -5272,5296-5864,5893-6041,...
  SCN-specific regions: Sequence locations=...6063-6067,6092-6898,6920 -7209
atgcaggaaaaatttgataagaaagaggagcaattggagaagaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatttgattttcttttttgctaaaatgccgtaaaagatgctacagacgaacgctgatgccgaaaaggagaatgatgacaacatgaaaaatgatcacaatgaaatggagaagaaaaatggacaaaatggagaaaaaattaaacgcggtggggtcaaattataaatcacttacaaaaacacaaaaataaaaaatttttggcactaatattttaatgttttagaaaatagattgctttttgcaaaaagaaaaatctgttaatttcagcagatggcatttcaagaaaagcttgagaaaaatgtcatggcacaaattgatgtgaaagtgcagacgaaggtttactgtcaaatagttaagggaaatgagcaatggttaattactgtacctaccgtaacattattattataattactgtcaaatattaataggatttgttccaatttaagttattactgaaaaggcaattttgattgaatcggtgaattggagggacaacaaaaacaccaaaagagcaaggggagaaggagacaaaaggcgagttgtaattatttatttgagcaaaccgcaaggcaacatgtaattgcacttatagcggaaaacaaagtaatgaatacaatttaaaaaaaaatatgatatggtcaatacagtaaaatacataaaataaaataaaaaagggatgaattaccactcaggacttattttctaaataaaattctctcagaaaatttttaaatttagctaaacttccgatttccatagccgttttgggtagacaattccagggattaattgtacgaataaaaaagttatttcgagatttattactgaatcttttgttttgaatcctaaatgtttttcgttgcgaccttgaagaaaattcgaaatatttttttgggtctaaatgagttaagcccctaattattttgaaagtcatattcatatcagtgagcgaccttcgagtacttaatttctccaatttgcaaatctcaagtcttttttcatatggtattgccttgaggccacattttttgtatacgattcttgtgaaatatttttgaaccttttctattcttttactctgttcttttgaggagatattccaaatttcggatgcgtattcgaggtgaggtcttatatagcttttatatgctaggattaaggtactgatattccttgtttttaatatttttaaaatttgatatgccttgtaataggccgcttttaaaatttttgaaatatgattgttaaatgagagcttttgatcaaccaaaacccccagatcacggacacaatctacgcttaaaattactttctcgccaattttatactcagtctagaattattttttcctaaatataatgctgcgcatttctcatgcgcaatggctatgccattgtctttagaccatttgctaagttagccaacgctaaagagagtaaatcccttttcgcgtcattatcatgcgaaatgtaaattttaacatcatcggcatacaatttaattccgacttcaggcggaatataattagtaaggtcatttataaaaatcaaaaaaagaagaggcccgaggacactgcctttgttccaatttaagttattactgaaaaggcaattttgattgaatcggtgaattggagggacaacaaaaacaccaaaagcagcaaggggagaaggagacaaaaggcgagttgtaattacaaaattttattaagaaaaaacttcataatttcgaccttttcgcaattttcatgtataacttttttggtaattgtctaatcgcgaagtgatacatagaattagattcgaaacatgttaagctttcgaatgataccaacaatcttggatttggatgctaaagaaaaaagttatagcgaaaaacataaaaatttttgaaaatctgcccacagataacacacaagtacccaaaattgttacaccgccagatttttattttattttttatttttcagtttcgtcatttgagtcctaatgactaagaaatttcagttccgtctctaagattggcttatttttcggaattttcatcacaaaaagtcaaattttgccttaaaaagtgtaaataagttcctgtttgattacgcgtatttagccggtttcaaactaaaaatgcaaagttcgaaaaatttgaattttcgaacttttgttcgaattcatgtccggggttcgaaattggtcaaaatagatgccggatcgtgatcagcggccccaaaccctaggaaacatgctttcatgttttttgaaaacaaaaaaatcctttatttgatttgagtcatttatgcattattcgaattgcctttgattgttcagggcaaaacggtgacccaaaaagacaggcacaaactgctgcaggcgaaagttgggaaaacggcaaaaatgagataaaaataaaaactttattatataataaataaaaaaaaagtacaatggcgtcaggctatgtctactacaaatggagaaaattggcgagaagtgatgtcaaaaattgaaaaattaaaaaatttgaaatgacgcgtcccgccgtacattagtgttaaccggacggcaccgtgttttgtgaattgaataattaaatttatttatttaattttatcgatcactgagtttttgtggaacgcccacactgagcttttttgtggaacgacctagcaccggtaaaatctatcccactttaaaagtgctttacatgggacggacaatagaggctgcaacagttggaaaattttgcgcaatttttggcaaatattaaaactaccgtttatttttttttaattttaaaaattagagtcaattttttgttgttgtttgaggctattaaaaaaattctttaaaagaagtcattgacctagaaaaaatggagcagcacaagtttttatcagattttatctagaattgtcattttttaattaaaatatcccaaaatatgtacaaaagccccaatatgtaaataaaaatttttcaaatggttattttttggaaaaaaaaaatcctcgtaaaccgcccacttcggcgccggccttttcggcgccgttgctaacaacttttttcattatcaaccaaattaaatatttttgattcgatagctcttgagattctctattagattgcaaaatttcaaaaaatttagtcagtttacaaaaacgttgtggccaaaaaacctcaaaaattgactttttcttggctttttcggcgccgtgtgccataacttttttatttttgaatcatttattctattttgacatgtgaatatagagcacacatagagctttcaaatgatgccagattggctaaagttatttttaatcaatttatttcttcttctgctgctgatcactgtttttgttgttttgtccgtcactaattgtcagaagaagacggcccatttgtgatgctttgtcccgtttcttctgccggtggaggagaaaaaatttgcaaaaacggcgcattctataacgacatcaataacattcacctcccccaaaatgatcacaattatgccaatgccaatgtgaatcccgaaaacattatcaattttctcactggtttttcccgaaactatgaaatgcgaccttagtttgttctgaaatttgttattttttgttatatttttataaaattttaatttttccgtttgacgcacatccgaccaaactgacaaattactgtagaagatattagccgcaagaaataaaaaaattaaaagttaagaaatttgtccgaatgcgggttcggattcgaaacatggatgttttgcacaaatccgaccaatttcagtcctaaacagctactcacgcgaaaacggccccgaccgattcttagggggtctaagaatctctatttgtaataaattgtttgaaatttgccggaaattccctgagaaatttaatgatttttttaaatcgttaatgggatttggggaacaagctgtgctcctgcaaacccacgccacaacataaattttttgcctatgtgtaatcgaatgaatgcatttttctttcgaaaattgtgtagttttcaggattttgacggggatttacgacatccattagcaatattagcaccggcaaaattaaaaagtgtcaaattgctgctgttcctccctcttttctgcttcattctctcttcctcctctttctccccgtccttcttgcttcgaatttttcctttttcactctctctcttccgtctctcctccttccccaatgctattttcatccttttcctcctcttccctcgtttctccatttttgctaccaacaaatgttggatttggttgacaaagaaaatttctaaccttttacaaatgaaagttgggtaaaaattatccatccaattgattatttgattgattgatttgtgggtggggggataaggtaaaacgcccggcaaatggtaccatcaattgtagcaattttttcatatctttacttaaaatcaatcaaatttttaattccttatatcattcgatagttctagatgttttctatgagtctgtatcgttttggcgccgccgttttggcgccgccgttttggcgccgctgttttggcgacgccgttttggcgacagggtcgttttggcgctgccgttttggcgccaagccaaaattaaaaaattgtgaatccaagatcgatttcaatttttaaaaattacaacttttcataaaaatgtaaataacaataactagggccccgacttttagtgaaaaaactttttttttgctcaattgttttgaagaaaggagctcaaaaaacgcatttccgcgtaaaaaatttttcatttggacgtcatttttcgtcactaaaaatcactattttggcgttttgtcacttaaaatagtgaaaattcacttttttggcactttttcgtcactaaaagtcggggccctaacaataacaaacaaaaagaagacaaataagaaaattcatgggttcatatgataattgcgcgaaacgccacgaagaaattccaaaatgatatgatgattttgatttgggttaatgtggtaattgtgatcgttatcattgttcgggttcacggaatgtaattctacaccaaattgaagaggcgcttgtctgccgcttatttctgcgtctctgattttttggcgccaaaacgaccctgtcgccaaaacggcggcgccaaaacgaccctgtcgccaaaacggcggcgccaaaacggcgtcgccaaaacggcggcgccaaaacgaccgattcccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgccttaaaagtgaaaaagtcatgaaaatggtcaaaaaaatacaaaaaaagaaaattttgaaaaattattgggcatttatttgaccacgaatttgagtgccaaaagacatttttgtaaaaaaaaactaatttttccaaaaaatcgccaaaatatgtgacaaaaactgccgaaaccccaaaatatgtttttattcccaaaaagcccaaaataaatatgtgctaaaactcgctctgattgaaaggaaaacaggtaaaaatgctatttttgagattttcatgcgatagataaaaaaatatataaaaacatataaatccgttccctgataatatccgtcaagaaataggaaaaccataaaaataaagctttaccaacgcaattaattcttctgctatttgtgtgacatcattcggagctcggccaaattgtgctaattgcctcaaaaatgaaccgacggtaaaaggattttaaaagtcacacaaattcgtcatttatttagctaaactgttttccataatttcagttggatttgcaacgacgtttggatggacattttgcccagttttgaccatgcccaactcggcctcaaattggcacttctttcgccacgtttcaatgcgttggtggacaaacatttcgatggcaaaagcgaattgacaatttggagaaagatcaaaattcatcgcaaggacaaaggacctgaaccgaagctgtctgtacaaatggatgacaaatttgtgccatttccattgcccgaccgtccgctgcccagcaaaatccgttttaagaatcttcagattgagtaattcggaatcagagatttatggcaataaaagcattcatcccatttttaggtacatcgatcactccgtcatcgcttttcttcgttcaaatcaccaaattttcaacaaaagaaacatcaaattattgttgtcgcttccatcaccacacaacacggatggccagccaatttgggatgtttttgttcgcgaaatttggccctttttttcggcaaacattcgccacttgcgctttaacgatggtgatcatttggacaatttgcttcgtcaaatttcgccgacaattctcatcgatcttaaccaattgaattcaatctattcatttggtctgtcgcccgctgcgattgatgctgattttgatgcaacaatttctgctggccaagcattgtccaaatggttgcactctccgagaaaagatggccaacccaagcgattgcattgcgaagatcacaacgaacaaacgaacactgattggatcaacaatttcaaggaggtgtggccataatctcgacaaatcactgttttttgttttcaaattgtttagcattttctccgtgccaatgccatttcttccgtcagttacgaaattcatttttctgttcatgtgccgtcaatacaaatggtgccatttgaattggtgaacgaatcgacaaatgaaaagctgacattggccaaagcaaaagaaaatgaatgggggggcatcggttggataatgaaacgatgcaaaattattggggagacggcggcggttcattgggaagacggaaattgggacaataattgggacaatgtgatcattttgcttgatggtggcactaattgcattgggtga

SEQ ID NO: 79955 - DNA, 933 bp, Heterodera glycines
  Genomic contig location: Contig_ID=SeqID_2481; Location=5134..6066; Strand=+
  SCN-specific regions: Sequence locations=1-13,152-271,294-309,331 -391,413-486,508-618,656-687,709-890,912-933
atggagaaacgagggaagaggaggaaaaggatgaaaatagcattggggaaggaggagagacggaagagagagagtgaaaaaggaaaaattcgaagcaagaaggacggggagaaagaggaggaagagagaatgaagcagaaaagagggaggaacagcagcaatttgacactttttaattttgccggtgctaatattgctaatggatgtcgtaaatccccgtcaaaatcctgaaaactacacaattttcgaaagaaaaatgcattcattcgattacacataggcaaaaaatttatgttgtggcgtgggtttgcaggagcacagcttgttccccaaatcccattaacgatttaaaaaaatcattaaatttctcagggaatttccggcaaatttcaaacaatttattacaaatagagattcttagaccccctaagaatcggtcggggccgttttcgcgtgagtagctgtttaggactgaaattggtcggatttgtgcaaaacatccatgtttcgaatccgaacccgcattcggacaaatttcttaacttttaatttttttatttcttgcggctaatatcttctacagtaatttgtcagtttggtcggatgtgcgtcaaacggaaaaattaaaattttataaaaatataacaaaaaataacaaatttcagaacaaactaaggtcgcatttcatagtttcgggaaaaaccagtgagaaaattgataatgttttcgggattcacattggcattggcataattgtgatcattttgggggaggtgaatgttattgatgtcgttatagaatgcgccgtttttgcaaattttttctcctccaccggcagaagaaacgggacaaagcatcacaaatgggccgtcttcttctgacaattagtgacggacaaaacaacaaaaacagtgatcagcagcagaagaagaa

SEQ ID NO: 79956 - DNA, 404 bp, Heterodera glycines
  Genomic contig location: Contig_ID=SeqID_15653; Location=1393..1796; Strand=+
  SCN-specific regions: Sequence locations=1-163,210-321,359-404
atgatagtaattagtggtttatttaaattagtctctgccgaaagtctcgtggtgatccccgatattgaagcacaagcattcaaagtgatgctcagcttcatttacgcggaagatctgagcgaattaaacggagacaacgtaatggcagtgcttttcgctggtgaattaaattaattgaattttaatttgttttaaattaaaatatttaagccaataaatacaacatctctttgttggtcaaggcttgtttggactttccgattaatgaactgtctgacgtattcctcgcttataagcaagctcgccttctcaacaaaaaagtattaatgatttttaagtatttaatttattaaaatttcataaatcttttgtatgagagcgctaatagcttttgtttattttaa

SEQ ID NO: 79957 - DNA, 1554 bp, Heterodera glycines
  Genomic contig location: Contig_ID=SeqID_15654; Location=758..2311; Strand=-
  SCN-specific regions: Sequence locations=1-527,549-946,968-1459,1481 -1554
atgagcgaagtggcggatttgagtagagattttaatggcgaagtttttaacaacacgtcgaacagctcgggattcccacactttaccacttttacggtgtgtgacaattaaatgaccagaagcattaattgaccaatcaatttgaaaatattttgctgaatgaacaaaaataatttatttcaaattatctcctttcctctcccgttttaggtcattttttaaaatatttctcgctattttggtagcagggcaaagaaactggatagtctgagctcttataaattatgagattttattttttttttctctcaattttttcttttcatattaaaaagtaattaattgccattaagacaaaaattggagttgcaaatgttcggcggcaatttaccgaattgtgccgcaaatggacggtgtttgggatttcaggaaggaatttaaagaccatgtttttaacggtgaattatatgactggggatttaaaaatttcattaaattttcggtgaggaataattcaattttttgcttaattcttccaattatgaggtaattaaggaattgatggacccgagcaaaggcttttacaacaaaagcgaggacaaagtgacactaactgttgatttcattgtaaaagaagcaaaaatggcggaagacaaatcataaacaattgaacaaaaaaaagatccatcaattgtcatagatcgcattttgcattgtttctaagatttgtccggtactagtccagtttttttaccccattttttgaccacattttttttcaattcttcacacaccatcccagaaatgagctgctgtaccaaaaaagatttgcgtgtgtggctcagtggtttttgtaagatagtaaagggacaaagggtggtggttcgagtccgttgtgcaacatgaatattttcatttatttatgtccaaaatattaaaaaatgacgaattttgggaattatttttgaaggtttttcccaaccaaattggaaaaacttgatatcattcgaaagctctttatgaggagaagctttttctaagcaactgctaagcaattggattgattaggaaaaagatatgagggttcgaaattttgtttctcgaataactttttagttaaccctttttttgcgtttaaaaacccttacattttgtttgtaatttttttctctatcgatatgcaaaatttggagtggatctaacgtatagaaaaaaaaattaaacgtagcgaagtaaattcgatttttctctattatcagagacaaagaaatagtacgccaaaaagagagatgtttttttctctgcactctctatttattggtacacttctcgttttttgggatggtgtgttcaataggccaaaataattgtcatattcgtggtcagcgacctcaaaaacccccgaatatttgttttcataaacttttaatccaaaaatgagttgaaaaaaatgttgactaaaaaatgggatacaaactgactggagtagcatttgtccttaattccgcctttcatcttcatcttttttttaatttgtctgattttgataataaa

SEQ ID NO: 79958 - DNA, 515 bp, Heterodera glycines
  Genomic contig location: Contig_ID=SeqID_15655; Location=362..876; Strand=-
  SCN-specific regions: Sequence locations=1-301,323-515
atgaaaaagtgagccatttttttataaacaattaattttttgatgaaaattgccccattataggaaagaatttttgggtcctcgggaaacgtttgaagtgtacgaaaagcggaccaattcgccgctgaatgtttcgcgcgtgccatccccgcagggcgtgccggtggcatctccgcccaatccgtacgatcacatgccggtgccaatttcgatgcccgcagaggaagctaagcgaaaaggtcagttaatcaattggaaattgccaattagcttcatcaatcccgaccccttcattcattaatctttcctttcccattgctctacagtacccctaccgttcatcatcggtcttgccgttgccgttcccatcttcgttattctgatgcttttccttgctatttggcttcaagaaatgggcattatttaatcaaagcatattttgtcaccattaaaattaatatttaaatgtttattcgataaaaaatagcgaatgaaatttaaactaaaataataaa

SEQ ID NO: 79959 - DNA, 1031 bp, Heterodera glycines
  Genomic contig location: Contig_ID=SeqID_15655; Location=1020..2050; Strand=+
  SCN-specific regions: Sequence locations=1-231,295-403,448-505,527 -585,607-647,708-742,827-905,928-981,1004-1031
atgttaaaatggactttaatgtctttttataaaagaactgatgaaggacaaaagtgtccgtccgcacattggaattttggaatggaagaaaagatgcgatgggaagaaaattggatgatttgggcggagatatttaggggggtatgtgagacatcattttatgggtgcgcgtgcataatcaatggaaaacaacagcgaacgaacaagcgaactttcccatttaagagattgaaatttatatatatttaaataaatttaaattaactaattttggatatttttctctaaatgcaagcagattttgaaggataaaaaaagaaagggaattggggacaacaatatccaaaggtaacataaattttaaaagtgcaattagtataaaatgttagaaaatgcttagggcaataaaattaatatttaattattttgcattaattaattattaatgttgttttcaattgtacacattaaaacatggaacggaaagtgatttttggctattgacaacaaaacaaacaccaaatagcaaatacaaaaacaaccaaattcaatggaccattcgaatttaattcattccgaccggttggaaagggtgggagagattaagagattacagcgaaagaaaagggtggcacaacagcgaattggagagaaaaagaaaaacagagaacggaaatagacatagagagagaaaaagagagagagggctaaaggaacgcgcaaaaaaaagagcggaaaatgccgaaccaacggagaaggaatgaacgaaggaaaagagggagcgaatgccgtggcatgacaaagaaatgaacgaacgaacgaacgactaactgaatgtgactgactgttgttgcttgttgctattgccaatttgtgcattcgttacatttttaaattatactttatggcgaaatatttattttaaatgcattaggtaaatttgaatttcgctaacaaatcaaacaatccatccattcggtcggactttttcattaaatgctttaaattttcagaagattttaccaatttag

SEQ ID NO: 79960 - DNA, 111 bp, Heterodera glycines
  Genomic contig location: Contig_ID=SeqID_15656; Location=1055..1165; Strand=+
  SCN-specific regions: Sequence locations=1-111
gaatgtgaaagttcgcattgccgtggccacgtggagaaacagcgaaagccgccgccgtcggacgatggaaatggcggcggtgggcccggcccttcgtccatttcaacctga

SEQ ID NO: 79961 - DNA, 1258 bp, Heterodera glycines
  Genomic contig location: Contig_ID=SeqID_15660; Location=470..1727; Strand=-
  SCN-specific regions: Sequence locations=1-32,135-180,206-222,330 -341,372-391,451-490,645-677,699-713,735-782,848-931,957-974,1000 -1133,1158-1200,1236-1258
atgtttctcttttattcaggtaactctcgcccttaaaatatttatttagatttgttattaaaattatagatttttaaatattctttttaatttgtgtaatatgtaaattttagttaattgatttattatattttggaatatctccgagtattaaatatgtttttcataaacaaataattaagtcatttatttatatttattatgctattagttaaacctaactttttattaattttattttcatcttttaggttcctaagtcttaaatatttatttatttaaatttacatttaaactttctttctattttttacatttttatttttgttgtccaaaagatgaaaattaatttttattcaatttaattttttcatgcagaataagtcaattctttttttattatatttgttattattaattccttttttcaaatatatgttttttaaatttcttaatcatgtctcatgtattctctctcctgatcaatttctttataaaattaattttgtaattttttatcattttctattataagaatatgtagatattattttcaatttaaattggaattttcttatgatttaatattagcaattttattcaatttcaaaattaatattaataactaacatatatttttttaactgaatgtaattttttaaatgtttattcttagctttactttaattggttaaatatttgttgttttataatttctcttaactttttcatttattccatatatttgccgccttcattgccccctgtattctataagaagattatttttaataatatttttgtatttattttttattattttataaatgttatttttaatttatttgtcttgcattcattataaaattacatttaaacaagtcgctgtgtcctccgacacgagcggcgaatttggtcgatctcgtattaatataaatatttttgtagtacatatttagttttataatctaacgaatatttatttatttattattttttcattttcttgttcataggtgccattattcattaatacgaaatatatgcaatttattgcgttattttgtatttccatttgtgttttttttattaattagtttgaaccaatgaggaaaattttgcataattaagccatataattaattttttatattttagtaattcacttagacattgaacagtttaaccatcaccaattcctttttcaaattgttatttatttatctatcgatatcctttaaacaatatttaaaataaa

SEQ ID NO: 79962 - DNA, 282 bp, Heterodera glycines
  misc_feature (246)..(246): n is a, c, g, or t
  Genomic contig location: Contig_ID=SeqID_15661; Location=38..319; Strand=-
  SCN-specific regions: Sequence locations=1-146,172-186,208-282
atgctcaggcatttcctcctgcgccccctgcccatccatcggcgattggcatttgtgccgttttccaccggcatcaacgtcggacacttttctgctcgtgcgactccggcggcacaaaatgcgatgccaactgcgccgatggccaccacggcggcgctggcggcggcggctgacggcgacccgccgaaacagcaaaaacaccaacactttttggcctcgttgcccgaactgaagcagggccaaggngatgcggtcgtcgattttgaggcgttggacaaaaaa

SEQ ID NO: 79963 - DNA, 1139 bp, Heterodera glycines
  Genomic contig location: Contig_ID=SeqID_15663; Location=311..1449; Strand=+
  SCN-specific regions: Sequence locations=1-107,136-489,511-534,556 -566,610-611,640-971,993-1002,1024-1027,1049-1139
tctaaagcgctttgagaatcccccggagccaccaagagagcgcatgcctttttattccagtaccgtggcgcgctttgagtgccaaagcgaactggactcagcggccaaaccgagaggaagagaagaaagaggagaccgagaaaggatgagccttggaatgagcggaaagcggatgttcgcaaacacgctcaaatcggcagtcgggacagtggaagatcgtccgtgtattccccctgagggattaaatcgcgaaatgctcaaaagaagaccgactccagcaccagtgccgcagtttacgacacgcagcgcggagaggagccccgtgaggaagacatacgcgccgtttcggaaagggatgccactggaacgcgcagaggaagccatctacaaaatccgcaagtcactgctcgaggccgcggacttcgacggattttcatcttttcctacccccttccccctcacaattttattatttactcattttcaaatattaaataaattagaatttttgctctttatccttttccctagtggccaaaaggggaaaagaaataaggcgaacgtttgaaaaagagggggaaagagagagagaaagagagatagagagagtaaaaagaattaaaaatgaaaaatttaagaattagttgttgtgttaattgcgcgtccatcattcaggcctcgacagcatggaattttggagggtgccgtgcgcaaattttaactgcacttcaaagtgcttcgccataatatggccagaaggaactcaaaaacccagtaattcgaacttttttttgctctgatttttttgtgcataaataaaaatttttgaaaatttgcaggctaatagcatttttcgaatgctttcgaataataccaggaatgtttaatttggatgagaaagaaaaaagttatggtcgaaaaattcgttcgacgacgtttcggctgacgacgttttgtcctactccgcctccggtgtgcctgaactcttcacattggaattgggcttttccgttgctttgcgccgtcttcagtctgctcctttccatcacttgcgtcatggctttccttctgttgcgccgtcgtcgccgcagctcttctcacatttccttttgcagacaatgccatcgcttttccccgaa

SEQ ID NO: 79964 - DNA, 219 bp, Heterodera glycines
  Genomic contig location: Contig_ID=SeqID_15663; Location=1058..1276; Strand=-
  SCN-specific regions: Sequence locations=1-219
cggagtaggacaaaacgtcgtcagccgaaacgtcgtcgaacgaatttttcgaccataacttttttctttctcatccaaattaaacattcctggtattattcgaaagcattcgaaaaatgctattagcctgcaaattttcaaaaatttttatttatgcacaaaaaaatcagagcaaaaaaaagttcgaattactgggtttttgagttccttctggccata

SEQ ID NO: 79965 - DNA, 703 bp, Heterodera glycines
  Genomic contig location: Contig_ID=SeqID_15664; Location=155..857; Strand=+
  SCN-specific regions: Sequence locations=1-122,178-286,355-525,547 -566,588-641,687-703
ggaattgtgtgttgtgaaaaataatgacaccacaattctcaaccatcatctttcaacatcagattcatgtttatatcagcacacaaatgcgattgacacattagtacgacttggtaaaatggaaaaatatttaatttaattgactttaatttttaataattattttttaattaaatagctgaacgtaaagaattcaatgggatcagtggaaaatattttgatgctaatggcaaggaaataaagcttggcgccgacacttcggacgtcagggttcaagtaaacgttcttttaaatttaataatggattagtaaaagtaattaaaatataaatattaattaatgaaatatattattgctattcaaggacaaattatggattgaatcatcattaatttgcaatgcaattctcggaagaaaaacggctacagagtcaacaattgaaaattcatttaaatatgccacaatattccaataattataagtagtttctcactgaaaatctttatggcaatttaagcattggaaatattatttttaataatgaaaatttgcaaatattagaggctaccataaaaaaggaatttatgattgagtaattttatttacaataataatatttcaaattgctaaaatttagttgcatttttttctaattattttattaatttattttgaattttaaaattgcaaaacgatctggtaa

SEQ ID NO: 79966 - DNA, 815 bp, Heterodera glycines
  Genomic contig location: Contig_ID=SeqID_15665; Location=5..819; Strand=-
  SCN-specific regions: Sequence locations=1-64,108-289,351-481,506 -664,687-815
  Gene Ontology: Mol. function=signal transducer activity; Cellular component=heterotrimeric G-protein complex; Biological process=G -protein signaling, coupled to cGMP nucleotide second messenger
atgatggaattggtggatgttgtcactgaccttggcttacaatttggaaatgcttcattaatcgtaaataaattataaaatttatttttaaattttaaatataaattctaaaaaccaatttagaatgatgttaatgtgttgcataaacacatagcaaatggcttagaatttgcaatgatcacggaaattttgaagcaagcaattcaaccaatttggcaagaccagtcaattcaaattgcttttgaaaagcgatcaaattatcaaatccaagacagcgcacaccagtgagaaatttttttaataaaatatttttattgtaatttaatcaagttattattattatttaaaatctgatcaatgaatattaaagcttttttgatcaaattgagaggatagcaacgagggattacagaccaacaaatatggatattttgctgactcgagtgccaacggcagggggtaagtgccggatgcaaacacaaaaagaaattgttttgttttttggaggaggctgatcccgagcaattttcgaaataacccggaataatcccaaaaaaattccaacgaaacccagactcatcagtgttgtatgaagcttaaaaaaatgaattttagtgttcagacttcaattcaccttgagggacatcgatttcaagtatattggttttaatttagcaaaaatatttttatatgcaattaattagatgattttaagtgtctatgatgcaggtggacaaagatcccaacgtagaaaatggattccattcttcgatgatgtattatttaactaaaaagaattctgtatttttaataaa

SEQ ID NO: 79967 - DNA, 513 bp, Heterodera glycines
  Genomic contig location: Contig_ID=SeqID_15665; Location=851..1363; Strand=-
  SCN-specific regions: Sequence locations=1-116,146-156,178-234,268 -298,350-394,416-437,459-484
atgggctcatgccaatccacggaagcaataatagcccgagaagcatccaataaaattaacaaaatgttgcatcaaaaaccagaaagatatgttcaaaagctgcttcttttgggtacatatattttttgtaaaaataaaattggaaattcaaattattaaagaattcttccattataatttaattgtttttcatgattaagggcctggtgaaagcggaaaaagcacttgcgtaagtaaaaattatatatttatttatattatttaaatgtgaaatttcaggtaaaacaaatgcagcatgtttttaattaaataattttgataatttaatttattatttaaaagaattttacacacaaacggattcactgagaatgaagtggaagagagaaagtgcatcattttttcaaatacaggtgcaaaatattatttcttcttaatgtatataattttgaattttactgtgttattttcattaaatttacactaaattaaactaatttttattttaataaa

SEQ ID NO: 79968 - DNA, 1306 bp, Heterodera glycines
  misc_feature (14)..(15): n is a, c, g, or t
  misc_feature (34)..(34): n is a, c, g, or t
  misc_feature (81)..(81): n is a, c, g, or t
  misc_feature (223)..(223): n is a, c, g, or t
  Genomic contig location: Contig_ID=SeqID_15667; Location=1..1306; Strand=+
  SCN-specific regions: Sequence locations=1-101,123-298,321-571,594 -1306
  Gene Ontology: Mol. function=beta-14-mannosyltransferase activity; Cellular component=integral to membrane; Biological process=N-linked glycosylation
atgccaaaatcttnntaccagctccaaaaatcanttaattgtagacccgcaaagttgatactaccgaaaatgtttcctttntaggatttcttatttggtcggtttgatcgaaggatttttcggtcgaagggcttcgtttaacttttgtgtgtccaatgcgatgaaaaatgacttggaacgccgctggggtgtgaatgctatcaccgtttatgaccgtccgccnaaattggttctccaagtaaatctgttagcattttcaaagtctttgatccatttttaagaaacacgagctccgaagaaaagataaaattcttgcattgctttacgtcggaaacactgagcggactcaccgagggtaagttgttttgctaatagttcattttatgcttacttaaattcaatttttagaatggaaatttgttcacgaagaagctgatggaactctcacgcttcgtgaaaatcgaccgtttctcgctgtttcttccacaaggtatgaatggaaggaataatgcaccaatccatcactgggagggaaggggtgctagagggctttagcccttcggacccgaagaaaataaaaatttttcattttccggcgacggtggggcgggggatagatcaaaattcaccttgggactttcacaatgaaccacttattgttagctggactcctgacgaagacttctccattctgcttgatgcgcttgtccgcctcgaccaacgaatggccgacgtggaaacacagaggacgtccaaaacacacccgaaaattgtggtggtcatcactggtaaagggccgcagaaggaattctacgaagaacgcattcggaataccaaatgggagaaagtgcgcattttcactgcttggttgtcggcggatgactatcccaaggttcccaccaatgcttagttttctatttactatttgccccttttcagtttctgtcctgtgccgaccttggagtttctcttcatacgtcgacctcgggtgaatagctgatgagtttggactcgtttaatttggtttccctaaggatttgatttaccgatgaaagtcgtggatatgctcggcagcggtgtccccgtgttggccaagaactttcccgccatcggtgaactcatcgatggaaccaatgggctcctctttgatacgcctgaagaattggaaaatcttttggccgacctttcgcttggatttcctggaaattcggttcttgtctattttctagtgatgctcgagaccaaaaatttcccgagaccgagactcgaccccgagactcgagacccaaaaccccgagaccaaaaa

SEQ ID NO: 79969 - DNA, 1487 bp, Heterodera glycines
  Genomic contig location: Contig_ID=SeqID_15668; Location=194..1680; Strand=-
  SCN-specific regions: Sequence locations=1-120,143-160,183-660,713 -823,846-1000,1032-1082,1104-1115,1141-1211,1240-1336,1371-1487
atggagaaaaacgaaccttatgagaacagtgtcgtcgaagacgatgaatttcatgtggtgcagtcacacaattcgttggtccattcgggcagcgcacttttgaggaagccgcggaatttgggaaagagatggacctggaaaagtaagaatgaaaaaaaaacaattactgatttggacagatggaaaacggatgtacccaaaattttgctgccaaaactttaaaaaattttcaaactttgaattctttcaagaaaaaaactgtaaaaagtttttataagatatcacaaaaagtagtaatttttttttctgaatttttttttgcgacgaggtttcggccggtgacattttttcctgctcccttcccccccccatcccctcgcgaaaaatttttgtttccgcaattccttagaaaaattgttccttatttgggcacagaccccgaatgatggtacacgcccccgacaaaccttttcaattaatgcaaattgttgccgcttttgttgctcgttcagtattgttgcacggtccaattggattggtcggcacaaatgtcttcttcttcgccatcctcaaatcgcgatgaatgttgccgtctccattttttgtcaagcgtccgattcgggaagggtgggccgatgcaaagctattggaacaaatgtgaattattaatagtaatatatttaaattttgaaaaaaaaaaactaaaatttatccgccggcaccggcgctacttggcaaaacaggacattaattattctcaaaattctgtccaagatttaaataattgatttttttggacccatttttcatgataagtcaaaaacaagtttttgaatgaaattttcgtttttatttgctcatttaccgagaagtgcacgctgttctcaaccggacgcgaccaaaaccaacttgcgcgggtgggcagcagaaacaatacgacaaaaggcaacggcgtgggtcttgaataagaaaaaaaaattgtcagcggcattccgagtgcgttttttatttgagaaaattaaattgtttaaatttgacaggcccaaagccaggaaaaaaagttttcagatggggggaatttgaatttttttgggccaaaaattcataaaaaaaattatcccaatgttatttttaaaatttgctatttttcgtcaaaaaatgatgactaatgtctaagaactttcaaatgctaacaagtttttttttggatttggacataaatgaaaaaataaatgtttacggattagtaattcataaatagggcattttggaatcccataattaaggatatgtatttcgctaattatttaaaatccagttacgtctccagccctggttttaatttgaaataaaatatattaattaaaattcaaatctcaggtctacaagttgtgctcaaatccattctgtgtgcgatggcaccactgcttcaattgggctattggtgctgtttgcaattgtcatttttgccatcatcggattggtca

SEQ ID NO: 79970 - DNA, 551 bp, Heterodera glycines
  Genomic contig location: Contig_ID=SeqID_15668; Location=1114..1664; Strand=+
  SCN-specific regions: Sequence locations=1-385,408-425,448-551
atggcgaagaagaagacatttgtgccgaccaatccaattggaccgtgcaacaatactgaacgagcaacaaaagcggcaacaatttgcattaattgaaaaggtttgtcgggggcgtgtaccatcattcggggtctgtgcccaaataaggaacaatttttctaaggaattgcggaaacaaaaatttttcgcgaggggatgggggggggaagggagcaggaaaaaatgtcaccggccgaaacctcgtcgcaaaaaaaaattcagaaaaaaaaattactactttttgtgatatcttataaaaactttttacagtttttttcttgaaagaattcaaagtttgaaaattttttaaagttttggcagcaaaattttgggtacatccgttttccatctgtccaaatcagtaattgtttttttttcattcttacttttccaggtccatctctttcccaaattccgcggcttcctcaaaagtgcgctgcccgaatggaccaacgaattgtgtgactgcaccacatgaaattcatcgtcttcgacgacactgttctcataag

SEQ ID NO: 79971 - DNA, 292 bp, Heterodera glycines
  Genomic contig location: Contig_ID=SeqID_2482; Location=1551..1842; Strand=+
  SCN-specific regions: Sequence locations=1-292
attcgaaagctcttcacaggctctattagcctactaaaaattacagaaaatttcgaactataaaaaaaagatagaaataaaaaacttcgaaaattctgccttttttgcggttttcaactgacaacttttttgagagctgattaatcactgagaaatagcttataaatatcttctaaacatctagggctttcgagtgataccatgattgtgaagtttggccaacaaagaaaaaagttatagctttttgaacattgctgagatggagttggccagacggagttgacccctaccg

SEQ ID NO: 79972 - DNA, 326 bp, Heterodera glycines
  Genomic contig location: Contig_ID=SeqID_2483; Location=2812..3137; Strand=-
  SCN-specific regions: Sequence locations=1-118,181-326
atgccatttacacagagtcccgaaaatgaactcctttatcaaaaaggtgccgtgtgtggcaaaaaagttttttgtaagaagtaaacggaaagaaggaggagggtcgagtccactccacaatattaatgtttttatttatttttctttaaaaataaaatgattatttttgaaaatatttttgaagctttattaattgatttttttgcagccgaattggatgaccttgacgaaagcttttctaagcgaaaaagataagcgacaatgcactataaaaaaattgtgggccttgaaacttttatttttgaatagcgaaaagttgtaataaa

SEQ ID NO: 79973 - DNA, 102 bp, Heterodera glycines; identical to SEQ ID NO: 51993
  Genomic contig location: Contig_ID=SeqID_2483; Location=2217..2318; Strand=+
  SCN-specific regions: Sequence locations=1-102

SEQ ID NO: 79974 - DNA, 736 bp, Heterodera glycines
  Genomic contig location: Contig_ID=SeqID_15669; Location=34..769; Strand=-
  SCN-specific regions: Sequence locations=1-32,55-75,97-171,194 -563,585-686,715-736
atggagaataaatttattcttgttccttccgacttgtacaaaaatttattaaagcctgagtctggcgagattaacgttgaaaatgctaaaaataaattgtcatcacttttgaagcagagaaaattagacgctacttcaaaaaatttactttataaccaggaattgaggcgtttcttaaaacttaggaaggaagttgaagaaaaaccggtaaaggttgagctttcagatggctcattaatggtgtttaaaccaaaacagcgtgaaagagatagcaaaattcctactcaaattgttaatgacgaaggattggatgaaacaggctctattccaacacttgaagacccttacactactgctgaagagagtgatgctgagtcaacaacatcaacaccaaagacgagaccactgataagaccaatgcgtgttggaacaagtaaatttcgtcaaaaacaaaagtcttttgtagtcaagaaaaaaggaaaaattatgtcaattataaataatgaccctgagaaatttggggttggctctaaaggacatatactgagagctgatggaacggcatatttaaaaagtaatgttaatcaagcattagagcgaatattgagacggtcacccgagaatgctccatcacccataggtacaaaagctttagagcaacgactgagaaacgacccgaggactagtggaatattaaaacaaaaatttaatgaacaatcgggatcgagcgttaaaa

SEQ ID NO: 79975 - DNA, 402 bp, Heterodera glycines
  Genomic contig location: Contig_ID=SeqID_15669; Location=952..1353; Strand=-
  SCN-specific regions: Sequence locations=1-222,244-362,384-402
atgaaggtagcccgaattaattcacaatatattgttttaatgtctgctccgaatgctgcacttcaaatacgtaatttgggcgttcaactgtttccaaaaaatcttacatttttcctaagtgcctataaagatgcaaccgcatcaccgtatggatatttattcttggatttacacccagcttcgagccctttgctgagaatacggacaaaaatatttaaagaagatgaagaaaaagcattgtatattcaaaatgattagtttacctaaaaatgttattcaaaacttggattttttaaagaaattgacaaaaacaaaatcttttaaaaagagacaacaaatatttaaagaggctactagtgaacaaattgcattattaattgaaattagttataatatattaaa

SEQ ID NO: 79976 - DNA, 786 bp, Heterodera glycines
  Genomic contig location: Contig_ID=SeqID_15670; Location=503..1288; Strand=-
  SCN-specific regions: Sequence locations=1-323,345-661,683-786
atgaagtcggagcctgggaagcgctacatcgccaagctctgcctcaactcactctggggccgcttctccatgcggaaccttctctcaaaagcaataattgacaacgacgaaagcctaattcatcagtataccgaagacaaaaagattgagctaatcgacttggaaatgatggatgaggacaacgacgtattcatgctcacttacaaaccaaaggaggagtttgtcgacgaaaataagtactccaatgtagtcatctccctcttcacaacatcaatggcgcgtctatacctctacgatgccctcaaaaaagtggccgacacccccggatgtgaaattctctactttgacaccgacagcatcatctacgttcatcccgaggacaacgacccactaccaacaggaaagggacacctcggtgagctgacggacgaaaaaccagaccacgacattttggaattcatcagtgctggctgcaaaaactacggactgaaacttcaacggaaagacaatgctggaattgagtatgatttgaaaataagagggttcacccttgatgcacaaactgtgcaaatgatccattatgacacagtaaaagagcaaattttacgttatggttccgatgaccccgctgaccccataattgttacatatccccattttattcgtcctaatcttatccaaggcaaagtgtttactcattccctcacaaagcattatcaacccatattcacaaaaggtattattaatgattcattccaagtcctcgaatttggttatcgaaaatga

SEQ ID NO: 79977 - DNA, 1284 bp, Heterodera glycines
  Genomic contig location: Contig_ID=SeqID_15671; Location=263..1546; Strand=-
  SCN-specific regions: Sequence locations=1-212,234-628,650-870,903 -1062,1084-1284
atggacaccggagagacgaccccgccaccgctggccattgacgagcgatcagagcgcatcgaacaactggagaagcagctcaaggaccgggacgacaccatcaaatttctgcgcgagcaggtgcgcaatcgagaagcgctgatcagtgatctgcgtcggcagctggacgagcacatggtaccaccgatggcaccaccaacaagtgagtgaaatttttcctttttgaatttcataaaatctgatcattaaattttagcaccaccaaacagaggatgaccgaagaaaagactggatgaactgcagcgcagcgccaggcgcgacatcgtcgaccaaattgtggacgtcatcgatcgtgatcgctcacgttccgcgagccgcgcatctctgtaccggatccaccgagatatccggcacaaattcgcgcactacacgccaaagaagggcaaggagcggaaggaggggatggacgctgaggatgggcttttgctgctcgctcaacttggaacacagaaggcgtacaagcggatgaaggcgattttacggccattgtttgtgcaccattgctgccgtccatcaattttgagcagatgctgttggctccgttctatgtcttccaaggcctcggaaaatgctctgatcaaggagttggaagcgggagaaaatgccgaagtcgcccagaaattcttcagacggataggggcaaggagggaagcgttcagaaagcgagacatgacggggaacagcatccggaaaatcctcgtccacgccgatcaaatggaggcccttttcgagacggaatggggcaaaacaatttgccaaacgatggcacatttggggaaaatccaaattttcaccaaagtgattgtcttcattttttgtgtaaatattttttaatttaaggcccatctattgtccccaggtgatttggacggactggagacggcagttgatcagttcaaggcatttctcgacgaacaaccaatggtgcgaacccttctttcaaaaaatacaaaggcccattttctgcttcaccactttgttccatttgcgcgccaacaccgatttttggggcttttggatgagcagggtgggaccatatcattttttgggttcaattttaaatgttgtgatttttcaggagatgaggcattgcattccgtgtggcggcgacttgagcaactttggaagacgatgccggactctgaacaaatgcgacagcagctggagcatcatttcgtctcgaattggctgctggacaccggcagactcgacgaattgaagctg

SEQ ID NO: 79978 - DNA, 326 bp, Heterodera glycines
  Genomic contig location: Contig_ID=SeqID_15671; Location=1625..1950; Strand=-
  SCN-specific regions: Sequence locations=1-326
atggcaaaaagaaaattattaagtaagctaatcggcagagaatctgtaaaaaagcgctggaacaagcgagaggagcgacaagcgcaaacggtcaaggcgagacaagcctatttggccaagagaagtaattttttcaccattttttacttaaaaatctttttttttgtattccagccgctccacagccgaatcccaatgccgaaatgccaccgcaggacgaagcagggccgtcaacatctgctgcatccgtcgaagaagcgatggaaccgccgccatcaactccaggaccagtgccgacgccggaaatggacgaggaaattttgtaa

SEQ ID NO: 79979 - DNA, 1234 bp, Heterodera glycines
  Genomic contig location: Contig_ID=SeqID_15673; Location=299..1532; Strand=-
  SCN-specific regions: Sequence locations=1-189,211-265,297-514,555 -640,662-777,820-1165,1214-1234
atggccttaaatctgacctatcttttaaccctgagcttatactgctccaactccatgcatgaagttggagctgtacaggtttgttgagaacccagagaccaaatctaaagccatattcggactcagcgtggtcaatttacttagtttaattaaattcggaatttccaaaaccacttttaaaacattttgttatttgatggtcttgaaaaatgccgtttttggagaccatttttagactcggccctccaataattcatttttgaagtaataaaatttttttcttataattttttatagtcctaactttgctctatttactcacgttttctctgcctctgtatctcttttcattttctttaaatcagccatcaaaaatacatacctcgaaaatgaccatttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcggaaacttatgttacaccctaagtatcaaggttttttatgttcaaggggtcgagcgatttatttagttgtttagatatgaaaaattattataatactttataggcatttggcgccaatgcgaattttggccaaaccggtgggcgttttcccttcatttagctgtaaaatctaatttcgcttacatttttataaattcggattaaaaattgtcaaacaaatttattaaattttttcaacaaataatgttttttttaaaagccattccggattcttaagctttttgagtccggtttttgagcatccgacccaatcaatggggccaaaaccgcacaaagatttttatggacccgtagcccgaaagtttttacagactacggggttttatttttgggtcgaaaaaaacttttaaaacgaaaacttttagaaaattcattttgccagtgtataaaaattagaaaccggaaatttcaaatgtgcggatcccgctgcgggattggaattcaaaattttttgcgggacgggatcccgcgggattaatcccgcaaatcccgcatttaaaatttgcaggatcccgcgcgggattgcgggattttggaaaattcgaaatttttttttattaaatttcaaaaaatttccaaaaattaaaaaatacctgaagttttgaacaataaa

SEQ ID NO: 79980 - DNA, 489 bp, Heterodera glycines
  Genomic contig location: Contig_ID=SeqID_15674; Location=1..489; Strand=-
  SCN-specific regions: Sequence locations=1-5,185-186,212-489
  Gene Ontology: Mol. function=protein binding; Cellular component =cytoplasm; Biological process=response to pathogenic bacteria
ccgtaaccgcctccacaaccgcatccacctccacatccacctccaccgccacaaccaccaccgcagccgcctcctcctccgtagccgaagcctccgccaccgcagcctcctcctcctccgccacaattgacgatgattgggcctccaccgccaccgcatcctccgccaccgccaccgcaacaacatcctccgcccccgcccccgcctccgcaacagcagcagccgcctccaccgccgcctaaacttaatccgccaagtccacctccgctaccaccgcaacaacatcacccaccgcctccgcctccacaacagcaactctgctgcggtagtccagtgccatcggcatgttcgctgatcagcgtaaccaaaaaggcggcgaacataaaaggcaaaagggttgaagagaaacggcccattgtttaattatcacacactaaaagggaacaaacgaattttattgggtgaatgagcaagtttttcagggtttta

SEQ ID NO: 79981 - DNA, 709 bp, Heterodera glycines
  Genomic contig location: Contig_ID=SeqID_15674; Location=1085..1793; Strand=+
  SCN-specific regions: Sequence locations=1-14,36-161,189-221,267-709
atggcggcgacgagcgccgccaccgctgccgccgacccatcagcagcgaataaagtgcacttcagctccgccgggaacaactactgcaacgtggtgaaggagcgcgtgtggtgccaggcggtgtcgatcagtgcgtgagcaaagcgatcggaaaaaagtgatcagaggaggaggaagaagaaggaaaatgcaaaatgatgatcagcaacacctcacaattgatattataataagtttttaattaaaaaaaaaatatatattaattacagttaattgcatcgcttttgtcagttctttgttaggataattattataaattttccatgtgtaagtgtaaaatcgtatgtgtgcaaaatgagtttgatcagagatggtgtcatttgaatttaaaaaaaacatctcgtcagttgtgatgcgttcttgttaggactcaacctcttggataatgtgcgctaaaagtggtaaaaaatgagcaatgcacttttttggtcacagtttttgaaaccttatgaattttaagaaatttggagtttataaaggacattggctaccgctaatgccaaatttgcttaatttatttgcttcagagaaatattttacgatttgtcaaaaaactcgaaatggcgaattttatgaaagctcaaaagtaggacaaaatttttcgtgatattgaacactaatttaagtaacaatttataagtgccgcaga

SEQ ID NO: 79982 - DNA, 1047 bp, Heterodera glycines
  Genomic contig location: Contig_ID=SeqID_15675; Location=41..1087; Strand=-
  SCN-specific regions: Sequence locations=1-53,87-948,970-1047
atggccgacgatggaaacggagaggcggaagataatgaaaatgagaacgcaagggacggcggtggcgacgacgacgccgacgattattggacggtggcggaggtgggcaaagggtggggggggcgaagttggactcatctgtttcagctcctcaaagaactcacccgcgcatttcttgacgaattggcggcccccaaacttttgcccgaaaagttggaaatggcagacaaaatggtagcgcaaatgggacacattgacaaaatcataatggccagctcgagcaaaaacagtttgacgtgctcagcccatcggatggaactttaccggacggaacacattgtaaattcctatttgaggtggaaattcgaaaattggacaaaatattacttagattcattttcagagttcgactaagaaaaattgaacagaacccggcactcgctttgcgcgaccattcggagcgcattaggcgggcgctgcaggcgcgacgagcgggcgggcgcgtgccggaacagcccgcgctattggaggcgcgtgaggtgcagttcgcccagcgactgttgagcgcaaacaacacactgctgcgggacgcctttctctcgcaccttcccgccagcatgcagcacgtgccggtgccgcactcactctccgcccactcccagcgggtgtttgtcgaagtgctcaaagacaatgtcagtgggtggtctcgcgggatacccaccccaattaatgggcataaattgatagttcatttgtcaaaaacatcctaatactttgaagttttgtatgattgtaagtgcgattttttgcagttggaccgtatcccggtgccgagtctaaacgacccaaatgcggatttgctcgtcacattggacaaaggcacacggcacatgcttccctttcactgtgtggaggaactgctcgaacttggccatgtccgtctgttgtgacattttattctgtaatttcttgtctttttcattttttataatcacttgtcgttgaataattatttttggcttttcatctaattttctttacaataaa

SEQ ID NO: 79983 - DNA, 2498 bp, Heterodera glycines
  Genomic contig location: Contig_ID=SeqID_15675; Location=1391..3888; Strand=-
  SCN-specific regions: Sequence locations=1-562,584-647,671-1223,1246 -1325,1394-1969,1991-2029,2051-2123,2156-2159,2181-2214,2248 -2383,2405-2498
  Gene Ontology: Mol. function=SH3-domain binding; Cellular component =chromatin remodeling complex; Biological process=chromatin modeling
atgagagacgacatcccgccactgttggagaaagcgcacagaaagaacattgaatcgcatgccaaagagaccgaagaattggacggcgaagtcggactttctgcaatcggaacattcacaaaggtaggatttttgaagttttaaatttgaatgaatgttttaattttagtccgatgagagccaaaaatcggagcagaaaaacacacgggaaacggcaaaattagaaaacggagaaataagccaaacggaggcagcaaagaatcagcaggaggagaaaatggacaccgatgaacaacaacacgagaataccgaagaaagtggaggagcagaaaaggacaaggaagaggcggttgtgagagaggcgaaggaaatgacgacggaagccatccaagtggcggcagcaacggcactcggagcggcggcaacaaaagcgaaatatttggtgggggtggaggagaagcgaatgaaagcattggtggcacaactcgtggaagcgcaaatgaaaaaagtggcatttgaatggtttaattattgttcaacgtaaaccaaatgtttagttcgaactgaagttaaagcactttgaggagttggagcaattgatggaccgggaaagagaaacggcgagttttttctaattggagttttattctctctcccctccccaaattttcagttggaggcccagcgtcagcagctgattgcagaacgacaagcattccatttggaccaacttcgctatttggaacaacgagcacggtcagatgcacaacaccaactgacaaatgatggacgaatgccgacaatattaccaccgggatttgaagtatcattaaacttaacaccgcttgaattagaagaatgggcacgcattatgttgcaggttagcaatcccacgcagccacaagcggtggtcgcaccggccggcattccgccgtctcaatccgctgcaaaagcacagcccccgccgtccgttcaagcagctcaacagccgcttccgcccgtatcggtgcctccacaacaaactcaaccagtaccaccaccagctagtggtgagacattgtccaatgaccctttctttatcctgcaaatatttcgatatgttgggtaatttttcatttgcagatgattctggctacggttgttcctccgtcaatggggctccgttgttgctcctcctcagccccctttgactttggccactaatactgcagcggaagtttccactgctgcggctacgacttcgacgccaaacactgcgcccattgcggcggcgcctccagcaccgtctccgcacgcgacggcaagcagtacagccgctccctacgcaccgcaacagccaccgacatcagcaccaccttcaattccaccacaacaacaaatgccaccaccgccagctcaaggccaacaaccacaatattgtaattgtttaagcagtgaataagattttcttttatctcatgtttgccctgaaacatagattatgagaactttgttggatttcagcccaaccgcctctgtctaccgcctattacccgccaccgtctgcgtatcccccgccggttcacaatcagtcgtacgcgccgcctccgcacaatgcgactgccacatacccaccgccacaggccttcccgccacaagcggccccaccacctcagcactactacggaagcgtgtcacgtgcggcacaaccacccgcgcagtacggacagtcaccgcaagcggtgggaccaccggggcgacccatcgccaactatcctcctcaggttttacaaatgtgtttttgctatctaattatgttattttcagtacgattattacgccggctcggctggacaaccaccgccgcagcatcgctacggtcaacaaccaccgtacgcgtcgtatggccctccgccaacgtcggcacctcaacaacagccacagcattacccaactcctggacaatcccaagtaaagaaaacaatgtaaattatggggatgtaaaattttatttcagtattatgcgcggctttctcacactcagcattctctgcagggccaaccgccgccgcctcaaccgatgggtcttccgccatccgctggaccacaacaaccgcaagaaatgattgtcggtgccggcagtgttcatcaccatcaacaacaacaacatcatcaaggaccaactggtggaatagttcaaactgcagcggacgcgacgagtgcgacaccgccaatgcatcagggtgaggagggggaggagagggacattttgaaaaagtattgcgttcccggatggcaatttttgtgttacgatataaacaaatgcaataaaaccaaaaatggatctttttagttcaaatgtattaatatttcattaaacttttagagagcaacaaagaatgctgacgatgaaaatgatggaaaagaaagtcggaagtgacttgctttttctctttttgacaatggctgcaaccaatatttgttttaaattctcacttttatcaatccccgccaataaa

SEQ ID NO: 79984 - DNA, 546 bp, Heterodera glycines
  Genomic contig location: Contig_ID=SeqID_15676; Location=137..682; Strand=-
  SCN-specific regions: Sequence locations=1-546
  Gene Ontology: Mol. function=transcription co-activator activity; Cellular component=intracellular; Biological process=organogenesis
atgccaccaaagtaattattttatatgttctatcttaacaaatatcataatgttcttaacaaatatcataatgtttctattgaagggggtttaaacgaaagagagaagaaggatcggaagtggccgaatcagttgatcttgaccggattgatgatgacgaaaacagtcgtcttacactcactccttccgccataattaaaagtaatttttgtttcggttcatgcttttgaatttccaccaaatttcattgcaactaataattaaaaatttagcaaaggacaaagatatagaaattggctattcaaagcagcaaaaactaactgaattggatgatgatggaccggctgctaatcagctcgacccaacccaaacgaatttatcttcgacagtcgaaccgcagacccattacattattgtgccgtcctattccgcttggttcgattacaatgcaattcatcaaatcgaaaagcaggcacatcccgacttcttcaatggacgcaacaaaagcaaaacacctgaaacgtaaacttgactttgaagattaaa

SEQ ID NO: 79985 - DNA, 674 bp, Heterodera glycines
  Genomic contig location: Contig_ID=SeqID_15677; Location=409..1082; Strand=-
  SCN-specific regions: Sequence locations=1-484,506-674
  Gene Ontology: Mol. function=cytoskeletal protein binding; Cellular component=cell-cell adherens junction; Biological process =intercellular junction assembly and/or maintenance
atgggaagctcaaaggacacttatggaggaaaaaatggaagcgaaagaacgcgaaaggcgagaagagcacgcggcagagaaaaggtgcagacggacggacaatcggacgaaacccttaaaaacagagaatcgttgcgagagatgtcccggcgagaagcagaatgggctgacgaacgaacgcaacaccgtcgcgaggtggaccaattgcatgccgagatgcaggagacgcgtaaaatggcggaatgccgcgaaacggaactgatcagggaacacacgcgtgccgacgaggcggaacgcgaggcacacgcgagagcgaagcgagtggaggacgaaatgacaacgctggcggaagcgcaaagaaaggcacgcgcgcgagcggaagccgaattcgaagcagaaagggcgcggtcatgtgaggtaacgtgacagcaattaataattatataatatgataagtttagctgatggcccaacggactcatttggagacggaaattgagaggaaagacgcggaactaagcgaaggtcgcgaaaattacgaagaagcattgagagaacgagacaaattcgcacaagcactacatgaagcgaagctgaaaaatgcaatgacaaattcggaatgtgaaagattaatggaaaaactgcggagggaacggaacgacgccattgagtga

SEQ ID NO: 79986 - DNA, 506 bp, Heterodera glycines
  Genomic contig location: Contig_ID=SeqID_15677; Location=1912..2417; Strand=-
  SCN-specific regions: Sequence locations=1-242,278-506
atgtcggtgccaaatttggtggaaaatattggcgaaacggacgaacgcccctcgaattcgcaaaggtaaaggaagggacagatcactcactttccgatcactcagtgatcagagaggcgatcactccttggaaattcccaaatcgttttctacagattttcatcctttggcatcagcgaattgcagcaaatttcctccgacctttggttcactcgacgtcgaattgaggccggactcaggtcaaaaaaataaataaattaaataattaaatttttttgtttccttttttagggaacaacgaaaacaaaaagcgattcttgagcatgtccaagagcaggcgagaaaagggacggaaaggagaaccccgtgctttcttttattgcctttcagttgcttcgttcgcgccttcggcacgcgaattggcgaagcgcgcggagtcattcaccgccaaattcgtcggcacgatcagaagaaacggagcggtaaaagaaaatgaagcaaataaa

SEQ ID NO: 79987 - DNA, 1287 bp, Heterodera glycines
  Genomic contig location: Contig_ID=SeqID_15679; Location=141..1427; Strand=+
  SCN-specific regions: Sequence locations=1-468,491-583,615-816,846 -1287
atgaattcaaatcctcaaaactaccgtatgtcgcattttacaagaagttctgattcactgatccattttctgatcacggaaaaatgcaatttgttcagttggttgcatcattagcagcaggaacgggaaggtcgttctgtcatgtgttcgttcgtccgtcgatttgaccccccggggggtacaaaacaaagcaccaccaattttcaaagataaagaaacataagaacagccgaggataacaacaataaaatcacataatattcataatctttggttgcaaaatgcaaaaacaatcagcccccggcttttaccatttacgggattttaaaaatactttcattcgtgctcaatggatttaaatttcaaccgatccttgttttgtaataaatttataaatttcgcagatgataagcaaaagttttcccgtttcaaatcacatttatcacatttactttctgatcaattcaagattcaaattctcagtctctccgtgtttaagcctaagccaaggcctagcctaaagcttctaagcaattgtacgagttgtctgtgtacaagttgtcacgacacccgaaagaaactgttaaattttaaaaaatttaatagtttattttgaaccaagataaatattttagtttatttgtttcattatttttcaatttttatagtttttgtaaattctcgtaaagctgagttgtcctcagctgactgatcctgtcgcgtccatattaaccggtccatttgaaaccaaaaacaacgattggcttatttgaaaataattggagtttaacttttgcttatatgaaatgagaaaccaattttaaatttttaaaaatattttttaacttttgttttgaattttttgtttccttgtaatgtccggttcccggtcccgaatgaaaatccaggtcccggcttttcgactcccggcaattccccacccgattctgctcagaattccgggtctcgtgcaattaattctagttcaaataatgaatttgtaaagaaaaagagtaacaattcataattgacattgcaggcatatgaattcaaatcctcaaaactaccgtatgtcgcattttacaagaagttctgattcactgatccattttctgatcacggaaaaatgcaatttgttcagttggttgcatcattagcagcaggaacgggaaggtcgttctgtcatgtgttcgttcgtccgtcgatttgaccccccggggggtacaaaacaaagcaccaccaattttcaaagataaagaaacataagaacagccgaggataacaaca

SEQ ID NO: 79988 - DNA, 344 bp, Heterodera glycines
  Genomic contig location: Contig_ID=SeqID_15680; Location=1476..1819; Strand=+
  SCN-specific regions: Sequence locations=1-110,132-176,199-281,305-344
atgaccggacagcgaatccgcgaatttttgccgaaaaacaccgaagctggcattagcactaacataaagacacggaaagcgaacagttcaaagaaagcgatagaaacgaatgttcaaaaattggcccaaaatgacgacgaaaaaagggacgaaatttcaaaggatggaagggacgtgaaaatattaatcaaaatgagaaggaattcatcggaaaacgttgaacaatttggaaaaaaagacaacatcaatgggccaaagaaatgccaaaaatggaaaatcggaaaataaaattgaggaaagcaaagtgcggcatttgggtattgactttctaaaaattgagatta

SEQ ID NO: 79989 - DNA, 805 bp, Heterodera glycines
  Genomic contig location: Contig_ID=SeqID_15680; Location=3208..4012; Strand=-
  SCN-specific regions: Sequence locations=1-272,295-442,471-784
atgagccgaaatatacggaacttaaggacccgccgtttcaaaacctttacggaggtaagcgatggacggaaagactaatgattttttgggataaaattcaaaaaaatcccaagaattttagtggacaatttccacgaatggatgagcggcattcaccgaatagtgagcagggcgattggaataataattaacttcaattattttaattaatttcgtaagggactcaaccaatttacggatgtgaccagaaaggagaaggctttcttcctcctgtggaacggattcattgggaagagaacaaaccgccaactcggagtttgtcagctttttgctcttttggtgagtgaatttaattattttttggaatttaatgtaataataattttagtgcttaaattctctatcatttttaatctgctttgctttgtctcttaagttttagattaaattttttaattgtttaaaatttacagaaacgtttcatcgatacgcacggaaaggaactgctcacgatcagaaagggcctcgtgacaaatttcattttgcattgtgccaattttgagaatttcggttatatttcaaattcggaaagggccgaacttatggattatgcggcactcaaactcagctcattggcaaaagaattcgaagggaaaatgaaacggggaaagtgaaaagagtcggaggagagaaacattaatggaaacgaactgttaattgttgtaatttaaggaaatcgaccttcactttcgctttttttttgtatttcgggttaattgggataaaattaagagaaaaaattaaa

SEQ ID NO: 79990 - DNA, 405 bp, Heterodera glycines
  Genomic contig location: Contig_ID=SeqID_15681; Location=304..708; Strand=-
  SCN-specific regions: Sequence locations=1-142,164-207,229-373,395-405
atgtgttatcatcaaatcgatcatgttggagttgttgccagccgatgtgctagaagatttgaaaagggagcaacaatttttagaggtgttccgtaaaatcaagcacaaccggcacatcattcatttgtttgacgagtgggttaagatatatttaatcaaatcacttctctaattattagggaaaatgtttttacgagtgaaaaatgcaaaaattccattcaaatttataacactattttcagaagatatgagtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaa

SEQ ID NO: 79991 - DNA, 1562 bp, Heterodera glycines
  Genomic contig location: Contig_ID=SeqID_15681; Location=1317..2878; Strand=-
  SCN-specific regions: Sequence locations=1-1357,1379-1416,1438-1562
atgtataaatttttaaaacgagtcaaaagatttgataaagtatcacttcatttgctgttgattttgtttttgggatgctgccaaattaatgcaacaaatgaaaaacatacggacaaaaaaactgagaagacatcaacaaaatttcaaatcggtccaattggtctggtaaatgtaacagaagaggaccaaagtgaacgagaaaatccaagccatcaatcaacaaaaacattaaaaattcaagatgcaaaacattttgtggagcaacttcaaattccaatcactaatctcacttctcgacatgatcctgatcaggtaacgacggaaattccgatcactgaaggatcaggagatgataaacctatgacaaattcgattacaataccaatcaatagaacgaattatcaggcagattcgaagaccaaggaaatcccaatcgccggtgatgtcgacatgaaggagcctaatgagcatcaagtggctgacaagcaagatcagtccccgattggaggaaatataagacagttaatgatggctgagcttgacgaaacttcggcaaaggacaatcagcagaaaagtggcaacaatgacaattttttatcaaaatcgagccattcttcaaaatctttcgctagtcacgcaaccaacattggcactccatcaacatcaatggcacttagtataaagtcgccaaaagttggcagcaaaagttcattggttgcggtgccaaaagcttcggggcaattagcattgtcaaaatcgtatccacaagaaaagcatcatggaatatcaaaattttttaaattttcctgttcaccaccaaaacagccagacccaaattttttgtcaaatattaatataaggacaaaatcatttcgcatgacctcccgaatgccatcgcttgataatgcgacgtcaaaaaaaagtttggcacgaatgtattccaatcaaaaaacaaaaaagccaccgttgccaccattgccgccgaagccaagtcccagcgcatcattccgacgaaacggccctattttgggcgttcatgagggtagcttaaaagcagtaggcagttttagggagcaaattgaggagcaaaaaaaatatttgatccctgccgaccgaaattccggccccaccaagtaagcaaagtctcgtgtttaaatcgctatacctgttgatcaatccttttttactttttggcaagttaatctatcataatcaaatatcttgaatttcgagacataataacaattaaaaatttcaaaaatagcaaaaatagcaaatgtttgacttcgtctttcgcttaatttcaaatcatatttaattttagtcttgctgtggataatccaacaaagatgatcacaatgttgaaacaaggaaatttcttggatttggagcccaatccaaacgctgaagaattactcgatgaaatggataaatgcaacaaattttccattggtgcaatgaaaattttgcgtattcaaaattcagctcaaaccaaaattaatgaatattacgtgttcccggagccaataagcggaggagcaacttcaagagtcattttataa

SEQ ID NO: 79992 - DNA, 4285 bp, Heterodera glycines
  Genomic contig location: Contig_ID=SeqID_2484; Location=1..4285; Strand=-
  SCN-specific regions: Sequence locations=1-82,104-194,217-243,267 -1395,1467-1528,1550-1554,1576-2725,2753-3030,3059-3234,3256 -3336,3365-3397,3427-3864,3886-4125,4147-4239,4261-4285
  Gene Ontology: Mol. function=protein binding; Cellular component =cytoplasm; Biological process=development
tttgtgctcaaaaaggtgttggacgtgtccatttgtctgttcaaccatttcggctgtctccgccatgacaaaggtcagtgccccccttcccttttgtccatttgttttctgcaaaaaccccaaattcagaacacaccctcagggagttccaccgtcaatacaggtccccgaggggataagcataacaaatctggaataagcatttgttgtttattttgaaggatatgcggtgaaattggctccggtggctttggcagagtttacaaagtgagtctttcttttctcattccatcgttcactgagaaaacctgggtaattacttaggttaattgtaattaactttatcggtctgcggttgtaaaccctatttaaatggcataatttcgggcctatcgccttgcggacggacttccggtggcagtgaaaagcattcggcacaaaagagtcaatggatggacgatggccgaacggcgaataatccccacggagatttgcttcatcgaggaatgccaggatgtgcaggtcggcgtgccgattggaagcggaccttttggcttttcccatgttcttattcgactgtcccttccattcgaattttcagggcgtcgttcgtcttattggatggttcacaaggtgttacacatattttctttacttactttctgatcactgattttcattggttttttgtgccgttaaagtcgccgtggctttttgattgtaatggaacggcccgccaactttatggatctgttcgatttgatcaacaccttcggctggttggaggagagaatggcacgcggactgtttgtgcaaattgtggacaccgttgttgagctgtacaagaaacactcggtgatccatcgggacataaaagacgaaaatgtggtggtcgatttggattctgggactgtttggctggtcgacttcggagcagccgaactgctcgagcgtgctaagtaagtttagagaacgaaatcgagacaaaggtgcatgaatggtccaggattgggaagcccatcacaatcccggcaaatccgatcaaaattccgaatgtaaagccaactgaacacgagattctattttgactccaattgatcaattatcctttgttcatcaattaggcagccttagcattaatgtaaaagagaagcataccaatgttcaaaatcctttaggaaacaatgctttcaaggttcgttccgtccgttcgtttttggccatttccccaaattcgtcaggcactttgtcctactcgccgcctgaggtcatttgaatggcaaacacataatttgaacaaatcacttattgtttgattgattgttcgcaggtgttcaaaagggactgtttttacccattggagggcacagtgtggtcattgggtacaaacaattctttatttgttttaatttattaatttattttaattaattttatttaattataattaatttatttatttattttccgattgaattacatcaaatttcaaatccatgtagtttttgcaattttcaatccaagacagtcaaattgaaataataccttacctttaataaatcttttcatttttctgttcgaaattaaaattgtcgtgtcaattgtctcctcttttccaattgtccctcgtcgttagtccatttgtctttttttccgtttttttcgaattttttttttcgccattttgccgacctttcaggcattcttctgtaccttttggtggtcgggaagccgccctttcggaatgagctccaaatttgtacagggaaattgcgattcccgcgcaatgtgtcgtcaggtcccttttaaaaatgagaaaaaaatggggggaaaattggccataattaacggagaaaactcataatattttaatcaattatgttgatcagagtcctcatatattttcaaaaatgatcaaagaaacactttggcattggcattcgtttacttttctttctccccacagagtgccgtgccattatccgccgttgcctttgcccgtcccccgaaggccgtgtaagccttgaggagctccaacagagcgaatggatactgaacaatgagacgacggactcattttttgcaacttttgaagcgcaatggaggaagagaaaacgggtaaataaagtgttatccgttggaattggggagcaaacagacaaaggactcattttgagactcgcgatggggaatccgataaaatgaagttaagccgataaggaatttatatggatccaatccttaagtacggctcgctgaactcaaacggtgtctacgctttgtccgatgatggcgccggggacgatgacgaggactgttcctacagaacggaggccggcgcggtgcccggtccgctgaccattccgccacttttcggaggcatttccagcgcccatcggtcgaccaccacaacaaattcattgtttatggagcaaaacagcagttactcagaagaggtggaggaaaatgcggctgttgaacgaaatgaacaggtcgaacacaaacagggaaagtgcggcatttccaaattacaattggaagggggattatccatggttagggccaactacggtcaaataagctggcaagatgggcaatcggttcccagtcagtgttggcatcctacggcacttttccccttttctatccaatccattaatttttgttaacatttctccccttatcaacagaactcaacgccagaattggctgcagctgacacccgctcttctccctcctcctcctccttggcaatttcggacatcggtttcgagacggcaccggaatatgacgaatggaaatactccagcttcagctcaagcaattccatggcattggatatttgcaacaattccgagactcctcaacaccaaaatttccctcgggagaatcaatgttcacctctcgaccatcagaattctactcttgactttccaaatgacactttcggtcgaagagattgcgccccttccatttcgatgccttttgttcgctttgggatttgtgccactcaatcggacatggcaagtgcctccttctgctccttctcttcctcttcggacagagaagcgcgacgcaattccttcacgtccgacgattccttcaattcttcgaccacttacttttcagcaaattcactcgaaaagtttgtccaaagagaaaaagaaattttaaatattaggaaacgaatttaatccaaattattgttagctttggcgaagtgtccccatcaaatcagctgctgatggatgaaattgagaagaacgaagacgacgacgacgaaaagacccttcggacggaacaaccgaacattttgatggaatggaggaaagaaatgtcggaggaggaggaggaagaatgggacgaaacaatcagagaaaacatgggaattgggtgagaaaagagcagagaaagaggacgaagaaattggaaaggacgacgaattggaagagagggaagacgaacaacaaactgaacggagtgatgaacaatggatcgaacttgttgaggaggaacgctttggaaaggacgattcgtttgaatggagcgaattggctgaaggggatgaactgctcaaagatggtcaactgcatgaacggaatgatgaactgctcgaagaggaaggtccatcatcggattttcctccagcgcgcgcaaaatgggaaaaagagcaaacggacaaaagcctatcaaaacggaaagggggcgacagatacaggcgaaggcaaaacgaagcaaaaacagaggaagcgacgaaatttgacgggcgaaggcggcggcgaatgatatcgccacccgtaatagcaggaaattgtgattattagagatgagtttaggtagcaaaaatagccaaacagccattttcctgtttaaaaaccatattttataggattaatttgaaaaaacccttattttcgaaattttaccaaaccatgtagttaattttacatgcttatatcgatgaaaaaggagtgcagaaataggctttgcctaaaaatctcatctctaatgattatgagctaatatttcaccgaaaatttgcaattgtatcaatgaaattatgggtaaaatttacgatttttgtcgaagtatttgggattttcaatcctaatagagattctccatttttgttggagtcgagtatttggcaatcatgtcgatcattggtcccgaaagttttttctttaattttttttctgaaaatccatataacacgtttctaggggtgttttgaggcgctgagcacaaatcaggcctccatttcgaccaatttcgaacccctaac

SEQ ID NO: 79993 - DNA, 769 bp, Heterodera glycines
  Genomic contig location: Contig_ID=SeqID_2485; Location=975..1743; Strand=+
  SCN-specific regions: Sequence locations=1-15,57-143,169-564,586 -620,645-769
atgcatccgcaaggccaacaacaaaaacagcagcagcaaaagcagcaacaacaacagaagcagccgaagcactctccgcactccattccgatagtcagcagaatgggcggcgctgcgttgagtcacccccaccactcgcagccgtaccaccaccagcagcagcagtggtcaccgggggcagcggtggcgccggtggcggactttggaccttcgtccgccccttcggtcagcggatccatcattttcatgccctcagttgtcagcggcgacaacgctggtggtggtgggatgggcttctcctccaccagtgaattcagcagccgaatggcgttgctcatccgtgacgtgagttgggtatgtgttttggtgttgcacccattgcattttggggggcaaagcgatgtgtcggtcccacaaaatcaaaaagaaaaaaaattatttcacattttgacgaacgaaaaaaacaaaatgtgatagtcccaccgcatgtgccgctgtcgtgggttccccccccccacaccgccgttgttctttctccctcccctccggcgctggctgttattttcattatctttgttattttcagggtgcctccgtttatttatcagcttcctcttcaaacaatgatgatgatgaaaatgaatcagacagcgaaatttctccaaattgttggaaagaaggtaattgtcatcattttgaaaaaaataattcaaaaatttgagaaatttctcatttttttcagaattgcttaaataatgccaaatttaaa

SEQ ID NO: 79994 - DNA, 530 bp, Heterodera glycines
  Genomic contig location: Contig_ID=SeqID_15684; Location=765..1294; Strand=-
  SCN-specific regions: Sequence locations=1-294,316-318,358-530
atgggcaaaatgttaaacctcgggtgggaatcgaacccactcatgcaccctttccgtgggcagctctaccattaagctaccgaggcacatctgccctttctttttatggatcttatcaacccccgctttccgcgttttaaccgcccagccagcttcttccttacaatataaattctcaaaaattccaacccaaacgcaaggagtaccaactttttttgcccttttcccgccttgtaaatcaaacataatttaagatttcaagcgcaaaaattttttcattgtccgccaaatgggcaaaggtatagattattggtcccgaaaattatttttaaataaagtttaagaaaattatttttaggggtaatctgaggcgccgagcacgaatccggtcttattttggctcagtctcgaatcccgaacccggactcgaacaaaagtttgagaattcaatttttcgtacttcgcagttttagttcaaaacccggctatatacgtggaatcaaacatgatcttattaatacgtcaataaa

SEQ ID NO: 79995 - DNA, 324 bp, Heterodera glycines
  Genomic contig location: Contig_ID=SeqID_15684; Location=1920..2243; Strand=-
  SCN-specific regions: Sequence locations=1-188,211-324
atgaaaaaagacgaaaggcatttgtaagcgaattttgtataaaaagtgaaatattttattagttatttcttctttattcagtttgggcatcactttcggattcgctgttaaacagcagataaaattggatcgatcaattcaatgggaaaagggcacttatgcctatgaaagcgatggctatttattgattaacggaaaaggaaagggaataaatgccgaatattcctacggtgttggcgataccgttggaattggcgtcaattcggccactcgacagctcattttcaccaaaaatggacttcgtttgggttagcaaataataaa

SEQ ID NO: 79996 - DNA, 3160 bp, Heterodera glycines
  Genomic contig location: Contig_ID=SeqID_15686; Location=261..3420; Strand=+
  SCN-specific regions: Sequence locations=1-588,610-795,817-830,852 -884,918-950,972-1012,1035-1218,1267-1387,1409-1453,1475-1486,1508 -1887,1909-1948,1970-2100,2129-2204,2226-2326,2348-2454,2476 -2559,2616-2747,2778-2794,2816-2908,2946-3160
  Gene Ontology: Biological process=positive regulation of growth rate
tggcgatgcgcttgtgcgtgtgccaatcctgtcgctcagtgccgagacgtgcattgggtgggtttttgatgcaatttatcatcctgttgctaatcacctttttctccgtctaatgcttcattttgctgaaactgaattttcttgttttggtaccgctctgattttagtgtttttttcgcaaaaatttcaatgccccgaattccattaaatacatttccgaatttctattttcccgctttttagacgccatttctctgttcactccgctgaacacgccctcaaaatgggcgccaggtcatccacgacatgtggccgtttgccaacggcagttacgtttcgggccgggccgtcacaaagtcgcgggaagtccaggttgtcggttgggtgggattacatggcttatcattatgcttttgattaggggtggcttgggtgaaacaatttcaaagattttttgacccattttaacctaagaatgcttttcaagttgattcgtacatattttgacttgtatgtcgattttcaaatcgaaatttcgaaaaaaaataatgttttcaccaaaaaaccgcatctttttttttcaaaatatttttatttctcagcacaatgtccgtgtccaccatgagcaccgcaactgctgctcccgcgacttgtgcctgcagatgaggggagggcgacaggctggcggtgcaacacagacaggtaaccagaaaatccgaagcggacacagggggggggggggggaaaacgaaaattttttgcatttcgcaccaaaaagcttttaaaatgacagtcaatggaataaattaagaaaacgtaataaaaaacttcctttaccccatccccaaacccacccaacccactcgggaaatcagtgaattccgaacggttttttaatttattttttgccatttttctcaaaaaaaaactggcactgtcatagccttttgataatttttttttaattttttgctagcaatgctaacatcggtgccattctttacaatttattcccattttcattattttcccccattttctgtccaggtttaccatctccaattctatccgtccaatgtgtcctttttgtcgggcctttgggagaaggaatttgagcgcacaattcgcacttacaaaagcccatacatcagcttcacctatttccactcacaggtttttattcggaaaataacaattgggtgaaaaaaaggcaaactgaaatatacaaaaaaaaaaaaaaaattttttttttataaattaattttaccaaggccaggtcgaatcaaaaaagttgtttatagtgcattttaaaacccgttttttatgtaggttttgtggccaataaaaccagcggtttggattgggtcaaaattgaaaacatttttttggattttcaaatttgcttttgctttgcaatatttactaatttcggcaatcctaacgaatgggtgtccttaatttaatctttatttttggactaaaaatctgtttcttaggatttttgggtactgattacgaatctaaaccggattagctcaattcataatcgcaaaccgatttcgaacggaatttgaaaaaatttaccaaaatatgcgttagcattctcgaaaactccatgaaacggatttagagcccaaatttattaaaaaaggattaaaattagggacttccattgattaggagtgccgtaattacaatatcgttttaatttcattaccgtatcctcccctccctttttttttgttagactttggccgaagaagcgaaacgcaacgcgcacacgctggtgctccattttgtgttcgcctttttcattctctttgctcctttctcggtaagacacaatttttcttttagcctataaaaacttaatattttaaatgaacgttttttatgcttatattgttggataaatttcgaggattgtatcgtccggcggtgctcaaatgccggcgcccccacaaaatgtccaggtcacgaaatgtccacaagagtaaaaatccattaaatgtccatgaaaaattaaagtttataaaaattcgggaaataagtctaaagtctattttagggttttcggagtcggtaaacttatttttcgggtttttataaaattaaattttatttttttctggacatttcgtgggcttgtactcttgtggacatttcgtgggtagcgcaaataccaccaaagaaatttttttttgagttttcaaaatttattttcctaatttttaagggataaaattaagaaaagccataattaacttatcgctattatatgcttctcaaatccaaaacgcaaactatattgggactaataaattccaaacaattaaaaaattaattttttgtatttccctgaaaaaggttggatacatccattagtttaaacgcatcatttttttatgaaatttagggagcagctcggttcttctcgcatcgtttccccacgagaaatttttttaaaaaaaatttgctaacttagaaatttttttagaaattttaatggtggattagttttttaaaaaattttccaaaaaaatcgctgagaatttctcgaaattttttttcttagaatattttataaaaagatttattttatttttttttaatttctcttgggggaactgatacgggggagaaatgaagtgcacccaaaaattttcttgacctccccatcgttcgtcgtaaggagggcggctgtaaaagagggtggtcgtcgtggaggggaggcgttaacgtagggggaaaatttaaaattggtacaatttccttagcgaaacccatgcaaattcaaaattttttcccggcggcgcctatcggcaccgccggaccgcctgccaccgccttccccaaaagttgaatgttttttttccaaaaaattatagaacttttcctacgaaatatgatataaatttttaaactatttttttctaatttttttactcctgtgttttgtagctacgaccctacgcaatattttataatttaccaattcttttattaactttaccctacaatttgcaggcgttgtacaacatgtcccatctgtcgtgcccacaactgttacattgactggacactgtccaagccatttctggcaattttgggtgtggtcaacgcgggcatgggcattgtgacggccatcggtctgcttaac

SEQ ID NO: 79997 - DNA, 538 bp, Heterodera glycines
  Genomic contig location: Contig_ID=SeqID_15688; Location=1172..1709; Strand=+
  SCN-specific regions: Sequence locations=1-104,136-145,251-434,457 -468,499-538
atgcttttgtcacttcgtcctagcactaaattgggcgatcagagcattaatctaaattgttttctaattattatggttggaggacaatcggctcctaattttggttttaataatttttctaattatatattttttcgtttgcttgaattaaatacaaaatcaaataaaaattacaaaatttataaatgctcttttgtttataaattttttttataaattttcattaaatcaaaaactttatttttaaaatcattgtttagtttaaaaatgatgatggtgaagtggtcgaatttgacgacgatgttctaaaagcagtgctgaacaaagctttgctgtcggattcggccgcccaagctcaggccatggacataagcttcagaccgcatgattatttggtgggtatcttggaatggatcagtcgggatcttattcccttattctatcaaattcatggatatcctggatttgattttttaaaattcttttattaatgaaaaggtgaaattataatgctaattttcgaatgcataaattttaa

SEQ ID NO: 79998 - DNA, 211 bp, Heterodera glycines
  Genomic contig location: Contig_ID=SeqID_15689; Location=1036..1246; Strand=+
  SCN-specific regions: Sequence locations=1-211
atgtgccagtgtatgtgcgattgtcttctccttattttgtgcttcatttttccagtatgttttttaatggggtaaaagttttttgaagttttcatttgtagccaatcgccgtcttaatgcgccaagggtgcaccatccatttttgcattaacattttgcttacttgtttggcttggattccgggagtgatccacgccatttagtatgttaa

SEQ ID NO: 79999 - DNA, 1463 bp, Heterodera glycines
  Genomic contig location: Contig_ID=SeqID_15689; Location=1869..3331; Strand=+
  SCN-specific regions: Sequence locations=1-442,467-582,611-809,831 -864,886-1105,1128-1463
atgcccactcgcttaaggcgcttcgcaatttgcgtcggcgttgacgaagaaaatgggacttgtctgatggtttatgagaacgacttaaacgccattgaagtgaggatggtgttttccggtgtgcaaattggcaaatggtaccggttcgacttggcaaaaggcacgagacgaaattgggaggtagcggaggaacgattgccgacgcggattatgccacggggggacgcggggagtggcggaacacgcggggatcgcattcaggtgaaccacggcacaacaaggcaaatgatccgacggattgggtctgccataaaatgtttctaatgctgtttgaaattattctgctacccattggtaattcctttctgtttttagctttgccttcccattttctttgtccccaacttcaaatgttttggctgcacttggcgtgtcacttcaccaacttcttttaatgacaaaatgcacttcaatttcgtttcgcctcgattggaagcgccaggcaaaattaatttcagcgaagaacgactggccgaatggaacatccgtccgggggagcagtgttttgcatttttgacattgtattataaaatttgtttatttaaaaaatggatgccacttttcagggattgccaagggcccgggccgagcataaaaccgccgcaatggacactcgatgcagtggagcattttcacagggtatgatttgtttataaatcagtttttgtgtaacatgttaggatttcaagaggcaacccgtttccatttgcgacatttcgatacacagtgaaaatgcctcctcaaatagataaatttgaaaagcttttcaatatcttagtatccttccttttgagaaatttaaacatgaattaaaaattaaatttttgataaagaatttacggattggatgtcaagataaatgaatttttcaacaatcaaaactcattccctgcaatatcaaatttaattttaaaaagtccttcgattgtttattttcaggtcaatgttgacccattggccctctccgttctgtccgtttccctcggcgcttcgaaagaatggggcattctgctcgatttggtcattgaatctgaggacgaaagaaatggaatgggtttcattctgtgcttacgcgacggaaaattcgcttttggacgaattttaaaaaccgaaggtcacaacgacagctgctggagggcaaatgtgggcgacactgtcggcttctctttgatgttaattttccaattagacatttctccaattttcctttcagtgatgttgattgctttaattaccccgttcggttggctttgaatgttattgcctggcaatccccggcgttcacttctgttgactccgatgttctttccgaccaatttccccaagaatccttgcccgaatttccttcagttcgccttatttctaaaagtactggaaaaatggctcaacatttggtaatttga

SEQ ID NO: 80000 - DNA, 1022 bp, Heterodera glycines
  Genomic contig location: Contig_ID=SeqID_15690; Location=666..1687; Strand=+
  SCN-specific regions: Sequence locations=1-90,113-258,280-289,332 -463,490-551,681-1022
atgagtagaatttgtcattttctatctgagaaaaagatcaaaccggaaaatgcagatttttttttttgcatcacaccctcaagctataggtaaaattttttttaaaaaatttcgcttttcgcatttcgctttttcgcatattttggcttttcgcatttcgcttttttttcatttcgcatttttcagtttcgcaaatttcgcttttcgcatttcgctttttatttttcaatttggcccatccctggtgtatagtaaggcaattaaaaaaaaattaaaaatgttcagcaatttttgctgcgttttcaatctttattgtttaaaaatcaaaattcgtttgtatttggcaattgtcacatttatttctgcgttgcatggatgtattgtcagtttgggtttgcttaatagtggaaacttacatggtgacctaatgatcacttgttgcttcattgactttttcatggtgtaatttaaaaaatatataaaaattaacgtgctgagacgaagtacgaaaagtgcaaggttgggcgaagcacgaaaaagtgcaagtcatcaaattaaaatcaaaataattaatttaaaaatgaaatcaaaaataattatgttaattacatttaattgtaacatttattatttaaattccgttacataattaaaatatttttttatattaatgattttatggattgctttgttgattttgacttataaggctaggaagcatggctggacgtaattacggaaattacggcctttttggaccgccgtaatgacggattacggatggccgtaactgaaaaatcgccgtaattacggattacagatttccgtaattgaaaatcagttacatccagccctgctatgaagacttccttaaaaatcaataagaatcattcataaatttttttctacaaagcggatcctgattggtggattttctctctctttttcagaaattagttttgctcttctcgcaaccttgcatacgagattatgttggaaatggtcgtttttcagtttttgaa

SEQ ID NO: 80001 - DNA, 632 bp, Heterodera glycines
  Genomic contig location: Contig_ID=SeqID_15690; Location=1727..2358; Strand=-
  SCN-specific regions: Sequence locations=1-253,310-444,532-549,571-632
atgccggcacagaagcggcgccggcacaaaatcctttggacaaggaaagtgcgcgaatcactgtgctatgcattgctgtccaaatccatgccgtatgtcatgcgttacttggtcaagtcaccattatgccatggtacactctgttgacaatatgtacaaattacgacccaattttgcaacaactgtattatccaatcaatgtgttcacttcgttatattacatatctgacgaggcaattaataaagacagaacatatttaatcaattaataataaatagaaagatatgatatatataaattaaaatatagcattaatcgagagcgtatttttcggttttcggactcgctcacaatcagcaggtgggccgtcacggttggccccgtgcttagacgaagcacgaaaagtgcaaggttgggcgaagcacgaaaaagtgcaagtcatcaaattaaaatcaaaaaattaatttaaaaatgaaaagcaaaaataattatgttaattaaatttaatcacaaaatttattatttaaattccgttacataatggaaatatatttttatactaattatatgcgtggtgaaccgaagcttcactaaaaatatactaattaatggataattacttaaaaataaa

SEQ ID NO: 80002 - DNA, 482 bp, Heterodera glycines
  Genomic contig location: Contig_ID=SeqID_15691; Location=456..937; Strand=+
  SCN-specific regions: Sequence locations=1-200,227-264,286-303,325 -343,365-482
atgccaatgcttgtcgcggtgcttttgctggccaccctcatcaccatgaacatgttgatgttgaccaatggcttatgcgaatacaaccacacccttggatggtgccaaaatgatggagattgcctgaaaaactgtgcgcccgtggcggaaaatgaatgcgactgcgtttcggtactttcaaaaaaattatacaatatttaatatatatatatatatatatatatattaaagtgaaattttgaaaaaattagcgggcatgacttgagaattttcaaaagaataatacttgtggactacggtgcctggcgatttaaaaaatatactgtatctcccagatattagggacatttggttttgactcaagtaaaaaaaacaagcaaggttagacggtgctaatttgggggtcagggaattaggaaaagcaaggttactccgtgccgatttatgagtcagggacttttttaaattcaaatgctctaaaa

SEQ ID NO: 80003 - DNA, 1347 bp, Heterodera glycines
  misc_feature (800)..(800): n is a, c, g, or t
  Genomic contig location: Contig_ID=SeqID_15692; Location=321..1667; Strand=-
  SCN-specific regions: Sequence locations=1-115,137-207,230-319,348 -421,445-548,573-886,971-1185,1241-1347
atgccattgctcagcttggacactttaacaattgaacacattgtttggcccattagtaatggtctcggtttggtggcattttccagctgtactccggtgctttttctgtgcaggtgtttataattaattaattaatgacaggaaaaattaattgattttgtatattttagcaaaaaatatcgagaaggattttgcaaatatgtttgcagaacagaacatgaatcaaatgtcgttgtgccattgcaaaatatacgttgttctggcatttctgcttgaactttgtttttacattttgcgtattaattcggactcgatgatgtcatttcatttaatattttttatcagtgatcggaaccgcccactttggtgtcagccattattgctttttaatttgattagatataaaattggtggccgcctcaaacttttcaaaattttttattgccctttgttgtgccaaagctgtgtttgtcaacgttaatttttattatggcagctcaaagcattgggaaaagtttgaggaattctaattatgtcaattttagttcaaataaaatattaaataaatttttggcataattttaacaaaatgtcattatgaaaaagaaccaacaaaaaggatggttttttggtaaaacacaatttttagattttttaaatttagcctttagtggaattgatcagattgttcggtcaacaaatccattcgtgatgaaagttttttccacaacagcattttaaatgttcttcagatgtggacactaatatacatgtggacggaggacttcagaaacaaaacngccatcaaagaattggggatcgcaaaatcaacttgcgtcaatttttttaaaattttttgtaaagatattttgttaatgaaaacccctaatttaataatttatcaaaaatttcatttatgaaaatccatttaaaaaattaagaatttaaacctgaataggttgaaaattggatttatttttttgtgttcttttgtctttttgagcagaagctataaaaaaaatttggggtgctttggtcactaattcagttcccatttaagacttctgtgttctttaatggcatacttccattgctcggcttgaaccttttaacatttgaatacattaatggtctctttttgatggcatattccagctgtactccagtgcttttcatgtgcaggtgattttaattaatcaattaattttaatttctaaaaatagtaaattttcatattttagcactgaataccgcaaagcattttgcaaatatctttgtagaaatcaatacggatcaaatgttgttgtgccattgctgaatatgcgttcttctcagattcgttcttga

SEQ ID NO: 80004 - DNA, 1253 bp, Heterodera glycines
  Genomic contig location: Contig_ID=SeqID_15694; Location=1710..2962; Strand=-
  SCN-specific regions: Sequence locations=1-77,100-204,226-616,638 -667,691-979,1006-1206
atgctccacgagatgggcctagagttggtgtacagcaaaagcttcccggacgccattggccatttcatggcgcagcgcgggcgcgaggcgcgccaactcatggagagcatgaacgcgctggagacggtggtggacgcgcgacgcttggagacggagaagggcggcgtcgaagcggcacagcgcgagtacggcgcggcattggcacggctgagaaagagcagcggcacaccaacaaccgacggggagggcgacagtgccaatgacaaagacggaagcggaagaaatgagggaccaacggggtgggggagaccacacaaccaacagcagcagagacaatggcaccagcgacagcagagacccgtggaaacaacagtggtgggtgatcattgaccaatgttggctacccaccggtagtggcattccgttttgattttgccacgtgtgatttgcaacgttttgtgatacacaatgaaatgccttcatacatggattttcaatgccatttataaaactcgttcatttttgatctaaaatcaacatatctgaaaacggggggcggagttaccaaaccttttgcgagcgaatgggtcaagccatcatataaatcgatttttagattttttatggaatttataaagaaagttagccaaagttcagaaattttccttttagaaaattaaaaatttttcactttttaaaaaaaaggttttagaggtttttcgaggcgtggggaaacgagctgttttcccttttattgaccccgttcattgttcagggaaccctatcaacatcggaatggcaagtgctgaccatgtaccgggtgttcgcatttcgacgacgcccacgccaatgccaaaccgacaaagacgacgacactcgtggcaaaaacgaaacggaggaggggcaaaacggtgccaacgacgatgaagtggcaaaaacagtgacagaagcaacagcagaagaagaagattatgcgaatgaggagaagaaggaggaggaatgaaggcaaaaacggcaccaattgcattaatcgattttttttttgaatttgtacaaaggattggaccgcaataccacttttggcgccggaatcccgagttccgggagtttttcttgacttgcggtactatccctgatttgtaccccctagggcatggtattcttacaaaatcaatgacatttaagtgagcgattatctgctaatcgtttttaaatctattctttatataatttatttaatattttcaaataaa

SEQ ID NO: 80005 - DNA, 377 bp, Heterodera glycines
  Genomic contig location: Contig_ID=SeqID_15696; Location=746..1122; Strand=+
  SCN-specific regions: Sequence locations=1-99,121-377
atgctcggcccttccccccagcacttcgctgccttcgctgtgcgccaaccccaactttctgtgtccgcccgaaatgactttggacgtgttccgtcgctgctccctctcctcctcctgctcgtccacctccaacaacgagtcgagcccccaactgtcgcctttgccaaccccgcaaaagccaagcaaatgccccaacagtttcttcatcgagaatctgatcgagaaccaaaatggaagcggataaaaccgagtgaatggatgccaaattgtgcggtgaatatcctgaacaatcccataaatgcaatgaatttgtaattaatgaaaaataatcagccaattcctctcaatatttattgactctaacaatgattagttca

SEQ ID NO: 80006 - DNA, 1977 bp, Heterodera glycines
  Genomic contig location: Contig_ID=SeqID_15696; Location=1257..3233; Strand=-
  SCN-specific regions: Sequence locations=1-1,23-46,85-311,333-451,478- 706,732-937,959-1254,1276-1497,1520-1977
  Gene Ontology: Mol. function=fucosyltransferase activity; Cellular component=integral to Golgi membrane; Biological process=O-linked glycosylation
ttttgctcattgttctcgttgtattttgacttttcttatttgttagtataataaatttacatttttttcttttaaaaaaattttcccttgccaatggtccgacttaaattccgattttccatttcattttttatgtaaccattcaaattgtcgagtctcaaaagtccccccccccttttgttgctctttctttccatgcgtttgttttgccatctcttcgctctttccctcttttcgctgccctttccctcctccgatgccttcgttctcttttgtccttgcatgggttcgtgccgtgccaaagtcgcagcttttcattttttaattaagggcgttttggcaaccaaatggaacagtttttgggtgcgtttgcctttgctaaatcgctgaatcggactttggttttgcctcccattataaattatcccccgggcgctgaagaggcggtgggcattttacatatttcattttgaaaattaataaaactgaagggaatgatcgaattcgaccaatttttcctcgtgccgccattggcccaatttcaccgaattgtttcgctccgcgacttttcgcatggaatcgctccaaaaatttggccaatggaaaaacgaagaggtgctgagaaatgagaaaaaaaacaaatattttaacattgtttatgtcagtgctgcgatttcgaaatttaaaaaaatttattggccataagaaaattgtaagatgaaatttgaaaaaattgattgcaaattgttagtccaaaaaaagccgaaatttgttttttttctcaaattaaataaaaaacacaaatgagttaaaagcgcaaaaatctccgctttggtttatgccactcaaatgcattttttccaaatcggcactttttaattacccccccccccccttcagtgttctgttggtcccctcgccctggccttgccaatgcctcccttttgggctgtcatgccaccgaagggaatccgttcggtcccttttggcgttacgcaggcacacattttgtgggcgaagaatattttggggtgaagacgggcggattcgacacgcaaagggagacaatcagagaaaaatgggcgacggagtgagtctcggccaattcagtcccacgtgggggggcggcgattggtgggtcttacgactttcggcaaaatgccgatgaatcgttttaaccccttcttttttagtggtttcattttaatttccattgtcccattttaaattccccgcccattcttcgcctgtcctcgctttttcttctgcccccgccgcttttcccgtccgccccgaccaccgtttcatccagcgattcggccagtggaatgatcgaattaagcaaaaagcgattgaatttgcctcccgcaactttggccacggaaaggcattcgttggcattcatttgagaaatggcagagattgggtcagtttggcattttatgatcaaaatcgcatttggaatgacaggaaaatgtgtgccaatttctccgggaagaaaatgtaatgggaaaacgacaactgtttgccagtggccaatgcacggggccggaagaagagaatgggccattgacggcggacgcatgcgacccgtcgatggacatcattttggaggaggtctttcgtttggggaagcctcgaaacacattcttccatttgcacattggcccttctcaggtccgttttcacgtcgtccgtctctccgcgtccgcagttttcgtcgccagtgatcgcgaccatcgcttggcccaaatcggcgcccatttggccaaatctgtgcgttggcccgtcaccgtaagaagtgccggaggagcgaatgtgccgatggatttggcactgcttggaatggcggaccatttcatagcaaattgcgtctcgactttcagtgcttttgtggtgcgacaacggcattttggagatgagcaaaggcatcggtccgtctcttttctcgcttttcccaacgcggcgatggaattg

SEQ ID NO: 80007 - DNA, 562 bp, Heterodera glycines
  Genomic contig location: Contig_ID=SeqID_15697; Location=427..988; Strand=+
  SCN-specific regions: Sequence locations=1-562
atggcgaatttttctcctccttctgacaacactgccccaaaaaaatttctgtccgaccttgaccaactacaaatccccaaagaaatcgactcagacaactccattcccgactacgccaagttgcttatcaagcagcttcattcccttttaagcaccgcctccgtcctaattcattcacaggctgcggctgtcgacgcggtcgaggaggaacgacgactgagaactgtcgttgtgacaaatgtgcccgaaagcatatcggacaaagcggcggagagagcccgggaggaccgtgccgttgtggacgaaattttgaatgccacggacgtcgaccaggcaccaattgtcttccgcgtcggcaaacgaatggatggacgaccgcgcccgctcaaaatggaattcccgaccaaacatgcagcgcgacacgtcatccgcatgcgcggaaaggtgcaggcattgaatggtctccataatgtccgcgtccgcgagagcatgaccaaggaacaactgtcggagcggcgaaaattgattgaggattgtgcgaagaaaaggcagacggacagcg

SEQ ID NO: 80008 - DNA, 1419 bp, Heterodera glycines
  Genomic contig location: Contig_ID=SeqID_15698; Location=288..1706; Strand=-
  SCN-specific regions: Sequence locations=1-353,380-589,613-830,852 -1106,1130-1419
atgggagcaaaaaggattgagttcaaaataggcgatcaagtacagtttgttaattaccaaaacggtaaaacagtttggctttttggcaaaattgtggcaaagaatggattaattcttaaaattcaatccccacaattagcacataagatcatcacacgtcaagcaaacgcagtgaggctatcggcagcgactggcactgatcatgagtggtcaaacgacgaagtgatcagaccgcttcaacaatatcttccggcaccagttcattcaccagtccgatcgccacaaggacacaagcaaaacacaccatcacccgatcatcgaatgcaaccacaagaacggactgatcagagggaccaacaacaagaaacagaagaacaaacaccggaactgcgacgatcaaaaagaacaaccaagaaagttcgatttttgagtccaaggcccactggacagcgacatgagatcagggacaaagttaagttagaacatgacggcgcactctatgttttcgaccaattgagcgcagatggacttaagaaattttggcgatgtgagtttcatggcccgtcagacaaatgcaagggtatgttaatatattattttgatgcaaatcttttaaaattcaggccgtttgcacacggatttaaataacgttgtgcagaagttggtcggagttcattcgtgcgacatgaatgctgcgcatgtggaatgtcagcgacttgtaactggactcaagcgacgtgctgctgagacgtgcgaggcacctgcgacaattcgtgctcaagtgctgcaaaacacatgcacacctgtgctagcagcttttccgagcaaaagcgccacaaaaaagtgggtttatatccaaaaacaattttgttatttttttgtttttaggtaatcaaacgattgcgccgtgatgaaaatgcaccgcggaccgaacctctcaatttggagcagttggaaattccaaatacctatcgtatttacaagcgaactgaaattggaacaatttctattggcgacaccggcgtttttcaaattcaaggacaaaatggacctcaacggtgagacatcatttatacattaaatgctgatcattgaaccggtattaaggattctcatttttggaagagcttctacggcggattgggcccatcagatgagtgacatttacgcggacggcacgttttcattgacgccaccgcttttcagccaaatttatgtgttgttggcaaagtaaagttaattgtgttatcacaatgttcaatctttttaggagagatggttgggtatttccaatttgctactgtcttttaacatcgaagtgtgccgcaatttatacgcgcatgttacagcttcttttggaacgatggccgaatttcgcgccgcagacaatttcaatggacttcgagttggcaatggtcg

SEQ ID NO: 80009 - DNA, 140 bp, Heterodera glycines
  Genomic contig location: Contig_ID=SeqID_15698; Location=882..1021; Strand=+
  SCN-specific regions: Sequence locations=1-140
ctcggaaaagctgctagcacaggtgtgcatgtgttttgcagcacttgagcacgaattgtcgcaggtgcctcgcacgtctcagcagcacgtcgcttgagtccagttacaagtcgctgacattccacatgcgcagcattcat

SEQ ID NO: 80010 - DNA, 105 bp, Heterodera glycines
  Genomic contig location: Contig_ID=SeqID_15698; Location=1136..1240; Strand=+
  SCN-specific regions: Sequence locations=1-105
tgtctgacgggccatgaaactcacatcgccaaaatttcttaagtccatctgcgctcaattggtcgaaaacatagagtgcgccgtcatgttctaacttaactttgt

SEQ ID NO: 80011 - DNA, 2462 bp, Heterodera glycines
  Genomic contig location: Contig_ID=SeqID_2486; Location=183..2644; Strand=+
  SCN-specific regions: Sequence locations=1-136,159-395,417-578,604 -809,833-839,889-934,956-1017,1039-1270,1301-1544,1600-1795,1817 -2111,2152-2190,2218-2242,2274-2462
  Gene Ontology: Mol. function=folylpolyglutamate synthase activity; Cellular component=extracellular space; Biological process =nucleobase, nucleoside, nucleotide and nucleic acid metabolism
ggttctcggcaccactttgccccaaattgcgtggaataaggccggcattgcgaaaccgggcgccgtcatgcttagcgtggaacaaccgcgcgatgcgatgcgcgtcattgaggaacggtgcgcggagcggacggtcaattttatataattataaaaaacatttactgatcggcggtgggtcgttgattctatctattgggattgattaaattcggacatttcattttctttgattactttacttactgtatttcttgaaatagaatccatggctgatcggtctgtgtttcaattcccttcaaaagggaggctttgtttcagtgggggggggggctgtattataggaaatacggtatttaatttgatcgctttcaaacagccgttgattattcaatcattttaccaaataaaattaatgagtttgaacccctgcaattatttcattccttattgattcactgattaattttatgatcattttaattcttctgatcatcctctgctaattctcacttttgggtttgttaattattttcaaatatttaatcagtaattcttcgtcgttttattctcagatcatttattaaattaattatttaatttgatcacttttccccgcttttcagtgcccccttttcattgtccctccactcaccgattatcgttggccttcttccaccggcggtcaacggccgtttgaacttggcattgccggcccgcatcagcacatcaatgcttcgttggcactccaactggcacgcatttggctgctcaaacgacacggacggcacattggtcggcaattttccaaaaaatggaaattcctttttaggaaactgattaaattttttaaattcattttagaattttaaaattatgttttttattccattattttgtttcacaatttcccagaacatatcttaatttttcttgccttttctgaaattattgcgaaaaaaagggatgggaatttatttagactaaaattcgaataattatgatttcctaacagactaattatatttaaattaaaaactaattctggtttaagaagctgatcaaaatggcacagaaatagccaacaaaagcagcgacactaattcaaatgatctccagcaactgctccaacttgatgggaacaacaccgtcgacaaaaaagagccgaatttcccgacaaatcgtttgaacgcatttgcattgactcatggttagtcagccagttaaaaatggtaaagtggatagtctattcttcccgttgaaaaatggctttttatgaattaaaatttaaaaataaattgccccaggcgttgcgcaagcgttagccaagtgccggtgggacgggcggagtcagctgttgcgacaagggccaaacacagtgttccacttggacggcgcgcacaccccccaaagcataaaggcatacattttcagtttattttacaaattctattaatttaattttcctaaatgcttttcaatgctatttcttgcattcctctttcgtttcccttatctctcgcttcctttcttcccacagtttgtatttttaaaaaattttaaataataaaaaaaaatctttttaaaaaatcaaaaaaactcttcagttctgtgcccaatggttcctccaaagtgtcggtgccaccgtcacagcgccgtccgtttcagtcattcgcattttgttgttccattgcaccggcgaccgaagttcggcccaactgttgccaaatttaaaagtaaaaaaacacatttaaaaaccaaggccaatatttagggatgcgaaaatttttttgttatttcctaatttattttttaaaggattgccgttttgacatggcactgttctgtccggcgctgatctgtccgcccgatcgtcggcccaccgggcgctcacttggccaagactcgaccaacgtcaatttggacctgagcgcagagcttcgacgatgcgagaatgatcaacaaatttggcaacaaattgtaaattaaaaaaatgttctttttaatttctgatgaatttttccccattgtcttattattttgaaaaattacactgaaaaaaaaacatttttatgattccccatcaaatttctgtacggacctgcggaaggtttaaaaaaattatattttttatctatttgtaaatatattcctctctgtgtattattcgaacgtttctctattaaagcgattaaatatattttattttccaaaaatggtcgaatatttaagggatgatcagtttttttttctaaaaattattttaaaaaattcctcattcattttcccataggctcctggccatccctccgctgtgttcagttgtgtttcggatgcgttggacaaagtgcgtgccgtggcggtggagaacagcaaaggaagtgccggcactgagctgcacgtgttggtgactggcagtcttctgttggtcagtgattggttgggcggtggattttttcggg

SEQ ID NO: 80012 - DNA, 457 bp, Heterodera glycines
  Genomic contig location: Contig_ID=SeqID_2486; Location=3365..3821; Strand=+
  SCN-specific regions: Sequence locations=1-120,142-174,197-203,244 -362,384-391,422-457
atgactttaatgcttcataacatacgaggattgtttcgtcaaaaactttcgggatgtttggaaatgtcttcactgtcctcgttctggtttggaccctttgcacaacgggagtttggtcatttttcgtttgtgagagctgtgttggaggtgccaatcagggctgcatttttctattttttatttaaagggctacccgtatttcgatttatttaagaattaaaatagatttataattttttatttgttgttgttaaggctatttgggtagttcgcctagaaaatagaggcatcacttttttgtcacacctatttctcacgcattttatgaaaattcataaaaccttagccaggtgaggggaggaattccctcccaccccctcccccgcccgaaatgaaaaattaaaaatttttacaggaaaaattgtgactttaaaattttttttgtcgatttttctta

SEQ ID NO: 80013 - DNA, 2246 bp, Heterodera glycines
  Genomic contig location: Contig_ID=SeqID_2488; Location=2004..4249; Strand=-
  SCN-specific regions: Sequence locations=1-361,393-547,569-1117,1139 -1367,1415-1426,1468-1598,1635-1693,1715-2154,2176-2246
atgtcctctttcgctgtcccatttttgatcactcttctcctggtaactttgacgatccaatcggacaatgcgaccaccgtggatgaccaagatggacaaatggcagcagctgctggagacaaacgcattttccgttttaagcgtggtaattaaattaatgagattcacgtgttgagaagataattcattaatttcataaatccgccattttggaatttttttttcgtaaaaaaaatcctccataatttcaaagaagtaaccaagtcaaagaagcttttcggcaacattttttttgaaaattctcaagccttttttgaatttacattttaatggagtgaatgcatttatttgtttgggctatcagccaaaaatatttatttttgattgtttttgatcaaatgtgtgacgaaagattagtcaaaaacgacggaacatggcaatatccgaattggataattaattacaattttcctgttaaaaatggaattattaatgcctatacattattttttggagtccggcaatgccgaaatgcgccgtaccggtaattattttcacatttttaagctatttctccccgatgccctggcaatggatgtgactgtaaaatcccttactgccaagcggtgtgccaatattgcggcaaaggaaagaaataaggagaaaacggcggtggatcatagaaaaacagaagccaaagatcaatttcgattttgtgttacttttaaatgatttgacgttcttctcacagctcggatttgtccttgttttagcgaggtcaaatcaaaaaaaaaactaaaaactgtgaaaaaaactactttgttttgtggtttttggattgataaatattaaatacagtacatacctaattgaatcaaaattaaaattaaaacgaaaaatttgttaagaaaagagtcaaaaaaaattaaacgattttaagcgaataagaaaattttttgtaaaaagtctcgagtttttcggtctcgaggccgagtcttggggtcaagtcttgatcttatgtctcggaaaatttttggtcccgagcatcactaaccattagcatttcataaaaattttggctgctaatatccgtggcttagcttgttaaaacatttttattaaaagtaaatttattaaacaaatggaacagtaaagttacaataatatgcaccaatggcaattgatattttctgcttcacttccgtccccacaaattgtcgaaaattgtgccgcgattgtatgccatcgaaattgcgtcagcgtaatacgattggggacgagcattgaccaatgaagaaaagtgcagcagaaaagtgagcagaagcagcagcaaaacgatgggggaaaattgagaagaaatcattttgaaataattaattaattaattagagaattaaaaaattgttttaaaaatgatttttgatgataatttgaatttgaatttattcatttggccctttcctttttataagggggaccagagcgtttgggcccccgtttttgggcccccgcgtttgggcccccgtttttgggccccggggtcgtttgggcccccgtttttgggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatgcgtcacgtgttgatgctcaaatggtcacgaccgcaatcaaaaggcgcgcaattgccaccttcgaaccgccttctgtcatcagagcagaagcgcttcaaaatgtcccgtctccgtcggcaattttggtgtcaaaacaagcagcaaaagatgtgaaaacaaaatatttttcatataataaaaacaattccaatttagttaatcaaaagagctcgccgagaagtgaatgcgccccccgtcgttcctgcaaatcttga

SEQ ID NO: 80014 - DNA, 746 bp, Heterodera glycines
  Genomic contig location: Contig_ID=SeqID_2488; Location=5346..6091; Strand=+
  SCN-specific regions: Sequence locations=1-264,289-302,369-502,541 -661,683-712,734-746
atgcatttgaaattgtgcctattattctgttcaatattatttttgattatcctaactgatccgatcgaagcagaaaataaaaaattggaacaaaaatcatttgaggaaatatttggagaaaaattggaagaaaaaagatatggagaaatttgtaagaaaattggggtttgtcttaaattaattaaaaaatggaagaaacaatttggaattagccaaaaatttgcactaattatttctttgaaaatcgtgactttttgaacttggttatataaaaaatttttattatatctgcgaaacaaatcaaattaattaattgataaattaaaaattatatcaaaatcaaaaaatatttatcaataatataaaatgcgataataataagtattattcaaaactaccttataaattagctaaaattaaatatggcctaatctgttttatgcaaatcctaattgagttttccatcggaaaattgtgctattactaacacccaattttcgcgcaattattttttcaattgttcttgtggccttctggttgaatttgttcgtgaatttttcttttattttttcaaattttgcaattaccgtattttctctttttatagacacggggggataaatggagaaggggggattatttttcgacagatttattttgtataaaatttttgatattttttagaacatgtcgccaaaaaatgtcatcgagtcaaagaaaaatcatttttaattgcattttttaaa

SEQ ID NO: 80015 - DNA, 2569 bp, Heterodera glycines
  Genomic contig location: Contig_ID=SeqID_15700; Location=612..3180; Strand=+
  SCN-specific regions: Sequence locations=1-165,190-498,521-524,563 -860,882-992,1014-1438,1460-1482,1505-1861,1892-1898,1922-2349,2373 -2505,2527-2569
gaaagcaaacttgaaggacctttcaacttttccgcagtgccattgcatgggaacttcaaagatgttgaggcaaaagtgaacgttacaaatcacattaaaccggtgtggatttgcagcattaacacgcacaaaaagacgttggcttacaggtatttgttattaaatcagaaaggtattttccattgctaaagccaggctttgtttttcctttccaacggatatatgtctaacgcttaagcagcttttcgatattttagtaacacttttaatgccaataattgtgataattacatgaacaaaaattaagacttttttcgaggtgctgatcacgaatatgacatcgactgcgaccaatttcgaacccggaccggaattcggaaataatgtcaaaaaatcaaattttatgaattttgactttgtcgagttcgggtccagggtacgaaattggtcgaaagaaacggtcatattcgtgatcagagaccagaaaaatcatcctgaaattttttaaactatattttaagcacatttattagcattttaaaattgattaaatttgtatcctaaactagaaaaaatgttcctgcatattttgttactactgtttttgtatttatttgataaccaacaacacaatttcagttacgaagttccgttccaaaatgcatccaagctgatcatggacaaactcatgcggtggtaccacagcgaaaaccacgacaaacagttttcgcttgttccgcttccatttcaaaatgttggacggatgagagaagcgctgaacaaagagttggatgcgaactacgacggttgtcgggatttcgtaggtataaatattatcgttgtgctctttaattgagttatttttaaatttaattgttgttccattactatgagcaaaaaattaaggaaaacataattgttaaggataccttttttagcagtggcaacattgacttcgggatgggggctgaattcaaaaagtcgatttttaggagtgtattttcattttcagaaatgtagaattaggagggtgtgttttgcagatttgttttttcgccataaaaatgaatttttttttttcattttgggggtacggcggtgccggcggaaattttaatgcatttgattaagaaatcttttgctctttgaaagtttacacggccataaaaatttacgcaaccattaaaaatagcaaggtcatttaagctttcaaaaacttatggagggaacattcaaaaaattaatttttttattcatagagctacgcctattacaattagcatggacaaatcctcaaataaatgcccatttccctttctaatttaacgcgttgtttaggcggtgttcatttcttcaaagtgaacacctccaaactgacagctgcgctgcactataccattctgatgccaagcaacaacgaacaatccaggtaaaaaagctttgtctttgtcctgttgtgcaagtgggtagccagtcccttggctttgggtgggggagggctgaattcaaaaattcgattttggggatgtatttttgaaaatttggcctgcgatttgttaagagttgcttaaaatattctaaaaatttaaccaatttcttgaaaatttttactttttttgggtttaaggcggggaaagccccctccccccccatggtacgcccttgtgctgacgcaaattatttgaaatttaacagacaaaacagttggtacatgcaactcattaaccaattctggcgcgatgatagcagcaaaaaacagtttaaaaactaccaaattcccggatctccgccctattggtcaagcggtttcctgtcgcttcagtacgcaatcgaaaaggcgttcatcgaattggtccgtatcaatatatatatttatataatattttttaatggacttattgttaattttgtgtattttttacattgtgctcaattaaaaaaatatatagagatttcacttttttacgtgcttttaaggccaatggtgacgatgctttggcaaatgtttcgctccgtctccaccgtttgcccattccgtcgtacatgaacaagcaaatggccaccataacggtgcccccttttctgaccacgcttttgtttgtgtgcgccttttccatgctgaaggacattgcggtggaaagggagtccggcattatggtaatttaaatgggataacacatatcttcagaaaatacaaaaaaaaaaaattgatgaaaccatacattaaatcggtggtcggcccggtcgtttacgaacgaatgttagaggtgggggggggtttaattgtgcgaaggagtccttgccatgtagatcgacgagcttttcataattttttttacgattttagtcaaaaaaaatttttttttttttttggctagttgcaagactgaaaacttcttattattataaataattaacaataatgattgcgttttttaaggcttacatgtctgtcatgggcttgaatcagttcgctttctacggctcacatcttttgattgctgtgctcaaaatgttgccttttgctctgatattcgcttcactttgtgttatttatcgactcattgag

SEQ ID NO: 80016 - DNA, 679 bp, Heterodera glycines
  Genomic contig location: Contig_ID=SeqID_15701; Location=360..1038; Strand=-
  SCN-specific regions: Sequence locations=1-121,161-180,202-251,276-679
atgccaaaatggggagacaacgactgcacaatggacggaccaacaaaattcgaacaacaatttgaacaatgtcagcatttatttgaatggcgcaaattgcatttggtgagcaaaatttgcgtaaaattattaaaaaataattgaaattttagaataatttgttacgttgagaatatctttaaaaaatcaaaatttaaaattgcaattaatttttggggtttttgtttcttttcgactttttgttcagaggcaaattcaattaaaatttaaaaattttcgaggtaaaaaaaaaagaagtagattttgccatttctttaggccattgtcgtccacaccaaaggcgcgaaaaagcggcagaaagaagcggcgtcgaattgtgcggaagtgaaatttaattgagaaatgatcggcttattggggattattgaatggacaaattgatctgctgatccatttttgctcattaattttaatgattctttccgacgaaatattttttatttctttttacttttgacattaaatgcaccaattagggctgctcaaatgagggctgaaatccccagaaaattaaccctcgtatttctccacaatgctgttcaaattcggatctccgcaagggcgtagcgaagggggcgggggcttaggaggctaaagcccaccgaaaccgaaaaataaa

SEQ ID NO: 80017 - DNA, 54 bp, Heterodera glycines
  Genomic contig location: Contig_ID=SeqID_15703; Location=548..601; Strand=+
  SCN-specific regions: Sequence locations=1-54
atgccgtcgtgtaacggagatcgacatccccaaggagaaggtgaacaacgacgt

SEQ ID NO: 80018 - DNA, 1477 bp, Heterodera glycines
  Genomic contig location: Contig_ID=SeqID_15704; Location=1..1477; Strand=-
  SCN-specific regions: Sequence locations=1-1317,1340-1477
  Gene Ontology: Mol. function=beta-galactosidase activity; Cellular component=lysosome
ctccaaggaggttcaaaagcaaacagaaggaccattggcattcactttcatttattccgcctttggcattctgttgtctttgtgcactctctttcatttcttcgcgtgtattttcaccttcccaaaaaggtcctcccgtcaattccgagttttacaccacgtggttttccatgtggggcgaaaaatcgatggttcgccaggaaatcggtcctgttctgaaaacaatggattacatgtgggcggaaaacgcttcgttcagtctgtacatgattcatggagggacgagctttggtttttggagcggaagagaaacgaatgggcctgtgagtggcgaaaggggcgatgaatgacgtcacttcaggtgatcacttcgtacgattacgctgcccccattgatgaagcgggtcaaatcaccccactttacggggccattcgaaattggatcggcgccaaaaaggattggcccaatccgccgttgccactgcccaagaacagaacgttggtcccccccccccccctccttccatttaccaaactcattagtggcgtttccatccaaaatgtttttgccgttaaattgggcgatttcatcgctctgaccaattcgagttcgctgagttcttcggacagtcgccagcggtgcattcactcctccgatgggccgttgaattttgaggcgttttaccgggaccatggctttgtttggtacagcgcatctctcgagacggacggaaaaacattggaagtgcctgaacttcgcgaccacgcttatgcctttttggatgggatatttcaggcaaatagcaaagggaaaaattaagtgaaaacattggtctttctcatcgcagggcaatttgagtgtcaatgacaaaacggggggacagatgaaaatggaactgaaaggaggcggaaaaaggggacagagaatggacattttgggtgggttggagaaggaaacgcgcaacggaacgatgtcaccaattaagtggaaaacatcggccgacttacgtaccctctgaccaaaacggaccccaaagtgccgtcccccccccgccgcttttcagttaactttaagggacttttctcgccacctttcatcgatggcaaagtgatcagcaaacgatggattcagtgcggggtgaatttggacaatgtttacgccgaaatcgaaaagcgaatggccaagtcaaaaaatcgaaaagaggtcggaaagcgagggatttgaagggaaaaagcatttgccaatgcgaagaatgacttcgctcatttgtcagcccaccgacacaattcgttctgcgcttctccaagagccgaccatttttgtggccaaattccccaccgctcacatcgattgggcccaaatgcacacttttctcgactcgcgcggttggggccacggcgtcgctctcgcaaatgggttcaatttgggacggtattggccaacgcaggggccgcaggtgtttttgaattttgaaat

SEQ ID NO: 80019 - DNA, 2654 bp, Heterodera glycines
  Genomic contig location: Contig_ID=SeqID_15706; Location=20..2673; Strand=-
  SCN-specific regions: Sequence locations=1-96,125-142,191-313,335 -596,634-1154,1177-1199,1242-1246,1269-1421,1454-1606,1628-1665,1687 -1739,1782-1987,2050-2654
catccgacgcatatgatttgttgttttctgatgcggatgatatgacagcaaatcttccaacatccagcagctcattggcagcttcaacttcgggtgaattttataaaataaattatatatatttcaattgagactatctgacatttttagattttttaaaaaattgaaaactaaatttattaattaatatgaggtttttccaccatgacaaaatgtcgccagccgaaacgttgttggacgaatttttggatcataactttttttttctttctaaaataaattaaagatatcttgttagttgttcaaaagcattattaacacacagaattcttgataaattttttttgtgcatgattaaaaaaaatcatgggaaaaaatcttcgaaaaactaggtttttgaattccttctggccatgccataattttttgaaaagtaacgaaatttttgagatttcgcaaaacattaatatcaaaaaaaaataattagcataatcggattgacatcaaacaaagttatgaccaaaaaaaaaaaacttttttcgtcagagcgacattttggggtgcagccgaaatatttatttctgaattttaatgccaataaaaattttaattaaatttgataaaattttatatgtcaatcaccacatcatgtctaggcttagctaaccacaacgaaactgaagtattacttctcgaacacgcgattgcggaatcattaaagctgaaagagaatgaagatatcgaattggccaaagccatttcaattagcgaagtgcgaaatgattttggaaatggaaatggccacgaattgctgtccattgacccggctgaaattgacacgcaaaaagcattaatgaagcaaataaagaaagacagaaaaatgaaaatgcggcacaaacgtggggcttttcctatggtgagcttaatggacaaatacggatacggtattatagtctgtctgtatattaaacgataatagattattggcctgctgcctgtggggtgatattactgcaacagtattttacagaattatcgaaaaatttacaaattgataagggtttataaatgaagagaggaacacttcatgtattatattgactaattgaaaattttttttaaatttttctacgttttcgcaattttttcttgaatttacgcttgtatattttattgtttgcatgcattttatactagggtttatataaagattaaattaaagttttatttaaataataattgttttcaaccaattttcaatttttaaggcataacaattgtataacaactaacaaattggcaacaggaatgtatttcaagaacgatgatatagctaaatttcctagacactgttttattttcattaaatgatttttagcatacattttttcgatttggactcgagtagccactgtattcacaaattattataatttatttttgtaaaaaataacatatatgacaatgtgtcagatttaaatgctgataattagtgctaacacatttttcggtcgggggtcgttttcgcgtggccattttcgcgtggccgttttcgcgtggggtacgttttcgcgtgagtagctgtttaggactgaaattggtcgggtttgtgcaaaacatccatgtttcgaatccgaacccgcatttggacaaatttcttaactttttaattcttttatttctttcggctaatatcttctacaataatttgtcagtttggtcggatgtgcgtcaaacggaaaaaataattaaaattttataaaaatataacaaaaaaataacaaatttcagaacaaactaaggtcgcatttcatagtttcaggaaacaccaatgagaaaattgataatgttttcgggattcacattggcattggcataattgtgatcattttgggggaggtgaatgttattgatgtcgttatagagtgcgccgtcatgttctaacttaactttgtttcgttttgttttaattttttgctgctgatccatattatataatttaaatagccttaatttagtttataaactcattaaattataaaataaaaactcgttagaaaaaagagtgaaacaaattttggtaaaatataatgtgagttatgaattctcatttatatgcaaccacgcgaaaacggccacgcgaaaacgtaccccacgcgaaaactgccacgcgaaaacggccctcacgcgaaaacggccacgcgaaaacgtcctggcccgtataaatagggacctaaaataggccgctgcccgtcaaaatccctccgcgtcataattagggatacgatttatagttactaaaaagtgccaaaatagttagttttagtttctaaaaacccccaaaatagttgctaaaaatgggaaccgcccactttggcgatctccgggttttttttactgtaacttttttatttgtcaaccaaatcagcattttgttggtatcattctatagacctgattgtcatcaattagcctaaaaatttttcaaaattttgtttaagttcagaaacgttatggccagaagaattcaaaaaaccaaattttctaacctttctggccataaatttgttcaaaactgacgaaatttattgaaattttgcagggtaatagagtatctgaagggctatcgaatgataccaacagtgttggatttg

SEQ ID NO: 80020 - DNA, 238 bp, Heterodera glycines
  Genomic contig location: Contig_ID=SeqID_15707; Location=339..576; Strand=-
  SCN-specific regions: Sequence locations=1-116,139-150,193-207,229-238
atgcatttcccatattttcaccaaatttttgtttttgctttgataatagtgaatcgagcacatggacaggcggcagacgacaatcagattgacggaaccggttatgagaactacgattcggatgatctagaagctttaggatggagtaagtttaattttatttaatatataattttatttaatattattaaagttatgatttttaggtttttacctattttctaagaattgtacttga

SEQ ID NO: 80021 - DNA, 64 bp, Heterodera glycines
  Genomic contig location: Contig_ID=SeqID_15707; Location=868..931; Strand=+
  SCN-specific regions: Sequence locations=1-64
atttcaaatttaaatatatttattgagcaaaccacaggcacattagtgctcttatgtggcgcat

SEQ ID NO: 80022 - DNA, 646 bp, Heterodera glycines
  Genomic contig location: Contig_ID=SeqID_15708; Location=22..667; Strand=-
  SCN-specific regions: Sequence locations=1-470,492-646
atggcgaggaaagtcaaagattgttttgtgccggaagttaacttgttaaacgacgcaactgagaagctggcacaggtgaaagagtaaaacaggggtaattagcaccaattggctaattaggagtaattaactaattggataattagtagtaaatgctgccataatgccaagctcaatcattcattaggcgatcaatttttgcgctcagcgaagccctttcgacgcgaccctttatttttttgacgggaaaggcccaatccaaaagtgttcccgccaggcgttggtgtgccgcggcatcgcttcggcaccgttggcgattgggtgcccttcgggtgagagaacgaaagatgaataacagaacgccaaattaccgcaggcaaatcgttcgatccgaaaacgctgaattgtatcgctgccccggagcaatgcgcagtgctcgtgggcctttttttgatggaaaatgccaaactttgccatttgaaatgtttaggcatctgctcaaaggcccatccgacagctgttgctccatttgtactgctccaaagcgcacccaccgaagaaagacattccgaatgacgaagatggaatgcggatgcgatcagaaggcgacgagccgtcgcagcagcaaaagccagcgattgtccaa

SEQ ID NO: 80023 - DNA, 332 bp, Heterodera glycines
  Genomic contig location: Contig_ID=SeqID_15709; Location=771..1102; Strand=-
  SCN-specific regions: Sequence locations=1-15,39-183,205-332
attccatcaaactaatcccaacatttccttttgttattctcgacaattacacaatgccgacttatttttgacactttcctttccgtttgtaagcgccttatctcttggattagttgtttagtccgcctttgttgttacgcctcaatttgaattttattcttggccttaacattgtatataccatcttattttcttttgtcccttccctaagcatcattagtccctcctcgtttcccatttttattgtttttttttctgccggtgcttccgtttattctcgtcaccgactttttcaatttctaatcacatgcataaaatacttaatttcttta

SEQ ID NO: 80024 - DNA, 1668 bp, Heterodera glycines
  Genomic contig location: Contig_ID=SeqID_15710; Location=829..2496; Strand=-
  SCN-specific regions: Sequence locations=1-54,76-333,386-1668
atgccggtgccactaggcgctctgcccggagcgtttggactcaatgtgcaggataaggagttcttccctcatttggcgaatgttgaggcgaattatgggcacattctgcagtcgctaccgccaaaagctgactacttatacggtggaatgacgcccgaccggcagcgcagatttgaccagtggtacgcggaacaccgccatcagcagttcgacctatgtgaacagctcgcagcctactgcaccaacgacacgcgcatactaattgaggcgttggttgcttttcgcacggagttcttgacgatcagtgacccgatggagcggcatggatgcttggatgatgacgacgacgacgacgaagaggaggaggagcaggatgacgacaatgcatttgaagtgatcggcggtggcattgacataacgtgggagccgatgaccatcgccagtgcctcaatgagacactttcgactcaatcacctcaagcgggatcagctcgccattgtgcccgagtgcggctacgacactacaaacacgcaaagccttgtagcgctcaaattcatggactggtacgccaaaaagaacggggtgagcattcagacgttacattcgcccgacggagagaaaaaaattggccagtacactgtggacggatacatcgcggcgaccgacaccgtgattgaggtcaacggctgccactggcacgcgcacgaccacccgcgtcaccgctttcagccccaaacagtgatggcgaacgggaaaacggcgcagcggatacgggaggacgatgcgagacggatggccttcatcacatctcaggtgcaacaagtgctcgtattttgggagtgtgaaatcaacgcggagaagcgcaacaacgacgaaatgaagcgcgcctttgcgcagtacaatgacagcggcccaattcgtttgaaggactgctaccatggaggacgtgtgggtccacaacgactacactacgaggtgccggaggggtggcggatgaaatattacgacgttcgttcactctacccccacacgaatgctgtgacagcataccccgtgggtcacacaacacgagtgaacatcattggtgaggcagagcaggcggttgactggcgacgcgccgaccaggtgccggtccgaggcattctcaaagtgttcgttgtgccgccccaccatgttgatgtgcctgtactgcccgtgaaatttgatcagcggcttcttttcccgctgtgccgtacctgtgctctgcaacatccgcatggagccgtcaatgaggactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgccgaattcatggccatgaaaacgcatgccagcggcttcccggacgaaattggcacagccgaggaagatcagcagcaattcatagaggaatgtgaggaaaaattcggaatccgaatcgagcgggaaaagatggtgcacaacaaggccaagcggaccatcgcaaaactgtgcaacaactccctttgggtcgattctctttacgcaacgggttgtccaaaacgattgtga

SEQ ID NO: 80025 - DNA, 1618 bp, Heterodera glycines; identical to SEQ ID NO: 15711
  Genomic contig location: Contig_ID=SeqID_15711; Location=1..1618; Strand=+
  SCN-specific regions: Sequence locations=1-206,241-259,281-349,371 -374,396-443,482-597,629-813,837-853,875-1618
  Gene Ontology: Mol. function=GABA-B receptor activity; Cellular component=integral to plasma membrane; Biological process=negative regulation of adenylate cyclase activity

SEQ ID NO: 80026 - DNA, 704 bp, Heterodera glycines
  Genomic contig location: Contig_ID=SeqID_15713; Location=41..744; Strand=-
  SCN-specific regions: Sequence locations=1-254,276-443,467-629,662-704
atgtttcgcggtccgttcactctaattctctcgggggctaccgggagtggtaagacccgttggctattacggtttttaaaacaccataagaatctaattgaaccatcgcccaccaaaattctttattgttacggtgagatgaatgatagtattttaggattaatcggggagggtgtcgagacttttaacgggattccggacatgaataagattaaagaacaggaaaaacccctcttactgatacttgacgatttaatgcttaacatgcagaacaattttcttgatttactctttaccaggggctcccataattggaacgtaagcgtaatttttgtaacccagagtctctacggtcgggacattaaaacggcaagagctaacgcccattatctgattttaatgcgtaacccttcaggacaattacaagtgaggacactggggtcacaactgttcccaaaaagactgaattatttcatggatgcatataacgatgcgaccaataatcaatttagctatctcatgattaacatgcacccaaattctgatgaggaattcagattatgtagcaaaatttttccagatgagactctggaaatttatttaccaattgaatagtatataagaatatgaatttaaattaaattaaaaatgtataaatttagctccgaagtaaaggagaatacagcgttcctaaagaagcttga

SEQ ID NO: 80027 - DNA, 642 bp, Heterodera glycines
  Genomic contig location: Contig_ID=SeqID_15714; Location=860..1501; Strand=+
  SCN-specific regions: Sequence locations=1-62,84-151,174-305,327 -535,557-560,582-585,607-642
ttttgggttgctatttatagaaggggtatataaagggagtgaaaggaccatttgattgatacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaaagccacggcattattatgggaatccggaaaaatgatatgtctggggacgaaaagtctgatagactgtgaaaatgctattaaaaaatttatagaaataattaagggttcggggtgtccgggggcttcttacaccggacacacggttgaaaatattgtttcgacctttaaattcggacgtgaaattgaactgaacgagtttcgaaaaaatcgtcgtgcattttatgaaccggaaatattttgtggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaagttagggagacgataaaaaaattttcatttatggg

SEQ ID NO: 80028 - DNA, 1082 bp, Heterodera glycines
  Genomic contig location: Contig_ID=SeqID_2489; Location=247..1328; Strand=-
  SCN-specific regions: Sequence locations=1-339,361-462,485-634,656 -789,811-999,1024-1082
atggtttaattttattatttttggcactttagaatttggacggcaattctttcttaatatgaccgttaaactgggaaagccattttaattaaagtattcaaattttgttccattttgtagaattctctgctctgtgcgaaattgaatgccgcagcggccacgatggctgacatttatggtgcactgcttctgcatgcgattttcgatggcagcaaagtgtgttatattgaaaaaaagaattttttattttcagttttgaaaaacagggttaggcgcaggtgttccatattcgaacccaaagtcagcgaggggtggtcagccatcacatttattaatgggattaaccctcgaaattcgacattttttttattacttttcgcaaatctatgttcgtgctgtgttttgttcaaaaaaatcacgagtatggttaggcggcgccggataaatttttttaatttagccccaatttatttgctaacttgtccagaaaatgacaaaaatgcactgcatatttttaatcaaatttgtcattaaaactttcttgggagcggggtacgtagtacgtatctatcccgcttataaaatcagcatttggccgataaaaaattataagttgcggtaattagaattttgaattattccaaataaaaaatcattaaaaattgtttttgtttttttttgcggtgctgacaaatttttggaattttgagccaatttatgtaaataggcggtcgtttacctatgcatttttaagcgtttttgtctgtaattatgcgcacacttcgttcttaattgccttcattgatttcaggattacaccatggtcagtgttagcttccgtcgcgagcatcagccatttctgtcggagtttggggcgttgtgtaccaacctcagacattttctgttggacattaaacagtacttggacgaacgtttcccggcggatttctaaatagagcccattttttcaaaagcgccgatgccgctctaaattctcgacatttgttgttgttgtttaaataagaattatcttccgagactgtctgatttgttaaattttcaatggccgagtaaagattaaa

SEQ ID NO: 80029 - DNA, 1688 bp, Heterodera glycines
  Genomic contig location: Contig_ID=SeqID_2490; Location=140..1827; Strand=-
  SCN-specific regions: Sequence locations=1-237,296-423,445-528,556 -680,704-816,838-890,913-917,940-1511,1533-1543,1589-1594,1621-1688
atgtcgttagtgagtgtcaatataatggaaattaatgttttttgtaatgttcaatttgctactgttatgttcttcgtctttgaagactgtctgtgtttattctttatcagttattattgattaattaatgaacacttacattggcactgatatgggggaggacacatattaaagaaattgctaaaataccaagtaaccatggtgacgaattccaacaattttaagccaaaaattccaactgctacaacaacaacaatgcaattttgctacgacaaaacgaaacaaaaacaacagaaattgcgcttttgtattccagccgaactcattaatgagcttctcctttttatggagccactaaaatttttgggcgtaaagcgtttgttgagaataagcgcaattttttaccgtttaattgtctgcagaaaaaatattaaaaattggcgaaagccattctcaattattgtaagtgaaaatcgttatctttaacgtcgaaattatgctgcttttatttcccttaaaagcaataagaaaaataaattttatattatataaaaacatgtggcattattattcagccaaattcagttttttgatttctttttattcactacgacttttaaatatttcagtgggaaaactcacttttttgtctttaagttggcttttttaatgctctttttagaaaatagtattttgttagaattaatttgatatagaatcgtgtggtaatattattcagccccaatttgtttaattatttttattcaagtgcgacttttttattgtttttttaagaaactttttttgactgcaaccttttttatttttaaatttaatcttttgaatggcttttttttcatttaaatgataataacattattttctatatatattttgtttggatttccattattaggaaataataattattatattaaaccagggtttcgatcgaaaatttttcaaaatcggggtcaaaaattcaaaattttcaaatcaggacatttctctgataaatggggacagattgaagccctgaattaaactaatctttaatttaggagcgcgaaaatgcttacaaatgtgagcttctttacccgctccaaaaatggccaattctgttgcgccttcactccaactgtctcccgtttctttcgatccacacgctggacattgcggccaagtattttgtggtcgccgaaacggactcgccggctgattatctcctcaaatttcaaattttgattgtgattgacaaaaacaaccacccatttgagcaaatgcgcgatttggtacgttggattgttacgatttttttgaatttttttaatttttctccagttttttttttaatattttcaatgcctggaaaaaagcagaaatttctgaccgttgttcgctaaaaaccacattgatttttggatggacggcggtgccgttaggcgacgtcgagaaaattttttggttttagcaatttgatcgggaccaggagaggatcccgggtccggaatttaatttattttacatttcttaaaatatggtcattatatattttttcttcttaaattgataattttttttatttttagcctcttggaaaatggtttaattttattatttttggcactttagaatttggacggcaattctttgttaatatgaccgttaaactgggaaagccattttaa

SEQ ID NO: 80030 - DNA, 915 bp, Heterodera glycines
  Genomic contig location: Contig_ID=SeqID_2490; Location=3463..4377; Strand=-
  SCN-specific regions: Sequence locations=1-26,49-397,419-469,491-915
atggcgcaaccgaacactccaaccgttgaagttggtgggggaaaggggtggggggggggggggggctgaacatggaattggggtgcactctctgctctcggcttgaaatatcctaccttgcaccttttggtttgcaataatgcataaaaatgtgtgttgtctaaaatatgtatcaaacgattcctgtcttgtgcctgtaactttgtatcaaattgtcgccggccacccagacttagctttcacaaatggcattttgccaactaaatctaaatcggattattcgccaattattctaaaatgatgtttttgctggatgaaaatgtaaatacatggttcctattcgttcttcgatgacaaaattatatgtccttgaaaagtatcgttcgaaaaaacattattttattaaaaccaatttttaaatacctaaaagttttcctaagcctaaataggccgtttttacggtattgtgttttctaagaatttttattccaaaaatcatgaaaattatgtaaatttttttaatttacagcccaattgaccagaattcggaatcgtccgattttgtataattggctacctgtccgcgtccatgacgcatataattcattttaagtcaatttttcccttattccggtccgctgatatcatggatatttttgaaaattatagccctaaaaactctcctttgatttttgaaaatgtatcatctccctcaccaagcaaagagtgacaaaacatatcgccaaaaatgactatattgttttttaatcgctaacattgaacaatatttgtgaatatgcaatttttcctcaaattatttgtttaatattggactaaatgttatttttttacatgtatcaactttaaggtccgctttttgggtttaaatttcaaacactaactagtgttaataaa

SEQ ID NO: 80031 - DNA, 394 bp, Heterodera glycines
  Genomic contig location: Contig_ID=SeqID_2490; Location=4623..5016; Strand=-
  SCN-specific regions: Sequence locations=1-394
atgtacatcgatgaaaaggcggtggcaacggcaacaaccaatttaaaaaaaggtcggacgatgccgccgcgagcagcggaaacgggaacatttgtcaccgaccgggtcggcgccgttggtaataacttttctcttaattttgtttttttcgtcattttttgtttgtaaatcaaaatttattttttgatcaataatgcgtttttttgttattttgaagctaagtgtaataatttattaacttcgtaaacggtctcttccagtttttgcattttttagcacaacattgagtcagacaatgcaaaacggcgaatttgattgtactacaatatgttgttggtcgacactcagaaatgattttatgcgttcaatgctaataaacaaatgctttgtttaa

SEQ ID NO: 80032 - DNA, 2288 bp, Heterodera glycines
  Genomic contig location: Contig_ID=SeqID_2491; Location=209..2496; Strand=-
  SCN-specific regions: Sequence locations=1-333,355-782,807-936,960 -976,1026-1045,1088-1103,1142-1146,1168-1178,1202-1382,1416-1446,1468- 1844,1866-2288
atgggacgaaaaacgatgacattgacggccgtagtggtgatggtgaaatctgcaaatataacgcactcggagtttggctcgagaaccgagcaagcttttcatttatcgtttaatgtatcatttttgttgctaggacccgcaaaatcttacaaaatgattcccagccctagtaatgattggagttttattgtaaaaaaattttcgctttttcacccccaccacttaattcatgaaaaaatttttttttcattcaggttccgccgacaattttttccaaattgctcgctgttccgacaagatcgtaatgtatcactttggttgttggaacccgcaaaatcttacaaattgagccatataatgtccaaaaatctacttacaaagtacctttttttgggaggggcgcggttaccggctgaaacaccccctccccccccccccaaaaaaaattttgtttttaaattttttgttttcttaggtttttggtaaaaaatttatgaattggatattttgatcgtcgttaatgtaaatttttatggaacatggtgacaaaaccgaaaagtacaaataacctaaattgcaaaaaaacgcttatttaaaattaatgtttaccaccccaatttcttaacagattccaccgaccaattttcaattctgtggcttgctgttccagcagcagaacatgctacagagaatcacccgaaccgccgcttccctatcagcggccaattttcaaaaattggcacggtttctgggaaggttcgttgttgcaaaaaatatataggtaatattaaaaaaaaaaaatttttcaccccgaaaaaatatgaaaaaattaagcatcgctcgggaaaaattcgcaaatttgtcattgcccacgcaaaggcatttgtatggcatttttgatcaaattcaattttttgattctataaactatacttcttaatttttttatataaaaaattctttattcgaactccagaaaaaaattgaaatttttttatattttttgtaaaaatagaaatttaaaagtttgattctacaaaaagactatttttatttttattttgattctctttatttattcttttttgctgcacaattggtggaataattttttttcaaaatttcatttttttttatttttcaaagtcgaggcctcttaatgtatggacacagtagagtaaaaaatttttttattttttaagaaaattggttgaggccatgtgttcagctctgtgatggtggtgctgagtaccaaaattgaggcgtgaaattcccagagcagataattagggattgaattttgcggggaaaaaaattcgcatcgaaattcggtggcattttgggaaaagaaaatagacctctaatggctgcacaatgtagagtaaaaaaaaaaaaaaatatttttcattttttttgttttttgaggaattggctggcgcaaatggattcagctctctgatggtggtgacgagtgccaaaattgaggaggtgaaattcccagagcagataattagggattaaattttgctgggaaaaaaattcggtggcattttgaaaatctattgtgttatttaaaaaattcacttggaaaatagatatattcaagagttttgttaaacaaatttcgccagtaaaataagcattttcaacagtcgagaaaataaaaaaattttcagtctaaaattttgaaaattattcgatcaaatttattttttttctttatattccaaggtcgatgtcattatgtcctccgatcccatgggctatatgctggtcaacgagcggatgttggagatgagcccgcaaatttcttcgccgtgttagtcactaataaaacaattttattttccaatgtttacctataaaaattttttttaaaactattgtattttttccacatttgtaagccaagccaatgtgatggagttggagatgtacatcgatgaaaaggcggtggcaacggcatcaaccaatgccgcgagcagcggaaacgggaacatttgtcactgaccgggtcggcgccgttggtaataacttttctcttaattttgtctttttcgtcattttttgtttgttactcaaaatttattttttgatcaataatgcgtttttttgttattttgaagctaagtgtaataatttattaacttcgtaaacggtctcttccagtttttgcattttttagcacaacattgagtcagacaatgcaaaaacggcgaatttgattgtactacaatatgttgttggtcgacactcagaaatgattttatgcgttcaatgctaataaa

SEQ ID NO: 80033 - DNA, 690 bp, Heterodera glycines
  Genomic contig location: Contig_ID=SeqID_2491; Location=3249..3938; Strand=-
  SCN-specific regions: Sequence locations=1-424,446-690
atgaagcgcctccttctcgcctcaaccgaaatcagctcgatcggaacaccgttttcgatggacattgctgacctccttgacgaaattcgggagctccacatttttggacgtgctgacctgatgacccaagaacaaatcgacaatttctcaaataaatgctcaatggctatttcaaggcaaagatactttttttctgtttttctcattttccccttttcaagaaactttgggaaactcatccggctaaattcgacacaaacaatgccgctggattcaccccaaaattacactggcttctcgcccatggtccagactttgccaagcgttgggggtggttcgcatggatcagtgaacagggaatcgaacaccttcaccacgttttgaacaagcaggttggacagactcaatttcacagttcaaaaacctattttttgttttagtctgagcgcttcatgcggtacaagggcgacgaactgctgctgaagatcggagaacatcagacattgctcaattctattttcgacagacaaatcggtttcctttgaccaacaattgttaggaatcgttagttttattatccggttttgttaaaatattgttcacgttaatatttttgatcagataaacctttcaaacaccaattatcgactaagaattatgtttgcttagatttgatcagttgggaataaa

SEQ ID NO: 80034 - DNA, 1056 bp, Heterodera glycines
  Genomic contig location: Contig_ID=SeqID_15715; Location=218..1273; Strand=+
  SCN-specific regions: Sequence locations=1-141,163-462,486-965,987 -1056
atgttttatgaggcggtgcgacaagttttggacaatataacccaaatggtgtctccatcgcatacaatgaattctaatgggacgatggcccaatctaacaatcagcagcagaaggcgccactgagcagtgcgcctccgcctccaccgcctcccccaccgccggacttcaaaaacttattggctggcaaacaacaacaggcaacctttgccgacaaacttcgggatgtcaaactccgaaagtgttctgcaggtcccttgatttagcttagcacctcccgcccccaccttcgcctttttaggaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaagtcggataagttatttgatttttaaaattgccaatttagatgcaaatggcaccccaaatcaaccgaattcacagactcttcccgtgaacaatgcgaaaggctctcaatcagcgattcctcctttcggaaagtcgctttttggaaatcagcatttaattgttaaaaaaacactttcttagaatcggcttcgttgttgcatcgtacggagggacaccgtcgacagcgggcgcagcctccgctgctcatgactcacaattaacttgcgaaccggtggtgaaaggcccaacacaattaacttgcgaaccgatggtgaaaggcccaacttcatcagctcataatgacattgccaattccgaggctcgaccaaaggcgacgactacgagcagcgatttcgagcggatgaaaggcgaactcctggaactgttctcgaacgaactgcagaacttcaagcgggaacttgcgcaaacaatccgagacgaagtggccaaattgtcagccgatcggagatgactcaacttgttcagaatatgtctctgttgtacattgtcttcctttttaatgtgcagtcactaacgctcttcacctttaatggtaaccataa

SEQ ID NO: 80035 - DNA, 131 bp, Heterodera glycines
  Genomic contig location: Contig_ID=SeqID_15715; Location=2309..2439; Strand=-
  SCN-specific regions: Sequence locations=1-79,102-131
tatggcacggaaagacttccggtttccgacatttttggggtctgaattccgacttccgaaatttttgatgaaaagtcggaaattttttaaattttttttttcacaaaactagtaagttttgtacaatttct

SEQ ID NO: 80036 - DNA, 796 bp, Heterodera glycines
  Genomic contig location: Contig_ID=SeqID_15716; Location=108..903; Strand=-
  SCN-specific regions: Sequence locations=1-53,77-96,163-539,561 -653,676-739,764-796
atgaattcgcacaacaaaatttacccgatgatcaatttgcacgaaaagaataagggaagtgagttttttgtattaaaatacaaattaattgcaatgatttttataattaagaaattatttttgttaatattttttgacaaaaaatataataaaataaaaattccaaccccaaaaagatgattttcgaatttccaaaacattttcaatcaaatttggatatgaaatttcttgtttcatcagcggcacctatcggcacagcagatccaaaactcgcttattttttgaaaaaatggctcaaaaatccataaaaaatggttaggttttttgtaaaatctgttcatgaatgaactcaaaatttacaaattattcaccggcggtgcctgtctcaaaggcacagttttttaattaaaattagatctaaaaagctaaatattaacccattttaacacaaaatatataacaatcaggcacacattcggactgaatctgtgaatggtttcatgcaaaccgctcaaaaatttaggctttataatctatttaaaaatgtgtctgtaccccaaaatcttattttatttatgatttgcttatttttgaaaatttgatcacagctttgcattaaatatatttttgtttttattcctttaaattttggaattactccctctccctcccgccggactccctgttaaaaatgacgtgttttttacggaaagccgcccgctcccgggacaatttggactcccgctcccggcgcccgcaaattttctttaccggtcttcagaatttagtgaataaa

SEQ ID NO: 80037 - DNA, 250 bp, Heterodera glycines
  Genomic contig location: Contig_ID=SeqID_15717; Location=282..531; Strand=-
  SCN-specific regions: Sequence locations=1-250
atgttggacaccaaaaacaacaacattgttggtcatgtatttggcgttagtgattttaacttatttagggagccaagttttacctttaaaatttttctgtttgcagtttggctataaaagattggttttagacaaggatttaaatgtcgagaagaagctggactttgtcagtaccggaaaagccgagattaagcggcataatgagtttcaaccggcatcgatatcctcggagttcattagttttttttaa

SEQ ID NO: 80038 - DNA, 466 bp, Heterodera glycines
  Genomic contig location: Contig_ID=SeqID_15717; Location=1127..1592; Strand=+
  SCN-specific regions: Sequence locations=1-56,80-81,121-150,172 -339,361-466
atgactcatccgatgaaacgcccaattattaccaatgctaaggaaacgccaaaaattgttattaccgtaattgaaaatgcagtggaaaaatttgagaaattaatttattgtgaattctccgagcacagaattggatggtaaattttacactaataaataatatttattttagatgagtgtgtggaaaatgttcttctgctggccaatcattttgggctggacacaattgagaatcgtagtgtcgaatttttggtggaaaaaagcaaaaaatcggccattcaaaaattcaatttggcacatcagtacgccatcattagcatgaaggtgaataacaaatcgaaaaaataggaacacaactaatttcagaaaaaaattctgaaggatatgactagaaaggattttgttgttgctgggaaaaacatttaccgtgatttgttggaaatggaaaaaaggacacttgaaaacg

SEQ ID NO: 80039 - DNA, 639 bp, Heterodera glycines
  Genomic contig location: Contig_ID=SeqID_15718; Location=82..720; Strand=+
  SCN-specific regions: Sequence locations=1-12,35-329,372-639
atgcttcttaaattttttgatagtgagattttaaaataattgatttttcgacacaccgtccgaaaaaacgagaagtgtaccaataaatagagagtgccagagaaaaacattactttttttctctaattttttgtctccttttggcgtactatctaatatttttattattaggaaaaacaacattcacttcatcctgtttaacttttttcctgcttgttaaatccacaccaaatattgcaaatcgatagagaaaaaaattctgcatcggttaataggtcaagttaatattaaaataggtcgaattagagttttttttgtgctaataaataaaaatatagattctttaagtatttatggcaaaagaaaattattaagtaagctaatcggcagagaatctgtaaaaaagcgctggaacaagcgagaggagcgacaagcgcaaacggtcaaggcgagacaagcctatttggccaagagaagtaattttttcaccattttttacttaaaaatctttttttttgtattccagccgctccacagccgaatcccaatgccgaaatgccaccgcaggacgaagcagggccgtcaacatctgctgcatccgtcgaagaagcgatggaaccgccgccaaagactggatga

SEQ ID NO: 80040 - DNA, 1154 bp, Heterodera glycines
  Genomic contig location: Contig_ID=SeqID_15718; Location=1356..2509; Strand=+
  SCN-specific regions: Sequence locations=1-129,151-360,382-410,432 -526,585-617,639-725,748-927,949-1154
atggagacggcagttgatcagttcaaggcatttctcgacgaacaaacaatggtgcgaacccttctttcaaaaaagacaaaggcccatttgctgcttcaccactttgttccatttgcgcgccaacaccgatttttggggcttttggatgagcagggtgggaccatatcattttttgggttcaattttaaatgttgtgatttttcaggagatgaggcattgcattccgtgtggcggcgacttgagcaactgtggaagacgatgccggactctgaacaaatgcgacagcagctggagcatcatttcgtctcgaattggctgctggacaccggcagactcgacgaattgaagctggtgagttgatggaaggggctttaaaaccttgtccaactaattaagcgggaggaggaacaacgggagcaagcggaggaagacaaaacgaatgaagaaagtgatcaagaagctgacgtcgatgtcgttgactgatcgaggattaatggtttttatttcattacaagcggtagataaaatttttaaaaatttgtaaacaatttttcaatcattttggtcacttttccttttatttattcattaaaatcatcgaaatacatcaatagcatgcactgggaatcgaacctgggactccccctttggtgaccttctcacagaccacttcgccacacatacaaatcttttttggtacaggagctcagtttccggacgccgtgtatattaaattttaaaaaataagccgattttttgcaacttcttattcaagtttatttaggtattcaaatctacagagtagtgtaagtaaattgggatggaaagttgtgaattccaatgttctgaattaaaaacgaaacggattcttcttatcacttctaatgttggatcgcttttcgcaatggtacatatttatatttgatcaaattaataagcatttaaacttttagaattcgtcggaaatgcgaaattactggttgggtcaaattttggctattgtcaatcagaagaagcccattttctttgttttgcatctccaaggcattttttaatatttgtacgaatgaattaaaaagaatttttagagagtggcggtaaaaactaccgacaacacagccgagaaatgcctgaactcgttgatgaattgcaga

SEQ ID NO: 80041 - DNA, 167 bp, Heterodera glycines
  Genomic contig location: Contig_ID=SeqID_15718; Location=1922..2088; Strand=-
  SCN-specific regions: Sequence locations=1-95,117-167
ttaatatacacggcgtccggaaactgagctcctgtaccaaaaaagatttgtatgtgtggcgaagtggtctgtgagaaggtcaccaaagggggagtcccaggttcgattcccagtgcatgctattgatgtatttcgatgattttaatgaataaataaaaggaaaagtg

SEQ ID NO: 80042 - DNA, 699 bp, Heterodera glycines
  Genomic contig location: Contig_ID=SeqID_15719; Location=377..1075; Strand=+
  SCN-specific regions: Sequence locations=1-131,163-240,264-699
cttttggtaaatcgtttgtctgaacatgccgataatgcgtctgcttctgttgctgctgacgatggtgttcagcaggacattggtccgttgctgatccgatgctctttggacattgtcgcgggtttgacaatcatttaaatgttttaaaaatgaaatctaaatttatttatgagcaaaccaacagcacatattgccttaaattgtgcatattatgaaaaatctcctaagatatacagacagataattaatataataaaataaatgataatgttcaatgtcgaaatgccgatttccgattttttgggctcggaattccgattgccgaaattttttgacagcgttggcacacatccattgtgctataaaaaatgctaaaatgttacagagattagcccaactcaaaacactaattacttttaaaaagtcccaaaatttattttgcttattggcattggatgccgttctgcagggggtttattcagatttatacgttttccagaggccataatgggcgttcgattggacgctgccaatgccaaatgccgcgaatatgtgcaggcggtcaaagagttcaatgacttggcacacatttactcgaccagcgcactgttcacgtttattccgatcagttggcatttgtttggccgtgccaaagagacgaaaaaatgtgtggccaagctgaagcagttcaccagaggg

SEQ ID NO: 80043 - DNA, 526 bp, Heterodera glycines
  Genomic contig location: Contig_ID=SeqID_15720; Location=503..1028; Strand=+
  SCN-specific regions: Sequence locations=1-10,32-37,64-406,428 -488,511-526
atggaacacgcgctggacagggaggagctgcgcgagcaggtggacacgttcatgttcgaaggtgggcccggcagggagggggagagaaggcaagtgcccggggcatcacctaccacattggggtagatccactcattcataaacccaactcatccatactaaacttatgtatatccaacttatcaatactatcatcccatataccacccaactcatccatgtacaataaatgccaaaacacagaccgcataatgcaagaaatgccacggcacggactgcatattaatgagatggatatggatgaattggatttggatttggatgagctggatatatcgatgattgagtttggatgaatttggatgagttgggcatgattcccacacatttgtcacattcataacggaatgccaattttttaagcaaaatcggttcatgatttaattaaaatttgtgaaaatttcgcaattaccgttcgcctagtcaatgaaatactttttatttgcccaattaatgaaattaatta

SEQ ID NO: 80044 - DNA, 1213 bp, Heterodera glycines
  misc_feature (310)..(310): n is a, c, g, or t
  Genomic contig location: Contig_ID=SeqID_15721; Location=391..1603; Strand=-
  SCN-specific regions: Sequence locations=1-174,196-219,242-377,399 -1213
atgcggcttgttgggttttatcaacaaattgttgtgtccgagtctgctgaagtgtggcagtgtgtgtcaggcacttcccacgacgactgcaaaaatttttttgcggaattgggcgctgtcttgcgcttagccaatgtaagttgtttaatgtgaattttcaaaaattagaggggtgaaaaattcggaaaaagcgggggattcccggtggttttcacctgcttttttgattttcatgattaatgttagttaatttaggaactccaattttctttcaaaaaggcgttttgtaagttgtccgatgaggtcctcncagcgaaaatacacggccacgtcgcatttacgcaggtttataattcatttatgttaattgttagctgactttaatttgaaaatgttttagtatgctggtggttctttgagtgttaaaggcactttgtttggactctcccgccaaaacgtttaccaaatcaacgtttacggttcgtgcatcgccatgtgttccgttcatttatatgttttcagtttacggtgatatctccaatggctccgtctccgtcggtactcctttcgcagctgacgaacagaaggttttgttgggcgagaattgccggggagggttgttttggctccgccgtttcggcgcgagcccaactcttttgactatatatttttctttgtcatctgaatttaataatcttggtatcattccacatctcttcacatgctccgttagccttacaaaaaacagacaagagctgctcgttgagttgtacttgaacctcggacccccaccccccgcccttcatttcatgttaaaaccattttcagaattcacttctcattgaaattgacacttcttcgaccattggcggcgaggacatttttgagttttcatgtgatcacttttctttgtttggtgtcaactccatcattggccgtgcgcttgttctgcgcaaacccggagaaggctcggtcccgtgcaaaaccggagaaggctcgggtattttcctctattatttgctcttcatttaatggcaattcaatgacttttagtcgctggcccatcggagaagagaatcaaactgtccgtgtctgacgagtccgagaaaatggcgtggggcatcataggcattgctgagattatgccatctgaccttgacgttgctggctgagcgagtggcggttgaaatggcaatgccatcggagaaataaa

SEQ ID NO: 80045 - DNA, 918 bp, Heterodera glycines
  Genomic contig location: Contig_ID=SeqID_15723; Location=13..930; Strand=+
  SCN-specific regions: Sequence locations=1-85,107-255,277-406,428 -645,667-685,731-918
atgttacgagcaaaaattgccgaattggaaggggcgacgtcaattgcgagtttcgatgttttggcaccgaatggaaatggtgaaataaataaatgatttcttttttagtggattttaatgagaattaattactaatagaagcgatcaatgaaagtgacacgtgctttggaaaatttggtggtgttgatcagcagctgaaggtgagttcccgaatgtacttattctgagatttgaccttgtataaaagtcgctgggaaaattttcaaaaattttttcatgaagttttattaaaaaaacagtttttttttcttgagaaatttctaattgtaagtttgaaaatttaaaaaaaaaattcgcgcgggtggcagcaagggggaaacgagctgcttccaaaaaattacagacgaaatttgttgttttcatttagaactttcgtggacaatttgtaaaattggaaatggaattgagagaaacgaaacaaatgaacgtggtgacaaacttggaaaatgtgagtttaaaaattagacagagacagttaaaaacaacaaagttcaaattttcagaaggctcttcaggcggagttgaagcatcagaaactgttgatgttaaccgaacaaaaagcgatggaagagaaaattgccaaaatggaaaaggaacagcagaaaatgggtgggagagaattgacaaattaaatttttcaattttttgtttaattttcatttaaataattgcctatttgttccagctgatcagttggcacaacgacaaaatgatcagcaaatgaagttggagcagttcaagcaaaaaaatgcaactgatttggaacagttgaacaaatcacaagaagggattctcgtgaaaattgatgaggtggaaacgaacgaacgaacgcacaataattattaatgggaaaaataa

SEQ ID NO: 80046 - DNA, 377 bp, Heterodera glycines
  Genomic contig location: Contig_ID=SeqID_15724; Location=326..702; Strand=-
  SCN-specific regions: Sequence locations=1-377
atgttttttcataagaattttgagctattgtcaggttggtaatcagcgcatttttacatcaaaaaaatgaaaaaacattttaaatttgttttcctccgtgacacaaattctccaatattagttgtttagcatggtcgaaatttctattagagcccggattttaaaattgccattacttagaaaatggacagggacttggtcccgagattcacgttttccgggactcccggtattttgtccaaaaaaaccgtggacctgaaccacgagtctcggcaaaatcccggtccctacaagcttaattttatctgcgttttttggattttctccggtatttaccggtcaatacgctttgtccaatctctaattaaaagaataaa

SEQ ID NO: 80047 - DNA, 1850 bp, Heterodera glycines
  misc_feature (165)..(165): n is a, c, g, or t
  Genomic contig location: Contig_ID=SeqID_15725; Location=105..1954; Strand=-
  SCN-specific regions: Sequence locations=1-82,168-211,249-372,412 -694,716-754,776-787,833-912,952-1045,1069-1256,1278-1341,1363 -1487,1510-1608,1630-1728,1750-1850
atgcaaaatgatcaaaagtttttattggagaaagtcaatgaattgaagaaagaacaaaagcagagaaaggtgagctaagaagtaaaaaaaatatattttttaaatagtttcattaaatttttatttaaacaatttcattttaaaataattttatatgaattattntaggctcttttaaatttccgacaaaattattgggatgccaatgtttgtgtaaatgcttttacttttaaaaaagcatgaaaaatactataatgttttacaaataaacgctttacttgttaacatattttattgaaaaaagtgacaaaattgaaagaacgtatagaatacaataaactaaccactacgacacagaagaaattattagtcttttttaaaataaatattatttaatttttttaattttttctttccttcaactttggtcaacattttgaccccgcccccattaccttttaaaaattttctcaaacaaatgaaaattaaatttttgaattttgcacttttttgtgaagtgcccccacgtacattttcatatgaaataattttcagtcgttagacatttcgagacaaaaacaattttaggtcggcgcataaaacaatttttccgatactgtaggttcattttcaaatttaataattgtggatactatttttcagttggtaaaaattgccaaaatagttaatttttagtttctaaaaacccaaaaaataggtgccaaagaaggaaaatcataaaattgtatccaaaaagtaacaaaattaagccatttcaatattaagatacacaattttaaaatcaaacattgtttttaataacaaataaaaaatttgtcgataaaattttgagaaatttttgatttatttagctttttctttcagtaatttttgggttgattcttaaggtgtatttttcctatttattgcattttttaaaacaaattttctgcaaaacgccaaaatagttgaaaatagttttccaaatttttggctaactcgaaaactagcttacaaattaacaacaaccgaaaaagttattttcctgagaaacaaaacaaacacacctagtttttttttgaatatttttcattactttcttgaaacttagcgaaattttttaaaattttgcgcaattgaagatatcgctattttaaaatttagttgcttttgagcaaagttaaatcaaaaaaacttcatttgatggtttttgactgattgttgtatcacacttcagatgcatctaatcacactcaaaatgataaattatataaaattgatttgttaataaacttattttgatcaataatgtgcaaattctctgctggcattataatcgcctttagaaaatgccttatttttgagccaacaacttatttttcgccagtgatttgcttactttgtaatattttcactcagtgttggtacggattttcaaaaaacgtgaaaacatggacgaaaagtgaaaatccattaaaaaaaaatcattttttcatttaaatatttctccagcccttgcttgccctccgctgagttcgccagccgacgatttgaccgtgcacattggtaacagaaaggtgaagagtcaataagcactgatcatttgagaatttaaaggaagagtattggttcagttgaaaaaaaattggtaaacggatactcagattacggtgtccgctgcttggtttatgtgccaattgccgatggtccgtcgaatgctcagcgtggaaatgaagaagaagcagcagccgtcgtcactttgaacgaattgggcatcgacatggagcagttcatggactttttggaggcaatttcgaccaatgctcttctatttccaattttgccaaatc

SEQ ID NO: 80048 - DNA, 1185 bp, Heterodera glycines
  Genomic contig location: Contig_ID=SeqID_15725; Location=2055..3239; Strand=-
  SCN-specific regions: Sequence locations=1-141,207-318,370-650,676 -772,804-1185
atggaaaaaacgtccgatgtcgtatattttgtttcaattaacaaccgaccatcgtatatccgacatcatatatacgatgaaactaagggaagaaatcgtaaattcatccgtggtgcaacccatgtatttggtcccgtcatgtaaaattaaaaaattcacaaaaaatttaaattttaatataaattataaaaaaattttgttttatacaatgaagtctcctctttctaatgatataaaattcaaaaggataattaattatgtgaatgattattactgtgtttttctcgagaatttcttcagaagctcaaaggttttcacaaaaattttcaaaaaatctttaaaattatcaataattttattaaaaaatttggtcaattagtctaaattatgactagagctcgcattttgaggcatatgcctttttttctgcgcacttctttcgatatattaagcataaataacgcattttccacttggtttgaggcttctatgttgacttttattatgccttttttttttgcctttttcgggattttcgtgccttttttgccttttttcaaatttttggtgcctattatagtgcctttttcgcgatttttggtgcctttttatccgagctctaataattacacaccctacacataagtaccaaaatttttattaattaataaaattcaggaattccgtgaaaagtttgcaaaaatggaaatggaattgaaattggccaaattggaactcgaaattgtgaggagttttgccataaaaattcgactaaaattaagaaatttttaaaattatttttagaaggtacttgaacaaaagttaaagcatcaggaaatgatggtcgaacagaaggcattgaaggaaaaagtgatcaaaattgaacagaaaaatgaaaaaaaatgaaagaaattgaaaaaattttatggaattcttattgaataattcgataaaattaatgacaacaaattcaaaagctgaaaaatgagtttatggttttaattggtattttattcaaaaatttaattaagctacttcggatcaactctcaaaaatagaaaatgatcagaagactctatttgaaaaagtcagtgaattggagaagcagcaaaaacagcagcacgaaaacacgaccaaaggcgggggaattttaagcgaagaataccaaaattatcaattattaaa

SEQ ID NO: 80049 - DNA, 643 bp, Heterodera glycines
  Genomic contig location: Contig_ID=SeqID_15725; Location=3311..3953; Strand=-
  SCN-specific regions: Sequence locations=1-220,242-402,425-643
atgggggaaatttggcaggctgaacgcgacccgataatgcgcataatggcggaccaattgtgtgaactgtgccacggaatgttctcccacgtgaaccccaatttgcgtgcccaatgctccagccaatgctacaaaaacgcgcaattccgcaaatgcctggagatgtacacggcactgcccgaggggcacccgggcggaacggtggaaacgaaacgaggaaaagggggtggaagggagagaaacagaacaatggcaatgggcgcagaagagtgaacggacgacggacgaagccaaacgcaacggacgccaaaagggcgacaaacggacagtgtccattgtgaaatacttgtgaaggaagggaaggaactgtgctgatactgctccgactccttcgcatttgaacacagtccatttggaacaaatacctatatattttatctcttcattttttaaatatttttcgtcttatatatatattttttgttactgatcaatgcctacctacatacattcttggaatcaaacgaaagttgaattatcacgtttatcgaatatccggggcctatttcaattcccgtcgtatctccgatatgatgtcatatctccgatacgacatcgcatcgtgtaattctgtttcaataaa

SEQ ID NO: 80050 - DNA, 315 bp, Heterodera glycines
  Genomic contig location: Contig_ID=SeqID_15726; Location=52..366; Strand=-
  SCN-specific regions: Sequence locations=1-315
atgaattggccaaagtcaaattggaatggacagaaaatgatcaaagagaggccagcaaattttggacgatcggtgaaaagggcgaaaaaacatcggattaataagccaattaaccaaaggcactttttcttagataaacgcccattagtgcggcaaacgctttatttggttcgccatgcggaaaagctggacatcattgacaaaagctggagcaacgacaaaaacgagttggagcgggaggactcgcctctgtcaccgctgggccttcgacaggcggacgaactcggaaaatggtgggcaaattgggggccatag

SEQ ID NO: 80051 - DNA, 560 bp, Heterodera glycines
  Genomic contig location: Contig_ID=SeqID_15726; Location=652..1211; Strand=-
  SCN-specific regions: Sequence locations=1-560
atggcatctgtccgagaccaagggatatatgggctattgatagtcgttttttggcattctgaaaatagcacaaatttgtccaccaaaaggcaattgtcggtgttggatggacttcgatttgtgcactgttccgatgaccattcgcgaggagtgatcaaaagggatgagcagaagctgctcgactggatgggcgagcagaggcaatgcttcggcgacgctcagaaacacttttcgctgccaaatcgtttcttccggcaaattcgcagcaaaataaacgcatggaatgccaaactaagcgaattgaagaaatgtgtacggatttccaaattgagtgcctaaatcggcttttgaattcatttcattcagacaaatgttcacaattactacaagaagttccgggttagctttatccacccattccattcagttttttttttgaatagcttttgaacacaattcgtctgatatttcgtgcccaaaacatcacaattgtccaatattttcttgatatgtttctcaataacactgaacagaaacaattgggaaaggttaaaaataaa

SEQ ID NO: 80052 - DNA, 595 bp, Heterodera glycines
  Genomic contig location: Contig_ID=SeqID_15727; Location=1248..1842; Strand=+
  SCN-specific regions: Sequence locations=1-59,110-270,331-407,432 -464,486-552,575-595
atggcggacaaccaaaagcagcaacgattcaaagggaaagttgtcatcataactggtacaaataaatgttatttcaaattaattaatataataataaataaaaatttatgtgtgtaagaaaaatctcattatcactgaaattaattgccaaatgcaaaagcattgattgattctttgtgaagggtccagtgcgggcattggccaagcggcagccattgaatttgcgaaggatggcgccgttgtcgttattcacgggagagatggccaacgaataaatgtaaaaaataaaaatgaattaaaatattcaattaaacaaattttatataaattcttaattcttactcaatttggagatgaggaaaatgggaattgatatcaaacttcgaaccttttttaggagactgaacaaaaaattttggctttggaagtgccggcggatcgaattttgaaagtgcaggggccaattgaagaggaaaaaacggcacagaaattggtggaggaaacactgaacaaatttggacgaatcgatgtgctggtaaagtatttaaaagtagaggagaaaatggtcattctgtacaaattcaatcacaaataa

SEQ ID NO: 80053 - DNA, 1595 bp, Heterodera glycines
  Genomic contig location: Contig_ID=SeqID_15728; Location=301..1895; Strand=-
  SCN-specific regions: Sequence locations=1-299,321-452,495-974,996 -1595
atgccggagaacaacagccagcaacgacaggtcgtcaagcagtaccagcagatgaacagcgccaccgccaacgaacgccttttggagcactgcgaaagtgccatttgcagcggagacgccgaaccgatggaaaggcgtacttccgacgctggcgttaatgaagtggtaaaacaaattttgggctttttaaaatatgcaaattctcagtctgacgccgatggcaccagtgcggaagattgttcaggggcggaatgccaaagttcgggcaatcaaagcccgattttgccggttgaatcttcagccggcacaaatgctttggctgcggcggcgtgcaaagctcttctttttggacaaatggacagcaaagttttggccaaaacgctgcttagcagttcacgggctacgaacatttgcggtgccataggacaacaaaaaggtgagggaagtgtggcattcacccatcattaaaattacttgttcggaaaaatggtttaggccggcaattcccggctttagttcatgacttcttcagtaaatgcctttcccactttttttttgcttctgatcagtgatcaccgcttttaaaagtgaccacaattgaatgcactgcttctcctaagaagggcatattaaacatgatattttgtgcctgtttaccttgataatttctcagactcttccgccgatctgtccaatccgctgcaaatgcaggcgaccaatgatgagataatgcgcattttgcagcaagtttcttcattgactgatcagcagcagcaacaacaacaacaacagaatcatcaaaatgatgcttcttcaactgcggctgtttctgctgccgctgcttcgagcaaattggccacccaatgtcagctgtgcggaaaacacttcagaaaacgtataaaatattaaaccattaaaaatgggctgaatttaagagggaatttgctgaaatgtgaataaaattgttacacaatttgtattaagtatttccattttgttagcctaatattaatttatgctttacaaattcaagcacgcgacttgatcgcccatttggcaagcaatgcacacaaattccccgcttcgacaccgccggcagcaacagcgccaaactggacacatggcagcaacaacggcaccaacccattgttgcgcatttcctcagcaaacggaacgccaatggctgaacaaacgcacttacacaatgttcagcaacagcaaccgcaggaggtggtcggacagctttttaaggttggcttgaacgcacaagtttaagaacttgggaaatattaattgaccaattagttaattggtgaactcataaattgctcgctctttaaggaaatgtcgccggccacatcgctaacaacggccacaacaacacaagccagtaatttcggtgctggcgatgatggaaatcatcagcagcaattggtggccaacgaactgaaagagttgcgcaacactgtggccgaccttcggacatcggctgggagcagcaacaaattggagcaggcaagtcaaaaggggaatgatcagaagaaacaaaggatggctaagaaaaagcctacaaaggaccaaaatcaattagagaa

SEQ ID NO: 80054 - DNA, 684 bp, Heterodera glycines
  misc_feature (651)..(651): n is a, c, g, or t
  Genomic contig location: Contig_ID=SeqID_15729; Location=41..724; Strand=-
  SCN-specific regions: Sequence locations=1-129,151-349,371-684
atggcgggaacagtcaacagaataatggcgcacaacagcaacactttatgcacaccgcacctggcagcaaccaatcggcggacagtggcggcacagatcagcaaaacggcgggggtaagtgcaatcgatcgatcattttaagtgatttatcacccaaacataattaaaattgattagatttagtattgacattttaaaggtttcgtccttggaagcaaagacatcacggcataaatcttagtgttaatttagtttttgaagttttacagattcttataatttaacttctttttttggatattctaatctttttgagttattaatcaataatggttttgttatataggaaatgattattattttgtattatctttttaaaaattttggtttttttttgtagttttagcctttcagcaaaaatcctcaaagttggcagtgttgggtctttaagaatttttcctacaaattaggctttattgacgattttatggctcgagtattagggtttgtaaaaattgactgtaaaccctaaaataatttttaccttattgagaaaatattttaaatgcattttttttttttttgtcttttcatgcgattgaaacatttacattcagaactttgatggccccggcattctcttgtcattgngcctcgattcggctcattggatctgaaggctga

SEQ ID NO: 80055 - DNA, 812 bp, Heterodera glycines
  misc_feature (22)..(22): n is a, c, g, or t
  misc_feature (36)..(36): n is a, c, g, or t
  misc_feature (63)..(63): n is a, c, g, or t
  misc_feature (141)..(141): n is a, c, g, or t
  Genomic contig location: Contig_ID=SeqID_15729; Location=857..1668; Strand=-
  SCN-specific regions: Sequence locations=1-165,187-243,268-274,298 -337,367-653,700-812
  Gene Ontology: Mol. function=zinc ion binding; Cellular component =nucleus; Biological process=regulation of transcription, DNA -dependent
cattatgtgttatgtgtgaacntgttttccagaaanataggtatttgcccattgttattttcncaaccgggttcaaaaaaaggttgacctgcagctgtttacaaatgtttacatttttatttttctgcattttttaatgtntcaccaaaaatgttattctttgtgtacattcatacaaatacatttttgccttctttgttcgatttataagttccattttggatttatttcacacatataaacggcagtttttaaaaagttaaaaactacgaaataatttaattctgtttaatatttacggtatgaaattattttgattttctttcatcatttgaacattttaattaattattaaatatattttttcagtttcatttgttgtgatttaatgctgcaacagcagcaacaaatttcgctcgttccacagcccggcgatgtgtcgcagcagcacccccagcacaaagcttttgtctgcgaaatctgcggcaaggcttttcgattccgttcgaatttggcggagcatcggtcggtgcacacggcggtgaagccatttgtgtgcaaattttgtggcaaatcatcgcggcttaaaggtgattttgggaggattataggaatgtttaaacgggataactgtaaatttaaagggtcaaaccaattttatttatttatttttatataataattattttttaaatttttcagggaatttgacgaaacacatccttaaacaccacaaaattgagcagaaggaatacatcggcaccgaggattacatcatcaaaaagggcaaaaaatcggtgaaagaccccgcg

SEQ ID NO: 80056 - DNA, 541 bp, Heterodera glycines
  Genomic contig location: Contig_ID=SeqID_2492; Location=168..708; Strand=-
  SCN-specific regions: Sequence locations=1-298,320-541
atggttctcgtcagcgaattttgtgctcaatttctctcctgcccgacaaagtcacttcgcgatcgactgaaccacccagaggaccgagtccgagttttgcagcaattgattgggaaaaaggtccagacaacatacaaggatcggaatggaatgcgcaaatctttcctcgttggtggaatgactgaacgaggcgcggcatttgaaccagcatatggacgtctgcgtaagccgttcaacattaacgtggcagcgcatttttacgctcgtcaccgtgtcaaattgcactacccctatgtgccatgcatcattgaaggctttacgcgtggtgaggaccgttattatccgatggaactgcttgaaattgtcgacgacaaaaagggagggcgattatttggtcgattgttcactgaaattgaggcgcaggaggaggaggacaccaaaagtgaagcttcacattcttccaactcttcctatttacaatttaacggtaaaggctgcaaatggtatgaaagcattgacgaaattaccaacactgggcgtg

SEQ ID NO: 80057 - DNA, 1683 bp, Heterodera glycines
  Genomic contig location: Contig_ID=SeqID_2493; Location=220..1902; Strand=-
  SCN-specific regions: Sequence locations=1-172,194-308,335-492,514 -535,577-611,634-683,706-724,746-1683
  Gene Ontology: Mol. function=structural constituent of muscle; Cellular component=secretory vesicle; Biological process=cell proliferation
atgacatcaaatagcttctttgtgtttttgccaagtaatgtatcggattaccccgacaatcaaccgaacaaatatagggtacgtcttccaaaacctctacattttagtgggtcgtgggtttgtgggttgcatagcatcagctatccctactcatggcactctacaattggtacattggatgaccaatggattgacattcatttcaccaatctccattccgttgatgaggaccgacagcgtgtcatcagagtacctgtcccacaggcgtcgcacaaaaaagttgagcaactcagggattttttacaagcaacattgaagagtcaagaaaaagtcagacttaagccgcttgcgcatgaagaagggtacttcgataaaccggtagtgctcggctcgcctccacacgccaagcgcctcaagagatcaacaattgatgatctctcttcactgccctctcccccgagatatgatgagacagatgagcaacaatcacggcagcagcagcagcctcagtctccccccagattcgatgagacagagaaagaggataaaaaagtcaaagaagcaacacctcctcctgtcactaagcaaccgataccgccggctccaacacttgctcctccttcacatcctccaactgaagcgccaaaggcaccaaaacaggcagctccaaaatctgctacagtacctccccaaaagccaagtgtgacacctgctacaaccaaaacttccccggctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccaactctggcagctaaaccaaaggagccaaatgtcgcaaagaagtccactgtaccaactaccgtatctacaacatctatttctaaattaacttctcagatcgaatcatcaccaacaacaccgaaaccaccgccgcctcctattaaacctattcctacctcaattccggcaccatcaccgcccccaaagagtatagcaaaggacataaaacgctcagtcgaagctccaaacgaaagcaaaaaggaatcaaagagattggatgtggatgataggttttttggcggtttagctgccggagacgagtttcccgacgacgatgacaaagagtccgaatggccatatgatcctttcaaaaacattgtcgatgatgtagaaatacaatatcttgatgactttgagcgattcaaggtggtgttcaaaaatccagtgatcagccacttgtcattctcacctcagctaggctatgtgcttggatttgaaaacccccaacacgttgggcctcaagaaatctcaaaatacggctgtgacttacggggtggcttctcaagtttcgcagtctactcaaaaggactgaccgagaacatgattgttggtaattcgttgagttcgctgcttcgcgtggtgtcggtgagcggtgccacacccggtgactacaatgagaagatttatgattcgccaatatacgctcgagtgctgccacgggagatcagcgaaattgaaattgagctgcgcacgatggacaagggacgactggtgccattcgcctatggcacgaccatggtg

SEQ ID NO: 80058 - DNA, 2797 bp, Heterodera glycines
  Genomic contig location: Contig_ID=SeqID_2494; Location=1..2797; Strand=-
  SCN-specific regions: Sequence locations=25-89,138-463,514-721,743 -922,947-1050,1080-1206,1228-1369,1415-2382,2405-2797
agtttttaatgtcaaaaattttaaattgtcatttgtaaaataatttactttagcaaatggtgcaaaaaaaatcagggatttgttaacacaaatataaaaatgatgaaattttattttactattttaaaattattttagaattttgctcaatgttgtctgcaatacattgacgaaaatgcgcacgatttattcctctcaaaacactttttacaaattgacaacgaatttctaactgaaatttttgcgcgtgaccaattgcagacgaacggagaattggaaatttggcaggctgtaaattattttaaaaaccattaatttttcaattaaacatcattaggcactccgttgggccgatgcgcagtgccgtcgaaatggcacggaatgctccgccaagaagcggcgcgctgcgcttggcaaggcacttttcgaaattcgtgtgcccctcgttgacaaagaggattttactaccatcaccaccatctcctccacctcatcaataccaccatcaccatcccagccctcccgatcagcaatcttcctcgtctgacgatagtcatccgcctcgcccccctcgtccaccacgtcctcagagaacaaagaaaaaccatcaatcttctataaaacatggtcggttgaaccaatggaagcaaaggcgtcgtgacttgcaacaacaaccggtagtacgtgatctactcgctgaggcagcagctgctcctttacctgaaagtgacgatgacgatgaacaaatgctggaaggtgggtatctgctgccaacaccatcacaaaattatggagacatgccaatattgcctgattatgcagatgaaattgaggaaatggacaccgcccaacaaagacttgcaagcagaagaaagcttaaaggagaggagggaatagataaaaacaaaaaatacaaaatttactattctcctccaccatctcccacactaccacccgtgtacaaacgaccagaccatccccctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcaatgtctccaaaagggaaccgaaagttgaactagctcctcctcctcctcctccgcgtcacttcaccaaaaaggaaccaaaatttgaagttgacccacgaccatccacatcgaagcaagccgggtacttcccgcccccgaaaatcaaaaccgagccaaaacatgagttgcaacctacaaagaggccagtgccataccgtatcccgaaaaaagagccaaaaattgaagaaaagccattacagcagcagcaacaacaacctcctcctcctccagctgttgtcgtcgaagaaatgccctatattcctccgcctaggagggggaccaaacgcacctacccccagaatgatgatgatgaggtgcacataagaaaacgagtgaggcaaccgagaagggtaagagtacagtactcgcccgagccagggccatcaacatctgcacaaagtgaagaagaacgacaacaacaacgtgagctgtttgctattccgtcaaatcaactgaccatgacacagagaatagaacgattatatctcaaatgtaaccattatgccgatcgtatgggtgttcgggtgaatacaattaacaccgccaacggcaagccgttggcgcatagcaatttgcgaatggccatcaagtatataatagaccgaagagcgggccgtcccaccattaaaccaccgggagcagacctattggaggagcggcttaggcgggatccaattttgtattcatggacggctccaccaaagagaccatcacagagcaaaaccacccggacggcacgggcaatcaagaaggagtttcgcccgaaaaaatggagctgattaacaccactcttgacaaaatgtacaatgacccatcctccccagcggcgtttgcaggtgttacagcactgtggaaagaggcacggaaaaagattaaacatttacgaaaagaagaagtgcagagatatttggagggacatcgcacctatacattgatgcgcccccgcagggtgcggtttccaagagcaaaaactatagctgctggattcatgaccgatgtccaggtggatttggctgattttcaagccctttctcgtcataatggaggccaccggtacctgctcgtggcggttgatgtcctgtcaaaacgtttgtttgtcgtcccactgaaaaataagagagccgaggagatgctggaggcattcaaggagcttattgagcaaatgcccatggccccccatcgaatattctccgacaaaggcactgaattcaaaaacaaactggtcaaagaattctttgaggagcacgagattgcgaagcacgagcccgttcattcgtcagtgaaagcctcagttgctgagcgagccatcagaaatgttaagcagcgactatacagatattttgcggaaaagcagactctcaactgggtggatactgtacagcaaattgttgatggaattaacagtgcaccgtcccgtgttcacgggatgcgaccaattgatgtcaattttcggaatgctcagaaggtgtgggaacgaatgtatggacaacaatcgtttgttaaaaaaacaccccgcttccgtaaagacgattttgtgcgaatgagcagagagaaggggcagttcgagaagggttacctgcccaattacggcgatgaaattcttgaggttgacccaagtgct

SEQ ID NO: 80059 - DNA, 80 bp, Heterodera glycines
  Genomic contig location: Contig_ID=SeqID_15733; Location=876..955; Strand=-
  SCN-specific regions: Sequence locations=1-80
atgaaggccagcttcggccggtgggctgatcaaatgaaagaatgtttcggagacggcacattctcattggcacctccaat

SEQ ID NO: 80060 - DNA, 421 bp, Heterodera glycines
  Genomic contig location: Contig_ID=SeqID_15734; Location=178..598; Strand=-
  SCN-specific regions: Sequence locations=1-97,119-322,354-384,413-421
atgaaaaatgaatataagcaaaaaagaaaatattcgccaaatgaatgggagaaaaattatgccgaaatttgtaagaaagtcagagttagccatagaacaattgaaaattggaagaaacaatttggaattcgctgtaaaagaataacggatgaacaaaaaattgaaaaaatgaaaatttattggaaaataaaaaaagaaaatccaaaaatgagtgacacggaaattgaaaaaattttgaaaattggtaaaacgaatatttcaaaatggaagaaacattttgtggaagaaattttgaaggattgaaaaaacggaaaaatttacgaaaattttgataaatttatttaaaaaaatatctgcgctctaaaaaatagatttatcatataaattttcaaaaagattgtatttgtatttgataaataaa

SEQ ID NO: 80061 - DNA, 3127 bp, Heterodera glycines
  misc_feature (2244)..(2244): n is a, c, g, or t
  Genomic contig location: Contig_ID=SeqID_15735; Location=151..3277; Strand=-
  SCN-specific regions: Sequence locations=1-398,432-588,610-721,743 -955,984-1335,1358-2063,2120-2123,2147-2197,2221-2244,2266-2635,2657 -2715,2763-2820,2842-3028,3069-3127
  Gene Ontology: Mol. function=pseudouridine synthase activity; Biological process=pseudouridine synthesis
cgccatcattaaattcggagtttcaaaatgtttggcctcactgaattgcgtccaattcgtccgcgtttgccgaaggcgaaattcgttgtgtgctgaagcggttgtacagcgatttcattgtcatcgaaattccgtccgatggccacgtgttgaggccgaacagtgcggcggcgccagcggcccaaaacgtgcccccggcacggaatgtgaaaagtgccaagaagatgcaacaacgactacgactgtgcctccgtcggacgatggcaaaggggagaagccgacacggctcactgatcagcaatttgatcagatgcaacgggtggccgctgggacagacgaagagaggaaaatggacatcgatttgaaggttttctttttgttttttggacgattgttggagttttcaactttcaaaattttgtagggcttttcgaggtcgttggtcacgaaatttgacattcattagaccaactcgaatgccgaattcgaatgagaaatcaaaatgttttaaaatgcacacttaattcaaagaaattcgtttaaatttacaattagcaaattccgattaactttttgttccaattagggttcgcattggcgacctttttcatttcaaattgatataccttgacgcatcattttgctgggtctttttgggtcgctcggttccgactcccgagtctcggacccgaattcttacaaaaaaaaaagggagttcgactttttaccccaatttgggtcgcagttccagaaaaaaatttttttcacccaattacctaatttttgaaaagaacaattttttttcttttttaggattggtcaaaagaggagcgcaaaaatttgtaccaattcatccgggccaattttgacgcctccgcattggacacggaatgtgtggacggacaactgacagttcgccgaatgggcgccaatggacgaaggtttggcaattttcaaaaaaaaaaaaaattttttttttttttgggtcctttaattctttgttatggtgtagccctgcagaaattcaatttctccaaaaacaatattgccatttttcggatgatttttgatgacaatggttcgttgcccttttgatttttagttcaacaaaacggtggtcacagtggccaaaggggcgcggcgattttgtgcactttaccatggtcaaacggaacatggactcgcaggcggccgtccatctgattgcacggaatgccaggtctgtttttttgaaaaattggaatttgattcatgttcgggtgagttttcctttcgcgggcgcaaaatgttgggtcggactatccatccataccctcatactccaaaaaaaaaaaatttttttgtttgtttcttttgcaacttaaaaaaaattttcacaactttctttgagtttttcagggtttcaaaaaaatcattgttttacgaaaattatataattagaaaatcactttaaaaaaaacttccggggccggctactcccccaaaaattcctcatttgaatttgtgaaatttctgcatttttttgcgccttcgttttatgtgtgtgtgtttcgtccctatattaaattcgatacaaaacgcgtttttaccccccccccccacccaccccctcttggcacaggttgaagccgtccatgttggcactgagcggcaccaaggaccggcgtgcgatcaccgcccaacgcgtcagtgccttccgcgtcgagccgggccgcttggagtccgccgcacgctcattgcgcggcatttggctgcgcgacttttgctacgccagcgcaccgctgcgcttgggcgacgcgtgtggcaaccgtttcaacgttgttttacgggacaacatttggagaacaaattttacggaaatttgtcttgagttggtaccagtatgccgcgagttgagaaaattgttgggtttgatgccaaaagaaaaaaaattcatatcgaggcggtcacaaaattttagtcggtatttgggacgataaaattttacggttgccgggattttttttagacttttccgtccagagcagttaggaaaattaacaggatgccctcctcccccctagaaaaaattttttttaaaccaattttttcaattaaaaaataaatttgaataattttacatcaattttttcttttgaaaatttctaaccatgaccatgttgattatttatatccttaaactttttttttgtgtgtgttaaactctgatttcatccctttacccccccccccccccccgaaaanatgtataaattttattattctcccacagggatgtcgatgcgtcgtccgtcgatgccgcccaactcggtgctcgcattgcgcaatggacgcgcgatgggttcctcaactattttggcacgcagcgcttcggcacctgcggcgtcgacacggcacacattggccgtctgttgctcagtgaacaatgggaggcggccaccgctgcgctgttggccccgcgggcggaggcaaacggtgcgcgagggatggaacccagaccacgaaaaatttctaaacggattccaaggcccaaaatttttttcaaaaatcggaagtttggaatggaatttcgtgccatccccccgggaaggcatcacaccttcccaacaacaatttacaacgaattacaaacatatttcaaacaataaatcattctcctgtgcttgtaccacgccggagtaggcacaaaacgtcgccgggatataatgtcgccgcaaaataaaaacaaaaattcaagaaaatttaaaaaaatatatttttttgcttgtttttgtttttctatgattgggggggcctcattaaacaacaacattttgtttttgtccaggctcactcaacgcatgcctgcgctgctacgccggctcgtccgcgaacgcgtcggccgcgttgcgaatgttggagcgcagcaacgcgtccgccggcgccaccgtggagcgtgcgctgttgtccgcgttggccaaatgcccggctgggcacaaggcggccattttggcattgcatcgcgacatgcggacaatgtacggcgccgaaaattatttttttttttacaatttttttctataatttttgccttttacaggtacatccacgcctaccaaagcttggtgttcaacagcattgtgtccag

SEQ ID NO: 80062 - DNA, 347 bp, Heterodera glycines
  Genomic contig location: Contig_ID=SeqID_15736; Location=425..771; Strand=-
  SCN-specific regions: Sequence locations=1-7,29-347
gacattcaaaaagacaatattttgctaagccatcgcattgccatggaacgaaagacgcgaaagcaattgagcaaattgggagtggaggaattgggacaaataaaggacgaattggacaggaaggtcagcagaaccaacaaacagttggtgggattgctggaggagagggacgccctttcaatgcggagggacgccctcgtggtggaagcacgggacttgaaggaatggcaatgccaacgacggaggaatggcactgcggaggaagggcaatgccagtgacggaggaatggcaatgccaacgacggggaattgcaatgccaatgacggaggaattgcaatgccaatga

SEQ ID NO: 80063 - DNA, 1838 bp, Heterodera glycines; identical to SEQ ID NO: 15737
  Genomic contig location: Contig_ID=SeqID_15737; Location=1..1838; Strand=+
  SCN-specific regions: Sequence locations=1-228,250-423,446-533,573 -597,710-1207,1544-1545,1735-1740

SEQ ID NO: 80064 - DNA, 707 bp, Heterodera glycines
  misc_feature (583)..(583): n is a, c, g, or t
  Genomic contig location: Contig_ID=SeqID_15738; Location=662..1368; Strand=+
  SCN-specific regions: Sequence locations=1-12,34-535,558-563,617-707
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggaggagatgaaaatgaaaatgagactgatcaaaatgcaaattttcatcaaaatgatcaaaatgaatcaactgatcagaacgatcaattggatgttcaacaaaaaatcgaaattattcacaaatttcacgcaattagagaaggaattaagaaacggggaaaatattcggcaaaattttgggttaaaaccgagcaaaaaatagcggaaaaattgggaattagtcgacagaaaatttacaaatggaaaaaagaatttggaatttattattataaaaagaaaaaacaggaatttattgaacgaattgatgaatttaaaagaatgtccaaaaatggaaaacagaagcaatttgcgaaagaattgggcattagtgaaaaaacattgagcaaatggaaaaaggaatttggcattgaaattggcaaaagtaaattttaatttaattttncattttattattaatattaaattttattatattcttaggtcgaattcgattcaccgatgaacaaaaaatgagcaaaatgaatgattattatgaaatgaaaaaagcaaatcctttctttaagtga

SEQ ID NO: 80065 - DNA, 801 bp, Heterodera glycines
  Genomic contig location: Contig_ID=SeqID_15740; Location=28..828; Strand=+
  SCN-specific regions: Sequence locations=1-706,728-801
atggtccgggattcggaattggtaaatgccggattcgtggtctgcgacctcgaaaacctttagaaacatgttttcatgatttatgaaaagaaaaaaaacttgaaaagttaatggggacaaaccataatagagtcagaaattctgttatttccctgaattgaacataatagataatttgatatatggaaactgtcaatattattgttatttgttatacattgatcattccgttaatttaggttgacgagcatgcggttcgtattgccgacaacgtttttaagttcgttgattgggccacttttgtcactgcgcgccgtcatttgaagtctgacccgaacattcgtcatttgttttacagtttggatcctgcaactgctcaacagcttggcattgcgttggaaccgaaaataacgacgaccgttatcactttttggtcggatgtttctacccgttaccagtctattccttatgagttcttcgaattctaaaatgatctgttttgttattcatgaattttgttgcaaacaaagattatttatattttaattttgttgtggtcccttggaattccaaatccttgaatactctaatttgcttttcaacaatttaaacgatttgcgttttccacgaatcgccatgcctctgtttgttgtcatatacatcgagactaagaaagtcaatagaaatatttgaaaaaatctaattataaaaaggaagaaaatattcagagaccggttaaaatagttttggtacattcatattcaacttttttgttgtttggtttatttttttaaaccaaca

SEQ ID NO: 80066 - DNA, 162 bp, Heterodera glycines
  Genomic contig location: Contig_ID=SeqID_15740; Location=931..1092; Strand=-
  SCN-specific regions: Sequence locations=1-81,104-162
tcgcttcgtgcatttgagaaattacgcttgtgcgctgcatttgtgaaaaagtcgtggcgcaaattgtaaaagccatgctcaaaagaagcaacaacaaacacccgtaaagctcatctccgtgtcttctgtctaattggaaatattccatagcttttgattttt

SEQ ID NO: 80067 - DNA, 701 bp, Heterodera glycines
  Genomic contig location: Contig_ID=SeqID_15741; Location=129..829; Strand=+
  SCN-specific regions: Sequence locations=1-701
cgttagcagtaaggtcaatgagtcggaaagctacgacgcgaccacgcttggtaaattgatgaacctcgacgccaaagtggttgaatggctcgagaaagggccatatactgacgacgatccgctcttggttcttgacttccttggtccgtttatcaatcttcatggcgactacaaccaaaacaaggcctttttggtgcagaagttggtatgtcttaacagcaaattaacatgaaagcgggatcaaattcaaaataaaaatttcaatcagaaagtagaaaatttcatggaaaatttgagggttttatcacaaacaaaaacgtgtcgtgctacgtaattgaaagtaacataatagaacactacgtagtacatattatggttggtataaatcgatcatttcgttattaggttgccgctggaggggctataatcgccgcgaacgtggacaacgttatcaaatttgcgacctgggacatgttttacgaagcgcgtcgcattttgatggcggacctggaagtgcgtcactttttctacaatccaaatccggcaattgctcttcaaaacaacattaaccaatttccgatcgtctctacaaccgtggttacgttttggtcagatgactcgcttaaattgaagacgcagccgtatcagttcttcgagttttaaaggatgatccattgttcattcatcattttttgttgcaa

SEQ ID NO: 80068 - DNA, 293 bp, Heterodera glycines
  Genomic contig location: Contig_ID=SeqID_15741; Location=2352..2644; Strand=+
  SCN-specific regions: Sequence locations=1-293
atgtcaacgtcagaagtgaaaccggaagataaatcaatggatgaaactagcaagaatgaattgcgggctgaggacacttccattaaggacaaaggcattggaagcgttaaaggttttattacttcgttatcaattttctttcgtttttagaaactgaaacaaatggcgcaataactactgacaatgaacctaagattcacgcagaaaagaacgagactggtgatgctgcagttggccaaaaatcaaccgaggaacaattcgacaaaactgacgagaaagcagagcaacaaaat

SEQ ID NO: 80069 - DNA, 342 bp, Heterodera glycines
  Genomic contig location: Contig_ID=SeqID_15742; Location=1826..2167; Strand=-
  SCN-specific regions: Sequence locations=1-120,142-310,339-342
atgccggctaagcaaaacaacgatgccaagcagggcaaggtcaatgatgatggcattttcgctgtacaacaacaacattccgccgacgacaccaccgacgacggttgggaggaggatggcatttttgctcagtgccaaaaattgccgccgtgccaacagcaaaagtcgtcgttgctgctgacgccggccgccacgtcgtcttcctcggcaatggtggacagtgtgatcagttgccactcctcgttggcatcgacgtccgctttttctacgcagcaaaggtggcaccggcacgacactatttatatttgtccatgcatttgttttttaatttccaaaatttag

SEQ ID NO: 80070 - DNA, 744 bp, Heterodera glycines
  Genomic contig location: Contig_ID=SeqID_15743; Location=465..1208; Strand=+
  SCN-specific regions: Sequence locations=1-383,426-431,454-633,655 -667,689-744
tgttgggcagcgccgcgccttcatacgcaatttgttcatttgatgggcacgcaatgcgcggcgcactgctcgccgatggtgccgacatgcacttgttgtgggccgccctgtccatctacggaatgcattttgatcaaccgatggcattccatttgttctccattcacaaatgtggtgatgatgatggtgatgaaacaaatgtgatgatgacaggacaggcagaacaaattgttattgattgatgagaagatggacagagatcaccaaccatttttccatttttgtattttattgacttttttgttttactcaaatttcttttcacgccttttttaatacagattccaaattttggcaatgaaatattttttgttggccatagcatttaaataattattttttaaatttatttattatttttttttgctttcctttttcattcatcaaaatcataagtgaccttacaattaatgagttggttcatcataatcattctgctaattttcttcatttttctgcttgttgtcttcttcagtttgccaaaatcattgccttttgacccttcgggcaaacactgtcttatcactggtccgttttgagttctattcaaattcattaatttttggatttctgtttattataaaaaaaattattcagagtggcaaattaagtacatttcatacatttccaagattaaaaagaagatacgatttttggcaagaaatttttgtaaacagaaaatga

SEQ ID NO: 80071 - DNA, 1293 bp, Heterodera glycines; identical to SEQ ID NO: 15744
  misc_feature (39)..(40): n is a, c, g, or t
  misc_feature (102)..(102): n is a, c, g, or t
  Genomic contig location: Contig_ID=SeqID_15744; Location=1..1293; Strand=+
  SCN-specific regions: Sequence locations=1-436,460-833,856-934,957 -1025,1055-1293
  Gene Ontology: Cellular component=extracellular space

SEQ ID NO: 80072 - DNA, 120 bp, Heterodera glycines
  Genomic contig location: Contig_ID=SeqID_15745; Location=300..419; Strand=-
  SCN-specific regions: Sequence locations=1-29
atgtgtgcggtattaagtgaggagcggaaaggaggaggcggaggaggaaagaagaggatgagcaagagaaaagagaaggaggaggaaaaggagggacgaggaaaggagagggaggaggag

SEQ ID NO: 80073 - DNA, 2115 bp, Heterodera glycines
  Genomic contig location: Contig_ID=SeqID_15746; Location=906..3020; Strand=+
  SCN-specific regions: Sequence locations=1-232,255-354,376-446,468 -486,515-1565,1596-1730,1752-1768,1847-1867,1889-1980,2002-2115
caacaaaaaaaaagaattcgtcttccattggccaatccgtgcccaatccaaaagattgtctggtcctcctttgactatttgcgggggcccgagttggaatttgtttgggaggccgactttttgccggcaccgacggcggaggaaggcgccgatggggagcaacaacaaaattatggccaaaaaagctattgttgcacaaatggcggcaccgatgggacgacaaatgccattttggaggacgccgaaacggtggcggacgtgtcatgtaccaacagcagcaccgactcgtccttttcaaaggtgtccccctttttattgcattttcgattttgagactcagaaaatcagattaaaacatttccaaaaaatatttttgtgtctgtaaatttgttctcgaatgatgctcccaaaatattagtttttatcacaaattccaatgaatttgtactttcaaatttaatttatttccgctattttaacccaatttttcaagaaatgtttaaaaaatattttgttaatgaattgtctttttcaagaacaccggcgcatcgggtacaagcaccgcacaatacgaagagattgacgaattttataatgtaaatgaataaatttttcttccgatgtttgccccctaaatttttttggcggtattttagacgctgaatatgaattatgctaacgcaagcaaaaagactggtccatggaaagttaaactttacctaattatcggtataatgtaagttcattagcgcatgaatgagaagaaggggactcaaattgaatgacatttttacaatgttactaaaatgtgccatgccttcgcctcacttttatacgaagtgtaagctaattagctgatcattgatcagagcactcgaatgtgtcaatcacagaatatatatgccaatctctttagtttcatctttgctcactaataataggccgtctttttgaatttttaatcaatgctcattcacttatctctgtttcttctgataataacttttcacggaacatatttaaatttgcgttagcataaaataaagatcagattcgttttgcggtgtctaaagttaccctaaaaattgtcaaaaattatttcatagggttcacaaaaccctaaaatgtaccaatttttggtataaattcctttcctatttttagaatgaacttttgcagctgtccggtgacacctttcataatgccggccaatttttggtttcttcatccacctccgaacattgcgctggcggaccttctgtaaattaaatatttgttttttgggcccattttcgtttttggtcctctggacgactgtatttccctatctttattttaatcagcaaactttactgcaatttccacttcaattcctgccccccccctcattttcagcaacaacgtttaaccgacgagttgagctccctgaatttatcctgtcaaactgacgacactttgcgtgccgtcccttccgccagcagaaggacggacaacgccacagcttacaacagccaaaatgccgacggagatggtgaagttgtggcagtaacaacagaaacagattttgctactatcaccaccaccaccaaccacaataatccgccgtcctcgtcgtcgtgtgccgatgcgatggtcacttcgtgcgtggactccggcattggcggcacagtttccattgagagcaatttgagcacgtacacaaagccggaacacagagaaggcatggaacttggggaggggggcaaggggacgaaaaaatgttttcttgttaaaaaattttttagaattttcctataaaaatatttaatttttattgaaaaattgcatttgaaatttaaaaaaaaatcagtggcgaacgaacccgacgaaattttaatggcaaaattttggggcgcactcatttttttgctaacacaaaattcaaaacacagatgaagtgctgttcaattcggatgaccagcgctgcagcatcaaaatgcgcagcagcagtgccagcagaggggacgtgttcgactatcacattccggaagcggaggaggtcatcgagttcagccaggtctatgccgacacgtcgtccggcgaattcagcgatgggaacagtcccaatcgcaaaag

SEQ ID NO: 80074 - DNA, 570 bp, Heterodera glycines
  Genomic contig location: Contig_ID=SeqID_2496; Location=1077..1646; Strand=+
  SCN-specific regions: Sequence locations=1-97,119-570
atgtacattgagacagcccaagaaaacttgggcaaagagctgacggaccaaagtgtccgtgcagatcttcttgcagggagacaaaatctctgcaaagcaatttctcttttggagaaatacaatggaaaatgggaagccattttcctgagagtgaagggacaagctcttcaagatgaagagcaaaactacagagactttaagcctgaagggaaggctttcatgcattgggtcgaccaagcccgagggcttgtcgacaccattgaaggggccttgggcctctcagagctgggggatgcaattccccagccaaaccagccagcacaagtcgtgcaacagccacaacttgtgcatcagcgtcatgatgtgacgcttccgccgataacattgcccaaattctcgggggaaccccgagagtggcctttattttggaaactcttcgagacttccgttgaaagtcttcagattgaagacttcaaaaagcacatttatttgctgggatgcctcccagagaagtcagttactaggagagcaattgacttgtatccgccatcagatgaaaactacccaagg

SEQ ID NO: 80075 - DNA, 2375 bp, Heterodera glycines
  Genomic contig location: Contig_ID=SeqID_2497; Location=62..2436; Strand=+
  SCN-specific regions: Sequence locations=1-371,393-523,545-653,677 -941,963-1350,1372-1418,1440-2375
atggggcataattcccagaactgcacctcaccccgcaggtgtagtcaatgtggtgaaagacaccattttatggtgtgttacggagaaaagtcccgagagggaacctctcggggccaaccaaataatcagatgaaaagagaggcaagaaaatcctctcaaagtcatctgactatgtgcgagcacgctcataaaagcgtgtccggatcagaagttttcccagatgttgaaagcttatccatcactacaaatgtgatgacaagcgtgatggtgaaaaagcctcacgcatttctaatgaccagaaaaatactggtcagatccaaaaataatcgaagagtttggatggaagttccatttctcttcgacccaggaagtcaaacttcctacgcctcagaccctctcattgagaggctcaagccaccgaaagtgacttctgaagaaatggaagtctatggcttcggaggagagagaaatggaccaatgaggttccattctcccgtgtactccatccaaatcagaagaacggatggaaaatgtgaagaaatcctactcaataggacggaaagaatttccacgccattcaaaatggcagaatggaattccgaggaattcccactcgaagaaatggacatggccgacgctatgcgtttttctcgggaagaacccgaaatactcataggtgccagacatttctggcaattcttccaagcgaagaaagaagtttctccagggttgtttgtaattaaaacaactttgggaccgttggtaaacggagagtccgactttgggccggaacttccgaacccaggattatcaatgatggccattgatgagtccaatcaagggcaaatgcccaccgctaaagaaattgaatatttctttaatttggagtctttgggaatcaaagacgatccaaatgaaaatgatgaccaaacagcaatgagtctgtttaacaagtccatccgccgagataaggacggacggtactctgttaaatggccatggaaggaggaggttcccgacctcccttccaattaccgcatggctttttccaggctaatgtcgacttttggaaagcttcgtaattctccagatttaatggagcaatacgatgcgaccattagagaccaattggaaaaagggataattgaagaggccaggaaagcccctggcactcttgagcattatatccctcatcagggagttcttgccaaaggcaagaaattgcgcgtcgtttacgatgccagtgctcacaccagaggaacaaacagtctcaatgcctgtttgtatagaggcccggtaatactgccggacctggtcggaatgcttatgcgtttccgatgcccaaaattccctctcctctccgacatccaagctgcatttttgcaaattgctttggaaccggaggatagggaagtcaccaaattcctctgggtgaaggatgtcagtaaatcactggcaccaacaaatctgatcacttaccgattttgccgtgtggcattcggagtgatcagttctcccttcattttggctgcgactttgcagcaccatttgaagggatacgattctccagtggccaatgaattggcccaatcattatatgtggataacactcttcttgagtgtgaatccgcagaagaggctttgcataaatatgcagagtctaaagcttccttgcctcattatttgaccctcttggtctaatggggccgtgcattcagcctctaaagcttttcttccaaactctttgggaagaaaagaaaggctggtacgatgttctttctgagaaagaacaaattcaatgggcctccttccaagaaaattggaaggatcagaccctcaaaatcccacgaagagcaatgctgcaagggaatccttcccttcaattgcatgcttttgtggatgcttccatccacacatttgcagctgctatttatctaagagcagtagaagatagccaaatatcagtttggcttatcttctccaaaaataggctcaagcctaaaaatgcttcaaaagcattaacaatccctagaatggaactcatggccattctaatagggattcgcggtcttaaatttgtcgccgatcaaattcggcgacccatttctgaactccatctttggggcgattcacaaatcgctctgagttgggtcgtttccaaggaagcacagccaaaattcattgagagacgagttagggaaattcgtactctcaatgaatgtgcttttcactttgtccgaacagccgaaaatccggcggacatagcaacccgaggcgcaaaaccaggagaacttaaggataagtctctctggtggaatggcccttcctggcttaaggaagaccatgaccaatggcctaaagaaatggaatttaaa

SEQ ID NO: 80076 - DNA, 384 bp, Heterodera glycines
  Genomic contig location: Contig_ID=SeqID_15748; Location=1143..1526; Strand=-
  SCN-specific regions: Sequence locations=1-172,195-264,289-384
  Gene Ontology: Mol. function=calcium-transporting ATPase activity; Cellular component=integral to plasma membrane; Biological process =hearing
ggcgtgttcaccaatccgatctactgcaccatttgggtgttcactctcatcgtccaatttgtaatcgtcgaattcggcggtcgttggttttccaccgaaccgctgactttggaccaatggctttggtgcgtggccttcggcgtcggctctctcctctgggcccaagtgattattccctcccctccgtttggcttttcacggcttttcctttaggtggtcacatcaatcccaaccaaaggccttccgaagagtttgaccattggcggtggggaggtggagccggacaccgccaacattctgtcgggcgacgagggcggcgaggcgcgggagaaacgctccgggcaaattctgtggatccgcggactgacgcgccttcagactcag

SEQ ID NO: 80077 - DNA, 893 bp, Heterodera glycines
  Genomic contig location: Contig_ID=SeqID_15749; Location=199..1091; Strand=-
  SCN-specific regions: Sequence locations=1-160,191-788,810-825,851-893
  Gene Ontology: Mol. function=calcium-transporting ATPase activity; Cellular component=integral to plasma membrane; Biological process =transport
gtgtacactttcaactccgtccgaaagtcaatgtcaacggtcatcgagctgaagaagttcgaatacgattcttccacctttggctaccgcgtgttcagcaaaggggcatccgaaatcattctgaaaaagtcggacggatccaacggaattcgctgattgttgtgctcccattttacagatgcaaatggatgctcggaagaaacgggcatttgtcacaatttggcagcaaagacttggaccgtttggtgagagaagtgattgagccaatggcatccgacggcctaagaacgatttgcttggcctacaaagactatatagcggacggaacagcacaagtggagggaaatcagctggcatttggaggcgaaatcgattgggacgacgaaaatgcggtcattagtgacttgacagtcgtcgctattgtgggcattcaggacccggtcagaccaggtcggcctctgtctgtccgtttagcttcttaattacccatcgtccatttcagaggtgccggaggcaattgcaaaatgtaagcattcatttgaaacaccgaaagcattgcttaaggcaaatctgatgtccgtttttttaggtcaacggtccgggattgttgtccgaatggtcaccggggacaacataaacacggcccggtcgatcgcaacctcttgtggcattttgaagcccggggaggatttcttagcgcttgaggggaaggaattcaacgatcggatccgggacgagcacggcgaagtttgtcaggagaagttggaccaaatctggccgaaactgcgtgttttggcaagggcacagccgacggacaaatacattctggtcaaaggcatcatcgacagcaaactgagcgctaaccgcgaagttgtagcagtgaccggggacgg

SEQ ID NO: 80078 - DNA, 512 bp, Heterodera glycines
  Genomic contig location: Contig_ID=SeqID_15751; Location=146..657; Strand=-
  SCN-specific regions: Sequence locations=1-260,308-348,370-413,435-512
atggccataaaatatggacaacaaatcgcgaaatatggacataaaatggcaaaaatatggacatacattttccaaattgagggtgtaatttctcaatttttcttcaaattcgctaaatgtaaagtaaaacgttcaaaaatggctaaatatggtattaaaaattattttagaggaaaaaaacaagacacagctaaaatttactcatttttggcgaaaaatcaaacctaaaagcgaaattttcgtttttttactcatttttgatataaatttatcaatttttaagaaaatttaaattctttaaatttttcaagtttcaagaaaattttgctaaaaatgatttttttttggaaaattttctggtttttggggtcaaaacggaaaatttagctgatgggggccgttctaatagaggttttttagaaaaatgccaaaatatggacataaaatatggacaaaatgccaaaatatggacaaatatggaaatatggacaaatatggaaatatggacataa

SEQ ID NO: 80079 - DNA, 132 bp, Heterodera glycines
  Genomic contig location: Contig_ID=SeqID_15751; Location=1240..1371; Strand=+
  SCN-specific regions: Sequence locations=1-132
atgccaagtctgctgctgaacccgggcccgtcaacaatgaactttttctcctcctccctgccgttgccttcctttttcttccgtaaccgaaaaaagtgttacgatttgaacccggcggaagagagccaccaa

SEQ ID NO: 80080 - DNA, 3001 bp, Heterodera glycines
  misc_feature (2919)..(2919): n is a, c, g, or t
  misc_feature (2995)..(2995): n is a, c, g, or t
  Genomic contig location: Contig_ID=SeqID_15755; Location=54..3054; Strand=-
  SCN-specific regions: Sequence locations=1-944,978-1102,1126 -1986,2008-2125,2155-2945,2967-3001
atgttcttcaagcacccgttcaccatgtgcgtcgccggatgcaccggtagcgggaaatcgcagtgggtggaccgccttctttctcacattgacctgatggtcagtgaaggccctatcactggcgtgctctactgttatggggaagtgaacgacaatgtgctccggctacaacgtatggagaacaccgccaccacttcaagtgacagcaacaccacggagggaaaacattctatcagaatgtgccacggagcgcccgaggagagggatgtggagcgggaagcacgcgctacgggcggacggcacctgttggtgttggacgacctgatgtccggcggtctacgctgcagctttctggacacggtgttcacccgtggctcccacaactggggcgtcagcgtggtgctcatcacgcagcatctgttcactcgtgagcttcggatagcgcgcaacaactgtcactacatggtgttgatgcggaacccggtcggcgcacttcagatccgcaacctcggcgcacaactgtttccgggcggggcgctacgctacttcttggaagcgtacgaggacgcaacggccgaaccgtttggctacctgttggtcgacatgcacccaaccacggagcaacagttgcgcctgaaaacgcatatatacccgggggaaatgtgcgtggtgtacatgccacgagcgcgcgcgaattttaatgcaaacgcttagcacaattagcaaacagcagtcgacaccgaaaaaaattgaaaaggcggagccaacaacaacaacacattgaagaagaggaccgaagggtctggcgagaaaagacgacccagcagccgcaagctcgccccatctcgccccccagtgctgagcgaacacgtgaggcgccacattgatttcttccgacaactgaaggcagcacgcagctctcctacccgctgccaagcgctggtcgccggagccagcagcgagcagcttctctgccttgtggagagtgcactgaacatcttacgcgcgcgtgtgcccatccaacgccgtcatctggccagcctcagacagcgtgcgagcgacgtccgcacactgagcagggtgcgtagcacacgctccgcccgtcgccttctgctcaacgcccacgcaccgtcaacagcgcaaactggtcgtggcataccgactctggtcgggttgctcgccagcgtgctggtgcccgtgctcgtccaacgcgttttcgagacaaccagcagtagtagctgaaaggcacccacacgcacgcttgcccacgcagaaacaatgacgttgaagcacactgtacgcatgctactcatccccgaggatgtttatcgacgtctgatggacaaccccagtgcagcggtggcgacgtcttctaccacgtgcatgaacaagttgccacgcccgcaactcccattgagcgcacggcacgcaaaatggtggtggcgtcgagcaagcacatgaacgatgacgaacgcctcatccactaccaacaggagttcaagcgctaccagaaactgctggaggaggaggcggaacgaccgctcaacgtacagctatcgcaacggacaacaaacgcactgcgtgacactgtgctacagaaggctgcgcctgcaacagcgacgacgacgccagctcgcccccaacggaccacacctctgtccaggcgacgtggcttacagcaacaaaaccaagcgccgagcgcgtcttcctcttcttcgacaaggccaacaaaaagtagcagcagcagcagcagtgacgagcaacaacaaccgctcccccagcagactgttgctccacaaaaaattggcggtctgcctaagcaagctgagccgcgtatgcatgccgcgatggcgtacgcgcaacagaacccaggcttgcttggcgtcggcggtgaagacggtcagcaaattttgcaccttgcccagggcgcttatcgccccatccggggcagcaaccttgacacgctgctccgctaccactttgtgggtcgtcatcagcagcagcagccgcggtcctccactaccacccccaccgccagtgtcgctaaggcaccaccgggctacaaaaccttcgtcaacaatgcgcgtgacgatttacaaatgtggcgtttgctgtttccggatgaaagggcggcagcggcggcggcgggcagtgattcagcgtcaacagtgggcggacaacctcggcgccaccaacctctgcgcggacaaaagaaaactggcgcgggccgcttttccctgagccgcttactacagcctaatcatcatcatgcacataaatctgttcaaaaaagtgcgacgagcaagaggaagcccaacactgcggagcattctactgccaaacgttttaagcctcaattatggtgattggaagcaacgccgtccgctcactgacggtggaaagtcttttggacccgatttacaaggacgaacggtcgccagcttgcttcaccagcgttgagcccctgctgcgggaggcgaagcgccggcacccggacgcccgtcttacgcgcgcggagatcagccgctacttggcgggccaacgtgtctacaccctgcaccgacaagtgcgacgacgcttctgccgtctgccgactctggcctccggtctacacaccgactggcaggccgacctggccgatttccaacgtctccgcgcgcaaaaccgtgggtacgcctacctgttggtgtgcatagacacgctgagcaggcaggtgtatgtgcagccggtcaagagcaagcgctcggacgacatgatcgcagcgctcaagcgcacctttgcccgctgtggctacacgccgtggcgtctgttgacggacaagggccgcgagttcaccgcctccgctgtccaacgctacttgcgcgacgaggcggaggtgcgtcaccactgcatggaaacatcgccactgtggcacgctgngatggcggagcgtgcaaaccgcagcatcaaagagcgtctgtaccgttacttcacgcaccgtggcacccatgctggnacgcgg

SEQ ID NO: 80081 - DNA, 1204 bp, Heterodera glycines
  Genomic contig location: Contig_ID=SeqID_15755; Location=3165..4368; Strand=+
  SCN-specific regions: Sequence locations=1-215,237-247,290-435,464 -1204
atggattcattcggaactgtcgcctggattctgcgaccaacggctcagacgacaggcactgctgtgggctcaatggagttcgaagaggaggaaaacgggacaggaaagttggtccacagtgacacagctactgtcaccacacctaccaccgtcgagtttagactggaaaaaagccccctcctccaagaaggacggtgctgaagaggcagcgacggccacggcacactgctgttcatcgaatccgatgatgtggaggaggaggatgaggacattgaagacacccccgtcgccacagactccccctcggctgcgacggcaaccgttgtggatgactcctccgacactgttaaaggggtggagcagcagcgctccagtgaacacaccgacgtgacggacggagcgggcggtggcggtggaagcgaaggcgcaaaactgctcggcggaggagagaaagaggaggtaggtggaggccagctaattttctacctcccaccactgtttgtagcctgttcgaatgccgctgctcaactacctgtgcgcgttcaacgactgttcaatgaaggagctgcaactcctcttccacagtgtccacgcacgacagcgtatggtggcgcatctgcaacaacactgccgacttcataccgcgcatctgaaaccggcggagcgtaacattgcgctccactgtcacgacctcagcgtgaaaaacgcgaaccggacgttcgcctgcggtggctatctggagcttaccgtaagtcggtgagtgtgtagaaccagtcatggtgcggccttctgtccaggttcgacagtacttcttcgccaaacacgggctaaagctgaagcacccgtacatgccgtgcatgatcgagttcgggggcggcacgcacgcctcctactatccgtaagcggggggtacgcaaaaatgggggaaatgagcgtaaacgccttcagcctggagctcgtccatgtcgtgctggagcgtacgaagcgcgccaaacaggagacggtgaagcaagaagagccataccgtcgtgaatccggcgacgtggctccgacaaagtcgatggcaatgccggaacgacattggtgccgctgttgctgtcgatgcgctaacaactagctttttgagagacatggtcattgtagatttgcgtgcgtgatcacgtgacttattgtgctgttatagtttttgtgcactttttttgaa

SEQ ID NO: 80082 - DNA, 1090 bp, Heterodera glycines
  Genomic contig location: Contig_ID=SeqID_15756; Location=602..1691; Strand=+
  SCN-specific regions: Sequence locations=1-496,520-721,757-771,795 -923,947-1090
atgaaccacaaaaaacttgaacatgaaggtcatctttatgttttcgccaaacttaacgcggatggttttatcaaattttggaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctcaagattttgcatgcatatttgacaattttaggaataaaacgtagagccattgaaaccgccgagccgccatctacacttcgctcaattgcactccaaaatgtaagaacccctgtgttgtctgaagtcccaacaaaaaatgcaacaaaacaattaatttctctgcgctcattgtattgccttttttagctaatcaaaagggcccgcaatgaaggaattactcccgcaatgccgcttaatctaaaccagttacaaatcccacaacaatatcaaatttatgcacggaacgaaaacgaaactgaaaactttttgctagccgattctggtacatttttgttgaatgaaaatggacccccgcaacggtaggcaatgcgttttgttcgattcaccattacttttttttgttaggattttgattttcgggcgcatgtctcataatagctgggccaatcaaatgacagaatgttacgctgacggaacattttcattaagcccaccactatttttacaagtttttgcagttcttgcccggtaggctttaattaaatttttgtagtaaatgttcagttttttataggcgcggcaagtgggtcttcccggttttttacgctcttttaacatcaaaaacttccgccatttaccaaagaatgttcagtatgatcaaagcagtttggccggccttttcacctcagtccatgtcgttggattttgaaattggtttgatgaatgctgtacgagaggaattccctaattgcaatttgcgatgttgtttttttcacctcgtcagaaatttcaaaaagaaaatggccgaacaaaatgttattcaggtcccattcttccccccaaaaa

SEQ ID NO: 80083 - DNA, 506 bp, Heterodera glycines
  Genomic contig location: Contig_ID=SeqID_15757; Location=391..896; Strand=+
  SCN-specific regions: Sequence locations=1-71,108-153,176-259,295-506
atgacttctcaagtgattggccctgctttgttcgttttgcatggaaaaaccgaagctttaatttggttaccgagaaaggaacaacattttttcattaatgatgaaaatgttggcagctacaaattgggcgattgggttctcttcgactacaacagggaaaaaatcattgaacaacagaaagagactccgtatgaaacgaaagtgttgtattcgaaagttgtgaagcaaaagttcgtccaggtacagagcaatttcaatgaattttaattattttcaattaaattaacaattttagattaaagttccacttgtttttttctcggataaacattcctcagaagttatcgcctattctcctggctttggacgtgttggtgcctttgttccgaatttggcgatggatacaatgtgtttcgcttggattgctttgtatgttgatttttcagctcataattcgcaaattttatactatgtatgggtgccaaataattgaatcaaattacaaa

SEQ ID NO: 80084 - DNA, 542 bp, Heterodera glycines
  Genomic contig location: Contig_ID=SeqID_15758; Location=70..611; Strand=+
  SCN-specific regions: Sequence locations=1-339,361-542
gaaaactgagagtaatggagaaaaaaaggtcattcgttgcgacttggacaaatcaccgccaaattgggcagtgacgccaattagaaacaccgtccaggcagttgaacaacgtttgcacaaaattttatctgcattgttcaagatcgaactgactgcctttgtcccgaggaaatggcgtcccgagataattgcacccgaaagtcgtatggtaccgacaaattggtttgatgaaatgttggatttcggaatgctactgaccgaagacatggcggacaaaagtgttaaggttttggcggaaaggaacaaggttaagaacgctattgtgagactgacgttacttttactttttatttaagcattcctcaggcaaaacctggcacctggtgaaagtattgggagttttgtaagaagaagggtcgatcgagaaaacttgtttctaatatattattattgtttctatattcactcttacacactttcatttttaaaaaatatgttcttttcgctttataatatttgaaaaaaaaatttcatttcaatga

SEQ ID NO: 80085 - DNA, 1108 bp, Heterodera glycines
  Genomic contig location: Contig_ID=SeqID_15759; Location=74..1181; Strand=-
  SCN-specific regions: Sequence locations=1-228,251-450,524-615,638 -731,766-768,807-917,986-1023,1045-1108
atggatgcaatgaatttttcacacactcgtctattgacagatgaagttctgtcagcgaataaccatgaatatgtgcttcatccggatgatctttctgatcataaaaatgtgcacagacaaaaaactaagcgttttaaaggtttaattattattttgctagcgctgttatggttttagataaactaaatgatgtctattaaagtaggctgcttgaccttcctggttagaaagtttccaaaatataattatagtagaaggtacatagccggtaattcacgaggcttacgtttagacagtaacctgtttaaaatttattgccgagggtagcatggatggttttgaatttatgaaaagcgggaccgagtattaccgatactagaaaaaccatgaactagaccaaaatttttcaagggggcttaaaacggttcgggcctaccgggaacaaacttgtaattttttattaaaaaatttacataaattcttttaaattaaaaaaattattcattaaaatattattttatttgaagcatcggaaaatccaatttggaaaattggtctctataggaaaatcaatgacaaagagattgaatgtatcgtgtgtaaaaagccaaataaaggctgcgaaggtggtcgcagaccgaccaaagcaattcggcaccttaaaaccgttcacaaaaacagccattatgtacataaatatgaggaattgctgaagccaactatggagcaagtggaacaaatggtaaataaaataaaagtggaaaatggtaattttttattattgttagtaatattttttattatttgttcttatgggataataacgatgcattcgacttttttttttaaatgagtgatgaccacggcagaagtgccaaataacaaccttctggagctcgaacccatgaaacatattctaaaaaattagatattatttttacttaatacttttatttttaatatataaaatttttatttaattataccgttaaaatatggattaaaaaaattttttcaaaatacatttattttctcaatgattttagaagctccacgaaaatgtaaagcccaagtaaaggaatctgaacaggaaaaggaaacattgtga

SEQ ID NO: 80086 - DNA, 2588 bp, Heterodera glycines
  Genomic contig location: Contig_ID=SeqID_15761; Location=445..3032; Strand=-
  SCN-specific regions: Sequence locations=1-28,51-71,93-175,326 -333,536-587,609-750,773-923,951-1043,1065-1093,1120-1247,1270 -1418,1473-1590,1677-1799,1975-2055,2139-2187,2212-2228,2286 -2499,2569-2588
atgccaattacaccaccaccagcagcagaacagcaccaacggcgcagagattcgtcgcccattcgcagtgcgatcagcagcacattttttgctgatcactcgcgtcgatcactgaattcgatgttgaacagcatcagcagcaattctcgcaatcgatcggcatcggcatgtaagcaattaaattttacattcataaaaataagttttgaatatttaattttaatttatctaaaattttaaaaaaatgttttttttttaaattttattatggaatatttttttaatttttgaatattttgatttgttttattattttaatttttataaaactggttataaataattttaaaatgattaaaatgaattaaaaatataattttattattcttttaatttaattttataaaattgtttatataatcaaaatatttgttattgaaataaataaaaaaattttatcttttaaataaggaaatattgttttttctttttatttttttcaatactttaaaaaaataataaattttaaaattttcgaaattcagcaaatgcctcagccccaagaccaacaattagcaagcgaaatgagcaactttcggatgatggcaccactgctcgtccgttgaacttaacaaattgcaacaaaaagtgtgaagcagctgaatcaatcattgaaagactgtcctatttgggctgttcaaaaatgggcgacccgacgagcgaaagtgaaaaaaaatattgaaattttatttaaacaaagaaaaatatcaaacaaaatccacttcgaccaattctgaactcgaacaaaaagtcgaaaattcacatttttgttccaaacagcttaaatacaaagaaacaaactgaagtcatcaagccttgaaaaaaaagatcatttaaaccaccatttttgaagcaagtgcgaaatttgaaaatttgaattttcaacttttgatttcattttcggggttcggaattggtcgaaatgtgtgatgttaacttcatgttcagtgatcccgtaaactgtcggaaacctgatttccagatttgtgaaaaattcaaaaatgggcgatgaggtacaaaatgcactgacctccctctccccaaaaaagtttaaaaatagagaggaaaatttggtgttctgaagagcaaaagaaaaaaaaatggtcagattcgggtactcctagcctctccaagccgatatcccgtactgaaaccgtcactgattcagagatgccaaaaaatccccaaaataatcaattagaaaaatatgccccccccccccctcctctgttcaccccatttaactcacaggtgaaatgcttggcattgttgctgcaatgaatgccgaaaaggcacatgatgcggtttcggtcaccttagtcattcctcatggcccaacaggcattgttaggtgactgtaaaaataaattaaaaaatatataaattatttttaattaaatataatttttaaacagattttttttcagacttttggaaaccggcaaagaatgcccggccgaaatttgctcatttccaatccaaaggattcgtttttgtgcacgaggcaaacccgagacatcggaaaggtcctaaaaatgaaattatttattatatatattttttatttttcttttttatgtatgtaggtatattatttattaataattaatttaaaacgaatttagtagctgtttcgctctttcatttacacaattggcgggcaaaaatgctacacttcatcaatgccacgtttttcgttgcgtatttccggaggaggtgaatgaattgattgtttaatctaattttttagaaaaaaaaattgtttaatattaaatattattttttacattattttttagatttattgtttgttttaaaaatagtttaactgttttttaatttttaaaaagagaaaatcactatttaattattttataatttaatacattctttttcatatttttatttttaaatcataatcatagaattaattcaaaaaaacttgttatttaggaaaataagagttctttttattccaaaaaagtaaaaagaaagttattttttatttataaaaattttgttgttcaatttaaagataaattttttttttaatctaaatatttatttttttaaaaatagacaaaggtttaatctcatccatattggattatttacaacattatatttattttaactgaaaaagacattcatagtttttatttctcaccaatttaatgaaaaaataattgaaaatatatttttatttaataaaattaattaattttcaatgttatcttaattttgcttagaccgctcgtgcattgttctgttttgctcaagcattcaatcgtcggcaacaacaaagcattggcagcgccgcttcatcaaaagcgccgtccccgtcaacaccggtccaattccaattgccaccatcgacggaacaatgtggcacatctgaagagctgttcgaattcgaaacattaatcgaaattaaggcacaaaattttaaatattaatatgtttaattggaataattttttgttaaaaatttagaaattaaaattaaatgatctcttcaaagaaataaa

SEQ ID NO: 80087 - DNA, 138 bp, Heterodera glycines
  Genomic contig location: Contig_ID=SeqID_15761; Location=192..329; Strand=-
  SCN-specific regions: Sequence locations=1-25,47-76,98-138
caaaaaaactcagtgtgggcgatccacaaaaatctcagtgtgggcgatccacaaaaaaactcagtgtgggcgatccacaaaaatctcagtgtgggcgatccacaaaaaatctcagtgtgggcgatccacaaaaaatct

SEQ ID NO: 80088 - DNA, 241 bp, Heterodera glycines
  Genomic contig location: Contig_ID=SeqID_2499; Location=1994..2234; Strand=-
  SCN-specific regions: Sequence locations=1-1,23-241
attaaactttaaaacaaaaatagaatgttgaaatgcagcgaacaaaaggaaaacatttttcatcgaattgtgtcggctacttgttgttcttctcccctgtaatattccacaagtgtcggatgcgttggctcgaacaccttttcgtcctccaaactgaccaattggccaggctcgagtccaagaaacacttggtccggtcttttttgttcattttcgaaaggcggtggaccggtgaccaatg

SEQ ID NO: 80089 - DNA, 1670 bp, Heterodera glycines
  Genomic contig location: Contig_ID=SeqID_2500; Location=145..1814; Strand=+
  SCN-specific regions: Sequence locations=1-423,447-969,991-1047,1069 -1200,1273-1331,1484-1503,1526-1670
ggaaattctctctattcttcgttgctcaaagggcttcactccgttttgccgggaacttcgcctaaagttgaaaataccgtgaaactcgaagctgaacctccacagccacacattgacgaacccatttccaaggccgaatcggtgggcattccttcgcttttcgaatccgaccaacaacaacgcactgacggtaaacaatttctcggaaatgaacgctattttggtttatcctttcgccctttcctattcagattacaacaaatggcacatggaattctacggtcggcccagtcccttccttcccgggcatccgcccgtttgccaacgtcctgtgccggactcggcagtagaatcggctatttctgtggccgctaaatacgttgcattgcacggcgcttatgccgaacagagactgattggttgagttgtcttattatttttaatttgtccagaagattttttcatatttaccaatccctttgaacagaacacaaccaggacaaagtgcactttcttcaagcgagaagcccttactacaccttttaccagtcccaagtacgacaaatccaatggaaaatcttccagcaaagtcagcaaaatcgtcagcaagcgtttcatgctccgcaactgttcaccacaccatttggcaacatcgccgccgttccatcgcctcctccgccaagcgttgctgaattggtgaaagttccgagtggtcggcaaatggcggacacaatggaaaaaggggaagaaggcatggaactgaaagaagcaggtacaaaaaaggacaatttgatagttatggctaactttaaaaaatggctaaactgctattgaattcagagccggactccaaacaattggaacgccgtgaaaaggctcgactgttcatggaaagaattctgaacgaacggatggcggaaaagcgtcggacaaaaactaacaataagccaaacgaggaggaggataattggtgaattttggaataaaaaatcattttcccttttgattggatgtttactttcagtgtcactgtttcggaaacagcttcaacttctgctgctgcttctgttggtggcgtcgctattcagccgttgccaagcagtgcattgtctccgctcgcattgtcaaaagccatctcctgtctgatcgacgagcaaataaaacggacattgggcacttctccgccacaagcgccagcagaggcgaggaagaaaaagaaggaaaagcgaagggaaggcgaagagaggagacgaagaagaaagaagagacggacacgttcatactcatccgaatcatcatcatcttctccatcatcatcaaccgattcaaatgaggaggaacggagcagaaagaggaggaggagaaagagcagcaaaaggcggaagaggggacgcgagcatggaagtgaaagcgaccacagtgaaggggatgaggaggagaagagaaggcaaagacggaagcaaaaggggcaggaggagggggacagcaggtggaccaaccgagcaaggcgaagcagcgcaatcggagaatgcgagcggacctttgccattaatgcactttttaaagtactatttgtccccgtttcagtctttcccaccgtcgtcatcaacatcggagtcggtcacgttcgccacgtcgatgaaggaaaggaaaagataatttctgactga

SEQ ID NO: 80090 - DNA, 1253 bp, Heterodera glycines
  Genomic contig location: Contig_ID=SeqID_2500; Location=4020..5272; Strand=-
  SCN-specific regions: Sequence locations=1-127,182-267,289-383,405 -1218,1240-1253
gtaaatcatggacttctcagtactgaccaacatacctgtgcaaggaggtagtcaaggggggggggtcatgacgtcgaacataaggggtcaacgggtgtcgaacgtaagaaatcggggggggggggtcaaaagaggaaaaaaggagagagaaaagaaaaagaggaaggaaaaaagggagaaaaggcagcgtcgaaatcaaggaaagtgccgtgaattacattcactaatcctgaggagtgggatttgtcgaacgtaaaaaatggagacttgaaaattaactaatttccattaagaaatatcattaaaatattcaaattcattcgacactttccttacgttcgacgaattctgctgaagaatattcgtcgaatgtaagaggaaaggctgaaaaattcctaaaattttgctttctttttttaaagatttcattaaaaattcaaatatttttcctaaaaaggttggcttataatcgcaaaaaacctaataattttttggtaaaaaccttaattgtcaaaaattttccctgaccacccccttgcacaggtatgctgaccaatgaatgaattattcttcaacacccattacctccactgttttgcattcgatattcattgcgaccgtcgaacacctcaaaatcgtcgagtgcagccgcgatttgttcttcctcttccacacttccaccggacaatgagccgacggacgtcccttccgccaattcgtccgcgtcaattgctaaatgcttcggcgtactttaattggtctgactcattgggcagcacctgattcggccgactcggcagcgacttcgctccctccagtggtaattccgagttggtcgagcatccgaccgtacagcgcgtgtcttttgaaggcggggaaaaagcgctcttcactcttcagaatttcgacaatcttcagggggtgtttcgttatcaaaatgggcatcggattgcgctttgggcttggtttatttgcctgttcctgaatttgctcaaaccatccatccgatggttcgtcgttgcgcagccgggccaaaaacttgttgacaattgcttcgctcaacggaactcgagtgattgcctgagtcatcttcgtcttttgaagaccaaaattgtttagaggttcacttcctgtgacagatactgatggtacatgaagagagccgcttctcgaattgtctcccgcgcgtcgctgtccaaagtgtcgcccgaggccaaccccctcaactgatgctccatggacacgttgaaacc

SEQ ID NO: 80091 - DNA, 1776 bp, Heterodera glycines
  Genomic contig location: Contig_ID=SeqID_2500; Location=4184..5959; Strand=+
  SCN-specific regions: Sequence locations=1-801,823-908,963-1400,1444 -1776
atgactcaggcaatcactcgagttccgttgagcgaagcaattgtcaacaagtttttggcccggctgcgcaacgacgaaccatcggatggatggtttgagcaaattcaggaacaggcaaataaaccaagcccaaagcgcaatccgatgcccattttgataacgaaacaccccctgaagattgtcgaaattctgaagagtgaagagcgctttttccccgccttcaaaagacacgcgctgtacggtcggatgctcgaccaactcggaattaccactggagggagcgaagtcgctgccgagtcggccgaatcaggtgctgcccaatgagtcagaccaattaaagtacgccgaagcatttagcaattgacgcggacgaattggcggaagggacgtccgtcggctcattgtccggtggaagtgtggaagaggaagaacaaatcgcggctgcactcgacgattttgaggtgttcgacggtcgcaatgaatatcgaatgcaaaacagtggaggtaatgggtgttgaagaataattcattcattggtcagcatacctgtgcaagggggtggtcagggaaaatttttgacaattaaggtttttaccaaaaaattattaggttttttgcgattataagccaacctttttaggaaaaatatttgaatttttaatgaaatctttaaaaaaagaaagcaaaattttaggaatttttcagcctttcctcttacattcgacgaatattcttcagcagaattcgtcgaacgtaaggaaagtgtcgaatgaatttgaatattttaatgatatttcttaatggaaattagttaattttcaagtctccattttttacgttcgacaaatcccactcctcaggattagtgaatgtaattcacggcactttccttgatttcgacgctgccttttctcccttttttccttcctctttttcttttctctctccttttttcctcttttgaccccccccccccgatttcttacgttcgacacccgttgaccccttatgttcgacgtcatgaccccccccccttgactacctccttgcacaggtatgttggtcagtactgagaagtccatgatttacgccttcgattgctttataaatttcgttgtttttcaagtgtctgcaattgccaatgcaaccaatggcacttcagtacgcatcgaaatgctcggcgttggccaacagggacgacagcttttcgctctttacaatgtgcgggtccatcggacagccaccgatttacgtaccggttcttcgtcaaatgtgaccagacgctattccgacttccattcgttgcataatttgatcgttgtaaaggtggagaaaatatttctttttttaacttttttattttacagttcccaaacctacgaacgttgagctttcctggcaagaaaacattcaacaatttgaacaaaaccttcttggaaaagcgctgcagggcactcaaccagtacatgcgtgtaagcattgaaatgggacagggcggaatagtcccttttacaagtgaatgtttagtgcatcctgcagccgtctctttgggccgctaaccccggccttgaacaattggttttcgattttctcacccaaaaactgtacggtggcgacaaagaggggttgtcgggtgcgatgaacacgatgctcaacccactgatgagcggagtgaaagcatttggcaccgctgcggcagcgatgccgtccgacttaatcgacgggatcggcaaaatgggctccgagttgaacaaggctgcttccaatgtattcaaa

SEQ ID NO: 80092 - DNA, 772 bp, Heterodera glycines
  Genomic contig location: Contig_ID=SeqID_2501; Location=1..772; Strand=+
  SCN-specific regions: Sequence locations=1-772
taccttttcttctgttcagggctcttccaccagacaccttcattctttctcggggtcgttccgtctcgtcctccaccggcaatttgcccgactccgggcgtgtcgccgcccatcttgacgagaatgttgagtccgcatcggatttcgttcacctttcttttcttttccaggattccgtcgaaagcattccgcttcgtgtgctgcttctgctggtcgacgaagtgtttggactgcgtgccaaaaaccaatggttccgtcgtcggctcgtctcattgcttcgccaattcattcacgcggcggtgggtcagtcgatcaatcggcggatcattgacgcagtcaattggctgacttcggaggagcaagtggctcaatatttggttgctttcaggtattgagaaggcttcggcggcacaattgcttctaaaggctcgctgccccccccccttagagattccttttggtccgattccgccgctggctcttcgtcccgtgcagataactcgccccaattagactcgcagaaaacacgcttcctcgcccgtttcctggtgctttccgcagtgcctgaacagctgcgcctttttgtcggttcctcaaccgttcagtccggcgttgagaccgtttgcgaggcgttgcagaacagacacctcaaccgacgcctttgctatgtcatgttggagaggtgagcacgaagtgataaaaacaatcccaaaaccatttccgcattaactaccgtatatgctctaattatagcccatgggggattattttt

SEQ ID NO: 80093 - DNA, 494 bp, Heterodera glycines
  Genomic contig location: Contig_ID=SeqID_15764; Location=128..621; Strand=+
  SCN-specific regions: Sequence locations=1-197,219-260,291-494
atggtcgaacaatttcaattagaagaagcaaggatgaagaaacacatggaagaggtgcggaaaaaaatttaatattcaaaaaattgcaaaaaaattttttgtcggaaattggcactgccaccccttttctccctcagaaaattttaatactttgtagatttttgcatactatgaaactgatttttgtggatttgggctaaataaaaatttaaaaaaatgcttgatgaattgtgggctggcgattccgctaggtgccaccggggaaaattaagattttttaaaaatgaaatcataccttttttagggggttggggtcgaccggatggatattttcgaaataaagaaacctgcgagttctgataaaatgataattattaattaaccacaaacagagcgaacagaagtgggccgagattttgctaacaaacggaagacaattggagaagggaattgcgaattctgaagaagagaattggagaaaacaaatggaaggg

SEQ ID NO: 80094 - DNA, 241 bp, Heterodera glycines
  Genomic contig location: Contig_ID=SeqID_15767; Location=746..986; Strand=+
  SCN-specific regions: Sequence locations=1-241
atgaccggtgttttaaagggtggtgtcattaccgctgcagacgtgcaggatttgaagcgtggttggacccagcttgagctggatgcgaaagttggagcattgaaggcgaaaaatgaccggatgtatcagtccatttgtgcgcgccttcaaggacaggccgccacaattcagcggctgcgggcgacaaaaggcttgaaacgatctcgtggagacaagagaaagacttcagttcgtggaaatg

SEQ ID NO: 80095 - DNA, 615 bp, Heterodera glycines
  Genomic contig location: Contig_ID=SeqID_15768; Location=87..701; Strand=+
  SCN-specific regions: Sequence locations=1-242,264-482,504-615
atgcaggcaaagacgtgcagtctggtaagtagttttaattttcttgcccgaagaagaagaagcgtggtaccattgatgatcgggaacattcccgttggtaggtcggtcggagcagaagatcggagagatgacgaaacccccgccaatctggcccctttttccttttcttcccagttttctcctttttatttaaatcatcattttcaatttcatttctcattatccaatttgtccaccatttcacatctgcattttctccatcattcttcgccccatttgcattttcacattcattcacattttcaaattccttttgttcggcccgattggggatccatttctctaaatgtttatttcgtcctcatccaggcccatctcggtgatgctgcgctcggaggactgcgcaagaacgccatcgggattcaaatgctcgggatccgtgggcacgatcctgactctgttgccatccgatcagtttatctcatttctgatgaggtcagcccagtacgagctcctcagggcagttcggctacgtttgagctcaataacaatggtctgtgtgccaaaaacggagaattggctccgttcctatacggtttcaacagttgcggttaa

SEQ ID NO: 80096 - DNA, 954 bp, Heterodera glycines
  Genomic contig location: Contig_ID=SeqID_15768; Location=439..1392; Strand=-
  SCN-specific regions: Sequence locations=1-3,25-158,180-803,825-954
tcatcaatgatgatgagttgtgcctcacgaatccttcgctttaagaagctctcaagcggaatgcttggatgcttgtccagtgacacatctctgaccagtctgaaggtggaatgggctgtcttgccatacggcagcaaaatagctgcacacccaatggatgccttaaggataacggccatcggaccacaagcagggctcggcttgtttccagcggaaacacttgaaaattggagcaagttattataacgcgacatgcgtcgcacaaactctttccctgttttggttggttttcaccaacgataagctccataagctcttgagggtgtggttcaattttggcaacacaacccttccttttcggcagcataggctgctgtcttcgtgtaggaagagaagagctccacaatgggggcatttgtggtcacaaagatttccggaatgagaatattccggaaaatgttttgctgcagcagcagcgcagtgccagccgttgtgcaccataaggcaacgttttgttaacgctgttgctggccccagcacattagttcgtggccgaactgttagtgcgggtgaaggcgaacggcttgctgatgccgaaagccttttttgaacacgcaaagaacgccctggtggcgttttcggcctgagaaatatctcattgtcatgacaggagcccgccgctgggcatcttttaaccgcaactgttgaaaccgtataggaacggagccaattctccgtttttggcacacagaccattgttattgagctcaaacgtagccgaactgccctgaggagctcgtactgggctgacctcatcagaaatgagataaactgatcggatggcaacagagtcaggatcgtgcccacggatcccgagcatttgaatcccgatggcgttcttgcgcagtcctccgagcgcagcatcaccgagatgggcctggatgaggacgaaat

SEQ ID NO: 80097 - DNA, 81 bp, Heterodera glycines
  Genomic contig location: Contig_ID=SeqID_15771; Location=604..684; Strand=+
  SCN-specific regions: Sequence locations=1-81
tataaagcatttgcaagtattgacgttgatatagtatgtaataatactgataggcttttacacttgggtgttcatccttga

SEQ ID NO: 80098 - DNA, 829 bp, Heterodera glycines
  Genomic contig location: Contig_ID=SeqID_15774; Location=270..1098; Strand=-
  SCN-specific regions: Sequence locations=1-26,49-200,223-379,420 -549,571-619,646-769,791-829
atgaaacgacgagttcgagcagtcattgaagacgaagaggaggaagaaaatggtaaaaacggtggtgggaggagtgggccaatggtcattcacagcagcagcagcgaatctgaggaggaagaagcggtgtttataagatttaacatgacttcctttatccctgctgtttagactgatgagggttcttccgatcggcgaaagtcttcttcctcctcttcgtcccagcaaaggacgccgatgaaagcgaccacaaacattcagcgaatggtccgctaccagaccaattactaccaggttaattgttgtttgtttgttttttgttgtctaacgaggaattttcaataaatttggtcgagttttgggtcttatttactttacgttaccttaaaagctgacattttttaaaacgttctttaaaatagcttttcactgcctaaagcacgctaattgaaacacgaatttgaaattatcgcagtgtttaaaatacgaatccattttggacatagtcgcaactatcgaaatttagggtacttctgtttgggggccgcacattcaaattttaaaaaatgtcaactaacaataagagtgtgctgaatattcaaaaatagcactaatttcattttttattgtttttaattaagaaaatattggtgacttttacttttgccaatcttttaaatgtaattttctcggaaaaatgcaaaaaaattaaatgtactaaatttttagagtgatgaggaggatttgatcggtgctggctcctatgacgaagaagaagaagccaattttgttgtgccggacgatgaaattgaggaggacgaaggcgacg

SEQ ID NO: 80099 - DNA, 363 bp, Heterodera glycines
  Genomic contig location: Contig_ID=SeqID_15775; Location=55..417; Strand=-
  SCN-specific regions: Sequence locations=1-363
aataccgttgaatcatcctcggaaaagacagaaaaaatagtcagattaataagagcagcgatggaatgcatcggttttttgggtgccaattccaaagagttcaaagagcgaaaagccgacaaaataaatgtgaacgaattctttcaatggctagagcaaaacattccggaaaatacaacaaaatcaatgttggaccatttgaagtccgttaaagatggaaaaatgaagcaatttctggtagaaatcgaaagtgaatgtgccgagtttaaaaggcacatgtgggagcaaatggagacaaaaggacgacagaggagcgacgaatccatgggacaaatggtcgaacggaagaaatttgtgttgtga

SEQ ID NO: 80100 - DNA, 1647 bp, Heterodera glycines
  Genomic contig location: Contig_ID=SeqID_15777; Location=1..1647; Strand=-
  SCN-specific regions: Sequence locations=1-323,345-497,553-685,707 -901,929-935,967-1125,1147-1241,1265-1601,1630-1647
ttaaaaaaatccaaatttcgtctaacttttttgcattttctcccacgaaaatgccattcttaggggtgtatatttaaccccgaccccgatcggggttaagggtcggggttcggggttgtcggggtatgaagcgtcggggtcggggtatgaagcgtcggggtcggggttgcaaccctacttatattaattaatttttttcctccctttacaaaaatgcaaagcaacaaaacttttatttggataactcgaaatgatgtcaataaaacacacacacttgaacataagtcaatcaaaaaactttagaggaaaaaaagtaagagaagaaataagcaaaaaacaaatgttgaatcgtctgatcatcatcttccgtccatctttaaatgatcagacaaagccaaagttgcgtgctttgatcgcaagcgaaagtttgtccctcaacagcttctttgacgaatagatgggcaggtacagacgagaaatacacctgttgaaaaagcaaattaaattaaaaaagagttaaaatatcacaattttttttttaaattttttttacgtgttggccgttggcaaatgctggtcatcagccgggcgaatcatgatggttggcaacggtcggaaaccctcctgtaaagaatgtggagaggagggatttaaacagattcgttgcaaattcgaaaaaaaaaatagttgaaaaataaattcattacttaattgacacacacatacctccgaagatggcagatttggagaaccggtccaaaagaagcacagctcctgcaaaaatgagagaaattaacatatacatcatggaaatgttaatgttctaagattaaaaaaggctaacaaaacaacaattgggcaacaacaatgagccaaatattatatatttcaagaaccaccaaaatttaaaaaatcccaatttttcagcttaaaactttgtttgtttgtttgtttttgtttgtttgtacatatgtgtctggtgccctaacgctagacatttgttacaaatgccttatagaagaatggtgttattgctgtatagaaggcgaactagaatcttctatgtctataatattatagaaaactcaattcgactacaaattttttaataatagggtttcttcgaaatctccggatgatgaaaatttaaaaatatttcgacattttggttgtggggttaccttattttgggctttcttctcatgtgtttttttaatccacaactttcaattgaattttccattttaattattattttttgcttttcccaggaatgagtgttgtcactttggccaacgaaattgctcgacgcgttcgcattttctgttggattttgaccggcaaacagaaccaccaaaagcgggccattcacgtgaaggcgacttgggcaaaacggtgcaataaatttgtgttcatgtcatcggaggacgatccaacattgcccgctgtgaatttgaacatttccgagggcaggtggcgtatttaaaaaaaatatttccaaaaatttgtttatgcgtaccagagttgtttcgggtcactcgaaacccaatatttttctcgtcccgaatcccaacccgatgattttgggcgggattcgggacaaaataagaatttatattaaatttttttgaaacgattgtgttcaat

SEQ ID NO: 80101 - DNA, 391 bp, Heterodera glycines
  Genomic contig location: Contig_ID=SeqID_15777; Location=870..1260; Strand=+
  SCN-specific regions: Sequence locations=1-72,94-226,282-391
  Gene Ontology: Mol. function=ubiquitin-protein ligase activity; Cellular component=soluble fraction; Biological process=imaginal disc growth
gcaggagctgtgcttcttttggaccggttctccaaatctgccatcttcggaggtatgtgtgtgtcaattaagtaatgaatttatttttcaactattttttttttcgaatttgcaacgaatctgtttaaatccctcctctccacattctttacaggagggtttccgaccgttgccaaccatcatgattcgcccggctgatgaccagcatttgccaacggccaacacgtaaaaaaaatttaaaaaaaaaattgtgatattttaactcttttttaatttaatttgctttttcaacaggtgtatttctcgtctgtacctgcccatctattcgtcaaagaagctgttgagggacaaactttcgcttgcgatcaaagcacgcaactttggctttgtc

SEQ ID NO: 80102 - DNA, 173 bp, Heterodera glycines
  Genomic contig location: Contig_ID=SeqID_15778; Location=334..506; Strand=-
  SCN-specific regions: Sequence locations=1-173
atggatgcccttcgtctgctcgtcggtgccaacaatacttcaaatttgagtgccgttgttgacgaacaacaaaatgccatcgacgattattcggacggtcagcaacaaccgccgcaacaacagcatcaaacggttgaacaactgatggcccccggtcatcgacttcgggagcc

SEQ ID NO: 80103 - DNA, 1116 bp, Heterodera glycines
  Genomic contig location: Contig_ID=SeqID_15779; Location=1009..2124; Strand=+
  SCN-specific regions: Sequence locations=1-27,49-249,271-481,505 -709,731-982,1006-1116
atgttaatggaattatgtgaaagtagaagacaaaaatttttagaaattaaaagcctatttacagtacgatgggctgcgtctgagcttgaagcaataaaaacaatacttagattgtggcctgttttgcatgaattatttcaacacattagtctacaagttaaagaatttgacaaggaacaaagaattcgtgcatatagttattttctgtctttatcgcatctttctttttatgcgttagtttcttttttggctgatattttagaaattcttaacaaggctagtttgaattttcaaataagcagcgcatcactgattggacatggtagaaaaatcagaaacttgatagatcaactccaatcattaaaagaagagaatggtccctatatgcataagttttttaattcgataacttgcataatttccgacagaaattacccacagcatccatgtcatcaaaaaaatattatggataatgaagaaggatattcacatgttcaaagaatgtatttaactggttattcgggctctgattatgaggccgattttgtttttgctacagatggaaggaaatatgcaaatgcccaatttttaatgaaacagcaaataaatacgcggtcgtccgcagatgaaaatatagttgtaggaatatctcctccaatccctgagtttaatagaagaattcgaaggcaattaattgacaatgtcgtagaagaaataaaaaattattttccggtcgggaatataattgatgatattgatttactcgacccttctcgtttaccaactcaagcatcaaacataaataattacgcaaacagtattaaaaaattggctatatattttaactatgacgaaaatttgatttatctggaattttcaacaattctatctcaaatcttgaatgatagtcgtttaataaatttgaaaaacaaattatcaccacagagattttggaaattaattattgagcaattgggtgacaattttggaaatgaattcaaaaattttttacaccatatgcttatacttggcttggggtctgccgacgcagaaagagcattttctgttttattttatatacggggcaagaggtataaaaatgcgtggttttcttga

SEQ ID NO: 80104 - DNA, 813 bp, Heterodera glycines
  Genomic contig location: Contig_ID=SeqID_15780; Location=1030..1842; Strand=+
  SCN-specific regions: Sequence locations=1-129,261-265,346-500,525-813
atgcctccggcgtcaatgcccttgtgggcgcgccaatggcaaaaatttttcgttgaacgtgccggaattgattctttacacttcggtttactccttcttatgcttctttcactgctaatgctttttgttagttaaatttaatggaataataaactaaataaattaaattttattttaaattattcttttttgattttaattatattaattgaatagtattttataatattaaacttaaaattttattaaaatacatttaaaatggataaaaatatttaaaaaaatgaaaaatcgatataattatttgaaaatattttaatttttatataagttaaataaaatattcattcataaagttgacaattatgtccgtctttattcggttctgctgttgtacgcattgtcctcctcggcatcgaaaatgttcaacaacggaaactttgacaaatcgaacaccatcaaatggcggctttttctctggcactaacgaagaacgggtcaaaaaacaaacaaaagaattaattacctaattcactatggattttttaactatctcagcggtgccttctccagccgaatggcatttgtgccggacaaacgcaacaaaaacaacaaaaaaatgccaaaacagaagaacagcggaaaatggagcaacgcgatgggcaagcagtaacaggaacgaatgttgttgatgatgatccagaacaatcggccgcccaatcatttcagcaacaaccaaaagcaacagaaaatgttacgatagttgatgaaacagttacggtggcaattttaaatattctgttagaaagttaa

SEQ ID NO: 80105 - DNA, 137 bp, Heterodera glycines
  Genomic contig location: Contig_ID=SeqID_15780; Location=99..235; Strand=-
  SCN-specific regions: Sequence locations=1-7,29-137
aatgaataaaaataaatcaaatgttaaaaattcacaggtgattaaaatatagtgtatatgtggcacagaaaatttcctactcagaactcattgcttttagtaaacccttgaattcctttgccttattaatttgcacc

SEQ ID NO: 80106 - DNA, 629 bp, Heterodera glycines
  Genomic contig location: Contig_ID=SeqID_15784; Location=105..733; Strand=+
  SCN-specific regions: Sequence locations=1-69,124-219,241-283,305-629
atgacacagcttaccaaggagtgcccaatctgccgtaagaacatcactaagacggccgaattttacctgaagtaaaagcaacagatttatggggggaaaaacaaaaattttgggcccccggccgttgatgaaccaacttttaaacacggatttgaaaacagccccctccaaataaggacaggtcttgggaaatttagagtttgcaagaattgtgcgtaggaatattttttggctaacagtacgaataaaaaatttaaaaaatagttcatccctttcaatcattatacagaaaagaatcaaatatcggtgataaaatatggaattctttggggagaaaaaaaagcaatgcggaacaaaatatcgaacaattacagtgcctaaaatgcaaggaaaatatggtaagagaatgttaaaattaatgtccacttaacagtgttctaatttgctgtagcgccgtgttgtattttatccatgtaagcatgccagcgtctgtgtgcgttgtgccaaagtaatggcgaatcctggaaaagctgaagccaagaagtgcccaatttgtaaacagaaaattgaaaaaatactccccttttatctatcgtgactttataacactttagcggttcgatcaggga

SEQ ID NO: 80107 - DNA, 220 bp, Heterodera glycines
  Genomic contig location: Contig_ID=SeqID_2504; Location=1..220; Strand=+
  SCN-specific regions: Sequence locations=1-8,30-220
tccatcagaaagttttatgcatttgttgatcgaaatgccaatgccgaaaatgaacccgaaaatggaggaggaaattggcagggcccaattttggacgcaaatgcgaacaaaacacccgaagattgacttaatcaggggccaattttgaccaagccaacgcattttcactattcaatttttactctctttccctatttagaaacataaagggaatatttta

SEQ ID NO: 80108 - DNA, 166 bp, Heterodera glycines
  Genomic contig location: Contig_ID=SeqID_2505; Location=4861..5026; Strand=-
  SCN-specific regions: Sequence locations=1-166
tttttctacgtaaatcgttacagcgaatgtctcatcattatctccaactcagcatagagatcactaattgccgtgttcatctattatatccgatccatttgtttttttatttcattaaaacataaaatgtacataattttttgtttcaattaaaattgaggtttag

SEQ ID NO: 80109 - DNA, 3394 bp, Heterodera glycines
  misc_feature (1339)..(1339): n is a, c, g, or t
  misc_feature (1471)..(1471): n is a, c, g, or t
  Genomic contig location: Contig_ID=SeqID_2505; Location=392..3785; Strand=-
  SCN-specific regions: Sequence locations=1-131,154-271,301-309,331 -636,673-1002,1024-1865,1887-2382,2454-2503,2527-2879,2903-3394
  Gene Ontology: Mol. function=carboxypeptidase D activity; Cellular component=membrane fraction
atgaatccggatggttatgaaatggacagagccggcgaccgtgttgggtatttggtccgtttttgttgcctcattttactcaatgagtctcaatcaaaatcttccagggtcgtgccaatgcgcacaacatcgacctgaaccgaaacttcccggcccgttaccctttccacaaagaggcgaccggcggcactttgcctgagcctgaaactgcggcgttgatgaaatggcttctccaatacccttttgtgttgtccgccaatctccatgcaggtaaaatttttaaatgtaaattttttttaacacattccgttaaaattctcaaaattttccccgactgggcctaccctttataggctcattggttgccaattatccgtacgacgactcggacacgggacaggacggagtgtacacgccttccgaagacgacaagctgtttgtcaaattggcctacgactacgcacgggcgcacacgaacatgtggaagtcgggcagacgttgtggcctcagcgacaacggcgacgtttttctgcacggaattaccaacggggccggatggtgtgaataatgggggaattgtcttaatacacttgtttttcgtaggtatcacctcgctggtgggatgcaagtgagcaaaacaaatcattttacaaaaataatgaaaaataatccaatttcacattcccaaaaaaaggattggcaatatttgcactcaaattcgttggaaatcaccatcgaaatgggctgcttcaagttcccctatgacgacatggtgcccacgctttgggctcaaaatcgcttctctctgctcgcctttatggaggcggtgcacggcggagtgaagggattggtgcgcaatgagaaggacaaacccatcgcaaatgccatggtagctagtctaactcgatgaaaattttattaggaaaatagcgaactttattttcaacaaaaaaatctaacaataagcagttttttaatttttcggaaaatttatgcctttgacttgcgctgcccttcttcaggttagcctcgttagcggtggaactggcaaaaatgtgaccacttcaacacttggcgaatattggcgactgttgcccccgggcaattacaccgtaacaattgtttatacttttgaattcatataaataaattagtaattgcatttgtcagatccaagttttgcaccaaaactacaaaccgtaccaattcgacgtccaattggttgtgggccagcctaaagaggtcaatgtcactttgaaacacatggaatgtgatggccaaggttttccaaccgaacttttctttaaaaatgtgacaaattctcaaattcagacaaccncaagcaaacagacattcgtccgaggtcaaggcaacctcaaacttgttgctggtcggaattgactcgtcgtccagggaattgctcactcggctggccgcccacacgtgcccggtggattccgaacaagaaccntgaacttgtacgactcttattcattcgacaaatttcatcgttaaatttgtgcactaaggcccatcttttacacgaaagtgtccaactgcacattgtggcggagtacactcaaactgagttggccccctacttgcgcagtgtgttcgccgatgctttgattgtgttcgcctcgggtcctccccaatcgattgtattcagtgcgggcgaatacactcctcggctgttcaatgaacgaacgtttggagaaagtttgaaaaagtacgtgcaatttaggggtcgggcagaaactgtccaaaatcgggcgaaattttttttaggtttggcttttcaactgctaccagaatttattttttgttattttatgcattttagagtctttgcacctcattctgtcgacaatgaggacgagcagcaattggtgttggcgaccactgaaaactgtgaggaccgacttggtcaactcgtcagtttttgtccaaatttgttacccattatctccttttccccctcactcttttccaattaatcttgcgcaggtgtcgcagcaatggtcgatcagatgggcctcgaccgcctttttcagttgggcgttggcatcggttgcggaaactccaccgaacgggacattgactcggccaagttggacgtagcactgaccgccatcattgaggtgatttccgcgcacaattccaatgccgacaattaaaaagccaactttcaaatttgttgtatttattcatacaattcttggtttcgctacttactcttttcgggttagtccattcattttatgttatggcgggttccttttttgtgataactaacttaaaaacgaggcttaaattatttgttcctccttttttgctgtttatattcttaattatcttttttgtcccttcttaaatcgcaattgtattattaattctccaacaatttctgataaaatttcttttaattttattgtttctatttggattttatggtaggatagtgaaataacttcccgaaaatgttgtccctttcccttcagatgatggtcaacgtgctgaaaagggacgaggttcacgagttttcggtggttgtgccttctgtcgccccgaccgatcacttcactccctcgcaaattgcggcggtcacttcggttggcttcgatcggttgtctcagtccaccgtttgttccgcccgactgattgagtcggccgatggcatgaagttgcacgccgtcggctctcatcgcggcccacacactttggtgattgcggtcgaaaaggtcatttcctaaattggcattgtttggcaacgctttccatttgcatttcagaaaacgtctgctttggtctaccaattgggggcccgtctttgcgatcaaatggatgccgaaatggccgaagcagtaacagcgcccgcctatttagaggaggaggacaaacaattggcacgcattttggccggctccaccatcgttttggcacccgaaatcccacagtattatttgcgaaatataatcccatctgatcgtgagactcatttagcactcagttgaactgccacgactacgccacaatttctccgttcattcctttggtgtccaacattttggggactgtgccggaaattgactttgtcattgtaattgccactggcggtctcaaggcaattaagactaattgagtaaaatgggacattaaagacaactctcaggttcgttttatcgatgtgctccgccccggggaggacaacggaatgctgaagaacggcacggccgccccatttgaggaggagcaggaactgatgggcacggagcaaggaatggcggaggagaagctgcccgagggcaattggaccgcaacgccaatggcatttggccaaatgtacatcaaacaccatgaacagatgcgacaggtcagtgatgaaatgatctaa

SEQ ID NO: 80110 - DNA, 1510 bp, Heterodera glycines
  Genomic contig location: Contig_ID=SeqID_15786; Location=27..1536; Strand=-
  SCN-specific regions: Sequence locations=1-810,832-837,859-1400,1422 -1510
  Gene Ontology: Mol. function=carboxy-lyase activity; Biological process=dopamine biosynthesis from tyrosine
tcccattcatccgttgacaaagtgagtaacagaaaagcatcacattttcttaatgtttttggtcaggggataatgctaagcggcgtaaaaatgcgaaaattgccgacaaaccgagaaaagggcggcaatttcgtgctgagggcggaagtgttggaggcggcgataaaagtggcaaaagcggacattggaaagggtcaaattgtccgattttataggaggacaaagccaacggactgacccctttcattttggtggtcaccgtcggcacgactaacacttgcgcggtggaatcgtgccgcgagttggggccgatatgcaacagagagggcatttggatgcacgtcgacgccgcttatgcaggtgagaaacgagaccaaagacagctgagtgaaattaatcagaactgatcaacagctaatcactgataattgttacttaatcaatctaatcatctgctcttagctaatcaatcaacctatctaattagctaatcattgataattaatcagtccatcactttctattcatcgtctttatatcagattaatcgtgccttattatattattggatattggctattttaggcagttttttcatttgcgacgaattccgccatttgtcggacggtgttgaattggcagattcgttcaatttcaacgctcacaaagcattgatgatcaattttgattgttctccgatgtggtaagctaagaaagaaaaaaggaaatttggcatttgtcaattgaggtttaaaaacggagacgaagcaatcgcatttttcaacgtcgatccggtttaccttaagcacgaacatcaaagggatgcgtacgattttcgggtgatttttctccattttcccgtccttcccaaatattcgtttcgctttccttaattaattaagcatctccaagttgcgcttggccgtcgcttcagggcactgaaaatttggtttgtgtttcgtgcgattggcattcagcgaattcaggactttttgagaatggtgcgtccatttgggaaagtttcaaattttctgtattttccattagcaaaacaaatttggcaaattgttcgccgatcttttgctcggagacgaccgttttgagctgttcgttccccagcatttgggcttggtctgctttcggatgaaggtataatcactcgttaaaaggaatcactaagactaattaatgacaatttattaatgtgtcaatgccattgtctggcaaaacatgccgtggttactgtatgtctagtgataactctgtcgtggttactgtagggcccagttttttttccatctctttgcccattgtcccttctcttgagaccagcaatgaactgaacgagtcgctctttttggccattaacgacgatcgccgcattcatttggtcgcttcgttcactcacggcacttttttcctccgtttcgtcgtttgcagttcaaagacacgcgaaactaacatcgaataagcggtcgaagtgatcagagaaatggcggacaaagtgacg

SEQ ID NO: 80111 - DNA, 2056 bp, Heterodera glycines
  Genomic contig location: Contig_ID=SeqID_15787; Location=474..2529; Strand=+
  SCN-specific regions: Sequence locations=1-623,646-1007,1029 -1406,1429-1509,1532-2056
atggccgagtgcaatacgaaccggccaaagattttcgtgggaaaagtgagtgggttagtggaaataaatccggcaaaaggcagaaaattaatcaattaaatttttttcaaatttagtgttggagctcgtctattggcgtgacccccaaaagagcggtatgaatcatttgaaaaacagtgtaaattcgaaattcgttttcaaatgccttaggcaattaaaattcgttttgactgactgcactttaaattgggcaattaatctttgtttatttgacaatttccctactgttcaggtgccgttttggcctctctctttctctgcgtttacgttttccaacacttttccgtcctttccgttctcataaatggcgccctttgccttttgcttgccaccgtcggcttccgcgtgtttaagctggccgaagcccacttcaaaaagttgcccgatgccagcgccaacccgtaccagcagtacttggacatggaggtggccgtgccaatggacaaactccaccaccatgtagacttggccgtggaatacgcactgttcctggccaagaaaatccgtcacatttatctgtccgatgctttgctcgactcaattaaggcgagtcaattgtgttgtcccctttccattttaaattttgcccttttcagttcggtttgattctccactcgctgtcctacgtggccagttggttctcgggcctcagtttgttcgtcctctttattctggccgttttcacagttcccaaaacgtacgaactgtacaaagaggtacattgatttctctaataatcactcattgttaaatatttgccgtttaagcccattgacggttacgtgaacttggccaaagagcagttggaactcttcagcaatttgtgagtttttccaattacaaaaacgtaattaaattgcattgttttaaagacttcaagagaagttgcccttcctcaaatcgcccgtggcagagaaaaagggagaataaatgaatgttcggaaggaaagggacaagcggaggagaagcagagaaaagaacccgccaattgcgcttaatctctgctttatgccactgacaaaactttgcattttcgcatcggccttttcctccctttgttgtcatcaatgcttgggatcaaaagacaaaatgagggattgattggaatggtgggctctaatgcagtttacgcgtccaatcgacttttacgcgtccaaccaatgaccatcctcagtttcttaagccataacttttttcttacttggtcaatccatacatccttggtatcaattgaaagcttaaagtctcgggaatttataaatacaagaaaagagtaaatatttgcattacgaaaaaaatttcaatgaaaaaaacctgaattcatcatttttcgcgtatattcaacagtaattttttgtctattgcttttatccaggcatttttctatacaaaaacttcagtgaactttaagctctcgattgataccaagaatgtaagttttgaccaagtaagaaagaagttatggcttaagaaaccgaggttggtcattgattggacgcgcaaaagtcgattggacgcgtaaactgcattaggagccaaattacttagactaggtaggcctgtttttggcttaagcctaggcttaggctttttttgcaaattttttactttctgttaacatcattaagtgtacttagggttgcttttgcacatttcgataattacgattcacaaggtatagttttgattgatggttcgaaaaaaactatttttgtgacgtctaaactgttgttgggacgcgcaaaatatcatgggacgcgtaaaatgtcacgggacgtgtaaaaccgactagaaaccccaaattaggtttaacatgattaatgttattacgggttcataaagctggcagtgacgacttaccatctgtttacggaaaagaagtcgattgttgagcactttgcgcgtgtgcaatgtgataacaccaccttcgaccattttcactttttttattagctttaaattaaagttgaaaaaatgtaaaacaaaaatatataaa

SEQ ID NO: 80112 - DNA, 1029 bp, Heterodera glycines
  Genomic contig location: Contig_ID=SeqID_15789; Location=795..1823; Strand=-
  SCN-specific regions: Sequence locations=1-259,281-1029
  Gene Ontology: Mol. function=protein binding; Cellular component =integral to membrane; Biological process=signal transduction
cgccgtcctttccctggcctttctgctctttttgctcacctttcccttttcgctgcttttctgcgttaaaattgtccacgaatacaaacggatggtccccctttgccctttggcactttccttcccattttggcacttttaggtcgtttttcggcttggccgtttgctcgtcggccccccaaaagggcccggcattgtctttctgctgccatgcattgaccaccacacccaaatcgacctgcgcgtcaaatcgtacgacgtcccttcccaggcaggccagagctttcgctgcttctcccaaatgagtgaccaattgacaggaaatgcttacaaaggattccgtcacggtttccgtcgacgcggcagtttatttccgcaccagcgacccaatcgcggccatctcgtgcattgtggactcggcactgagcacaaaacaattggcacaaacgacgctccgcaacattttgggcacgaggacattgaccgaaataatgctggagagggaaagcatttccaaagtgattcaggtggacattggcacaactgcagagggcaaaatgaatcgtttaggagattttggacgaaggcaagtgttggcatggcattcactggtcaatggaatatcttttatcagctaaaagcacgcttaagggactcacccgtggggcatcaaagtggagagggtggagctgaaggacattcggctgcccaagggccttctccgagcgttggcagccgaagcggaagcggccaggagggcgagcgcgagggttgtgagtgcggagggggagctgaacgtaagcagtggcaaatgccaatgtcaatgccaatgctcagcatccccaaaatccgcaggcctccgcttccctacgcgacgcggccgaccaaatttcgggttcccccgttgccgtccaccttcgcttcctgcagacacttactcgcatttccaccttccgaaatcgcacttttgtggtgccaattccgacagaggcaatccgaaaaatgatgggaatggcacacaaaaaagac

SEQ ID NO: 80113 - DNA, 1010 bp, Heterodera glycines
  Genomic contig location: Contig_ID=SeqID_15790; Location=117..1126; Strand=+
  SCN-specific regions: Sequence locations=1-205,227-357,380-544,568 -625,819-833,1007-1010
atgacttaccgagtttatttatacaaaattgtgaaatgtgagtaggatgattatgccattcagcttattttatttgcttttccttttatttttccctttgtttttttcttttgcgcccccggcgataaatgtctcttttttattttttggtttatttctttttaataggctgaactattaaatttaatgggagcagttcacagcaacaaaaaagatgagagtaaactgtcactcgctgatcgacgttaccgcgtcagtgccgcctcaaaaggttgggaaacgaaagcaaaatccatgggaacggtaagagacaaaaaaaaagaaaaagaaaaaaagagaataattacggtaattagtaaaataaattccgttttaattgcagttgctaattcaatgcaaaggagaagcacaaggaaattgggaagtgttgcgctggaagttcaacaagaaaacgaaagtcagccatcggaagggaacagcagcaaaagggacgagggaggagaagaggagagggaggaggagcaggtcaaagttggggaacagtatcagcagcaacagcaggaggaaaacaacagcacggggacagggagagatgacacaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaagggggaaagggtaaa

SEQ ID NO: 80114 - DNA, 439 bp, Heterodera glycines
  Genomic contig location: Contig_ID=SeqID_15791; Location=54..492; Strand=+
  SCN-specific regions: Sequence locations=1-330,353-439
atgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcacttgcaaaccccaaaccagaccaaattatgcatcacttaagagcccttcaatatcgcttagcatccaatggatttgacaatttaatccatgaataatgattttatattttatcgatta

SEQ ID NO: 80115 - DNA, 1277 bp, Heterodera glycines
  Genomic contig location: Contig_ID=SeqID_15793; Location=1..1277; Strand=-
  SCN-specific regions: Sequence locations=1-578,601-620,642-1247,1269 -1277
ttttgaaaattcgcttttccagcaaagtgccgtccgctccatcccgcaaattgccgcgttcgtcccgcatgggttcgtcaacaaacggcttattcctgtgctgcagagtcaggccccgtttttccaggagcacattccggtggaaaagcatttgccaattatctaattaatagtcaattaccgaaaaattcccccactcatttgtgccggtttagcgccaaattgacctgttggttgcggtcgcgcacctcagcgaccgttgcgatgcgcaaacattgcactatttgctgacggtgacatcggtgtgttcgacgctgcacccggccatagtccactcaaaatcacgtgacatttttaaaatcctattttattttttcaaatttaaatttcaatttccgccactttttaattggcaaacaaattcttggcaaatttttttttaccaattttgacttttttttaatccaaaattcaggcctcgtccaacgcattttgacctgcgatgtcagccgtctgcgcgacccgttggttattgcgcatcatttgctgaacccggtaatgaattaatgagtttgggttgtttttggaaaattattaaaagcaattaaagggcagtaaatattgaattaattaataattaacataagtattcaaatttttagcttgtccttggccttgcgttgcccgaactgtcaccggcacattttgatgatgtgaaaacattcaattgcatttgaaactttaataaatttctccaattttgaggtgatgagctcctcgcgcattctgttggacattgtggaacagttgcgttatgaattcgatgacagccgaatgaaagcggagaacggcggggggaggtgggaaaaaacggggagggagcacttttggcattcaaaaattgcgatgccaaaaatgcctttgtttccattttcattccgtccccttttcttccgctgagcagtcatcgtttgtgcaaccgtcgcgtgtccatgtcctccaatcacttgcctcggcttctgatcactgccgcgcgcccatccatcggcgacggacgcaaaatgtcatttttgtccgcggacggacggttggaggaccgccgcggcagtaggcgcgagtcgaaggactcgcgctgctcgttagagtccgaagtgtcgctgcgaatatgtaattgatcagcagagtgaccaaattgatgagtcatcaataacccaatcaatggctaactcaattttcggccaaaatactgaattctaacatttttcttagtgttatat

SEQ ID NO: 80116 - DNA, 1880 bp, Heterodera glycines
  Genomic contig location: Contig_ID=SeqID_15796; Location=787..2666; Strand=+
  SCN-specific regions: Sequence locations=1-169,191-472,494-639,661 -758,780-1880
atgtacgtggacatgggctaccggacgaacccggcacggactgacaccaaagtgccgtcctcgccatattcattatcaagacaagaaaaggcggcagatacgcgaaccaagcgggatcagcagcagcttaagccgaatagagaaaggtgggacatattttatagaattgggaaatttttaatcaaatgccaaaaaaactgatcagcgggcgggggagggaatgatcattgctttcaattgatacgaggatgatcaactgacttttgatctgatcagcggtgaccacgataatcatttgaccattgttgatcaactggcactatcaaaatagtgaccaagatgttcaattggtaccaagatcggtcaattgaatctccgttaacttatcaatctaacacggtcaattggtctgatcatgttttaccaaattgatcagtgggaaggaagtatttgtcattttctgatcataattttgtattttttaattccaggataaccgaggaggaagtgcggatgttcggcatggatgtgactgatcagatggacagtggtgatccgacggagagtgatcagatggagagtgatcaggaggggaaagccgagaatttattgcccaagactggggttgaaaatcatcctaatttggcggtgaataattgcgccgttccgtcaattgcattcgatgaatgttcacttttgtaattactagcggggaaagcgccttcggcgcatcccccgctacgtagtacgatgtattattgagctatgaataataaaaccgaaaatggctcggccgcttcgcggcctgggactcaattcttcggcattccaatcacttggaatcactcaatccacctgcattccaatcaccaacaataaatctcgccgattcttctgcataccaatcgctgggactcagttctacgacctttcaatcaccgttactcaatccatcagcactcgaaacacctggactcaatctcaccaattctacataggcaaaacattttaacattctactggcctttttgtttcttgtcatttcttaaacaaccctcggcatttcaatcatcggaactctatctcaccaattctccggcattccagtcactgggaccaacccaccagcattccagtcactgggactcattctcctgcatttcaatcaacgggactcaaccctccagcatttcaatcactgggactcaattctccagcatttcgatcactgggactcaatcctccagcattccagtcactgggactcaattctcatgcatttcaatcactgggagtcaatcctccggcatttcaatcactgggagtcaaatctacggcattccgaacactgggactcaattctccagcatttcaatcactgggagtcaaccctcatttcaatcactgggagtcaattctccagcatttcaatcaccgggactcaatcctccagcattccagtcactgggactcaattctccagcatttcaatcactgggactcaattctccggcattccagtcgccgggactcaaccctccagcatttcaatcaccgggactcaacccaccagcattccagtcgccgggactcaaccctccagcatttcaatcactgggactcaatcctccagcattccagtcactgggactcaattctccggcatttcaatcaccggcactcaaccctccagcatttcaatcactgggactcaacccaccagcatttcaatcactgggactcaattctccagcatttcaatcaccgggactcaatcctccagcattccagtcactgggactcaattctccagcatttcaatcactgggactcaattctccggcatttcaatcaccgggactcaatcctccagcattcca

SEQ ID NO: 80117 - DNA, 317 bp, Heterodera glycines
  Genomic contig location: Contig_ID=SeqID_15797; Location=450..766; Strand=+
  SCN-specific regions: Sequence locations=1-317
atggcacagtttgacgaagccgaattcaagacaacggttagtgccaacgccaattttcgctttattactgccatgatgagatgttattatattaattacaaaatcagcggaagtttcagcaatccaaagagcttaaaagaagcgatgaaataacaatataccatttagcaataaaaagcaaatttatttatgcaaaagagaaaaaagtccacaaaaaggagtaatccacttactctgcggacatgtcatagattaagtcgtcctcgagtaatatggatcaacaattaaacaaaattaaggaatcacaacaaaattaa

SEQ ID NO: 80118 - DNA, 87 bp, Heterodera glycines
  Genomic contig location: Contig_ID=SeqID_15798; Location=251..337; Strand=+
  SCN-specific regions: Sequence locations=1-87
gaaatgttcatttattactgttgccgaacaactgaaaaatgtacatagcaacttcaaagtcttgcaatggaatatcgggcgagccca

SEQ ID NO: 80119 - DNA, 1053 bp, Heterodera glycines
  Genomic contig location: Contig_ID=SeqID_15799; Location=400..1452; Strand=-
  SCN-specific regions: Sequence locations=1-666,690-903,932-950,1022 -1053
atgtaccgtatgcaacatcaaattgacgccaaaagaaacaggtcaacgctacaacatgatggccatctttacaaatttgctaagacaagtaccgacgggacgattaaattttggcgatgtgagttcaaagacagcggtgtggacaagtgcaaaggacggatttggacttcacttcgagatgaattcatccgcatggcgacacctcacacatgtgaacggaatccaagtcacgtcgttgcgcaaaaagtcacgactgccatcaaaaggcgttctgttgagaaagctccctctgtaattcgtgcggtttctactcaaagcattagttcgcctgcactttcagaagtgccgtcaaaaaaggcaacaaatttggtaaatcttttcaatcataaaatttgttaaaagatctttcgcttagatgataaaccgagcaagacatctagtagatgcgccaccagctgtgccattgaatcttgaacaacttcaaataccgcaaagttaccagttttacgaaaaaacgatgtacaagaacgttttttattctgctaagctaacttttgatgctgatcaaaaaagtcttttacagcaacttgatcagatcactcctttatagtgaccgggacaccacaaaacacattgaaaatcggggaaatttccgaaaagaatccctagggggttgtgaaaaattttctgtaaaatttcagtaggccagtcagaaagagcaaaaattctctacaattgccttttaaatagtgagtctacgactagaaaaggcaaataataatggatcgaccaaatcaattaattatcagtgtttattttaatttgaatgcatttattgatcaaattcaaattttttattttatttttgcataaattggattacattactgtataagcttatcttttacatttaaaaaagaatttataaattttgtttttctccaaattacatataaaaataattaatgtaataatttgtttttgcttttcaaaaaaaaattttgaatttatatttaaaaaacggaatttttcatcgaagaaatgaaaaataaa

SEQ ID NO: 80120 - DNA, 634 bp, Heterodera glycines
  Genomic contig location: Contig_ID=SeqID_2506; Location=1264..1897; Strand=+
  SCN-specific regions: Sequence locations=1-72,95-105,153-634
  Gene Ontology: Mol. function=protein binding
atgtctttgtctgtggttgatcggatgaagcggatgttgagcactggagaggacgcggatgtgcactttttggtgggggaaggagaggaaaaggaggcaagtttgaaaataaaagtattaattaattaatttttatttaatttaaaaaaaaagcctttttaagagagttgcagcccataaagtaattttgaagcatgcttccgaagtattcgaggcaatgttccgttttgactcacagaatcaaaacgtagaaaatggtaaaaatttgatgaataaattaattggtcaattaatttgttagcctgcactaattgtgtcgtggaagtgcccgatgttgaggcagcagcgttcaaagtgatgctcagcttcatttatgccgacgatttgagccaattggacggagacaacgcaatggcagtgctttacgctggtcaaattgtttttgtgaaattaatctaacaatttaattattcattaattagccaaaaagtacaacatcgttggcctggttgtcccatctttgcaaattccaatttcaaaactgcacaatgttttctttgcctatgcccaggctcagctctttgaattagaggtgggatgacagagcactcaaaagcatcactctttcaataga

SEQ ID NO: 80121 - DNA, 832 bp, Heterodera glycines
  Genomic contig location: Contig_ID=SeqID_2506; Location=2324..3155; Strand=+
  SCN-specific regions: Sequence locations=1-128,150-164,196-197,221 -453,479-495,518-652,674-832
atggcattggatgttcagcagagaatcgccgtaaaatgcttggcccggcattgttcaaaattcgcttttccgctcgtgtcaaaagaagaattttcaagaaatattggtaagaaactaaattctacaaggaatttaagactttaaatgttcgaaaatatattcccattaaatttaattaaaataatttaattaattccgtttccaatttatttatttttcagttccctccggtgtgttaactgtggaagaagtgatcggcatttatcagttccattgtcatccgaatttgcacatggtttccgagctgtacccattgaaatttccgaggcagggaagaatttcggaccgaacagaagggacacttcagctggaaattgaaaaaatgtcggaatttgcgggcgaaactgtggggagctgccgatacagcaaaactgtgcacatccgagggcttccatttgaaatatttgcaaaaataaatgcgacgacggaaaacgatgaaaattttgttgggaaatggctgggcattttcctttggtgcacagcgccaacagaaggtgattataggcgcaacttttagtgaaaaaactttttttttgctcaattgttttgaagaaaggagctcaaaaaacgcatttctgcgttaaatttttttcatttggacgtcatttttcatcactgaaatcactattttggcgtttcgtcacttaaaatagtgaaaattctctttttcggctttttgtcactgttttttcactttttcgacattttttcgtcactattttagttaactatcgggatttttcgtcactaaaagttgcgaccctagtgatta

SEQ ID NO: 80122 - DNA, 503 bp, Heterodera glycines
  Genomic contig location: Contig_ID=SeqID_2506; Location=3484..3986; Strand=+
  SCN-specific regions: Sequence locations=1-332,354-503
atgggacggagaattgcacagggaaacgcattgacaatgtgtttaacagcaaatcaaacagcatgggattccccactttcattgctttttgggtgagggcttattataccgtacttacggtattagaacccccctctgtattagaaccccctttcgaggggggttgaaaatagaacccccgggagtactaactaattcagtaattacggtattctaatgagaatattttaatcttctgaatgatacgaagaatataaaacgtctccgactttcagcaattttgccattatttttcatttcccctggcaaatttaagaaaggccaataatggcagaaatggagaaacggcccaataaattcaaaaaagctaccaatcgattcctctcgaagagttaatttgtaagcacgaaaatataggtctccagttgcggaaatgcaaaaaaaaactgttttgaccggtttaaaactcgattgagcaaatttggcacttctaacttttttaa

SEQ ID NO: 80123 - DNA, 421 bp, Heterodera glycines
  Genomic contig location: Contig_ID=SeqID_2507; Location=206..626; Strand=+
  SCN-specific regions: Sequence locations=1-40,62-84,106-268,290-421
atggattacctttgttttcgtgctttgctcctcgagaggaatcgtttggtattaaaatttgcgccattttttcaagggcttcactatgatatatccaaaattaagcaattgatggatccgagaaacggcttttacgacagagacgaggacaaagtgactttggccattgatgtcattgtggggcaagcagaaatggacagagcaatttccgctgatcagagcaaatcgaaagggacactttttatggacattgaaaaagtgtcgcaatttgcgcgagaaagcatttggagtgagcgcaaaagcgaaactgtgacgtgcttagggggacttccatggaaaatatccgttcaaatatttacgattatgggaagtgccgtcaaatgtttgagcctttttctttgttgtaccgctccaaaagaag

SEQ ID NO: 80124 - DNA, 67 bp, Heterodera glycines
  Genomic contig location: Contig_ID=SeqID_2508; Location=50..116; Strand=-
  SCN-specific regions: Sequence locations=1-67
atggcccgcgctcacccggcggcgctcacctggctggcgctcagttggccgtgcacccctcccatag

SEQ ID NO: 80125 - DNA, 316 bp, Heterodera glycines
  Genomic contig location: Contig_ID=SeqID_2508; Location=1301..1616; Strand=+
  SCN-specific regions: Sequence locations=1-129,171-290,313-316
atgtcgtccgatgacgaaattcctccgttcctcgacgggccttacacgcccgtgcgagatggcgatgagccctttgaggatgctccgccccttgtggaagtgattaaccaattgcctattcaactggtgaaaattatttgaaataaaataatattattaatcaatatttagattttggatgatgttaaaggaaaaaatgaacatgtgacaaggagcgattaaacttggaagaatttaacggcgagcatttcaaatgcctggatgccgcacaagcggagagtggaagattcaaaggttgattaatttcttcgagcaa

SEQ ID NO: 80126 - DNA, 700 bp, Heterodera glycines
  Genomic contig location: Contig_ID=SeqID_2508; Location=1870..2569; Strand=+
  SCN-specific regions: Sequence locations=1-5,27-406,454-571,593-700
atggctgaaacaattttaacacactttgaaattgtcgaccaaagcaacaaagccaaagagcggccatcacttcttgaggaatcgtttgttattgacatcacggccatcgacagtggaggaaagagacagaagatggcggggaaaggtgggcgtcgccgtgacttcaatgttccgtacgaccttctggagggtgcaacatacggattggagaacaacgatgcgtattgcttgttccgcgccttcgaattccttcgcatgaagcatgtgatgccacatcagagattttctgaatataaacgtgatgaaggacaacaacttaacaacgtgacttctttattccgagagtgcgacatccaaatgtggttgcagttttattccattgaggaatatggaaacaaaattcaggtaatttaaaataaataaatttaagattaaaattacatttaaaaaatactacaacgaaatgcaccctgggatgttccgtctcttctgctttgacacctttggcaagatgaaacccatttggaagtccgccatgagtgattaccggtatgagctctgtgttctttacacgagggagatgatggagctgttggacactatgacgcaatcaaatcaattggaaaaaatttcggctcaaagaattactgattgtaaacttgattataatccctagtgtaagtaaccgatattcatacaa

SEQ ID NO: 80127 - DNA, 1429 bp, Heterodera glycines
  Genomic contig location: Contig_ID=SeqID_15800; Location=617..2045; Strand=+
  SCN-specific regions: Sequence locations=1-131,173-278,464-493,523 -578,609-812,834-862,884-972,1022-1139,1193-1371,1411-1429
atgccatacattggggagacaaatgatttcaaatttgagcaaaaggatgttgaacaatcattggtgctgatggacgatgatggggccacagatgtggccaaatcgtcatttgatgtggaggataaaagtgcaatttaattttaaataatttaattaaaattaatatttaaaaggaaaaaaaaattgaaaatatggaatcattaacatcaataaaagcagtacaatggaaacatcttcagttgaaataattatgacttcacaaaatttaaaaattgggcaaaattaaagtaaatattaaaaatttttaattttctttcttaaattgggtttatttatgagaaattttttagattattctataaaaatgctaaaattaaataaattaagatttataaaaatcaatgttttaaaaatattttaataatccaaaattattttattgaaaaaaaaaatatttttttttgaagatacaaggccaaagagtccgaaaaagtttaaaaatttaataaatactttaaaaaacagtacaaaacatcatgctttttaaattttttaaagcatttttatgaatccaaaacaattttatttattttttcaaataaaaaatagttgttttagcagcacaaggccaaagagtacgatcaaatcgaagaagaattagtacatttacaactccatcgacgacaacatcattatcatcatttccaacaagtacaagtccacaactcagcagtacaactaatggcgaagagttttggatgacaacaaggagtacggtaatgacaccgtaccaacgcgtggccacaacaccgtatgacattgccaagttttaccgtatgccaaatggaaactcaagacagcgtgaaacaggtaaattttataggcacacaccccggtacaggactaacttaacctgaaaatatttcaacgcttatttgatttaaaagattttttcaaaattctgagttttccattatttgatttatttttttttgcaaattaattacataaatatttttaagaaagtgcttctgatttctgacaaaatttagctaataagccaaaaaaaaagagagaccaatattaatgaatttgagtttatcctctttttataagagttttatataaaattgaagttctattaattttaattaatcccaatttataaaagttattttttttaaataaaattgaagtgctaacattttgctcaaaacgtgccgccatccgcgactcggccaacatggtgatcgcatgtgccggcgaagacggcgacgtttggacaccgttgcgctgtccgcccggcaccgactgtttgccggccgccgattcgacattcagaatttgttgtccagtggcagtgggaaaaagataaaaaataatattttatttttattattattaatttatgcattttatataccattca

SEQ ID NO: 80128 - DNA, 811 bp, Heterodera glycines
  Genomic contig location: Contig_ID=SeqID_15804; Location=493..1303; Strand=+
  SCN-specific regions: Sequence locations=1-29,52-327,367-424,446 -608,630-811
  Gene Ontology: Mol. function=transferase activity, transferring groups other than amino-acyl groups; Cellular component=integral to endoplasmic reticulum membrane; Biological process=fatty acid elongation
tgaacaatgtcttcgctgatcaaccttttcaactcatttgaaatgtatcatgaaaataacacgaggaatatgcactcttcctacaaacacaagtgagtggaggactgaccagaagtgatcggctcaatcaaaggcaatatttaatcgaatggcctttgattggtccctttgcctttgtccctaattacccaattaattattcgcgcggtgtttaggtttcaatttccctatgaacggattgaggacccggcgggtttgactgcgtactttcagaagtattgacatcaaaccatcacaattggcattttgtactatgttattgtgagcaatttatttattttttaaaacactaataatataattattgaaaaggtaaaatccattgaatggacaatgcgtgacagaaagccgtttgatcttcggaattgtctgtttgtttggaacacggcattggcacttttcagcatttgtggattcatccgagtgggagaggtcaaacagattttagagaattaaaaccaagccgttgttaaggagtcgctcatcaatttaatatacgagggattcactttcacaatttgccacacggtcaatgcacgcggcccgggcccattttgggggtttctgtttttcctttcgaaatttgccgaattcggagacactcttttcattgttttgcgcaagaaaaggtcagtgtcccaagcatacatttttccgttttcaactttcaatgcttttttgaattgaaggttaatcttcctccactattatcaccacgcggccgttctgatttattcggctcatgtcggtg

SEQ ID NO: 80129 - DNA, 516 bp, Heterodera glycines
  Genomic contig location: Contig_ID=SeqID_15807; Location=2747..3262; Strand=-
  SCN-specific regions: Sequence locations=1-31,53-374,397-516
ttttgcgcccgaggggtacggcctttttatcctcgccttgcccaactgtcccacccgctggagcgccgttttcgaatttcgattgaggggagggtagtggatgaggaggtatagacaatccaaagaattgggagggaagttaaatcccgtcacgtcgatagaatcattcaccaggatattccttcgttgactgtttagttgactgattgcgtgtcttttttgcagaataagtacggctgtcgtgtgatccaattcgtccttgaaaatgtcgtccaactcgtccatggcactgcgaatgccaacaacagcttggaaaagtgaattgttctttttttggcccgttatcattcgtaaagcttaagggaaatttccatccaaatattgcatgttctcatggagcccattctcaaaaatgcgtattcggtggcacaaaacgaattcgccaattacctcgtccaatttattatcaaatcgccctatctccgccgccaacgctgttacatcatcaaaactcac

SEQ ID NO: 80130 - DNA, 1491 bp, Heterodera glycines
  Genomic contig location: Contig_ID=SeqID_15807; Location=1601..3091; Strand=+
  SCN-specific regions: Sequence locations=1-22,55-669,727-1011,1033 -1266,1289-1491
  Gene Ontology: Mol. function=semaphorin receptor activity; Cellular component=membrane; Biological process=development
atgccatcccatacaaaccgcacccctctctctccccctctccaaagggtcgtttgtgcgtcacccactcgcccttcgttgctccctttggtcgccgcggggcaatcgtcgccgcaggcgttggcggacatcgcacggcacggactgctcgcgcgactgtccgttgtgcaggcggcggacgcggcggtgctcgcctcgaccaacttcacctttttcgactgtcaacagctgagctcagtgcgttcgtcccactttgcttcctcccaatgcttttcctcccccttttttagtgttccgcttgcgcttccgcgcgtttcccctgcgattggtgcgctttgtccgcgcgatgtgtgccaaatgcggaggacgtgtgccaaggagagacgctggtcaactcgatcagcgtaggctttacttcgcaaagccttcattattcgcttcccatttagcgagttggcccttcttctcgccgtggccctgagttttgcccccatttcactgtccccggcggtgatcagtacctttcgtccggaaagcgtcgctccgtgtcagtgaaagcgcacaatctccacgaccaaatgagcgcgttcaaatgccgttattcactggaatcgtcggctggcgtagtgcatgagaaattggcacaacggcaggaggacaaaataatgtgaggggggggggggcgagaggggaggggagggtgaagaggaaaggggaggaaaagggcattcgctgcattaaaagaaagagagagaaacatggaccaacagagaccatttcgttcagttgtgaagacatgcttttcgaattttcgggtcccggtgatggcaatggcactgttgtcgcccgtttcgacatcctttgggcttcatcgtccgaccaaaatgccaaccaattccatccgttggacaatgcgcagggaatgcgaatggtccgtagttatttttttccaattacaaactcacttttcactcactcattcattgctcagatcatctacaaatgcgcacaattggcatcaaattgtggcatttgtttggggttggatgagcgccgcttcgactgcggatggtgcgacgaggagacgcaatgtgtgccgaaggacaattgcgacaaagggggtaagttttggagggggggggggtggtgagttttgatgatgtaacagcgttggcggcggagatagggcgatttgataataaattggacgaggtaattggcgaattcgttttgtgccaccgaatacgcatttttgagaatgggctccatgagaacatgcaatatttggatggaaatttcccttaagctttacgaatgataacgggccaaaaaaagaacaattcacttttccaagctgttgttggcattcgcagtgccatggacgagttggacgacattttcaaggacgaattggatcacacgacagccgtacttattctgcaaaaaagacacgcaatcagtcaactaaacagtcaacgaaggaatatcctg

SEQ ID NO: 80131 - DNA, 531 bp, Heterodera glycines
  Genomic contig location: Contig_ID=SeqID_15809; Location=343..873; Strand=+
  SCN-specific regions: Sequence locations=1-165,243-531
aatttctcgcacttttggaatggatcccatcggctccaaataacccaattgtgccagacaatggaacggccttcgctcctggaaccaatttgtgtaaattgagtatgcaattgacaaaatgtaggtgagcgccacacagattttcatgttccttaaattaatgagaataattttcttaaaataattcaacaaatcattatttattctatttaaaaatttaatttaaaatttattttaaaaaaggaattttaattgaaattagtaatgcttaagtttttatttgaattcccaaaattaacggacggacttttcgcagcaaattgtgttgtaaaggcgtgggaacagaaaagcaatgcatcggttgaacgccaattcaatgtaaaaagtgtcaatgcaaaaattgacaaaacgaaaaagaaaggcatccaaagagaatttgacgatgagacgagtgccgatcagatattccagggaaagccaaacgtactcgaacagccagatcagatcgaacacattcttaaagaaaaatga

SEQ ID NO: 80132 - DNA, 96 bp, Heterodera glycines
  Genomic contig location: Contig_ID=SeqID_15810; Location=1873..1968; Strand=+
  SCN-specific regions: Sequence locations=1-96
atgcaatcgtttctccttctcgtaaatattttgctttgttcaattgtgttgctacatttattgtcaaatgaacatggattggtcaatgccatgccg

SEQ ID NO: 80133 - DNA, 372 bp, Heterodera glycines
  Genomic contig location: Contig_ID=SeqID_15810; Location=133..504; Strand=+
  SCN-specific regions: Sequence locations=1-350
caaatggcaacgaatttgggaaaaaccggtggattttttcttgtagtacgaagcaaccatatttccggaggatgtccaacgggacgaaacaccgacctttcaagacaatttatcattaatgtcccgaaattccgcctctttctcacattggcagcagttgtaccggggctcagtgctgagcaggcctcacttttgtcggagattgcccagttggcgtatgaaatcttcaagctgtccagcagagtccaccagctggacatcgagtcagtgttcaagttgccgttgcccgacgcttcgcatgtgccgtactcagtgacgaacacaggcaaacctttagggaagcagtttagatggagaagaagcttcccttga

SEQ ID NO: 80134 - DNA, 1573 bp, Heterodera glycines
  Genomic contig location: Contig_ID=SeqID_15810; Location=1..1573; Strand=-
  SCN-specific regions: Sequence locations=1-655,701-719,741-1070,1092 -1573
  Gene Ontology: Mol. function=glucosidase activity; Cellular component= cell wall (sensu Fungi); Biological process=cell wall organization and biogenesis
atgtgccgactccaagcaactcatctgctcgctcgactctttctgctttttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggtaccataaaagcactcacttttcaaaatggattaagaagccaaacatatttgatcaaaatgtgcaaagtgttaatgttaaataggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaatccacatccggacgaagcggtgattagtgccgagactgaggcaaatggcaaatttgaacattctcaaggtcaaattcttcacccgaattgctcaagcgtacggctcctaccctcacattttgtacgaggatttcaacgagccgctgagcgtttcgtggaccgatgtgctggtgccataccacaaaaaggcgagtcataagagaacatttttggtgaccaaaaggaacccatctgctgaaggtcattgctgccatccgagctattgacaagaaaaatgtgatcattctcggcactccaacatggtcccaagacgtggatgtggcatcacagaacccaatcaaagactaccaaaatctgatgtacgttttcgatcagttttacactgaaagtgtgccaatatggggggggggggcaaaatgaacgaccatcaaaacgacaaaaaacaattgtcaatccccttaacaacgacatcccttttaaggtacactctccacttttacgcgtccagtcacttcacgaatgatcttggtgccaagctcaaaacagccgtgaacaacggcaagtgctaatatttgtctgggacgtgccgggctcctcaagggaagcttcttctccatctaaactgcttccctaaaggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtgagaaagaggcggaatttcgggacattaatgataaattgtcttgaaaggtcggtgtttcgtcccgttggacatcctccggaaatatggttgcttcgtactacaagaaaaaatccaccggtttttcccaaattcgttgccatttgctggaactaaacgaattcaggcgtaagctgtagcggctcaagttccggcagctcttcgggctcgagttctggctcttccggttcaagttccggcagctcttccggctcaagttcgggctcctctggttcgag

SEQ ID NO: 80135 - DNA, 1087 bp, Heterodera glycines; identical to SEQ ID NO: 15811
  Genomic contig location: Contig_ID=SeqID_15811; Location=1..1087; Strand=+
  SCN-specific regions: Sequence locations=1-86,108-770,792-987,1009 -1087

SEQ ID NO: 80136 - DNA, 967 bp, Heterodera glycines
  misc_feature (29)..(29): n is a, c, g, or t
  Genomic contig location: Contig_ID=SeqID_15815; Location=1..967; Strand=+
  SCN-specific regions: Sequence locations=1-6,28-36,58-242,309-379,402- 414,469-601,705-827,849-967
  Gene Ontology: Mol. function=metallopeptidase activity; Cellular component=integral to plasma membrane; Biological process =neuropeptide signaling pathway
taaattttaaattttacttttcaaaactncggaccaaatttaaaaaatgcactgattgatttaaaaaagaagggtgtggccttttgtttaaccctaaaaattcaaaactcagcccaaattatgtcttcctggcgcagtgtgttcgattccgtgctgatctcattcggcggttggccttcgctggaggcgtcctcagaaccgaacattcgaattcgcatcgaacgcctctacggaataatggcaaaataaaaataaaaatggaaaaatttaaaaaataatttaggtaattaattattgttttttatttacaaattcccataaaagtttatggtttaaaattttttttttcgttttctagtcataaattattattgttttctttttaatggaagggcagtaaaatgtaaatatacctaaattaaattttaaaataaaaatgaaaacacttttaaattaattattttttttctaatttcaggtggccaagttcagagccgactccctcttcaaagcgacggtgcaacccgacgacaaaaactcggacaaacacgtgcttttggtaattattgtacatttacctaactgatcattttaaggaaagtataaaattcaaattttaaaattatttgaaattgttaaaaaaattaaattaaattttcaaaaaatattttttcaattttcttttcttttttattttattaaatgggaagaattttgcctcttcagattgaccagccggcactgaacctttttgcccgcgacttttacatgcttttggagacggaggacgaaaggctggcctaccggacattgtaaatttgaatatatgaaatccattaaattttcaaattttttgagttttgtagaattcgtgacgttttggtgctgctgggcgctgacccgcgaattgcggagcgcgactcgctggagattctgcagtttgagacggagttggccaatgtcagtt

SEQ ID NO: 80137 - DNA, 1166 bp, Heterodera glycines
  Genomic contig location: Contig_ID=SeqID_15816; Location=678..1843; Strand=+
  SCN-specific regions: Sequence locations=1-61,103-187,209-219,244 -250,272-443,465-541,567-615,646-780,811-1141,1163-1166
  Gene Ontology: Mol. function=endothelin-converting enzyme activity; Cellular component=cytoplasmic vesicle membrane; Biological process =cell-cell signaling
atgaattttggcggcatcggagtggtaattggacatgaaataacgcacggtaagtgccgaaaaattctgtaaattactgtaatgcagttatattttttgtataacaattaaaaaataatctccacaggttttgacgatcggggccgactctacgatcagtatgggaacattcggcaatggtggtaagattttttgcattaatttttgttggcattttgtcacttttttaatttaaaaaatttgagggacaatgcaacaattgtcaaatttgaagagaaggccaaatgcattgaagatcaggtgaaaatgaatgagggaatggtgtaataaaaattcaattaaaatttgagaaaattaaatttcttcctcagattttatacaaaaaaaatgagttaaaacaaataaattggaattaatataaattttactgattttgtttttttagtattccaattacattttggaccaaatttcaatgaaaatcaacgggcggagtacaaaaggggaaaacattgcggacaatggcggactgaaacaaggcaattaattaattaataattaattaaacataattgttttttcattttttcacccaatgcttcggttaattaatgtaaaaatgatcttaaattatttaccattttagcttatcgtgcctacaaaaagtacgaacgctttcacacaatgccgcagcaattgcccggcgtcaatctgacccaggatcagctgtttttcctgaattatgcgcaggtaaaattcggggaaagtttttccaatttgatttaatatttaataaaatttaatttaaatccacagatttggtgtggcattatgaacgacaaagaggccattcgcaaattgagaacgtccgaacattcgcccgggccaattcggtaattggacgggcagttttttattttgcgggaaatacagtaattgaaagtcgggacagaaaattttgcaaaaattttcaaaatttgcaggctccaagtatttttcgaccaggcacatagcaaatttaggagggagaatccgaataccttttgttgctcttcggatttttttttcagtattattttaaaaatggcagtgccgggaagaaaaagcaggcatttgtatccgcttttcgccaaaaaatgaacaaatttctgccattttgggtttaa

SEQ ID NO: 80138 - DNA, 2093 bp, Heterodera glycines
  misc_feature (1862)..(1862): n is a, c, g, or t
  Genomic contig location: Contig_ID=SeqID_15818; Location=382..2474; Strand=+
  SCN-specific regions: Sequence locations=1-1021,1183-1543,1570 -1676,1712-1989,2045-2093
atgttcactgtgtactcaattgtccacctcctgctgacgtgctgccttttgctggccataacagacgtggtcattagtgatccactgccacaaaatgcaacggttgctgatcaaccaacagaaacgctgaccaatcagactgtcaccgcagaaacaacagcagcaactgaatcaaccgcggaaacggtaattgcagatcaattactgtagcaacaattttttctcatcattcaatgccttccagacaattgccacaacagcaactgatcagcagaacgttacggtcaatgagagcattgagacggtaagagaaaatatcagcatataaaacaactgatcattgaaccgtaacccattttaagacagtaactcaaacggcatctggtccgactactgtcatcaattcgaccagcactgaaccggtggaactgatcgccgatgtcgacggcggaactgatcaagcccttcaaacatttaatacaacagcgcaacaaagtgatctgggcaacatgcaactgttcaggtgatcatgatgctggtatacggtattgatcagccataaaatcaaaaatttcagtcaccagtgcttacatccgagattgatcagcagaatgttacactgcagaatgccaccgttattgaacctgttgctttgatcgctgcaactgtaaacggcactgatcaagcagccgctcaaacacttttcaatgcaacagctcaacaaattgatcagaacaacaacacaactgtaatggtatgatgtgtttaatcacttttttacagtaaccgattttcgctcttttactgtaaatttagtacggtcacgatcagaaattgaaaaaaaacacctttaagccgttgcttgcttcgacaaatgagccgaacattacgctcaatttcactgttgaatcaatgcatctgatcacggacaatgggaccgatcagaatcgtactgatgaggccggagctgcgggtccttcagttgctggtggcgaactgggaggtatattcttgaaaaaatattcaataaataattttaacaaagtaatataatttaattaataattccaattaattaataaaaaggaattttaacaacttcatctcatggacaattaattatgtacttagttcattaataatttaataataaaataaacattggattcaacaataattaatggacgctcaataattgttattattgttcaaaaaatcatataaattatgatcaaaaataaattgttaaatatcattaaagaaagcaaaaattatgattaatagaaacgaattcaattaattataatttttttcttcaggcgaagtgccgcttgtgtcttcagggcaggcggacgaacaaaatgccaaaaatgagagtgccagtttaaacgggactgccagcgctgtgtcatccggaactgtagttgacacaaccaaattcataccacatggggacgacgattgttggacagaccaaaatggggaggacacaccacggtggtttgccaacggggaccaggtatttattaacattaattaggtataattagtcaattaattaattaattatacaccaatttatgtcctattcgcacagattgagcgcggcattgtgtggtacgagtgccaaaagggaaagcttgtgacacaaggatgtattgacgagaatgggcaagtttaaaaataattttattacaaaaagttttttttacagtaagcgcctgaaattaaacggtacctaccagttccgggcgttaccgtatgaaatgtatgccgtttggcgagaatgcgcgtcgacaagggatccggctgtgtgccggacggacaattggacaaaacgtacctgcggggcgaaaagttgngtgaacagcgaggtaattagcaatattttaaatgggcaagtaaaaataataattaaattgtgtgtgtagaaacaaatttggtggcaatgtgtgctggaaaatgcgtggcttggcggttgcgttgatgaagcaagtggcaatcggttaaatgttggcgatgccattgaccgcaatttgactacgtatgaatttatttcatttttcaccgttttgccaaaattggcattttga

SEQ ID NO: 80139 - DNA, 1133 bp, Heterodera glycines
  Genomic contig location: Contig_ID=SeqID_260; Location=662..1794; Strand=+
  SCN-specific regions: Sequence locations=1-17,89-180,202-320,343 -375,404-405,427-447,470-504,533-537,566-596,633-691,714-795,829-1133
atggacgaaaaagcagtgaaaagagaacagaagcagagaagaaaaagcgaggatagaagagagggtgaaaagaaaaagagcgaagagagagtgtgggaacagagaaataagcaaatcctcccggggataaactcaattttttaaatttggacaaaaatagaaaaatggggaaaagcggaagaagagggtgattttctcggaatttttggtggtcaagataatttcaattatcagaaagcagcccaaatcctccgtgggaaaaggattggattttcgggattttaaattcaccgagcagaattgcagaaacttcgcgccggaaatttaccattttttattaaacttttaaaattcgtatcgccagacccaaaatctcaataatttttcatttaaatagactcaaaatttaataattttttgataaaatctattaaggttcgttaccctctttctctttctgatagtttttggtgaaatcattaaaaaacccttaatttgaagcatttttgtttaaataaataaactgtaaatttccctagaaaagaaaagaaatataatttaataactagccagatgaaaaaaatcaacaaaatctatttgaaatttaataaaaatatcacaaataaattctcagtctgtccattttaaattaataatgtaaaaagaattgtttaattgattgggtttattttttattcatttcttgaaaaaatatcaagttttgaaaatgtttaaatagttcgaatcttttttgattcagattatcattttcgtaattttccaatcatatcccgcatataaattatttatttttaatttgttttatttcaattgtcaccttcataattatttcgccatatttattattttgttaaacaatgctaattttagaagcttatccaaatattcattgtttcttgctgttttttatgggttggggactgaatttaatcacaattttaacaattaaaatcataaaatattgtcatttttggactaaatttgttcgcaaagtgcactgaaaatttcaaaattttccccggcggcgttgactcaaaaacgcgcaaaaaaactaacgaattttttgttttgtgcgttttgaaatgataaatattttaccaaattgaatcaaa

SEQ ID NO: 80140 - DNA, 69 bp, Heterodera glycines
  Genomic contig location: Contig_ID=SeqID_260; Location=88..156; Strand=+
  SCN-specific regions: Sequence locations=1-69
tgacataaacatttatttgatttattttaccatattcacaatttgatcaaaatataggtggtcaaaagt

SEQ ID NO: 80141 - DNA, 494 bp, Heterodera glycines
  Genomic contig location: Contig_ID=SeqID_260; Location=4192..4685; Strand=+
  SCN-specific regions: Sequence locations=1-13,35-46,68-127,151 -233,255-494
atgaccaaaagaaataattttgattttttattggctagcaaaatggtaaaatgagacttcttttgagaaatttcttgtttttgagcaggtttgtttcagtttatagaagaaaatatttttggcctgggatattttgaaatatgtatatatttggcttctggaccagtcagccgaggacaactcacaaatcagctgacagataattccgctgatggacaactcagccgtacaataaaaattacaaaataaatcctaagcttaagcctaggtccaagcaagcctaagcctatgactcgcctaaagcttaggtaagcctaggcctagcctaagcgattgtacgagttgccttttgtaaattctcgtaaagctgagttgtccatcagccgaattatccaatctgctgagttatcctgacacgatatatttttcataattggcgtttttttagcaaatataaatccgttcaaatataaatccgttccttggatataaca

SEQ ID NO: 80142 - DNA, 363 bp, Heterodera glycines
  Genomic contig location: Contig_ID=SeqID_260; Location=10191..10553; Strand=+
  SCN-specific regions: Sequence locations=29-112,133-146,178-363
taaaaaaataatttttaaaattaaaattcttgccacgaaaatacctttttgagaaaatttcatttcttaggagtgctttttgaaattttttttgtcgattcttaggggtgtattttttttttttttttttttaggtcgattcttaggggtgtattttttggttttattgcatttttgttaaagaattttccaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaatt

SEQ ID NO: 80143 - DNA, 348 bp, Heterodera glycines
  Genomic contig location: Contig_ID=SeqID_260; Location=4975..5322; Strand=+
  SCN-specific regions: Sequence locations=1-156,179-298,321-324,346-348
atgccgggccgggccgggctggtttttccaggagtaaccgggttccggtcccggcctctcaaaacccggtcaactcgaaacccggtcaacccggcttttcaaattgccgggcccgggaccgggttggtaaaaattttaattttcacatatatttcaactccaaaattgaccaaaaagcgggtcaagtgttaaatttctgcactatttcacttcgggcgtaaataaatgacatcttcaattataaacctagaatttttcaaaaaaaaatcttagaaaatttttctatgagaatttcaagaattaaaaattaaaattttatagcgatttttctaatttttgtaatgaata

SEQ ID NO: 80144 - DNA, 344 bp, Heterodera glycines
  Genomic contig location: Contig_ID=SeqID_260; Location=8061..8404; Strand=+
  SCN-specific regions: Sequence locations=1-315,341-344
atgagcgaaattaatgcttattgttctaccggcacaattccgaccaattctgatcctttagagttttggaaggaaagagccaatgaatttccgggtattttaatgtggttaatttattaaccggttctaaggttttacacattatttagctttggcagaagaagcaaacaaatttctttgcattccggcgacgagcgttgcaagtgagcagttgttttcaacagcgtgcgacacatacgactaccgtcgccgccgcttgcgtccaagaaaggccgaaattctgatttttttgaatcgaaatcttccaaaaattcaatataaatattaaaaacattttactgtta

SEQ ID NO: 80145 - DNA, 195 bp, Heterodera glycines
  Genomic contig location: Contig_ID=SeqID_2510; Location=298..492; Strand=-
  SCN-specific regions: Sequence locations=1-69,118-195
atgatgaagaaaagggtcaaaatgacgcaatcattcaaaaaacaattcttctattggaggtggatttggttattttctttttatttgtaattaaaattattattttttaatatttttgaaaagtttttctcttggaggtttttattaaaaactatctatctctttattttatgcctttccattttcaggttgtaa

SEQ ID NO: 80146 - DNA, 1928 bp, Heterodera glycines
  Genomic contig location: Contig_ID=SeqID_2510; Location=798..2725; Strand=+
  SCN-specific regions: Sequence locations=1-54,77-102,144-271,293 -306,344-361,383-427,449-461,511-773,795-1017,1042-1234,1256 -1296,1328-1447,1477-1880,1914-1928
atgaaagtgtttgtgctcttaatttgtttgctgttcataacaaaggcagaatccgttgaagaaaagcagccaaattatgatggccaaggttttgttttaagcaatttttaattaatttttaaataaattttaatttattttttcagcaaaatcttgtgacaatttgttctttttttgagttttagattttgacaaagacgatattcaaacaatttttgaagatgcggttgactatgcccaagctttggcattggtcactttgccgcacacacatgaaggaaggtgggaaaaatgcctaaaaatgtctaaaaattatatttaattttaaaattttaattttaaagaggtgacgaagcattgattcacccgtttacgctctttccgactccatttccacgacaactttacgagcaggcgatagaactacaatgggtggggaaaaagaccaattattatgggtcaaaaaaatatttaaaattttaattcaattaaattaaattaataataattcgtctcattaggcgtacaatttgttgtatttccgaatttcaaatgacttcgattttctcattgaacattatgaaatagcagcaaaaacaaatgcgcacgtcagacactatttgaacattatgaaagaagtcaaaaaggagggcattaaacagaaaaaaacgctgcttttaggacgatcggtaaattttaaaaattattcggttaattaaacaactttttcatcataattaaacattaggctaaatttgtttagagagtgtagcgcccaacgggcatttgcccgtttgacccagtaaattttgagaaataccgggcctgctgggtccggtcattttgactggtcttttacgggcttaaatttggcttacgaatctgtcccatatttaaaattaccttgacaaaatatctttaattcgaacttttaaagatagaacttaggatttttttaataagttgggacaaattcaacacagattttagttgtcggcaccgccggtccaagatttcattattatttaaaaaaataaaattggggctccttaagcaaatttacttattcatttaatataaaaaatccggtctcctcctttccagaatttgaagaaaaagcgcgtcgcaaaaaaacatttcgaaaagcaaaaaaatcagcaaatttttgaatcttatgaaaaagaatttaagttggattcttgaaaattttcggtctcatccctgttatattatgattttcttacaaaaatggaagccttaaagtcacaaaaatgttcctaattaagctgacaaatgagcttaaaaattaaaccttttaaaatatgtgaattaaaatttttcattcttttacattaattaatcttgtactaaaacagaaggttaaacgatttttttttgttaaattctaacacagacccggcagtttcaaaatcccgtgctcaaaaacttataaaaataatattaataattttaaatccaaaaatgttttaggattatatgtgccatgttgtgaaagacgagaactcagaaaaaggagaacgttatgagctaaaacaggcaaagcatcaaaataagccatttatttcccgcaaatcgaaatttcactttttaattatttcagattgaatttaatactggccaacttggcggtgtccatctcgcgcgtcttctcacccaactgcaccgtcggacaatgcaaaaagcgggccttgaagcatccaaagatcagcttctgaacaatgggtcggactttgtcatcgccgaagcgttattcatggcctggtaattttgggaataattatttttttttgggataaataacatcccaaaaacaaaaggtaattttgggaattgtatttttattttttgaaataatacccataaaatttaatttctattttaaatatttaatacctattttcgaccta

SEQ ID NO: 80147 - DNA, 1827 bp, Heterodera glycines
  misc_feature (624)..(624): n is a, c, g, or t
  Genomic contig location: Contig_ID=SeqID_2511; Location=3623..5449; Strand=-
  SCN-specific regions: Sequence locations=1-98,120-145,168-522,544 -551,621-749,773-837,860-943,965-1018,1045-1352,1374-1472,1496 -1735,1799-1801,1823-1827
  Gene Ontology: Mol. function=structural constituent of cuticle; Cellular component=extracellular; Biological process=cuticle biosynthesis (sensu Nematoda)
atgaacaacgaagtcaactactgtaaggtaaacggtgaaattgttacaaaatgcatactgtaaagtacaataatagtcgattatcagaggaaccttcacaaaatgcctttatggttacaattctgctattatgggttatgagtaaaattaaaaaatatagtttttaagggtttgatcacaatatatttttgcagggttccgctcatgacatttggtcggaggtgaatcagttgcggcacgtggtgccaaccgggggagcggcgcacaatcgtacggctcgtcaagcggcaggctatggcgaagccgcagcgccatccagcggggtggcaggcggccagcagcaagcggccagcgggggcggctgcgacgcgtgttgcctgcctggcccgccgggaccagccggcacgcctggcaaaccgggccgtcccgggaaaccgggcgcaccgggacttccaggcaacccgggcaaaccgcccacccaaccgtgcgagccagtcacaccggtgaggctggaattttgtgttttatcaaaattaaaaatgtcaaacttcttataaaaaaactaatgaaaaataagaaataatttataaaatattacaaaaaatgattatttatattttctanataacaatgtaaaaccaaattttcatgaattgcaaagaaaatattataaggttaaagccagtgcacagctttggtgttaaaccgtgtcgattatagaaagaattgcgctttggcgccttccattgaaattttaattaaaattgggcaacatttagccgccgtgtaagccttgccctgcaggcccaccgggaccgcctgggcctccaggaccgccaggagacgctggtgggcctggtcagtctgggcaacccgggcaagacgcaccgcccggtgagcccgggccaaagggaccgcctgggccgtcgggccagcctggacagcccggagcacccggggagcccggacagccagcacagtcgcagccaattgttcccggtccacccggagaacctggtatgaaagttgtaaaaattgtccatccatcactaaaaaaattgttaaggtgatgccggaccacctgggccccccggaccgcctggcaacgcgggacaagacggactgccgggccaacctggtccgaagggacctcccggcccgcccggatcgcccggcaacgatggccaacccggtgcttctggtcagcctggacaacccggcggacagggcgagaagggcatctgtcccaaatattgtgccatcgacggcggcgttttctttgaggatggcacacgacgccgttaaagaaaacaatcaatggaaaatatgttatccgaaatggagcaaaattaaagcacttttagttaaatacaacgaaattaatacattacaattcagcagtaatttgggaacagtcagaaattatgccaaatagtacagggctcagcgattcaaactttctcagcactctgaatcattttgaaaaaatatagaagaggagattttaatagattaagtgcctcgagcatcaatttgcgtcttaaaatgttattttttaaatttttaacggtagtcttttttgaatttctaattagggaagggcgtgacattaatccggaaaaagtatagatgttatagaccattggataaagcaggttcgatttgtgttgtgaattttttttgaattcagaacatgtctgataaagcagaataattcgccctcttattatgtgaatttttctttttggtggccttttaaacattaaaattaattggttaataattgcaaaattaattcattccaaattttatcaaaaatttaataaa

SEQ ID NO: 80148 - DNA, 745 bp, Heterodera glycines
  Genomic contig location: Contig_ID=SeqID_2512; Location=2322..3066; Strand=+
  SCN-specific regions: Sequence locations=1-330,352-499,521-745
atgaatgaaattcgaatatgtaagagagaagaagctgattgattgctcatttacagacggacaatcagcaaatggaagagcttcggaagcaggaggagcaattgtgggaccaaatgagcgatgtgaaagacgaaaagcaaagggagaaactgaacacggaactgcaagaagtacagggcaaactgaacacaatttatggacagatgaagcaaaaaaacacggaatagagaaggagaacaatttggaagtgattgatgatcgatcgatgagacacaaaatattcgagaccgaaaaaaaagaattttctcgagtagaaaaaggaaaatcacttccctaaaggatgatgaagaatggcgaactttgctgggctcaaaacaagtttcgcttcttagaaatgtattttttccggcaaaattaatcgaccatttgtcaaacaaaaattttgcgaattgagtttcgggggtgttctaaatctctcacaaatttttgaaattaaatggaaaatttatttaggaaaaacgccataatttcggtaattcgtaaactaggaatacgatttttaggttctaaaaaccccccaaaaataattgttaaaaatgggaaaatagttgctaaaaactagagtgcagcgggaccgggaattttgggcttaaccgggaccgggaccttttctggttgaaaaccgggactagtcccggtcaaaaccgggaccttaattttaaaaatcaaaattcttgtcaagaaa

SEQ ID NO: 80149 - DNA, 1199 bp, Heterodera glycines
  Genomic contig location: Contig_ID=SeqID_15822; Location=423..1621; Strand=-
  SCN-specific regions: Sequence locations=1-5,32-272,294-670,694 -1001,1023-1199
atggcggctgttgctgctgcggctgttgctgtcggcacagaatccatgccgaacttcaattgcccaaaagtgcgtattcgccaggcgagaatattgtcggctcatttcacatcgattcaaggatggcacgctatgtcatcgacaatgtaaattataaatcaaaatgccaccggtatcgctaaattatgccaattaaaacctttttaaagattgaagtccgactcctggacggagcggaacgaattcaatctgctgttgctgatcagcaagatgcaaagaaggaggaagataaagtggcaccggaaagtgggacagatcagcagaatgagcctgaggctgaaaagcggaagaaacgaaatgccaacaagaaaaaactgccaaaaacacgccgggaaaagcatgcaaaagtgccggaggcgtcgtcagtgtgccaacgagttgtggccggaagaaaattggatggcaacgctttgttggcagctatgccggaggaaaagcatgaaaagaggcggcggcgcttggccaggctcggcatggacaacgtggtgttcatcaaagtgccggccgtgatcccgacaatcgagagtcagtcagtctgctaatggctaacgcgtgtcatatctttgtttgcacatagatcaagctcattttgatcatccttttgggacagaaaaaatttataaatttttaaaagcttatttctcatggctggtctgaaatttgtgacagcagaaatttggataatgaataattgacgctaaactgtatactcttttttggacaaattaattttcttatactgatcagttgcagtattttttttgttaccatgatttctgtctaatcagaatttgatatacaatttttggacctaaaaaaatttcaaaacactgctcagtttttttcactatttttgttgcttgatgagactgtctgattagatgagaattgattttggcacaaacacattttattcactgtgtttgttgcaaaatttaccgggcattttgatcaaatatttaagaattaattcactacttatcattactctattcataggagaagtagcagatgatcagcaaagtgtgcagcatgaccaacatgctcaacaaggacaacgcgttctgatggagtcgccttcgaccgcgacaatccgcgcgcgacgagagccgttcattggggtcaaatatgccttgcaa

SEQ ID NO: 80150 - DNA, 257 bp, Heterodera glycines
  Genomic contig location: Contig_ID=SeqID_15825; Location=1374..1630; Strand=+
  SCN-specific regions: Sequence locations=1-87,110-220,255-257
atgaactgtcagcatataaaatcgaaaagtataaaaaaacatatttgtatattgtaaagaaatctagctaccaagtggattgtaagtttaaagtaggaaaacatgaacaaaataaaagataaatacaaagtgaggaaattatggatttctaacaaaaaaaattaaataatcggatttaatatttacttttaggttctaattataatgaatgaaattgctaaactaaagtaaatatttttaactttcaaaacaaggca

SEQ ID NO: 80151 - DNA, 699 bp, Heterodera glycines
  Genomic contig location: Contig_ID=SeqID_15826; Location=167..865; Strand=+
  SCN-specific regions: Sequence locations=1-198,272-282,304-435,457 -597,619-627,649-699
atgaaaccgaaaaatttctttgttctaatttttccgcttttcgtttgcttttcgatttttgaagggatttcgtcttacaaatgggactcgaaaaacttgccgaacaatgtccatacatttgccggatttatggacgatctttatgaggattacagggtcaaaggacagatgggtgagtgactttattgcagcaaattcaaaaaataattatttaaaatttactctttttaaaataatatattcttaataaattggaaaattaattatttttgaatgcgtttgcttttgaatttaaaaatttttgtataaaattgtcagactttttcagacatacattggctaaaccaaccaaaattgtacacggaaaaaggattttcggataagcaaaaaagaacggttttcaatttgacatttgtaaaatgtgcggcagaaattgcccatttccaagtgcttagccaaaacgacgattcaaaagatgcttatctgaatttaaaagtggttactatcagtgaaataaaacttgtaaaagatgaatttgttggttttttgcattttgaccaaacacttggccaacaaattgcaaaaaaattcaaagacgaaattttttctaaagaaaaacaaattcccgaagaagttgtgcaccaaattcagcaattggccttctcatttgccgcccgagtcattctcagcataatgtaa

SEQ ID NO: 80152 - DNA, 1206 bp, Heterodera glycines
  Genomic contig location: Contig_ID=SeqID_15827; Location=1025..2230; Strand=+
  SCN-specific regions: Sequence locations=1-247,293-365,387-415,440 -451,474-573,595-875,897-1206
atgaagaaaaaggttgtacttggattattgaaaaaccttatttcgggagtcaaaaattggcccaggttcgggctccgagttttttcaaaattcattctctactaattattgtaattttttgcctcaaattaactccttaacaccattttaagaagcaatcaaattgagatggaactgtttaatgagccgttgtggaattatctgagagtttttggaattgatgccaatgtagccttgggtaaagcacattaatatatgtaaatttaaaaaacaaatagttaatttaatttatgcataatatcattttttagacgtgttcaaattttgcaaagaccttcatacagttgtccagaaaaaaattgaagaacataaaaaatctgtatttgataaaatgaatcttcaagttaaaaatgtgacaacagaaatgaaagaatttaaaaatttgaattccattcttaagttagtagaagataaggaaaactcaacggcattggaaaatttttcatcaaattataagggaaaaaatttatctcagaaaaaagaggtattaaaggaactgttggcaattttaatgaaaatctacacggactacagcaatgccagcaaaaaagaaataagcaaaaatgccattcggttgacacattctgggaatgtaactttacgatttggacaaattttatatgaaacgatagagaatttggaaaatttgccggaagaccgcgtgaagtacgatgaaaatgaacaattgctaagcattttgttaccatttgccaaccatttgcttaagcggctctatgaatttcttgaaaggtttgtaaattaagcgcttgggataatttgccacatttggccaaaagtctctgccgttggttaaaatttaaaaatggtttaattaattctgatataaatgggaaacatagaatttttaattactttttaagaaatttaaccgagaaaagcaaaatcagtgatgactttgattttgtgcaaacacttcaaacagttgccgaagagagcacggaattagaggcggagaaacggcaaatgccaatttcggctggagttaatgtgaacttgtttcaattgcttttctcattagcaattcgtttgtgcttactaattgacgaaaaagaaaaattggcaaacaaatatttgccaaaattcgtattcgcgttgaaaatgtgcacaaaagaaactaggtaaaaa

SEQ ID NO: 80153 - DNA, 106 bp, Heterodera glycines
  Genomic contig location: Contig_ID=SeqID_15827; Location=2403..2508; Strand=+
  SCN-specific regions: Sequence locations=1-70,104-106
atgaaaattgatggtaaaaatgtgcacataaatttaagaaattggcatttgccttactttgtgtataagcaaaaagaagatgaatttaaaatggaaaaagaggaag

SEQ ID NO: 80154 - DNA, 570 bp, Heterodera glycines
  Genomic contig location: Contig_ID=SeqID_15830; Location=857..1426; Strand=-
  SCN-specific regions: Sequence locations=1-104,126-209,245-570
atgatactgcttgatcaaataggtctttttaattacagaacacatgtgaaatcctcggaaccccgaattgcttcatcatcacttactgttatgaaagcagatcttcagcaaagcattccatcttctttagttcagtttgagtgccgaggacaggagaaaaaggtgagctctttttgtaacatttctaagctttggttttattaataacctattattttttaaatgattaaattttaaaattttagtttactgatgaacagattgtgcatgttgtagtgcatcggatggtagcacaagtcatcagagatgaaatgtccaatatactaactcacaaagctattccaaacgaaacaaatgttatgaaaccgataactgatgaacagattgttcgtgcaactgtcaacagaatggttgccattgtcacatttgaagtaaatcaaaaggaactaattgcattgaaaagaaagaatagtactgttgaacaagacttagtgaaaaaacctcgtactgatttataaattgttttatgtgaattgcttgatttatacttttttgtctttggtaaataaa

SEQ ID NO: 80155 - DNA, 1016 bp, Heterodera glycines
  Genomic contig location: Contig_ID=SeqID_15831; Location=580..1595; Strand=-
  SCN-specific regions: Sequence locations=1-87,114-160,194-543,595-991
atgaaagactataaagtcagttttgtttgaatattttgacctttgactttttttttgtaagaggattgtttcatggcaattcgttagtaaaaaaaatttttttaattaaattagaattacattttttctcaaaaaaaatcagaagaagttccctcaactgaaaaattttaattgaaattataattttttttttgtaccaaatgccattgtacgaactgccattgaccctgtggttgggcccaaaaattaaaatttcgcaaggacataaactaaatttccaatgggtttctaggacaaacaagtggatgacagcagcgatggcaaagctggacaacaacaacatccacaatcggatggcgaggacgacgagcaacaccacttcaggcattgtgccgaaaccgactcggatgaggagacagcgtcggcaaataatggtgagaaggcgccagcgtttaatttaatgaaatttttttttgttttaatggaaaaagttttttttcttttaagaagatttttttattcattttattgcaatccctctccaaaaataaataattttattattttagaaattaaaaatatatatttatttatgaaacataattgttcggaaataggttaaaaaacaggtggtaacagcccgaaaaagcttttttcgatgacaaccaaaatggagaatttttggcgctagttaaaaagcgttacattttgaaagttttttttggtcaaaaattttttttgtttttttttttgatgcagaatctgtttttttaatatatgatacgcatttcacgttatttaataattgaaaaaaaagtgaaaaaaatttcaaaaagatacttaaaaatcgtgaatatacttttattcgccataattgtgctgttaatgcttaatattcatcattatgtgtaaaaaaaaaaaaaatttcaaaaaaaagtgaaaaaaatttcaaaatgtaacgctttttaactaacgccgaatttttcataagaatttttaaaatttaagaaaataaa

SEQ ID NO: 80156 - DNA, 1535 bp, Heterodera glycines
  Genomic contig location: Contig_ID=SeqID_15832; Location=1..1535; Strand=-
  SCN-specific regions: Sequence locations=1-250,272-357,379-390,412 -611,645-737,760-1040,1093-1395,1427-1535
  Gene Ontology: Mol. function=protein binding; Cellular component=ER -Golgi intermediate compartment; Biological process=intracellular protein transport
aagtttagaaaattttcgtatgtttacaaaaaaaaaaaagtcagaggcaaaaagttcaaaaatactgaaaatcttttgaatatatgtaaatgtttataaaaaaagcttccacaattttcaggcattggccagaagggctaccaaaatttgatagccaaaaattcggcccaaattcgtgaggctatgctgcaattaatggacaaaaattatccaaatgagaagagacggcccgccgttttgccggtggaatggcgctcggctttgacattggatgaaggtggaaaatacattatgcttctacattttccctttatccccattttttcgatattaagcatttttaaagtatatatttttaattcgattttttatgtaaaatcggaattaaattatgcaatgtattttgtaaatttgtaataattactttcaaaaattattttgtaaatttgtaataattactttcaaaaattaaggtgtcactgatgtggcaacacttccaaaagtcggttttttgacatttttgacaccaaaaaaaaatttaaaaaattcagatggaatttgccaggtccacgctcaattctactttgatggacctggtcggtcgtatttccatttatttaaattttattttatttatttattttgatatctttatagatgtattaccaatcaccgttgtaccggacagagattgtgaacggtgtaattcgatgtttgaattcaatttacacaacattcaaagccaacaacccaaactttgatggtatggatggatttaaaaaaacaattttttttttgcgttttttcctctttgttggatgcctttaccggagcaggtcgttcgttccccccgaaattaaaattccaaaaattcgggttttttctaattttcgtttttttaatttacgagcccaaatgcgcgatgtttccctgacatatgtcgcatcctttcagtacaatcatgctttttattctattttagaaagggatttctcaaactcaatttttttaattcatcctaaaattttgtaaaaaatcgctataaattttttcttaaaattttcttttaaaaaaattttatagtttttttttgggggggggggggaaactgcatgaatgaatgcatttccataaacaatggttttaaccggtcacagcaaaattgtatgctttacaaacctgtcaggccccgtctccattgttggccattcacttggctccgtcattgcctatgacatcatcacgcgttggtcaccctttttgctgtacgaccaaattgtgtcaaatgcaattgaggagaacatgaacagcagtgtgtcgggcaatcagcgcaaattgtttgaggatttccacaatagcaggaaacggtgaaaaaaaatacaatcaaaaaattcgataaaaaataaaaaaaaatttttaaattttacacacagaattttggaaataccaggcttcatggaacaaatcctgatcagcccggagcaacagattggattcaaagtcaaaaatttgttttgtcttggttcaccgcttgg

SEQ ID NO: 80157 - DNA, 396 bp, Heterodera glycines
  Genomic contig location: Contig_ID=SeqID_15833; Location=74..469; Strand=-
  SCN-specific regions: Sequence locations=1-62,84-160,190-396
atggacacaattctaacaaaaaggaaccgtgccaagcttcagcacaacggccattcatacacttttcacaagccgagtgctgacggtgaaattcgcttactgcagaatgtggccacgccagtccttgcgcaactcccaaccaaacagcgacagcaagtgatattttattatttttcctcaaatattttttgtatatttacataatcaggcgtgtacgccgtgaaattgacgcaccgccaccagttccgaactgtgtggcaagacttcaacccggacagcgtgtcgatgcactttgagacaggggcgatcactgcgctgaatgtagtcttcacccctggaattattgctctggacatggctcttcccaacgaacttactccagtccttgactggtaa

SEQ ID NO: 80158 - DNA, 331 bp, Heterodera glycines
  Genomic contig location: Contig_ID=SeqID_15833; Location=919..1249; Strand=+
  SCN-specific regions: Sequence locations=1-44,66-86,108-163,185-331
  Gene Ontology: Cellular component=nucleus
atgaaaataagtgaagaaaccataagaaaacgactccaatcaattaatcaaacacaagaagcagttcaaacatgctcaaaatgggttttacataatcgtgaaatgattgacagaattgccacctgttggatggatatctacaaaaagggtattcatttattcattcctgtcccttaaaacaatgtatgtaatttcagctcctgagaaattacgcatcgcactcatttatttgttgaatgatgttgtgcaaaaagcagcaagcaaaaaggataataatgtaactttggctttgcatccacactggataaacgcaactgcgatgtccaagtag

SEQ ID NO: 80159 - DNA, 1274 bp, Heterodera glycines
  Genomic contig location: Contig_ID=SeqID_15834; Location=183..1456; Strand=+
  SCN-specific regions: Sequence locations=1-469,491-546,573-630,653 -708,738-1228,1271-1274
atggcctcgtttttggagagcgttgaaaggcatcggcaaaaagggatgaaactcatggaattgatgcaatatgccaaacagaccttcaatttgcagttgagggatgtgaccgtagtgaacgatgtatacatatttaagcgacacatctatagcacataaacgaatgttcaggcttatgaaaagtttgccgaaggaatgcgtgaaacaaaacagcaactcgaaaagatggaaaagtcaggagcgttgaccagtctggacgcaccttcttcgcccccacgagatgcaccatctccaactgctggtgatgacccattcgtacacggagtcgaatgcgatgaggcagtgggagcagaagacatggagatggatgaggagtacggacccggaccgagcagctgttttcttaaatcttccaaggattatgtcgcgtctattcccgccgtacctgaaatggacccacgtttgcaagtaattaaaatttggatatttttaggtattatatggtacacctcaaaaagtcgccgggccggtacatagcgtcgcagcaaaaaataaataatttttaaaaattacctaattttaaggtgttttcaatcaaaattattgttttttttttcggtttttgtttgagttattttattttatcaaatttcaatttctacacatgagatacaagataaaaaaaatttctaggtgtagaattatcaaaatttacctttttaatatatatattttctttatagcgtttggtgaatcaaactatttctgcttgtcaattgtccgacaacagtaatataccaatgccaagcgccagtttaagccgaacaacgctggacccccgtcaattggaccctcgtcaggctcgcttttttcctcctcctcaacaacctccgccacaattaacgcaacatttaaactttccacctccaatcattccaccgcctggtctttctccaccgccagcaacacaaaacgctacacaagatactgccgaaacactgcttaccattgataaatctcaacctccacctcaatttttttcgatgcctccgccacaaattccaaatggaaatggaaatgtcacagttctccatgaaaacgcttcaaattcgcatgggaggggctccactctctcgccaccaattgcgctttttaatccatcaaatcctccgccatcacttatggtatcgcaaaatcttattattttctttagttattttaatttcctaaacttattttcatttagcatatttcacctccttcttctcatatga

SEQ ID NO: 80160 - DNA, 249 bp, Heterodera glycines
  Genomic contig location: Contig_ID=SeqID_15835; Location=1266..1514; Strand=-
  SCN-specific regions: Sequence locations=1-249
gcggtgatgggcgcttacaacgaaaacaatggcaccatcgaagtgccattacatggttacaacgtcggaaaggcgattgttgaaaggattttgaacacgaaaaacgggacggtgcttttgcacggaatgcgcgaaccgatttcactggcaaaggccgtcgaaattggcttttttgacaacctgtcgctgactgtggttgacccgaacaccacgcaaaggctgtttttggacgaagcattgaaacggaaa

SEQ ID NO: 80161 - DNA, 249 bp, Heterodera glycines
  Genomic contig location: Contig_ID=SeqID_15836; Location=796..1044; Strand=-
  SCN-specific regions: Sequence locations=1-249
atggacgaggaattgcatcggagaaggctgggaccaaaggctgacaccgagggggatgaagctgaaccgttgctgggaggacgcgtcacggccgagcaaatcgtacaccttttgagacaaagacaaatgagatatgccaagctaaagcttggagaaggattttaccacgacttggacaaggaactcgcaaatggcattttgcgggagagaaaacagcacggagttggactgcttaagctgacattatga

SEQ ID NO: 80162 - DNA, 415 bp, Heterodera glycines
  Genomic contig location: Contig_ID=SeqID_15837; Location=519..933; Strand=+
  SCN-specific regions: Sequence locations=1-45,67-124,146-415
atggcctataaagaacaaaaggtaaacgaggaaaagaatttggcatagaattgaaagaattgaatattattattcattattcagtctccgcaacaacaaaaaatgatccattgacttccgacgaaataagccctaaagaaaagaatgttggtgaagaaagaacggtccaactaattcactgtcctttcattactcagtcgtttattgggcggcagaattaatgatgcgtgccgaaaacggttcgtctacccgaaaaatcgaagtttggcatttggtggcccaaaaagtttgcattttctcgccttttaagacgaaagtcgcttagcaaatggtgagtgaaaacggcagcagaaggatgaacggccatcccaaactcaaaatgccatccccgccttaattaaaagcagccaagcga

SEQ ID NO: 80163 - DNA, 1784 bp, Heterodera glycines
  Genomic contig location: Contig_ID=SeqID_2513; Location=551..2334; Strand=-
  SCN-specific regions: Sequence locations=1-897,920-1317,1339-1784
  Gene Ontology: Mol. function=creatine kinase activity; Cellular component=cytoplasm; Biological process=phosphocreatine metabolism
atggctgtccctcaggaagtaattgacaaaattgaggctggctacaaaaagcttcaggtgcacacaatgtgtgtgttaactattctaattttgaactaactttcaggcggcggctgattgcaaatcgttgttgaagaagtacctcaccaaggacgtcgtcgatgcatgcaaggacaagcgtaccaagctcggagcgacttttttggacgtcatccagtcgggggttgccaacttggacagtggtgtcggcgtgtatgcgccagatggtcagttaaatggctacgcataatcacaaccattaaacattcattcagccgaggcttacacactcttcaaaccattgttcgacccgatcatcaacgactatcatggtggctttggaccgagcagcaagcaaccggcaacggaccttggtgaggggaagactcaactgctgacggacttggacccggaggggaaattcatcaattcgactcgcgttcgttgcggccgctctcttcaggtgtttgtttgaatttaacataccaaaaaacagtcgtattcaggggtatccattcaacccatgcttgaccaaggagaattacgtcgagatggaatcaaaggtcaaagcggtcttcgagcagctgaagggcggtatgcaaccgctaattattttctttgtaacattatgttttagatgccgagttgggaggcacctactatccgctccagggcatgaccaaggacgtccaaaatcaggttcgatccaacaaataataagccattaatttttgaatgtttagctgattgccgaccacttcttgtttaaagagggcgaccgttttctgcaggaggccaatgcttgccgttattggcccaccggacgcggaattttccataacgccaagaaaacctttttggtgtgggtcaacgaggaagatgtatgtttgtttgtttcattccatcttgatatcgattttcaattaagcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgcgacggcctgaaattgcaaatccgcgggattcacggcgaacattccgagaggtaattgtttattgttctgtttttgaaacaattttcctctatttagcgctggcggcgtttacgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttctgttcgagtattgaaccccttcattgcaagtggatactaacaagcgacacccactaatttttattgattggtgtgttaaaaattggttaggaatcagtaaaatggttaaattgacggttcggcacccatgacttatgcgggggatttaaatcggtacatgacaaaatttggtgccatataattagggctcggatttttatgtgctaaaaatcctgaaatatgtaataaa

SEQ ID NO: 80164 - DNA, 339 bp, Heterodera glycines
  Genomic contig location: Contig_ID=SeqID_2514; Location=1515..1853; Strand=-
  SCN-specific regions: Sequence locations=1-40,62-305
ccggccagtggcgacggcatttgcttcgcttttgattgcgtccctttcttctcctccaatgcttttgaaatttgttccttcgcttcttttgctgagtttggtgctgtcgcagagaaataacgtaaaaaaggcaccgtaaattattcgttattttggggttttcttcgcaagggccaaaagtccgtgagggttcgctacccgtggatagcactgagcgatggctacggggaaaagggacattggcagccgaaggcaatggccaaatcattggcgaacagacaaacgacgagaaaagggagagaaagggaagagcaaaagcaaacgaaggacaacaaaaat

SEQ ID NO: 80165 - DNA, 1041 bp, Heterodera glycines
  Genomic contig location: Contig_ID=SeqID_2515; Location=42..1082; Strand=-
  SCN-specific regions: Sequence locations=1-719,746-1041
  Gene Ontology: Mol. function=methionine adenosyltransferase activity; Cellular component=cytoplasm; Biological process=amino acid metabolism
ctcgtcaagaattatttaattgttccaaattcccataaaatgcctccgattccgatggatgttgacgtcgttcctggtcagttcggcatttccttggccattcattcgtttaatacacaatttttcgattcagaagcggtaggtcaaacttttctgttcaccagcgaatcggttagcgagggacaccccgacaaaatgtgcgacattatttccgattccgttttggatgcccacctcggccaagacccaaacgcaaaagtcgcctgcggtgggaaaattgtggagaggcaaattgggttgacgacttaagcgattcagagacagtgacaaagtcgggaatgattttgttgtgtggcgaaataacgagcaaagccaatttggactatcgccagttggtcagggatgtcgtgcagaagatcggattcgacgacgagccgaacaaaggtatgacgaaagggaggaaaattgggggggggggatctaaaaacgaaaggggacgaaatgatgaagcgcgggacttgtcattatttcaccgtacttcaaattcccaaggatttgattacaaaacatgcaaaatcctcgtcgaacttgagcagcaggcgcccgaaattgcggcgggcgtttggatgaacaaagcggacgagaaggacatcggcgcgggtgaccaggcagggcactcactttgctgtttttattgttttgccttctttaagggtctcatgttcggctacgccacggacgaaacggaggaagcgatgccattgtctctgctcatcgcgcacaaactcttggccaagttgcaccagctgaggagggatggctccctcggctggtccttccctgactcgaagtcgcaggtgtgccgagtctttggccgtgccattctcattgcttttctaggtcaccgtcgagtacaaattcaacaaaggcgcctgtgtgccggtccgcgtgcataccgtcgtcatttccgcccagcacaaacagttcgatggagatttggaggtggtccgatcggatttgaaagagaaagtgatcaaagag

SEQ ID NO: 80166 - DNA, 238 bp, Heterodera glycines
  Genomic contig location: Contig_ID=SeqID_2515; Location=1962..2199; Strand=-
  SCN-specific regions: Sequence locations=1-112,145-189,211-238
cccccccccccaaacgaaaattaaaaagtttaataggcaaatttcgtaacaagtagcactcaaatttccaaaaattttttccggcggcgcctatcggcaccgccggacctacattttccactatttttacaagttttttgccttaaaacggccaaaatttggtaatttttagtgaaaaagtgcagttgttacccagcagggaaaaaaagttattggttaaatagcaaaaaaaaaaaaa

SEQ ID NO: 80167 - DNA, 1379 bp, Heterodera glycines
  Genomic contig location: Contig_ID=SeqID_2516; Location=50..1428; Strand=-
  SCN-specific regions: Sequence locations=1-284,306-312,334-798,820 -1293,1316-1379
atgaatgtgatcgttcgtcgtttaattcaaacgctatttgcgaaaccgaaattgtcaaaactcgtgaaaatgaagctggatgagtctgaggcctttcgtacgttgtttactcccgaacttacccgactctcccaactgtttgaggggcatggattcgagattcggtgcttaatgctttttttactcttaatgtttctccaaaaaggatcgccggcggcgctgtcagagaccttttgatgggcacgcgaccgtccgacgtggattttgcgacggacgccacgccaactcaaatgaaggagatgtttgagcgagaacagatcagaatgttcaacaagcgtggcgaggagcacggcacggtgacatgtcggataaacgaccgcgagaacttcgaggtgacaaccctccgcgtggacgtggtgtgcgacggacggagggcgaaggtcaacttcaccaccgactgggagttggacgccttccgcagggacttgaccatcaactcgctcttccttggtctcgacgggctcatctacgattacaccggtggtatcgaagacgtcaaacagcggcgcatcatttttgtcggtgaccccatccaaaggcttcaggaggtttaactttgctcaatgtcagtccattgcagttacataaacagcccatttccaggattatttgcgtattttgcgatactttcgcttcttcggccgtttctccaaattggacgcgccccatgaacagaaaaatttggaagcgatcgtccgttgccgagatgggctcaaagtaggtgcccattaacactcatttttaataatatttgcctttgaatttccttcccaaagggtgtcagtggtgagcgaatttggatggaattgcatcaaatccttgtggggcggttggctgcccccgtgctgcgctgtatgttggtcgattgtggcctcggtcccctcctcgcacttcgccccgatcgagtggatgaattcgagagggtttcgcgtctgaatgcccccaacggcgacgacgggaaattgagtattgagccgagcaccgcactcagcgcactttttgcaaattcggacgacgttaacaaattccaatcgctgtgcaaatgttcaaatttggagaaatggctttgcgagacgattgtcgagcggagggaagaggcgagcgaagaacgggcgaatccgtcgtacttccgacatttcatattgaaccaaaccttcgagaggggaggtcggcagaaaggcgggaccaaatcagaatttgtttttttaggagaaatgagagaacagatcaaacgcgagtgtgtggaactgatgaaatatgtggggacagatgcgaaaatgcgcgcagagattgagcaatgggaagtgcctccgatgccg

SEQ ID NO: 80168 - DNA, 178 bp, Heterodera glycines
  Genomic contig location: Contig_ID=SeqID_2516; Location=1..178; Strand=+
  SCN-specific regions: Sequence locations=1-113,136-178
tcttcggccccttgggcacgttcattgcgatcagatcaaatcccccaaccggcatcggaggcacttcccattgctcaatctctgcgcgcattttcgcatctgtccccacatatttcatcagttccacacactcgcgtttgatctgttctctcatttctcctaaaaaaacaaattctga

SEQ ID NO: 80169 - DNA, 1253 bp, Heterodera glycines
  Genomic contig location: Contig_ID=SeqID_15839; Location=921..2173; Strand=+
  SCN-specific regions: Sequence locations=1-58,102-341,363-495,524 -749,786-897,921-1037,1059-1138,1161-1205,1227-1253
atgctcgttcacctgttattttttctcatagtaataattagtaatgtttcgggcactaattgattgattgattgattaattattggtccatcgatcaattgcttccgtgatctccgctgataaaatgcttcttggcactgctttagggccaagcttgacgctcatccggtgtaccatttttggcttcgtgtgttggaggaccgtcgggagtgggaacggctgtaccgtcccgaccgactgatcgtcgaccagcaactgatgctggtgttccgatttgcgatcacgcacggctttctcgaacttgtccaccgattatggtaggaaaatttaaaattgcaatgttttaaaaaaataaaataaaacacgaatttcaggggcgatttgacagagggacaaatcgaaacaatcggtgattttttggcatttttaaactttgagaatgcttatgattttgaggtgtggaggattcggagaatttctttgaattaggagtacaaatattaaatattttttcaattaaaaacgctcatttgatttttacttttttttttaaattaatccctaattttcctaaattctttgcagaaaatctgtctcattttaattttctaaattgatcaaatttttgtcaggcttcttgtcctggaaaacgatttgcttcaatgtgcaacacaccgaaatggtccgtttcctgtgccgagtgttgtgccgaattaacatcaatggtgacggcattttccattttttgcaaataatttttttttaaatttgcattaaaaattataccaaacagtttgttaaatcacacacaaaataacatagcatgcaaaaatggcattaaatcttgcccggtgtaaaaatgccctaaaattcaactaaacccattctcgaaaacacaaaaaaaaaaaaattaaaattttggtttgtttaatgctgagatgacataatttatattggcaatttctcgtgttattaatcctggcatactcattaaaatggcgcttcggggaaaccttaccttctttaattaaagttaattgtttaattttgtagggatggttcgcctcagttgggacaatttctaccacaaagtgcaacaaacacttgaagtgaattcaaataaatatccaattttaatacatttgaatttttattttattcagtcggacgaaatgccaagggaagagcaaatgaaacgtttccacaaattggagagtctgctcatcaattggtgtcctgagctaagaaaagcg

SEQ ID NO: 80170 - DNA, 337 bp, Heterodera glycines
  Genomic contig location: Contig_ID=SeqID_15840; Location=1209..1545; Strand=+
  SCN-specific regions: Sequence locations=1-176,199-337
atgacttttcggatgaattctccgccgtccattacgtaagtttcgatgcgctcttcctttatctgtcggtgtgcttaattctttcgcttttctcaatttgatggccaaccccattcagtcgaatgctttcccgcataaattcgatgctcgccgggttcaaatcgttggcaaatgccttttttatttttatttttttaactgcaggcaaaatgaaagggccaacgccggcgaaagcgtcgaaaacgacggaattttggtcgaatttggcgaaggtttccgagtggactctgctgagtcgactgttccaaaagacctaaaagataaaaggatgaaatga

SEQ ID NO: 80171 - DNA, 97 bp, Heterodera glycines
  Genomic contig location: Contig_ID=SeqID_15840; Location=1583..1679; Strand=-
  SCN-specific regions: Sequence locations=1-97
tacgcacgaattccgagtgatggacgccgaattggtcgccggggaagcggagtttatgacggaggtggtggagcacggactgcgttaccgattggat

SEQ ID NO: 80172 - DNA, 112 bp, Heterodera glycines
  Genomic contig location: Contig_ID=SeqID_15841; Location=404..515; Strand=-
  SCN-specific regions: Sequence locations=1-112
atggttttggtgtctgtgacccttcgccaactttgtacgatgtcacggtcacattatgacaagattatgttcccgccaatttctgcccatggaatgcttacattggacagga

SEQ ID NO: 80173 - DNA, 1377 bp, Heterodera glycines
  Genomic contig location: Contig_ID=SeqID_15842; Location=1447..2823; Strand=-
  SCN-specific regions: Sequence locations=1-189,241-972,994-1077,1105 -1377
atggtctgcgccgaagtgaccccgacccgattggtaggttttcacctatttttttttgctgatatcatttgttcggatagacgcaaagaacacattttcttcgattaatttcgatttagagcaatttttagcaactattttcaactattttggtttatgaaactttttaacaactatttttggcttgagaaatttttaaaaaacttttttttataattataaaatttcaatatttaaattggtaccaagaatgtaagtatgaccaagtgaaaaaaaggcctaataaacagttagcatttctcgacttagaatacttgcatgaaatctgtggataaaaaagcaattaacagaaatgtgggtgctgcagaaggaacaatacactgtgttaattgaaaataaagacaccctgttttttgggagtttgacccccatgaaccgatcgagctgaatttttaactgtacgtagcaattctgaaaatattaagattctgaaagtgagaaaccgaaatgatgacggaaaaaagttttacgattttttttcaaaaatggggtgttaatttaaaatagagacacttgataaaaacgaacaaaatctcaacaactaccaaaaataaacagataaaacaaactaaataagaaagaataaatcttttttcacatttctgtttattttgcgaacagaaatatgtcttttaggcagagttatgttgaattttctaagttttcaggagaaattaagggccaaaaggcttaaatcgcctctaacatttgcccaactgaatcaaactaacagcaatcagcactaagataacgtacagacatcctttaagcattttttattcattttatgccataaaaaaggcattaaacacaaaatttttgcgggtgaaaaaatacgaaaatctgagtaaattcgaaaaaaaaattctagggggttgggaaaaattttccatggaagatgaatatgacgaacagaaagagcacaaaattctctacaaaatggcctttgaatgattgctctatagcaagtattcgctgaggggtgccttgtaaataccgactatccaaaaaatgactcaattcaagccatttttcctcatttttgaatcgtaaaacttttttacgtcatcatttcggtttctcactttcagaatcttaatattttcagaattgctacgtacagttaaaaattcagctcgatcggttcatgggaagtggtcaaactcccaaaaaacagggtgtctttattttaaattaacagtgtacaaattacctatttcaaaatgttcgtttcaaaaaattatgaccaaaaattcttcaaattttaccaatctttttttaaacaacattttttaaatttttgcatattaaaataaa

SEQ ID NO: 80174 - DNA, 654 bp, Heterodera glycines
  Genomic contig location: Contig_ID=SeqID_15842; Location=718..1371; Strand=+
  SCN-specific regions: Sequence locations=1-37,59-654
agaacaaagttttagattacaaaaaactaatttgtatttctctgtttctgtctgttgtaccatattatgattgattgattcacattgccaaattggtgaacaacaaacactatcaaaatgttcgaattttgcattaattattatgatcattaattatcacaacccccccccccccatcctaattaattattattttttgttgcctaattttcacgtcactctctcttttcttcccctcaagattgtctcctctcattacgtcgctcttcgtcttcatcatccgtcgtcgtttgcccacaacatttcgcaatttgctcttctcctcctccatccaccacggcaccatttcccccctcttccgtgcccaccgaagagacttggtggcttttttcccgctcctcccaatcatcatttgctaatcccgaaagcgatgatgagcgattgatttgattaatcattaatttatgttttggcacatttttgttgccctttttttgtttgtttccccccgcccattccccgaaatcagcgacaaattttgtgcccttttcataataatcccgatgtttttttatttacataaaatgtatgtttattagacaacaaaaaacagactctctctccatctctctcccgtgtttctctgtgcgcata

SEQ ID NO: 80175 - DNA, 84 bp, Heterodera glycines
  misc_feature (72)..(72): n is a, c, g, or t
  Genomic contig location: Contig_ID=SeqID_15845; Location=2556..2639; Strand=+
  SCN-specific regions: Sequence locations=1-5,27-84
atggccattgggatggtcgccttgacaacttttgtgccgcgtgccgcgttgctgctgttgctgacagcccgncgggcatttcgg

SEQ ID NO: 80176 - DNA, 95 bp, Heterodera glycines
  Genomic contig location: Contig_ID=SeqID_15845; Location=373..467; Strand=-
  SCN-specific regions: Sequence locations=1-95
ctcgaaaagtagcttaacaacagcccaaaaatcatgtttttcgtgcgtttcaggccacggggagctcaggaaaaaaataggcttttgcctaaaaa

SEQ ID NO: 80177 - DNA, 1309 bp, Heterodera glycines
  Genomic contig location: Contig_ID=SeqID_15846; Location=5..1313; Strand=+
  SCN-specific regions: Sequence locations=1-163,185-279,308-567,604 -661,683-785,808-847,882-1253,1275-1309
agcgatcagatcaccgtcaaattgaagaaaaatgatactgtgcaagttttgaaggggaagataatggaaaagttggataagaaaattgaaaatgtgattggacatgaattaggaatcaatcaaccgaagccgacattgaaatatcagcagaaatcacctgcagataataatgcttttgttgttgagcttgaggacagtaaaacattgaaagattatggcattggacaaaacgcaaccgttcatttgtcgtttgacaaatttgaaattttcgtcaaatttcaagaggaaaaccaaaatgaaaaaaggcgattaactgttggggtgaaaaaacggacacagttgaagcattgaagcggataatccaaacgctcactcagattgagccccaaaagcaaacactgagaagggacaattgcggtgctgtgcttaaggacacagaaacaatggccaattgtaacagtaaacacatcgtttatttggccattgatgagtttcaaatccaagtgaaattggagtactgtaacaatgaacatacagtatgggtgcacagtatggacacagttagcacagtgaaattgaagatttgtaatcaaatgatctcatatatttctgcatataagcatattagggccaacgaacaaacattgaaatacgacggcactgatggtgtgcttgatgacaatgcaacaatggcattttatggcatcggagcaggcgcaaccgttcaattgtcattggatgaaatatttgaattttttgtgaaatatgaaaaagcggaggaacagaaagaggagaaaaaagtggaaacattcagtttagaggtgaaaaaaacgaacactgtcgccagtttgaaggaaatgatcaaaaatgagaaaaaatttgtgccaaaaagacaaacactgcgacgcttttccccatatcatatgctgcttatggacactgaaatattggcaccaacaattcaacatgaaccaacaatttacttggccattgatgaatttcaaatttttgtggaatatgccagcgaaaggtacaacaccatttgggtgaagggcacggaaacttggcaattttaaagaacaagatcgcaaatgggcttaaaccatctaagtacattgatcccgacagccaagcgctgcaatacggcacattggctctgattaatgaccgtaaattattgaatgattatggcattggaaaaggtggtgcaacagtgtccttgtccattgatacattttcaattgatgtggcacatgaagaccaacaaggaagacatgaccataccatttgggtgtggaagagtgacacg

SEQ ID NO: 80178 - DNA, 1187 bp, Heterodera glycines
  misc_feature (244)..(244): n is a, c, g, or t
  misc_feature (249)..(250): n is a, c, g, or t
  Genomic contig location: Contig_ID=SeqID_15847; Location=704..1890; Strand=+
  SCN-specific regions: Sequence locations=1-506,528-808,830-968,990 -1004,1030-1187
atggcactgagacagtgcttaaagacgcctctcaaactttggcattttatggcattggcgaaaatgataacaacatttacattggacaagctgaatccgattagttgttgttgcaccatcgatagagaagaaggctaaatccacaaagatccggctgccgttataggacattttgaaaatccgtcatttttacgcccttttcgaaccaaaaattttggcatagcattttttttaaagacaacanaaaannccaaagaacatttgatgtcattcggtaaaacaaaatgctcagaattaggtgacaaaaatctccactaacttttcaaaaaagtagtgaccaaaaatgttcaaaaatagttaggtacatttttttacaaattttttttttaccatggctgaattgacgaactgtcttacatatcatccaaaaaagatggaatgatcgatccgaaacatttgtcgtttccccattttctttcggatctcttcagctgtcactgatgaaattgtttttgtcatttgaattttatggatggtagtgcgttttataaatccgtcagttttggttactgtaacagtaccatttgacgatccagtgaggtcagagcacatgcacaaatattgaaaagtttgattaaaactgagttcagcgtcagggtaaaaaaatgaaaaaagatttttcaattttttgagaatttttagggttttcagtttttttttaatatttttcagagaaagttttttttacaccttccatcgataaaatttataaaaaaatgaatgcatttatacatattttggggatcacaattaaaccaaattatgaaaatacaataaattgacttcgggtattgttcagtaaaaatttttgtgtttcgtattttattttagtttctttttttcgcatttcacattttattttaagtccccatttacattcgccttaacaacataactcgaaaaagaacatataaaaaatctaaattttaatcacccaactttcgaaaaaattaatttttaatttttttagacaattcatttctgaaatattggtccgcaaatgttcggctaactgatcttggattgtgttatattccattaggatatttggcactgttttcttaatttggttaacaactaaaaaaaaattagggtccaaaagttcaatgtttgatatgtattttcaa

SEQ ID NO: 80179 - DNA, 1515 bp, Heterodera glycines
  Genomic contig location: Contig_ID=SeqID_15848; Location=1..1515; Strand=+
  SCN-specific regions: Sequence locations=1-325,362-380,416-641,663 -845,924-1027,1049-1126,1153-1163,1186-1186,1228-1243,1265-1401,1423 -1515
ctactcgggccattcgcgttcatgtggggctgccggccaagtcgggcgtgtccggcgtgaccattgttgtggtgccaaatctgatgggcattgcgctgtggtcgcccccgttggaccgtatgggcaattcgtgccgcggggtccatttctgcaaaaagttgattgaccgcttcaatttccacaactacgattcgttggcacataacgaatcccaggtgttttttgatttattggtctatatgaatgttaagaaattttcgaaaaattgatatgtaagtgtgctagtgcgtttcttaaaaactgcaaaccccaagttctataactcaaaaaaatttttaaaaatacagtaaaaaaattttttggcaaaatttagagaagactttaaaaaagttaagaatttttatttttttaaattctaatttctagatttttctttagaaaattctaattttctctaagaaaatttttaagtcaaaatttctttcatgaagcttcattaaaaattttacacttttcagtcggggtggtccaccccattttccgtgcaacccgagtaaattgatttaaaaattttcgtcattttttcatataaatttaattgaaaattcttccgcgcaccttgacggcactgctggaataatgccacaataaaatttttcttcaattcttgaaattacttgattttttttattttacagaaatttgacccacgccggcgtgtcggtgagcgcgaaaaaactgcggtggtttcgttgctgtttgcttcaaaggctggcgatttgaacaccatcagaaggtcataaactaattatattgagttagttgatttcgaacaacaaaaactcaaaaataaaatttatagctttttttattttaaatttaaaatcgaattaaattattaattttcaacatttaaatttaaagttcaattgaattgtcagaatgtatttgcaaggctgtgacttggagatggccgactatgacaagcgaactgcgctgcatttggctgcttctgaaggccattttgatgtggcacttttccttttggagaccggcaaagttcaaccagacccaagagatcggtgagtcataatcaaatttaaaaatagtaatggcacaaaacataattatttgttgaagtaaatttaaaaataataaagctcagaaatttgtatttttatgaatctttaaaaattaaaaaaataaatgataataaaattttaaattgtttagtagcttttcaattcaaataaaactttgaatacctgaaattacaaattctaatatcttatttcaaaaatatatgaaatctatgttttccgtgccgaaacctgggcttggattccgtatttgatatgagcctgtttcttggacaaaaatcctggaaaatttaagccggacaaaattaaatttaaaaaaaaagaaaacttttgactcaaacagttggaatcggactcctcttgacgatgcccgttcggaacatcacacatcggtggcactgatgctggagcgacg

SEQ ID NO: 80180 - DNA, 1009 bp, Heterodera glycines
  Genomic contig location: Contig_ID=SeqID_15850; Location=1798..2806; Strand=+
  SCN-specific regions: Sequence locations=1-190,301-702,724-796,819 -1009
  Gene Ontology: Mol. function=zinc ion binding; Cellular component =membrane; Biological process=one-carbon compound metabolism
atggtgaatttttttgttatttttgtgccgtttttgttgttgattgtgtcaaatcagttgaaagccgaagaaacggaagaaaatcgacataaaacggaggaaacatggaattatgaggagcccgaagaatggggaggaaagtgccaaaagggcgacagacaatcgccaattgacattcacaaacaatgggtaattaattaattaattgaataagagatagcatgggtggcaaattattacttattaattaaataatatgatttatttttataattagtcgtgttaattaattatttaattttatgccttccttttcagttcattgattataaaattccggcaatttcatttgcaaattacgaaaaaaatggaactgtgacaatgaaaaacaacggtcatacgggtaaagaaagagctgaaattacggactgggacactatagtctgagccaagtttagaacatcataacttttttatttgctgaccaaatccaataagcttggtatcattcgattgatcttaacaagctctattggttttccaaaaaatacaaagatataccgacatataaaaaagttataagcaaaaatatgcaaaaaatctgaatttttggtagtattcatgtttcaacttttttagaagctgttcaatcgcttagaaatagcttatcaaaagcttctaaacatgtaaagctttcgaatgaagctaaatttataaaatttggccagctgagaaaaaattttgatgctttaaacttagctcagactataccggcctatagtgtcccccacccctgaaattaacataattagtataataaaaacataaacaacttaaatttacagtggtcgtaagcggatttgacacttgggaaaagcagccgaacatcgccgacggaggctttgggagcaaatacatgttgagccaattccattttcattggtctcaaaacgagaacggaagtgaacatacggtggacggagaacattatgacgcggaggtactgtag

SEQ ID NO: 80181 - DNA, 1388 bp, Heterodera glycines; identical to SEQ ID NO: 15851
  Genomic contig location: Contig_ID=SeqID_15851; Location=1..1388; Strand=+
  SCN-specific regions: Sequence locations=41-43,221-238,260-1388
  Gene Ontology: Mol. function=sodium dependent multivitamin transporter activity; Cellular component=integral to plasma membrane; Biological process=transport

SEQ ID NO: 80182 - DNA, 557 bp, Heterodera glycines
  Genomic contig location: Contig_ID=SeqID_15852; Location=118..674; Strand=+
  SCN-specific regions: Sequence locations=1-13,35-134,176-557
atgccaactcgtgccattgtttcccgttcagtgccctttttatgtccactttcggtgcccaatttcacttcggcacttccaacagttccgtcttttccaaactgtctcccttctgctattccagcttgggtatggtttctctccttttctgcttttctatttccccctcttccctaaggcgttttgcttgtcattttcatcggattgccaattagctgtgtctttaggcaacggcaaagtcaagcacagaaaaagtccgacttagtttcaatatttatacttcaaattttgttctttttcaggctgacttttgcctgcacttattttggcttggaaaaaccaatcgaaagaaagcaaagttttggcgaagagattggccaaatggaattacaaaagcaggagcaaagtttaagcttaatgttagcggaggaagcgcagcacggacagagagcaacagaagaaggggaacagataatgagcagaaggaaaagcaacaaattggagacgtacagagcgacggaagagaaacacaaagtgacagacaaacaaattggtga

SEQ ID NO: 80183 - DNA, 1252 bp, Heterodera glycines
  Genomic contig location: Contig_ID=SeqID_2518; Location=293..1544; Strand=+
  SCN-specific regions: Sequence locations=1-208,445-986,1008-1029,1053- 1148,1177-1212,1243-1252
atgttaggcaacgccaaactcatcaattcgagcaaatgccctcatgccgaaaatgtttatgccgagaaaaggaaccccggcaccggcactttgcgttgttataacccgacaaagaatcaatattatgactgctcctgtcacggtgataagaaatgcctcgctgaagaaaaatgggcacacgaccgctttctttgtccaataatgcaggtaattaatgaattaattaattattaatgtattaatgccaattaattgattaattattaatgtattaatgccaattaattaattaattattaatgtattaatgaattattaatgtattaatgccaattaattgattaattattaatgtattaatgccaattaattaattaattattaatgtattaatgaattattaatgtattaatgccaattaattgattaatttaatgtattaatggcaaaggacactgtgccgccgaaacatttcatataatactggcaatttaatttttttggccataaaaattaccattttttgtatcaaaaaagcggaatataagaaaaaaataaggacaacaagcggaaataaggacaaatatggcaaatgataaaccctcatttattaattaatctgtaaattcaaggtcaatggaattcaaatccaaaaagatcctcgatacaattggactcgtcttgatattgattgctatgtgagccgagttttactgtaccttttcaaaaatttgtttgattgactaattttacagaaggccgaagcgggtaccgtaagcttttggggctacagtaagccggacacaaaggaaatcattcgggtggacgaaatccactgtttgactgatggagtgctaaaacggttcaagagtttgcaagtcgatgaacagtcgccgatgaaaaaactgagtccaacgagtccattcttggccaataatgcttcatccctaatccacgtgttcgtgccatttgtttaagtccctctcatacatttatgtatttttaaacacataatccaccagcatgggcaaatataatttgttggctaatatctctcccctaaatacacaaaaaaaaaacaatgactaaattttgatttaaatgcatataaacaattaaacatttaattaatgcctgtggcggtgtctgtttttgtttaatttgttaatttcatttttatgacatagcaatgtattttattcatttatctaattattttgttgttgtttttatttcttattaaaatggataa

SEQ ID NO: 80184 - DNA, 562 bp, Heterodera glycines
  Genomic contig location: Contig_ID=SeqID_2519; Location=537..1098; Strand=+
  SCN-specific regions: Sequence locations=1-93,117-299,342-373,395-562
atgaactctttttctctattgaccgtctttctttgcttggtcattaattgctcagctcctccgatacggtaatttcataagtaatcaaaaaccaataaatattttaaattttaaaagcatttcaaaataatcgagtccaagccttgattcaggcctaatcaaagcctggatatttggcctgaatttttctaatttttcaaaattttcaatttttcagccctttgtcgtccgacgttagcatttggaaattgtgcaatggcaaaaatgggaaaattttggtggaaaatggctgcacaaagtaaaatatttcaaaaatttattttaaattaactatttttaaaccatttttaggcttcttctctgctaccaaagcgaaatggccaaaaacagaaaaatcggaaaacgttttggggtgggcaaaggaataattggcaaattgaaatttgtggaatgtgccgaagagattgccgaagaccaatggcacggtctgatcattacgaagcaccaagacggagtgatcagctacgaatcgaggcaaattgggagagataaaatattttaa

SEQ ID NO: 80185 - DNA, 1808 bp, Heterodera glycines
  Genomic contig location: Contig_ID=SeqID_2520; Location=253..2060; Strand=+
  SCN-specific regions: Sequence locations=1-46,97-813,854-883,905 -1167,1219-1474,1547-1808
tgccttacaaaggcaccgtttgttggcacaaccaaattccatcgcccaacaacagcaacaacaacaacttcaatcccgacaaccacggaacaacaaacattttcgtttcaaccattttccgaatttgtgtcccattttggcactaattgttcgaaaatcgttttccccgtggaggtggccaaattcattgtgaacatcaccgctaggccctaccgaattgcgtgcaatgactatgaaaaagagtacgaaattggacaattgccaaaggattatgtggcaaatgcatacaaaggtttcttcaatgcttgcatgtcagtgccgacaacaaaatgcgcaaagtgattgaaattctggcacaaaaatttggtgccaaattctcacaaattgtgttttaggcatgcggaactgaacgcatgctataaaagcatgaagccagtggtgccaagcaataatgccatcgccaaattatgccaaaaccatcttaatgaatcgaatgctgccggatttgctgtacaaatttgcatccatcgcgatgaaaaggaacagaagcttgtctttgaaacatttttgaacctttccaccacagacgaattgtatttaataatctcattaattaattattaattgggttaattaagcatcaaaatgacgcgcagctaccaaatttccattgaagaaattatagagacaaagaaaactattcccattttctttctcgaatttggcaccgatcaccaacaaagcgcaatccgtgaaaaagccaatgggaaagtgatcagcgaatcactgaatgaaaatgtgaaaacaaaatcgatttttatttatttttaaataattaattaattgaaatttaggccattggcattggcaccgttctcaatgacatcaaatcagaaaaattcaatgaaaatttggccaaaatgattcatttggtgccgcctgttgctgatcggatgctggcatttttccagattccaacgccggagttctccaaactgatcagtgcccagacgaatttgaagccatacgaaaataacccaaaagaagtggtaagaaaaattgaacaaaatccggcaaaaggattgggccaaaccatcactttttaatttaagccgagacttggaatggagccgaactttttaaaagtttttcagaaaattatcaatcatatttaaatgaaattaatttttaaaaatttacaaataattaattttatttgttccaatcatatttgtatcatcggtgggcattgtttcgcggagtgtcaaccaaaattacaaaaatgaaaattacaaaaattttagggcagatcatcaagatgcgacacatatggaaaagactgtgcagtgatcacgaaactgttgaacaaaattgaacaattgagaaactgtaaaaatgaaaccattgatacggtaattaatcaaagattttctaaaaaaatagaaaataattatttgattcttttaaattcgagaaaaatttagtttttttgaaaaaaaatgtgtatttttatttttattatttttatttaaatataatttaaattgttttctatggttgggttgttgtattcacctgactaatcctcttctcggaattctaattatttctgctccgtgtgcttaaattacgcttttaagtctggttttcgccttcccccatcggtcgatgttccgtcacctgcgataccgtacctaagtccgaccaaaacattgacgtgcttcggtgatatgtattgtaacaaagaaatactgcagcaacaatatgaccgagaacgcgaaagtaagttgaggaaggaagcattttaa

SEQ ID NO: 80186 - DNA, 961 bp, Heterodera glycines
  Genomic contig location: Contig_ID=SeqID_2520; Location=2308..3268; Strand=+
  SCN-specific regions: Sequence locations=1-147,176-299,321-328,352 -380,403-859,881-961
atgcgcacgggattttgctggtctctgtccgtgatcccgcattttttcgagcaggaattaggggttagttccgcgagatctctccggtccaacaaaaccttagaaaaacggagtattggaaaatggctaggcctaaataggtatgtgatcaatcaatcaatcatcaatcaatcaaaaggatgtgggctcaagccagaaaatctgatcagccgtcggaaaaggcaatttcgtccgttgaatggaacacaattgggcaaatggaattcgtttccgatcatgatcagttccgcagaaaaaacgtaagtgattttaattaaaaatgaaagccaaaatttttataaattttaaaatccgctcttggccaatgcttcatccatcacttatccatgtgtttgtgccatttgttgaccgtccatgaaaaagagagatcagtgatcagtgaaatctgtcatcatttgaaagctttatgtgtgctccatatttacatgtcaaaatataaatgaagaatgcaaggcgtacaaaagttatattgctggcatgtggcgccgggaaagccaagaaaaaagtcggcgctacttgcaaagagcacaattttgaaaattttttcaacttttttttggacaaaattttttttgtttaaaaagtcctgaaaccaagtacccggtgattttaaaggtagctgatctaaaatatgacaattatttgattctatcgcgaatatacctataatactgcgtaatcgtgctgctaatgctgattatgctatcagagattgaacaaattgaaattgaatccgattttggacatatgcgcaaatgtttgggcacgctttttctaccttaaaagacacggcttaagaaatttctatctttatgtatttttcagtgcgaccacaattcttaacaattacatcattgccattgttagggcaaccgattatcagaacatcacaagtaattag

SEQ ID NO: 80187 - DNA, 1045 bp, Heterodera glycines
  Genomic contig location: Contig_ID=SeqID_15857; Location=906..1950; Strand=+
  SCN-specific regions: Sequence locations=1-191,213-633,656-1045
atgtctaccgaccgatatgatattgtgttgtacggtgcttcaggctttaccggccaacatgttcttgaatcattcgtaaagaatggtcatttggaccaatttaatttcgccgtcgcgggaagaagtgagaaaaaactcaaacaaacactcgaagacatcgaattcatcactggtctggtgcaaaataaaaaatcatagacatacataaaaggaatttaacaaaataattcagggaaagttttgaccaaaattccaattatcatcgccgattcgtccgatgctcagcagctcgcagaaatggccaaacaagccaaagttattgtcaatgttgttggaccataccggttgtatggtgaagcggtggtaaaagctgcggttgaaaatggtgcaagtcatgtcgacatttccggcgaaccagccgtttgttttccaccatacaaaaaataataattgcttctcatactcatatttcactctcacttcagtggattgaagcgatgcaaatgaaatattcggagaaggcaaaagagcagggcgttttcattgtcagtgcctgcgggtgggactctgtaccgtgcgacttgggaatgaattatttgaagcagtacttcaaaggcactctttcgcatgccgaaacatttgctcatattcaaatcggggaagcggtaagcccaaaatgaaaaaaacaaatatgcatttttagtcattttcagggctattccttcaacgccggcacttaccaaacattgattttgggcctttggcaggccaaaaatgatggtcttggaaagatacgacggtcgattatgcccgagaaaatggagaaaactaagtggagacctccaaaaaggtacaggcacttactaatcccaacaatttaaatgctttttctagaggaatgttttggtggaacgattcattggacgcttattgccttcctttcatgggtgcggacaaaagcattgtgcaacgatcgcaatatttcgataacattgccgacaaaacataccctgtccgtaaagcctttcggtttttcattctttag

SEQ ID NO: 80188 - DNA, 85 bp, Heterodera glycines
  Genomic contig location: Contig_ID=SeqID_15857; Location=76..160; Strand=-
  SCN-specific regions: Sequence locations=1-85
cgggccaggacgttttcgcgtggccgttttcgcgtggccgttttcgcgtgagggtcgttttcgcgtggttgcatataaaagagaa

SEQ ID NO: 80189 - DNA, 299 bp, Heterodera glycines
  Genomic contig location: Contig_ID=SeqID_15858; Location=319..617; Strand=+
  SCN-specific regions: Sequence locations=1-129,151-299
atgtgctacaaatcattcccgttttggttgccgaattggaagaaatgcttgaaaatggcaattggaattacacaaatttaagccatttaaaaatggtggaatggaaaatgctggaatttgcacttcacaaaaggggggaaagccaaaaatggaaagaaattcaaaagctgtggaataaatggagacgaaaatttatcagaaaatttaaaaatgcaaacaaaatgccaaatttcaaaaaagtaatggaagagttgaaggacaaaatggaacaattgagagcggaaaaggaagcggaatga

SEQ ID NO: 80190 - DNA, 749 bp, Heterodera glycines
  Genomic contig location: Contig_ID=SeqID_15858; Location=1020..1768; Strand=-
  SCN-specific regions: Sequence locations=1-12,34-77,99-284,306 -339,361-703,725-749
atgagcacaaatgggccaagtgggaaaaggaagcgattgtttggcgatttgatgatcagtggagccatattaatttgtcagaaagtgatgaagatgatacatttgatcactacatcagtgcatggttggtactaatcgctagggatacgcttttttggtttttcctatttttccagaattcccagtgacctgaaaagcacgaaaaacattttttttcggttgttgttaagctacgggttttattttttagaacctaacctaaaaaatttctcaaaaattcaactccaaaatctatttatttattttattgaagagttgattttaaaaattgtgcttctcaataatttgacataatatttttgctttttgaatataaatttggttttacaccccccccccctaaattcggaactttttggcacatatttttccaatttttagcacctattttggggggtttttaagaacctaaaaactaactattttagcagtttttagcagctaagaatatcatccctactaatcactacttacttatctatccaatcactttcgtttttttttctcgttagtttggtggacacaacgccagtcccaagtggtcagcagaagtgaattgccgttgcgttgtccttatttggatgggcccaatctgagaaattttcaatccgatttgaaatatttgccctttttcagcctattatctactttatgttttccctttatttgttgaatataataataataaa

SEQ ID NO: 80191 - DNA, 366 bp, Heterodera glycines
  Genomic contig location: Contig_ID=SeqID_15860; Location=204..569; Strand=+
  SCN-specific regions: Sequence locations=1-233,255-324,346-366
gcccaattttggtgtgataattaatgtcgaatatcgactcgacaaaatctcgagtttctttttggtattggactcaattctcgggaaactttcggtctcgagcagcactaataataataatgtccactgtgtaatgaacaattaaatgagagtgactgacctccgcttatcatttgttgctattcatctctcaattaactaattaattaccttaattacccttacacaattgccaaggtcacttctctttcttgctaggtgagcaaaagttttggagcaattactacaaaacattaaacagttgttgctctatctgcagaatatatttttaaatggcttgaaaaatatgtataatataaaaattta

SEQ ID NO: 80192 - DNA, 580 bp, Heterodera glycines
  Genomic contig location: Contig_ID=SeqID_15861; Location=961..1540; Strand=-
  SCN-specific regions: Sequence locations=1-580
atgccgaaattcaaatttgataaagccgatcgcgatctgcaccaaattggggatttatggcacggttcgcgcgaacgaatattaactccaatttggcgccaaaaactaatgccgagaattcaaaattcaaagccttggcataaaattggacttttaagccactcatttatttgacccactttcagcttatgcctaaatgattttggcgccaaaaattgatgcctgcgtctatttttaagccttgcctttgtttgcgcttctcttcccaggctttaactcaccttcttaatttataatccgattaaacactttattttcagcccatttttctatcaatattaataatttttgcttaaaaattacatcaaatggtgaagggtaccccaaagacaccgaaaacaccaaaaacaacgccaactcaaactccgacaagaacgccaaaacggaaagaatcgacgaagcaattggcattggagttgccggaggaaccttcggaaaaagttttgcaacgaaaaatgaccataaatggttaccaaaactattgcatgtgcttgtttttaggagaatgccgacagtgtga

SEQ ID NO: 80193 - DNA, 1325 bp, Heterodera glycines
  Genomic contig location: Contig_ID=SeqID_15861; Location=1691..3015; Strand=+
  SCN-specific regions: Sequence locations=1-96,118-275,297-376,398 -564,586-703,746-751,773-1141,1163-1325
  Gene Ontology: Biological process=deoxyribonucleoside monophosphate biosynthesis
ttgactggagaaacaaaggaattcggatgaaatgaattatttgcggcaagtgggtgagattttgagtcgcggaacggtgcgcactgacagaaccggcacaggaacaatttccatttttggcatgcaaacgcgctatagcctccggggaggtcaatcgaaaaaaatgaaattgtttaaaaaatggcggggttaagggaccattccattgctcaccaccaaaaaagtgttctggaagggcattgttgaggaggtacaacaacacacacttaagaaattaataaagttttcattttttagctgctttggtttattcgcgcagaaacgaatgccaaaacgctttcttcgagaggagtcaaaatttggggtaccaaattatttttaaatctatttttgtattacctacatttattgctcaattaaacataaattttgacagatgccaatgggtctcgtgcctttctcgactccgcgggtttcactgatcgcgaggagggcgacttgggccccgtttatggcttccaagtggttattattttgagagaaattgcttatttttgccttaagtggcttcactttggcgccgagaatcgcggcgcggacgccgattacacggccaaagggactgaccaattggcggaactgatccaaggcattcgtacggacccgaacagtcgacggcacattttatgcgcatggaatgttcttttttattattgatatatttgtggaaatttgtaaatttcaataaagcatttttgaaaaattgattaatttggggaccaaatatgagggccctgctgacgtagaccgcgacagaacttatgttccaccataagtaattgtttgaacttgataaaaatcagaaaatcagagggacatggaaaattttttggttctagtcggttttgacccggcaatcaaaacatcagcgtgaagaacagacttcggcattgaagctcactttggtttttgtgaccagcttgttctgccgactagcgcggttaattacaccggacagccttaactgacgatcgtgtaatcgatatgaatacaaaacgaagaaacaatatacaacgcatgtttttccctttggaggttttaggacaatcaacgtgaatccgctgaatactgaaaagcagggacatcctgaatcgcattaacaatactaatttagaaaattatagaccaaaataagactcactattcccgagctaacgccctttttcggatgcggaaggaccaccccagatatcttatgatcgcggctatctatgtaatgcaagaattattgaaacaggccccgtggtgtgctcactgcggttgat

SEQ ID NO: 80194 - DNA, 317 bp, Heterodera glycines
  Genomic contig location: Contig_ID=SeqID_15862; Location=489..805; Strand=+
  SCN-specific regions: Sequence locations=1-317
atgcgtttcctttatgagagagaacacaagacattggcacgtgcgcaggaacgcgaggatgagcgcaattttttgcgtcaatggttgctcggtgagttaaattttttgttcattagacctaactataccaacagcaatattcgttcattaattgccattaaaatagcatttattatttccctttgtttcaaggaggcccacaagggcaacagggacatggaggcgttcaacaacaaggacaaggtcttcaaacgttaataaggccgtttgagtttgattacctgaacgtttaccaaaaatgcttatattgcatatga

SEQ ID NO: 80195 - DNA, 513 bp, Heterodera glycines
  Genomic contig location: Contig_ID=SeqID_15864; Location=671..1183; Strand=-
  SCN-specific regions: Sequence locations=1-7,61-315,378-513
atgccaaaacaacaccaacaccaacaacaacaacaacaacaccaagatcaacaacatcaaactgatgtgatcgaccatgatcactgctacgcgcgccccacaaaacagttatggaaattgaaaagacaaaaatacatgttgacatttaaactatgtaaaatgtgtgcacaagagatatacaaccgtaaggacgacatagcagagtgtaacgatggaggtgtggacttgaactttcaccggtgcaaacattgtacaatgctcaacatgcgactcagcgatatgaattctgtgcaatttatggcatatcagccacgtaataacaactacaacaacaccaacaacagcaataaaaacagaaacaataaaaacaacgataatgacgaaaatgacagtcaaaataacttttggtacgataattacggtcctacatactgtagaggtggtccaagaaacaactacatgcaaggaaaacgaaagtgcttggaaagaattgacatggacgacatgcattga

SEQ ID NO: 80196 - DNA, 673 bp, Heterodera glycines
  Genomic contig location: Contig_ID=SeqID_15867; Location=913..1585; Strand=+
  SCN-specific regions: Sequence locations=1-50,83-83,107-210,237 -532,554-673
atggaaaagcttaaaaatttcactcttgccgatttattcaaagtattggctctaccagacaaagaattcgaagaatggctcaaagaacttaagcttctacacaccacccgtttttgcgactgtggcaatgaaatgagctacaaatggaagcaagatcgacaacaaccgctttggatatgctattcgaaaaagaatcacgacggcaaacagccaactattggcttttacactggcactttttttgaaggagcccatttgtcgcctaaacaagttttaaatacccttaatttacacgatcaattgatattaaggttttggaattttcctactattgggcacgaaaattttcaaatgatgaaatcagttttcaaatgcaattgggacgtgatacagtgaccgattggaaaaacttcatgagagatgtgacatcagaattttacagcagaaatccaatcaaaatcggttttttgtttgcttgcaaatgttttattaaatgataagtttaggcgcagcaggtgcgacggtggaaattgatgagactgtttctgattttttgtggcgtaagcaatttggaggaccggatattttttataatttgtggacccaaatcgcggaattgtacccaataagcacgtaaatctccttttatttgttatttaaagcaattccgaca

SEQ ID NO: 80197 - DNA, 90 bp, Heterodera glycines
  Genomic contig location: Contig_ID=SeqID_15867; Location=1483..1572; Strand=-
  SCN-specific regions: Sequence locations=1-90
ttaaataacaaataaaaggagatttacgtgcttattgggtacaattccgcgatttgggtccacaaattataaaaaatatccggtcctcca

SEQ ID NO: 80198 - DNA, 632 bp, Heterodera glycines
  Genomic contig location: Contig_ID=SeqID_2523; Location=1326..1957; Strand=-
  SCN-specific regions: Sequence locations=1-632
atgcttcacattcgaaaaaaggcgatcaaggaactgcgttcgctgcccccgcgtacctacgatgtggttgtacatggctctactagtcagcatcagcctccccacttcaaggaggtgccagcgctgtactctgactatttgacatggctgaacagcgaaatagtaaaagtgcaaaacaatgaaagggaaggcggaatcttgcgatttgcggcggaagtccataataaattggttagtaaaataaattataacagtctcgtgaaaatagaaatttgtaccacataaataacagaaaaaatcaaaaccgttttccacaggtcaaagcccatgtttggggcgatggtaatggacgaaccgctagggcggtaagaaatattgttttggagaaatgccaacagcaccaagtgtcgtttgaaaccgttccgcatgccgagtacatgcgagctgttggcgatgcgctggacggaaacccccaaaatttcgaaaatctgctggacgggttgttgcgcgctgctgaggacgcatatatgactgcggtacacgggaaaccagggccaagtgggcatcagaccggctgagggcagcgaatcaacagttcggaaaatgagcgaagcgaacgaatgggaaataaa

SEQ ID NO: 80199 - DNA, 228 bp, Heterodera glycines
  Genomic contig location: Contig_ID=SeqID_2523; Location=127..354; Strand=+
  SCN-specific regions: Sequence locations=1-14,36-228
tttccatccatcttcatttatttgatggtctaaatgccaagaaatatcaaatggctttttatgcaacattttgatggcattccgttccaaaaattgttggtgtacaatacaaacgcacatccaacacccaaatttgaatgtcttccgtcagttcgatggtgtgcctcccgttcagtttgtagttgagagtgcgcaacccgctcaaagtgttccgtttacgcctcctct

SEQ ID NO: 80200 - DNA, 892 bp, Heterodera glycines
  Genomic contig location: Contig_ID=SeqID_2525; Location=89..980; Strand=-
  SCN-specific regions: Sequence locations=1-55,83-272,301-846,868-892
atggctgtagcaaggcctgacctcgtgatgaaggcgatcattcctggtaagacagaaaattaaaaaaaaaattttttttttagttatgagttttttcaaaatggcatttctttaatttttttaaaatttctggtttttttgatagatgcctgtagggaaggatgaaaatttcatttgacatttttcaagaaaattcgaaaaaaatttgcgagatttacaaaatgtcttatattgaaaattgttttgaacaaacaaggagaccttatcggctgtaaaaaaacaaaaaaaaaatttttttttgtcatattcttgaaaaatctttttttccattctctcccttccccccttaaacaaaaatccaaaaattcagtggtcatggccggcattgtgggattctgatgctgatcttctcggaggtacggcggcggtcggtgcggggcgagggagtttcagtaaggacaagtaccgggattttggtttggaaatggtaccgaaacgaaaaaattataggttttttagaaaatcctttgttcctgcagaaaatttttaaacctttggggtgtgtgcgttcgattaagtcgtcgttcagtaattcaacaaaaaaaaggaattttgttaaggcaccaacgaaagtcgaacggtcggaggcggaggaggacgtttttcaccaagcacaacaaaaaacggaggaacaccaaaatcaaagagaggaaagtgcaaaaggaacgacggaaagggaggagaaacaatcgccacaacagaaacacccgatgccggtgaagaagacggcgtcattcatgcggaaagcattttggcggaagatttgcagctgagtgagagcagttcggaggatgaggaggacggagggagggacagcgaagacacggactga

SEQ ID NO: 80201 - DNA, 1973 bp, Heterodera glycines
  Genomic contig location: Contig_ID=SeqID_2527; Location=2449..4421; Strand=-
  SCN-specific regions: Sequence locations=1-263,285-596,618-857,885 -1621,1651-1973
tctaattatccaaccatttctgatattgaatttgatgcaggtgaaatatcctgtatgctgaggactttaccgaatagagaatctacttcccctgatgaaatttcctttaaatttttacgtaattgttaccttcctcttacaccggttatttcggaactttttagactatcaatggatacaggcaagatcccttatatttggaaaaaatccattgttataccactctttaaaaaaggtgaccgaaatgatccacataattacagacctatttctcttacctgctgtctctgtagggtttttgaaaaaattttagcaaggcatatatacgattttcttcataaaaataaattaatatctgaacaccagttcgggttcgttaaaaaacgctctaccaatactcaacttatctctgtacttgaggattggtatgacagcatatatggtaacagaaatattgactgtgtttatgtggattttaaaaaagcctttgactcccttcctcatcacattatggttcaaaagttggataatatcggaattaagggaaaactgcttaattggttatctgagtttttaaaggaaagaacttatacggtaaaaattaataacaaatattcaaaatcttatccgattaagtctggtgttccacagggatcagttttaggcccactgttgtttttgatctatataaatgatcttccgaaggttattccttcggaaataaaagttaagctttttgcagatgatgtgaaactatatgtttcatacaaaaaaagaaatgagcgcattaagctaaacacagctttacaaaacattgaaaattgggccagtttaaacggtttaaaaatctcacccgataaaacatttattatattttttggcaaaaacaactctaaacaacaatacaaattatgcaacaaaattatcaatgaggttgaatcgattaatgatttgggtgttttaattgataataagttaaagttttctgatcactatcttaaaattactaaggctgcttatttaaggatcagatatatagccaagtttctaaaatcccgctcaattcgggtatggactactgtttacaagacgtacattcgccccctccttgaatacgcacctgaaatttggaatcctaagttaaaaaaggatatcattaaaattgaaagatgtcaaaaatattttacaaaaattgctctcttcaaatgtagattaccttatattccctaccaacaacgtctcagttttttcaagatacaatctttagaggaaagaagaaaagttatagacctagtccaagcatttaaaatcattaatggtctaacccatctcaaaaaaaatatttttcctttaatttccgatcactttccatacaatttaagacgtaaagttgtgttaaaatcacaatgcactaaaacatcccattcttttattaatagaactgctctaatttggtccaaacttaacaaagtgttaacagatgccccgtctgttgactgcttcaaaaagcgaatacagacgtggctggaggctaacaaaatttaactctaaaagtacccattcttccataatactactactattttataattcaacgtgtaagtggtcaccccttcgttggattttattttatttgaataaatattttttcataatcacaattctgaagcgcgagactaccagtgtctttgtccggtaatagtttagatggtacccccccttttttaaaaatttttttcaactttcaaaaaatcataaaaacatgtttctaggggttttcggggtcgctgatcacgaatccgacatccatttcgaccgattccgaacccctgacccggattcgaacaaaataaaaaaagcagtttgggaacaagactgaaacatacgacacctatttcccagaatttatttggcgtcagcgttttggagaccgtgaaaatgcgttttacaatttttggttgcatgtctctgag

SEQ ID NO: 80202 - DNA, 799 bp, Heterodera glycines
  Genomic contig location: Contig_ID=SeqID_15872; Location=487..1285; Strand=+
  SCN-specific regions: Sequence locations=1-11,33-124,146-503,525-799
atgaagaagaaactgggagaccaaaatctgactcaggttgtctcaatttttcaattcaatattctcaactttattgattttaagcgttttaatacggatccaatttttgccgagtcagcaaaaatgctgacattgattgcttttgttcaaattggcgatcccacagaagcagtcaatgcattggatgttgcgttccgaaatttaccagaaatacaaccgatgctcgaatggtttgttttttgcagtcattaacatgcaaatatttactgcgttcaggttgatgaacaattacacgggtcgtccacgcgcagatgggtcgcgaacggaaccacgtttcaaagccgaagcttggaatgtctacgagagaatgctgagcaatgacgacagaacgaacaattttgcagcccacaaaagaatccagtgtcatttcaattgtcaccctactctttggaacttcattgacgttcttcgaaaagcccaaacagtgattaaatttattgcttatttatccgtaacattccatttaagactacggatgccgattactcaaaatttgtcaaaggaattgagccgcctccaaaaaagaaaaaataccgtgataccgattcccgaattctagcaaaggttcagaactattacattgacattcccaacaacaatgctcacaattatgttaaccgtcatccccgtatcattgagtatttgaaaggcatttctcgcaattaccagatgaatccttgatcaattttttttaatattggtattatttatggaaatttgttagtttcaaatttcaata

SEQ ID NO: 80203 - DNA, 774 bp, Heterodera glycines
  Genomic contig location: Contig_ID=SeqID_15873; Location=648..1421; Strand=+
  SCN-specific regions: Sequence locations=1-210,314-590,613-774
atgaaacaccggtggattataaaagaaaatcgccaacagaaaaataaaaataaaatgatggggcaagaaatgggagccggaaaatccgacactggaaaatccgacaccggaaaatccgacactggaaaatccgacacaagcagaaaatccgacaccggtggaaaatccgacacaagcagtaaatccgacattggaaaaaccgaccccaactttaaattttaaaaataatttttgattgtttgagttagtaaatatttaaaatacatataataaaagttaaatacttaagttatttaaaataaatatttttattgctataaaatagatttaaagtagacatataataatcatattatttcaatgttctttttgatcatctcaaaaaaaattgtaacaatccggcaaatggaatcagatgaaagggcatgaagcataagaaagtgaacgtggtgcaagacatgaatctcacagagatttatgcgactcgcaacaatcgacatcaatatcccatcgaatggcagaatcaattaatttttttaaatccaaatcgaaaacttgataaacttagccagatattaactcaaacaatcaaaaatattttttaaatttaaagttggggtcggtttttccaatgtcggatttactgcttgtgtcggattttccaccggtgtcggattttctgcttgtgtcggattttccagtgtcggattttccggtgtcggattttccagtgtcggattttcctagagcccgcacaaagtgcctatatctcca

SEQ ID NO: 80204 - DNA, 791 bp, Heterodera glycines
  Genomic contig location: Contig_ID=SeqID_15874; Location=22..812; Strand=+
  SCN-specific regions: Sequence locations=1-228,250-306,332-365,387-791
atggcaccagccagtaagtgccagtagtacatattgttgctcgaaacaaaaaattcccaggactagagagtgattctgattgagaaaattcgagacttttctcgagtcgaggctcaagactgacactttcgagcagtactagtaaaaaaaatagtagtggtagtgtgtgttggtttgtttcgtaaaatccgccattttaacttctttttttcgacgaaatatgctatatatataactttgtttaaaattagtcaaattttgtattcttggttctttgatagcccaggtttttctctattagcatgcaaaattttaaaaaattttataaattcgaaaaacttgtatgaaaataagtatattgaatttgatatttaatttaaaattttgtaaggctaatagagaaaaatcagagctatagaatggtacctgtcaaattttgtaacttttaagcaaaattcttatttttggcgtattctcaggattatggcacgcccaagccaaatgctccatatccgccatatggccaccattgagatgctgtgccaaaatgaaatgggcaatggatgaattttaccgtgataaaaaatgagtgtggggaaattagagtccgtaatttttaaaaatcggggatgggattgggaatcaggccgggatgtgatttaaaatccaatttttggtccgggaaaatccacacgtcctatcccatccgggccctattactcataattggttagaatttctcaattggtgattttgatgtgatccgcgatttcaaccaattaatatgataa

SEQ ID NO: 80205 - DNA, 492 bp, Heterodera glycines
  misc_feature (464)..(464): n is a, c, g, or t
  Genomic contig location: Contig_ID=SeqID_15874; Location=1380..1871; Strand=-
  SCN-specific regions: Sequence locations=1-243,265-316,359-492
atgcccatttttatggctttcagcggaacaattgccattgaaaaggcaccggtcaaaatgcaagacgatgcttctgatcaaactgatcaatcacaaccgcaacaaaaacagatcatgttgggcgtcacaataatggaacttggcgaagaaacactgcacgagcgcatttatggcaatccgacggattttaatgacaaaaatggggcacaaaaattggacaaacaaatccgagaaattgcaaagccattgaaagaattgcacaaaggcaacaatataatattttggcatttgtgtgtttttacagggcaaattccacataaattttcataaaatttatgttttaaaattaagaaaataagcagagattggcctggatctggacccaggcctggatttttcctggctccagaggcccaggtccaggccattttttggcaacctagatttttcctggaccttgactntccttggatttttgtccaggaaatctag

SEQ ID NO: 80206 - DNA, 855 bp, Heterodera glycines
  Genomic contig location: Contig_ID=SeqID_15875; Location=560..1414; Strand=+
  SCN-specific regions: Sequence locations=1-225,247-251,294-771,796-855
atgcgcagccaacaggccaaagtgtccgcttctgaggccgcaaaagtgtcgcgcgggtcgggcgccgcctcggccgaatcgctggaggagcagtgcaaatgtgaggtgatgcagcccggactgtacgacatcgagacggagatgtgcacgccggaattggacgacgccaagcagttcatccccactgagttgcagaacaacgtcatggacaaaacaccggtggggagaaaccatcaacaaaatgaattaacttaaataaaattgaaaaattaaaaattttataaaaaataattgcaaaaaagcatgctagctagattaggttagttccaaaacacagggttcgttttagggcgagaacatttattttgtgtattcgaatccaccccagaaccagaacgaggcccaaattttttggcaaaaaaatgttacaaatttctgtatttttttttttgctctcccgcgctgaaattttttaaaaataacactgttttccgtgtctattattccggcgtgtaagtattttgctgaaaaaatggatatatcgaattccatacagatttccatgttcatcacggtctatcttatggacttgcaaacacatgccaacgagtcctacttgtccgcctttgggcgtgccattcttcaacggcggatggcacaaagcacggtggcatgttttctgatggggcttgatgtaacgttggccactgcacagcaacaacaacaatcccaagctcaacaacaacaaatgccggtggcaatggaaaaatgaatttaaaaatgaattattatttttctatacgatcgaatatccgcgcctaattagtgcaaaatttttgtgcattgctaagacaa

SEQ ID NO: 80207 - DNA, 226 bp, Heterodera glycines
  Genomic contig location: Contig_ID=SeqID_15875; Location=1533..1758; Strand=-
  SCN-specific regions: Sequence locations=1-117,163-226
atgatttgctggaaatgtcctgatgcaacggcaaaaaaaattgataaatattcaatgattattttcccggtctgttttattctgttcaacgtctggtactggttcatcttcatggggtaatatttcttttttttaattaaaatgtcattttttatatttttagccgtttacgatgaggacatattgcattttaattgaattttatcgttttaattttaataataaa

SEQ ID NO: 80208 - DNA, 559 bp, Heterodera glycines
  misc_feature (520)..(520): n is a, c, g, or t
  Genomic contig location: Contig_ID=SeqID_15876; Location=682..1240; Strand=+
  SCN-specific regions: Sequence locations=1-121,143-204,248-277,299 -335,364-375,449-498,520-559
atgctctctgcgctggacggtgttacatttctttacatcttttgtcatcacaaactcattcttggccctttttgcacaagcccaacaattggggaagaggagcatgtcatcgatgtgcatggggaggagggggtaaatgggacctcaggcattaaaaattcgattttgaggccccataacttttttttataatattgctaaaatattcattcattaatttttcacatggaaacatttcaaaattctggtgaaaaatgttttcggacaaaattgcagcagatttactggagcaacataatatagacacggatgtgaccaaccaataaatgataaggttttttttttaaatgataaatatttttagttttgatggactatattaaaaaaactttagaaaaattgtttaaacaattgaaatgaataatttaatttaactaaattaaaaatacaagcaacaataagcaaacatttattcaaaaaaggtgtaatgtgagcacatatttatttccttattttttanacaaaactttttatacattggtgaaaatcaaatgaaaaa

SEQ ID NO: 80209 - DNA, 173 bp, Heterodera glycines
  Genomic contig location: Contig_ID=SeqID_15876; Location=644..816; Strand=-
  SCN-specific regions: Sequence locations=1-173
taccccctcctccccatgcacatcgatgacatgctcctcttccccaattgttgggcttgtgcaaaaagggccaagaatgagtttgtgatgacaaaagatgtaaagaaatgtaacaccgtccagcgcagagagcatttttgggaacgttcacatcaattgagttacggaaggct

SEQ ID NO: 80210 - DNA, 1098 bp, Heterodera glycines
  Genomic contig location: Contig_ID=SeqID_15877; Location=175..1272; Strand=+
  SCN-specific regions: Sequence locations=1-7,31-216,239-364,388 -662,686-693,716-783,806-902,925-1098
gactcaatccaccagcattccaatcactgggactcaacccacctgcattcaatcactgcgactcaatccaccatcgttccaatcgtcggggctcaacccaccaacatttcaatcactgggactcaacccacagcatttcaatcgccaggactcaatccaccatcgttccaatcgccgggactcaacccaccagcattccaatcagtgggactcaacccaccagcattccaatcactgggactcaacccaccagcattccaatcgccgggaaccaacccaccagcattccaatcgccgggaaccaacccaccagcattccaatcgctgggactcaacccacagcatttcaattgccaggactcaatccaccagcattccaatcactgggactcaacccacagcatttcaatcgccaggactcaatccaccatcgttccaatcgccgggactcaacccaccagcattccaattactgggactcaacccaccagcaattcaatctctgggactcaattctcaagctttccaatcactgggactcaaatctccggcattccaatctctgggactcaaatctccggcattccaaacattgggactcaaatctgcggcattccaatcactgggactcaacccacagcatttcaatcgccaggactcaatccaccagcattccaatcactgggactcaacccaccagcattccaatcactgggactcaacccaccagcattccaatcgccgggaaccaacccaccagcattccaatcgccgggaaccaacccaccagcattccaatcactgggactcaacccaccagcattccaatcgccggaatcaaccctccagcattccaatcactgggactcaacccaccatcgttccaatcgccgggactcaacccaccagcattccaatcactgggactcaacccacctgcattcaatcactgcgactcaatccaccatcgttccaatcgtcgggactcaacccaccaacatttcaatcactgggactcaacccacagcatttcaatcgccaggactcaatccaccatcgttccaatcgccggaactcaacccaccagcattccaatca

SEQ ID NO: 80211 - DNA, 1292 bp, Heterodera glycines
  Genomic contig location: Contig_ID=SeqID_15877; Location=1..1292; Strand=-
  SCN-specific regions: Sequence locations=1-194,217-313,336-403,426 -433,457-731,755-880,903-1088,1112-1292
  Gene Ontology: Mol. function=RNA helicase activity; Cellular component=DNA-directed RNA polymerase II, holoenzyme; Biological process=establishment and/or maintenance of chromatin architecture
gctggtgggttgagtcccactgattggaatgctggtgggttgagttccggcgattggaacgatggtggattgagtcctggcgattgaaatgctgtgggttgagtcccagtgattgaaatgttggtgggttgagtcccgacgattggaacgatggtggattgagtcgcagtgattgaatgcaggtgggttgagtcccagtgattggaatgctggtgggttgagtcccggcgattggaacgatggtgggttgagtcccagtgattggaatgctggagggttgattccggcgattggaatgctggtgggttgagtcccagtgattggaatgctggtgggttggttcccggcgattggaatgctggtgggttggttcccggcgattggaatgctggtgggttgagtcccagtgattggaatgctggtgggttgagtcccagtgattggaatgctggtggattgagtcctggcgattgaaatgctgtgggttgagtcccagtgattggaatgccgcagatttgagtcccaatgtttggaatgccggagatttgagtcccagagattggaatgccggagatttgagtcccagtgattggaaagcttgagaattgagtcccagagattgaattgctggtgggttgagtcccagtaattggaatgctggtgggttgagtcccggcgattggaacgatggtggattgagtcctggcgattgaaatgctgtgggttgagtcccagtgattggaatgctggtggattgagtcctggcaattgaaatgctgtgggttgagtcccagcgattggaatgctggtgggttggttcccggcgattggaatgctggtgggttggttcccggcgattggaatgctggtgggttgagtcccagtgattggaatgctggtgggttgagtcccactgattggaatgctggtgggttgagtcccggcgattggaacgatggtggattgagtcctggcgattgaaatgctgtgggttgagtcccagtgattgaaatgttggtgggttgagccccgacgattggaacgatggtggattgagtcgcagtgattgaatgcaggtgggttgagtcccagtgattggaatgctggtggattgagtcctggcgattgaaatgctgtgggttgagtcccagtgattggaatgccgcagatttgagtcccaatgtttggatgccggagatttgagtcccagagattggaatgccggagagttggttcccggcgattggaatgctggtggggtggttcccggcgattgaaatgctggtgggttg

SEQ ID NO: 80212 - DNA, 773 bp, Heterodera glycines
  Genomic contig location: Contig_ID=SeqID_15879; Location=651..1423; Strand=+
  SCN-specific regions: Sequence locations=1-644,666-773
atgccttcgtggatctttcctcgagttgctcaacaacagcagcagtcgccgtttccacagcctccgaccactgccgttggttcttttcaacaacatttccaatcgcctggcagcagaggagcaccgttaccgccacacattccgccccaacctttcttttctgcagggcctccgaatggcactgtatgactgacaattgtttgatagttttagtgatggatggtagctattctctctatcgaagactcccttttttcatggcttaatttcttcacgtttttttaactatttctttcccttttcagatgaattctacgccagcaatgaacaactttggcactgacggtgctcagctgcacccgtcctttatgtacgatggacaagtgccgaccaacggcggtgctggtcacatgcttatgaacggagcgggcggccctggcgggacaattgacttcaatgaagacttttctggggggatcaatggcacaatgcctgcccaatacattctatccgacgaattgatgggaaagattcataattcgactaaacgaaaggtgtgtttgttataataaaatatgtttaaatagccgttttagacgctgttggaactgcagattggatttgagcaaattgcgtacgacgtgtccaacatttttgagacttgggctatggtgatcaaagagcgtttggttggcagtgacccgttgtcgtcttccgacttggagatcggcgccgccattctcattgaaatggtttcaagaaactgctattaa

SEQ ID NO: 80213 - DNA, 719 bp, Heterodera glycines
  Genomic contig location: Contig_ID=SeqID_15880; Location=1094..1812; Strand=+
  SCN-specific regions: Sequence locations=1-162,196-325,366-515,571-719
atggtcaaagacactttggcaaaaatgattcattttgtgccaccatcgaatgatgataaaatgctcccatttttccaaattgaaaggcccaaattttcaaaattcatcaacaacgatacggatttgttaccctaccaagatgatccgaacaaattcagtcagtaaaaaataaatttaatttttaaaattaattttggcactttttaagacaatcctgacccctgtgatgaatacggcgcagattgcgtgccgatcaaaaatttgttgttgaaaattgaggcattggcaaactgtaccggtaacgaaaacaatgcggtaaagacagaaaaaaatattaaaaaaatatatatactaaaataattttagattttcgaaatgccaaaatgggccccacttcctccagcgatgccatggaaaaagcgatccgaaacaatgctatgcgatggggatttgttttgtgacaaacgaaggctgcacgaacagtacaacagattgagggagagtgagtcacttggaaattaaataaattaattaattaaaaataaataaaactaaaaaatctaaattaaaattcagtttgtggacttcagcctgaaaaagtggaaagtcagcgtaaaaaacgacaatacaatccaaacgagaaatggaccgaatccccgatcaaaatcacattcaacaaaaaagctcgtaataatcttaccacattatacaggatttga

SEQ ID NO: 80214 - DNA, 1942 bp, Heterodera glycines; identical to SEQ ID NO: 15881
  Genomic contig location: Contig_ID=SeqID_15881; Location=1..1942; Strand=+
  SCN-specific regions: Sequence locations=1-109,131-146,168-417,449 -600,645-1186,1239-1502,1524-1942
  Gene Ontology: Biological process=body morphogenesis (sensu Nematoda)

SEQ ID NO: 80215 - DNA, 397 bp, Heterodera glycines
  Genomic contig location: Contig_ID=SeqID_15882; Location=16..412; Strand=-
  SCN-specific regions: Sequence locations=1-21,43-136,164-195,326-397
atgtgctcttcattttcgaaccctttcttcttccatttcccacaatcaccagcatcggcaggtgtcaccgtttcgtccgatagaacggaacgattgttggcgaagaatgccacgccaaccgttggcacaagggcagtggaaaaagcagaagaaggagaagcagtagatgcatttgaagggaccaaagaaagtgtagaagaggaagagggagaaggaagaggaggagcaggaggaagaggaagaaaaggaggagttggagaaggaagaaaaggaggaggaggagaaggaagaaaaggaggaggaggagaaggaagaaagggaggagaaacggcccatcaacaacaacacacagaattcgaaggcgaccaaagaatgtggccgcgacctgtgctgtgtg

SEQ ID NO: 80216 - DNA, 1722 bp, Heterodera glycines
  Genomic contig location: Contig_ID=SeqID_15882; Location=1945..3666; Strand=-
  SCN-specific regions: Sequence locations=1-156,181-481,503-679,708 -842,864-971,995-1431,1453-1669,1710-1722
atgccgcccgctacacaccaaatctattcacagaatttggatgcaattcctcacgtgccaagcacttcgaaatcatcgatgccgttaatgaagcaggaacccatctctgagcaagtgagtgatcatcatcatacatgaaaaagggagggtgggcggttttattttataaaaaaaataattggccgaaacatcactgctattttggagaaaatatcttatttattgtttatgttaataattattttcaggaacagatcaacctgcaattgggcttagacgcgccgaagtcgtctcgcgagtcgagtgttgccagcggatcgatccattttaagtatcacaaagaaggcactcaaccttctgtcagttctcttaggcctcggagatataggataaagccggattcggagaagcagaaccctttgtatcggataaagaggcaaaaggtatgtttgacatatgaaaatccatgtttttgacctctatttactggaaaacacattgattagggttgcagcagatgcgcgataaaccctcagaactaaaaattatttaagtccgaggatcttcaaaatataatcgaatctttttatggtaaaatttcttaatctaacaataagtgtcggtgaaataaaatttccagacaacccctccgacatcgccggaccttttttcgaaactgattttaaattaaaaaaagaaattattatgagcgaatatatttatttgatataatgaacttgtttcagaacaatgatgcagtccgacgcagtcgagacaaagcaaaacgcattcaagaagccaaggaaagcgagctgaagctcttacaagatgatgtaaggacgaatttcctcatttatataagcttactgggttttttatatcattaacatagaacggattctacgcttttacctatttagacgttttagtgccgcattttctccgcccaattcttgaatttagcaagaatctaaaaataattttaaaatttatacctattttcgcatttcgaaaaatttcttaagcatgtttttcccacaacggatatcggcataagcgaccccaatttcgaaccccgaattcgaacaaaagtcgaaaattaatttttcactaaaattctcatgtattgtccaaaacaggttcaaatgcactaaatggcagtgatctttattttctattgtattccgtccatttgaatagatttgggacaataaatgtaaaatttggtgaaaaattaattttctccttttgttcgaattcgggtctggggttcggcattgaccaaaattgaagttagattcatgattagcacctcgaaaaccacaggaaaggcgtttttaacaattttaaaaactcagaaccgcataaaaccctttaatttttttaggaaccaataaagtacatgattacccaaatttacataaaatgcttataagctttattttttagaactgtcggaaagccgaactgatagaaacgctaaaagccagcaacgcccaactgcaaggagagaatttgttgctgagacagaactgcaggtgcggtgctgttctgcgagttgcaaagcgttaatccgaaattgagcggagggaggtacttgagaagttgccgaaatgcaatcggacggattgtcatgccgcgtttttagatttgtgattactcacttgtgaaacgtgctttatttaagcaaacgatcatacacaattaacgggaactaataaa

SEQ ID NO: 80217 - DNA, 675 bp, Heterodera glycines
  Genomic contig location: Contig_ID=SeqID_15883; Location=356..1030; Strand=-
  SCN-specific regions: Sequence locations=1-71,94-367,390-675
atgcttctgctcttggcattgttcactttggcattgtgtgccagtttctgtgacggaatgggtgacaagaacaataaatcttttggaaaaaattggctgagtttgggcgacagtaaaggaaaaagtaaagcgtccaatgcatttaatagcaacagtggttcaacaacgaactttgccaataatcacaatgcaaacaattctttgtccaacccatttaatagcaacccatttggaagctatcaacccaaccagccaaattgggcaagtgaccaattccatcagttggacagttcatcgaatccaactcaaagtcgtggccaaaacacctcaaccctgggccaagacttccttagcattggtggtaacaaaaggaaaagcaacaattttggcagccaacaaccaattagcaaccaatcaaaccaatttggttcttcttctttctctgcaaaaaataagggcaaaaagccaatggattcaaataaacctccgcttcctcctgtctattattcaggtgaaaaagtttatgaaaatggatcaaccgaattcattgaagaagtgtacaaaaagacagggggagactttcctgttgtctatcattcaatggaccaaattcatgaaaatggatcagccgaatccattgaagaagtttacaaaaagacagggggaggccattga

SEQ ID NO: 80218 - DNA, 238 bp, Heterodera glycines
  Genomic contig location: Contig_ID=SeqID_15884; Location=524..761; Strand=+
  SCN-specific regions: Sequence locations=1-238
accctttgtaacctaatcatcacaactgcaccattttctcgaccaaaacactcgcttccaccggtaagtttgaacccgattttggacgttctgttggctttaagaaattggaaaacagttacatattgtagaagtggtgcaatgtgtacaaaagcattgagcagaagtacaacaccgccactctcgcccgccaagtgcgcggcgtcaatgctcactcactcattaatgagtatattta

SEQ ID NO: 80219 - DNA, 578 bp, Heterodera glycines
  Genomic contig location: Contig_ID=SeqID_2528; Location=83..660; Strand=-
  SCN-specific regions: Sequence locations=1-186,224-578
atggattgtgcctcaaaaattaaactccctgatgagtttctttccgaattggccaatgcctttcgtttcaatttccgttggtccgttcttcgaatttcttcctcagtttttaattactttctcgccaaaagacaacaacaaattcttcaaaatgttgatttgaaacttcaaaaagtaattttaaggaattattttaattaaaaaaaaacttcttaaattttatgtctcaaagtctccctaaaaactttagagttctttaaagaaaatcaaatgttcttaaaaagcttgaacatccaattttctcatacttcctaagaattttatgtaagtctcggttctcgattacttgaatcttgaaattttctctgcttcttttggagtctcggtctcgattttttgggaattttttattttcggtattatcggttcattttcagatcgtcaaatcgtacgaacagcgcgaggggtttagcagtgttgaaaagatgtccatcgttattaacaaaattatagcatctgtggtaagaaatgtcgccgaagctgtactcggggctcgcgctctgatcaacttacatacg

SEQ ID NO: 80220 - DNA, 1101 bp, Heterodera glycines
  Genomic contig location: Contig_ID=SeqID_2529; Location=963..2063; Strand=+
  SCN-specific regions: Sequence locations=1-51,73-77,99-143,182 -336,496-1027,1049-1101
atgcttcacaacattgccattgattgtcaggcaccacagcctgcttttgatgatgatgaaatcgaaaatgagcaacaagaaaatttaaatgatgaaaatatcgcattaagtgctgaagctgttcggaccgattatattaatcgtaatttttaattatttttaaattaaaaataaattatttgactccacaataaacccgggtttgcttaacccgggtttacttaacccgggttaaagacgagcaacgctattttcaaaaatttttaacccgggtttacgaaacccgggtttaatcgttaacccgggtttactaaacccggagacgagcaacaggcccctggctggggagttcctgcgatcaccaaggcagggctcctgtggcgaggctccaccattgcactttcggtcggggctgacctggcagggcggtcccgaactgggataggcccacagctaaatttttgagtgcagggaacggcgttcgcgcctcccctttaaaagctttgcttcatctatttgcttgccgtttatccttttcaacactccgagtgccgtgccgcgttgatgaattctaattgtttttctcataattttaaatgttggatgatttaaagtcgttaagaaaactttaagaacgagaacgaaaatgtccccctgccgtacaaaaacgtctcccttacggaaacaaccataacgaccctgaccgtgcacttccggtttacctcagttgggccccagcatatttttggactatatatattttttccattagaaacttaacgatattggcatcattagaaagctgttctagtagccttacaaaaaatcaaaaagatattttggcttttgaaaaagatattaagaaaaaatttaactttacgcaattttatttcttggcgttctgtcaaaaaccaaaaaaaaatacaatgaaaaaagaatttgcttaattttgttgactcattgaagtggatatgaacaagtttttgccttactcgtctgacaaaaccataaaaaccacttttccaagaaatggcttcttctgctgctggatttgccattgtcaccggtgccaacaccggcctcggctttgcattttgttaa

SEQ ID NO: 80221 - DNA, 108 bp, Heterodera glycines
  Genomic contig location: Contig_ID=SeqID_2529; Location=1196..1303; Strand=-
  SCN-specific regions: Sequence locations=1-108
ccaggggcctgttgctcgtctccgggtttagtaaacccgggttaacgattaaacccgggtttcgtaaacccgggttaaaaatttttgaaaatagcgttgctcgtcttt

SEQ ID NO: 80222 - DNA, 478 bp, Heterodera glycines
  Genomic contig location: Contig_ID=SeqID_2530; Location=305..782; Strand=+
  SCN-specific regions: Sequence locations=1-135,158-223,246-268,290-478
atgattcggtccgcactttcgtctcccaactcgacgagcgtccctatcaaaagggcagtttgcgattgctcgtcaacaatgccggcattatgggccatccctttcaattggtcgacggcgttgaggtaggcagacaaaaaaattaaaaaattaaaaacattttccctgggatttcgaggtcgctgctcacaaatatccatttgtaccttaaatacacggaaacaaacataaaatcatgatcagcaacccctgaaattttaggaaacttttttatgacatttaaacttttctccccaaaaagggggttgacgcgatcttaattaattgtattcccaaatgtttatgcattgcgaaaaaggaaaattccctctaacaataaaaaaacaggattttttttttgaaaattgcaattttcaaattttttaggtgcatttcgcctccaaccatttgggtcattttctgctcacaaatttgctga

SEQ ID NO: 80223 - DNA, 1030 bp, Heterodera glycines
  Genomic contig location: Contig_ID=SeqID_2531; Location=196..1225; Strand=-
  SCN-specific regions: Sequence locations=1-158,181-187,209-281,303 -747,770-1030
atggacaaaaagcggttgcttggcactgagaaaaggtaatttttggcaaaattttgttggcataaatgcattcaatttgagcagaagaaaactagaggaattttgaaacatgtcggaaaaatccaggatcctcgaggttttgatccagctggacctgaattttttgaaatttgttttaaagagcaaacaaatgttagaaaagaaatcaattcattgcttaggaattctaaaaatatcttaatacatgtttttttctggattctccatgctctaaatagtgggaaaatacatatttttacatatttcggggtttttaaatgggaacataaatgcgttgtcatttcctcacagcattcgtaatcactagggctgggatttttatgttttaacatattttttttgcggcttagttatggcgagagaagcccaaaaatagcattttctccgaacaatttttgatttagagcgacttataaaaacataaaaacacatattttggcgttttggcacctaaaaacatatcgcacatatttcggggttttggcacatattttgcacatattttggcatttttgagaaaaatcgtaagaaaaatacaagaaaatctgaaaatgcaccctaaaaattgactactttacgtttcttaagcatttggaaaatttctttatatatttaaatgcctaaagcagcccaaatcaaacgctgtgttaaatcgtcactggatttcaaagtgcccggaaggaacttattcaactgatggaaaaattatcttttgtcaacggtgccttcaccaagtattagttttgacaacggaacagcggcatctgatttgcatttgttctcacgaaattgataaagactgatattaaatatgatttttttttgcgtaaatacacttggtttttccaatttttagcacatatttttgcattttttaacacatatttaggcctttttttggtttttagcacatattttgagtttttttagcacatattttattacatatttcaggatttttaccacataa

SEQ ID NO: 80224 - DNA, 950 bp, Heterodera glycines
  Genomic contig location: Contig_ID=SeqID_2531; Location=1917..2866; Strand=-
  SCN-specific regions: Sequence locations=1-71,102-132,154-154,176-911
atgatcaactttggagctgtattatgtttcagaggtcagtagtcagtgataaaactccttagtccaaaaacaaaaaaaaataaaatatttaagaaaaattaggtaagaattttgaaaatttgaggcaattccaaaatgcataaatttatttttgttactcaaatgtaatttatttgcctaattgcagtaatggacctctaaaaaaacttatcgcaactttggaagaaaggatttccgagcagcagttcggaatcatttaaagcattttggccatagccgaagaatttctcaaaaatgccaatcgaaatagggcacaaatttggaacaaatttttatatgatgacctttaatctccaaaatgtcaccgcccgaaagttccgtccggtctttggtctcgcggcattttgcgcctcccccgttccgcttcattgttcccaattcgccgcttcatctcgaaacactgtgacaaccggcaatttggtaaaattaaatttcggcaaatttgtggcgagggttgtgaatgatggcacaccaaaccagccggcactttgccagagggtggcacatggcgatgaaatgccaaatggcgcggcggctgagacgacggagtggacagaataaaagaatagtgggggtatgccgacggcactttttggctcagacgaaattcaaattttcattttccaaaaataggccaaacaatggcaccaccaaaaaacctatacaacagtggcaacaaaactgcagttaaaaggtttattttgcatttttgaagtcattcttgaaagaaaaataggaaaatacaagaaatagggcagcaaattaatttttaccgtatatttttcaggtgtcagaaaattggaccaaccgtaaattttgtacaccgaaagattggacagcccaattttacctatttttataaatatattttgaaataagaattaaataaa

SEQ ID NO: 80225 - DNA, 394 bp, Heterodera glycines
  Genomic contig location: Contig_ID=SeqID_2531; Location=3565..3958; Strand=+
  SCN-specific regions: Sequence locations=1-196,219-319,341-394
atgtcatttttttgtggcaatatgtcatttatggcgaaatgtcatcggcaggcaatgccaaccccaacggcacaccgtttggccgtttataagcaggccatgttccaaacaaatggacaaatggcctcattttcactcatccatacatctgtcagttgcacttgcattttgctgagattttggcggtgttatgatcaaaataaaaaatatttttggttataactttgctaaaaagcaacaagattttttattcttgatatcatttaatagcactaaatattcttaattatccagccaaatttcagaaaattatgtaaagttttcaaaaagttatgaccaagatgttcaaaaaccttgtttttgagttcctatggctctaactttttgatagtta

SEQ ID NO: 80226 - DNA, 1156 bp, Heterodera glycines
  Genomic contig location: Contig_ID=SeqID_2532; Location=1022..2177; Strand=+
  SCN-specific regions: Sequence locations=1-265,298-405,434-775,797 -822,850-947,983-1015,1052-1156
atggccaagctgatgctggcacccacccagctgtggtgcttgtacgtcgacgttgtcgtcctccaatttgacggcaacgcaatggacgcaatttcgttggcggttcgtttctcactgaattattttaaaaattttcaaaaaatgtgtttttcggtagaaaaaggtttaaaaattctcaaaaaaacaagctttttgaccgttttataagttgtacggacgatagaaatgaatattttttggtacttttcggttttgtggcccggatttgaaatttaaaaaacaacaacaaatggagcatattgttagtgcaagaagtgcacaccaaaattattgcggagaaataaatgccataatttgagatattttcaaatgcctttttattaatttattcaatggaaacgtaaattgttgttttttgttgctgttttatgccgtgctgagacgatcctaaaatagtatcaatggggcgttcctaaaatagtatcaatgtgggcgttcctaaaatagtatcaatgtgggcgatcctaaaaaagtatcaatgtgggcgatcctaaaatagtatcaatggggcgttcctaaaatagtatcaatgtgggcgatcctaaaaaagtatcaatgtgggcgatcctaaaatagtatcaatggggcgttcctaaaatagtatcaatggggcgttcctaaaatagtatcaatgtgggcgatcctaaaaaagtatcaatgtgggcgatcctaaaatagtatcaatggggcgttcctaaaatagtatcaatggggcgttcctaaaaaagtatcaatgtgggcgatcctaaaatagtatcaatgataaaattaattaaaataattattattcaatgaaacaaatattttgcaagtaataaaaattgttttctacataaaatattattacgtcggaaacgataatcaatgtatgtcaatatttttttgccatataataacaaatttttaatttaaaaatatatttcccttcagtgttaaattcattctttagattgactaaaaaatgaaaatattttttattagttttatttttcccttaattttacttgattatttggaaggccataaatccggatttgaaggattcgtaaaaaatcctcaagcaatatcacttgtcaaaagctatgaaaaaaaggaa

SEQ ID NO: 80227 - DNA, 1053 bp, Heterodera glycines
  Genomic contig location: Contig_ID=SeqID_15885; Location=51..1103; Strand=-
  SCN-specific regions: Sequence locations=1-162,185-393,415-425,447 -588,610-704,734-944,966-1053
atgatttctgctaatggtggcagcagcaccaccaaagtattgaaatgtctgatgtgtggccagtcggagtcccgcagcacgttcatggcacatattgcagaacatttgtaagagcaataattaaaatgactaattatactgtacctgaaaatacagtaacccatttttaaaaaattaatttaaaggaattatcgacctcaccaatgtgccgaatgcgatttccgatcagtgactgctgaacaaatggcggaccatgaagcaaccactgaacatgttggacagttaaacgtacgtctaatgggttcaaccattaattaatactaattaattttttttgcaattaattaggcataattttaaaattaattaggcatcatgtaatccctatttggaccggctgtgccattttgtgtacaacgactgcgattttggggacaaaaatgggggtctcgataaagttttgatgcgcaaattggtcagcacagcggatgaggagcagcagatcatccgccaagcggttggcacaataaatttctgcaaatccatgcctttgccaattttttgtttaaaacatgaaaaaagcaatcaaatgttaaaaattttatttctgcttacttcttggaacacaaataaagtttttagttaacaatcacaacttacgacaaacttgtgcaaattgcaacaaaaatgaacagacggtaagcaattttaaaaaaaattaaaattttaaattcccaattctttttttcatgtttcagttggatttgtaacgacgtgtggatggacattttcccatcttttgaccatgcccaacttggcctcaaaatggcactgatttccgaccgtttcgatgttttggtggacaaacatttcgatggcaaaagcgaattgacaatttggagaccaatcgaaattagcaaggatgaaggaatgtcaaaacttttggtggatcaagattttgagggatttccattgccggaccgtccgctgcccatcaaaattcgctttaagaaccttcggattgagtaattttaaacttttttgtatattaaa

SEQ ID NO: 80228 - DNA, 3216 bp, Heterodera glycines
  Genomic contig location: Contig_ID=SeqID_15887; Location=138..3353; Strand=+
  SCN-specific regions: Sequence locations=1-270,312-427,476-839,861 -1276,1298-1317,1340-2163,2187-2359,2382-2531,2554-2959,2981 -2988,3017-3024,3061-3216
ccaattccgctcatcgctttgctgctttttgtgccattcattcaacaaattcggctcgtttctgctcaatccctgcgaaacattcacttgggcttccccgaggcgtgggacggggacaaattccccgaaatttactgtccttcaaaaaacatcccaaaatggttgggtgagcattttttgctttgttatcagttcatttatacaatagaatttaatttgttcacgagaatgaagtttttttgaatttataatctcaattaatattttcccaatttaaatcaaaaatatttaaatttttattttataaaattcacaattcattatttctcagacggttactttctgtgccaactttcggcagcgtacggcgaccccaacgcgcctccggggcagaaactgatgcatatgatcgacgccattggcgtactatattaattaattaattttttattaaatcatttttaattttaataaaggcaatcggatcgttccatctcagcgggggagaggtgaaaaatgattggcaaaaaccagcagagagagagagagtattcactgcttctctgcttccaattgcaggtggtgttctcggcccgctattacccctccaggccctaccgtatctgggaattctacgaccgtaacatgaccaaagcatcgggtcagtggtggtcatttacgcatgggatttcattacggtatacccacccgtccttttacagtaccatgggccggctggtcccactacaatctgagcgcaatggcacggtgggaacaagtgccagctaacccggacgcaggtcggtcaaagcgcaaaaacaaaaaacgaaactttaccaaaatgccaattttcaaatttgcttccacccacacagtgccattcattccattgtctgtccctttcccatggctttagcccgcttccacccgaacctcgacttttggcgggttggccacagaattatcgcgggcaccgaagcgccctattgggtgggctacgaattcgatgttcgttttttggcatttttttaatcaagtcccattcctcaatgaataagaggcattttcacaggttccaaaattgtccaattttcgcttggcctcttttgtggaggacaacgacattttcggcacttcggcacggccttcgctgattccaatttcgatggcaatgcacgaaagggcggacacgacacggaatgccaagaatggcgacgaaattttatggggcactttcagcgcaatgaattttgatgaggagcgattttttcaggcaaaatcattttaatgtttatatatttaatttggaaggatgggaaattaattaattatttaattagaaatcactaattaaggggctgttcaccatcgactcgaacggtgtccgaaaggtggtgggaatgtacgattacggcacttgggacgcaaaagcatgctcaaaagaggacgaatacatcggtgagacaaattggcaatcattgaataattaattaggcatattttctatggaagttaatcaaaatttaaatatgaatcacccaattaattaagacatttctcaatgcatacatttcgggaattcagaccaaaaaatgcccttaagagaaaacgttttaaaagaaatcaattatataatagctctcgtgtaaaattctcccctatttcataagtgtccatttattccgtcaattgtctctccgtcattcaattagcgtcaattagcataatgcgttccttttgccgcaggtgacaaaagtcatctgcccggttacatgcactcgatcagttccacggaacattacgtcattctgccgatcacttcgctggtgataaacccgtgcaagttcaaagagccgccgcgcaccgcgggcgccgacccgcaaattcagcagggcggcctttggggcatggacttttacgacgtggtgccgatgaggtgcgaacttgtgtcaggaaagcacaacaaaaccaaagcctcggaattctgttggcattattctctgtcaggtttttggtattcgacaaacgcaccaattcgtggtttacccaaaagccgttggaagtgttcccgtcaatgttcgtcacccatcagctgaacgccttcgaagactcggaggggaacatcgtggcggacatggtcagtcaattagcgatcattagaagagggagggaaggaaaaaagggccgaataaattgggtaattaagtaaatattaatgactaaagggagggccgaaatcccattaattcaccgtaagtgtgattttggccacaaacgtacagacaaatctttaagtttcatctctgacttttggcattttgccaaggcttaattggggggggggtgattgcttctcgggttttcatttttggctttccaaagattgtctacgacagccacgacccttacgtcaaatatttctacgccgactttcttcgttcccaactctacccgaacactgctcgcattttgcgctttacgttggacttgcgcacttttcgcgtcatgtacagctatttgataccgcaggcaaattaaatcaaattaaattaattggctaattaaatttgataatttcaatccattaaggagaccatttccgccgacttcccccaaattaaccgcgcgttcgactcgcggccttaccaatgggcgtattttgtggagaatccgttcgccgggggcaacaaaattgtcaaaataaatgtcaacgaaccctcggggacaaagtgccgaattaatgaccttttttaaaaagcatttaaacccttccaaaactcagaaatttgcacttcaccccggacgaattgcaattggtgctgcacgagccgtactttgagcagaggccgggcgccacgcgagaagacgacggcattttgttggtcagagggttggagttggaggagaacaaaggcaggcgaaggaggaaaagcatttgaaaagcttattaattaaaattaaaaacagacccggggggtaatttgggatgaaatgaataaaaatgtcatttaaatttcgacaatgaattaaatcataaaaaataaataaatttgaattaatgaacagttttatccttggaattttttcaggcattctgctggtgatcgacgccacctcaatggaagagattggtcgcgcttttgtgccaatttccgtccccttcggcttccacaatcgctttttctctcgccaacagttgggccttaccgtaggcca

SEQ ID NO: 80229 - DNA, 1511 bp, Heterodera glycines
  Genomic contig location: Contig_ID=SeqID_15890; Location=959..2469; Strand=-
  SCN-specific regions: Sequence locations=22-190,231-555,580-811,833 -1131,1153-1188,1210-1211,1233-1243,1265-1511
atggatgatgtattggattgtgtttggcattttttgtgcgggtgaggcggtggccgacattttcctcgcattttggttttttttattaactgttaattgaatttatttaattggattacatatattcaggtttccattttactacgaattgaaaattatttttgttttttggttgctcagtccatggtacttatttaagtttatctttatatatataaaattaataaattgcatttttcaggacaaggggcgcttcaatcttataccgcaattgggtccatccgatgtttatgaaacacgaggaagaaattgacaatttcctcgaacaagccaagaatgagtcctacagacaggtcaatcttttttaaatgaaatttggaaattaggtaaatggtactttcctgttatgaggccacaccaaaaatttaaaaaaaaatcaacaaagggagcgctgcaaacacagaggagctgatcaatttaacgaaatttatctgcaattgtttcatttatgcttcatcactagtgttacgctcgccttgtttatttttcgttcccttttattaatttttttaaatttttgggtgtggcctcaaaataggaaagtaccttaaatttgttaattttgcattggatttcctttccgttttccttgtcctagtgctttttaggtggtcagtcttggctctcgtggtttgtcttgtgcgcgtgacattgtcgcgaccgcggctctccgtggcgccgcatttagccatgtccaactcaccgatttgcaacgttcgtacagcacgggcgatataaataacgcgggaaagggcggcggtggggagagaaaaaggacgacgaccacaacaacggtggtctatcaaaaacaggcagcaacaacaagtatcgaagaggaacacctcggagacaacgacgacgaggcgcaggttcggacatggaccggctcatatgacgaatacggtaacatcgtggagaacgcaatggctgagtcgaatgaggcgacggttagtaagccataggcatggacaaaaccgtcgacggaaaggcccgtaaaatggggagggggtaaaatggtggcacagaaatcgttactttttgcagtttacatgacagatctcacacacatttttaaactccattatttatttgtccatttgcggaaatagttaattttcaggtaaaaaaggtcaatgatgaggagcttgtcgtcattgaggtttttgttttcaccactttatgcccttttccacctatttttctcgcctccttaaggaccccatcagttccaaaccgcgtcgctcggactccgtttcacggcgcagtcggtcgcgttcccgaaaaaacgacgagataaacggtttgtccggatttgagtcgaatactcttccacgtcgaagcacgcgatcgacgacacgtacgggtagcaacaattgatttattgagcaaatggaagacgaggcgaagagagatggtcatttgactgactgattctaatttttgtaaataaa

SEQ ID NO: 80230 - DNA, 844 bp, Heterodera glycines
  Genomic contig location: Contig_ID=SeqID_15892; Location=870..1713; Strand=+
  SCN-specific regions: Sequence locations=1-64,88-215,246-743,765-844
atggtaagccttagacgataagaccgattttttatttccgcgttttttttttgttgtgttacaaatacatatgtatatacatatgcaaatagctattagtaacggaaccccgacatttgcgtctttgtccaaaagcggattcaaaataaccaaacatcactaaaattaagaaattgtagtattctagtttattaggagcttaattatgttgtttgaataattaattattttttcaaaatttttttgtgatcaaatgatcggatacaatcacattctaccgcttatttaaagctgttaaggctatcagggattgaaaaaacttaattttgaacccgattttggacaaaggcgcaaatgtcggaccacaaaagtcggggcgcaaatgtcgggacatgattaataactgatgagttttgtccttcatatttttgcactgttatttgtttagatatgcgatgacaatgatcagtcgcttcgcttggctaattttgattggttacattttgtaaagtcccaaaatgactgtgactctcagaaagaagaactacaaatcaatggaagtgaaatcgattcgtattcagaagaagacgacgatttcattgatgtttctgattgcgaagttggcaatacgaaagaaatggcggaagtgacgagaaattcgtcaaaacaacaacacattgaggatcgtatcggaagtggtgaagagacgacggaggacgaattggaagacgaagcgcattttgaaacacggaaaatgagaaatattgggctaaaaagcaaagaggaggacacttacgccgactgttatgtacactttattcaatttaacaatgagacttattag

SEQ ID NO: 80231 - DNA, 129 bp, Heterodera glycines
  Genomic contig location: Contig_ID=SeqID_15892; Location=226..354; Strand=-
  SCN-specific regions: Sequence locations=1-129
atggcgcacgaacggggccttttgaccagccgtgttcgacacaccatcttcgatgtaaaaggagtgagaaatgctgcggatggttcaattatgagcttcaaggaagctcgtgatgcgggaatccttcag

SEQ ID NO: 80232 - DNA, 636 bp, Heterodera glycines
  Genomic contig location: Contig_ID=SeqID_15894; Location=135..770; Strand=-
  SCN-specific regions: Sequence locations=1-32,55-75,97-563,585-636
atggagaataaatttattctcgttccttcagacttgtacaaaaatttattaaaacctgagtctggcgagattaatgttgaaaatgctaaaaataaattgtcatcacttttgaagcagcgaaaattggacgctacttcaaaaaatttactttacaaccaggaattgaggcgtttcttgaaacttaggaaggaagttgaagaaaaaccggtaaaggttgagctttcagatggctcattaatggtgtttaaaccaaaacagcgtgaaagagatagcaaaattcctactcaaattgttaatgacgaaggattggatgaaacaggctctattccaacacttgaagacccttacactactgctgaagagagtgatgctgagtcaacaacatcaacaccaaagacgagaccactgataagaccaatgcgtgtaggaacaactaaatttcgtcaaaagcaaaagtcttttgtagtcaagaaacaacaaaaaattatgtcgattataaatgatgaccctgagaaatttggtatcggtgctaaaggacacatacttagagctaatggaacggcatatttaaaaagtaatgttaatcaagcattagagcgaatattgagacggtcacccgagaatgctccatcaccg

SEQ ID NO: 80233 - DNA, 1217 bp, Heterodera glycines
  Genomic contig location: Contig_ID=SeqID_15894; Location=953..2169; Strand=-
  SCN-specific regions: Sequence locations=1-375,418-511,533-892,914 -1037,1059-1092,1114-1120,1142-1147,1172-1217
atgtcttctacttcttcaaagaagactctccaatctgtagtggagcaagtaattcaacaagacgcagaaataaaaagcagtgagaaaccactaaaacagaatgagttggaaaagagtgaacggaaatcaacccacaccgtatataacttacttgaccaccaacgatccttttggaaattggcccggccaaagtttgcagtgatcaactttctctgcccagggtgtcgtcgaatcaactataagcacaaggaccagttcaagttgatgggagaagatgagtttcactttacccaagtgatgtgtccgggttgcgtaaagtacaatatgatgcagactgatatctataacaaacacacaaagaacccccactaattgtatttaagattaaaatttaacattatatttataattaataaagatgattgatgaaaaattttttcacttgaacgatttgaaattaaaattgccttttggcatggtaattagtggaccattccagtagcggtaaaacaacattttttctaaaatttttgagagaaagagatgagttaattagcccacacccaaaatcggtgctctattgttatggtcaatttaatgatagtattcctgtactacaaaaaatgggtgtacatgtgcacagagggtcacccacagatgaattgctgagctctctaaagaagcctctcttattaattctagatgaccttttaacaataattgatgagaaaagcctatccgaattattcattaaaaaagcccaccatttgaatatgggtgtgattttcataacccaaaatttatttgaaaaaaaggtgaaggtagcacgaattaattcacaatatattgttataatgtcggcgccgaatgccgcgctacaaatacgtaatttgggtgtacagttgttccctaagaggctttccttcttcctaagtgcctataaagatgcaaccgcatcaccgtatggatatttattcttggatttacacccagcatcgagccctttactgagaatacggacaaaaatatttaaagaagatgaagaaaaagcattgtatattcaaaatgattaatttacctaaaaatgttattcaaaacttggattttttaaagaaattggtaaaaacaaagtcttttaaaaagagacaacaaatatttaaagaagcgactagtgagcaaattggattattaattgaaattagttataatatattaaa

SEQ ID NO: 80234 - DNA, 1635 bp, Heterodera glycines
  Genomic contig location: Contig_ID=SeqID_15895; Location=415..2049; Strand=+
  SCN-specific regions: Sequence locations=1-92,114-1467,1497-1635
atcgaaatgagctctcacaagaaaatgaatgggaaatttattgggaagaaaaagcgtaaaattgaaaagaagtggaaaaaggaagaaggaaccaataccaatgacagcaaagggaagaagccatcgtcaacagcaaaacattcgccattggtcggccatgaaagtgatcagaaatggtctgattttgacatacggattcagagtgatcatgcaaaacggggctcaaattccaaaaaacggagaaattttgaaaattttcttcccatcgccacttaatggctttatttagaaaccaagatttttgcattaaaatccctcattttctaaggtacgagagccaatttgatgaggtcagagcagagggcagtgccacgccttccgatgaattggtccaacgagcgcagaatcggggggaggaattgctgagccgtgacatcgcccgttttgcccaatgttcgaattttatgcaaaattccgatcatttttctaggcaaaatgtttcaaaaaattggtgccaagttgtcaaattccgttttgccccttctgtggtgatgacaaaacgggccataaacttgggaaattgtaatttgatttggtcggcgcttaaatatgggaataaacgcgcatttccatggccaattcccaccagatgcgccgccacattttgccaaaatttcccaaaaatctgtgaagcgcatttaaatttcttccccatttttagcctatcggagtcaaaaccgtgccgatgccgactggctggagatggtggccaaccgtggcacttttcccgaccgtttgtccgccctccaattgcgcatccgtcgctcggctgtccacgcgttgccccaattgcggcaatttgtccaactcgcccagcggaaaggggccaaaattcgccaagcgcacacattgaccagtacgggggggggggacaaattgacattttgaatttctgagcaagggcctgtaggactaattttcggactaaattgtgcaaatttgggcggggattttgacagttccatgggctttttggggtcgctgatcacagttgtgacattcattttggacatttccgaactcgaacaaaactagaaaattaaatttttttccatttcggaaaaatttgaaaatttttgttggctttttttcgaattttgggtttggaattcgaaattgtccgaaatgaatgtcatagtcagtcagcgaatccgaaaactccaaatatggtctaggcaccccttagtgtacaaaatttttttgccgaaagcgaggggtccatcggtactagtattaccaaggtttcaaaaaaatccacataattttatttttagaaatttggacccaacttttttccatcgctctaaaaatgccatcccccatttttagaggcgttgaaggacatttttctgcacgaacttttgcctccgaaacggaaactgctcacaatggcacaggtttttgagcaaaaaataaatttaaaaaatgtaaaaattgcataaatttcagaggccattggagcaatgggtcaatccgacggcaaataacaaatcggaggcggacaaacgacttttgatgtggcactttgaagcggagctgaagcagttgtaccaccaatttgttcagggacttcag

SEQ ID NO: 80235 - DNA, 394 bp, Heterodera glycines
  Genomic contig location: Contig_ID=SeqID_15896; Location=46..439; Strand=+
  SCN-specific regions: Sequence locations=1-394
tgtaatttgcgttcctctgacagaattctctttgacattttgaagaaaattggcgacggacgaaaggtttctttcacttgcgacagttcgcgtgtcgcagaaaacagtcgagtgatagtcagactcaatttggaatcgaacggtaattaagcaaaaaaagacactatttcaataaccccaattaagaaataagcattcttcaaaaggaccaaagcaaaatcgaaggtgaaattccggtttggaaattcatcggctctttggttggcacttattgtgcggatgatcaatcggttaatgagttgacggaccaatggcttgcgctggcctcgtctgtccgaattgatgaactttcaagacagatgagcgttcatttgggggcacacgatttcctcag

SEQ ID NO: 80236 - DNA, 854 bp, Heterodera glycines
  Genomic contig location: Contig_ID=SeqID_15897; Location=17..870; Strand=+
  SCN-specific regions: Sequence locations=1-509,542-854
tgtaatttgcgttcatctgacagaattctctttgacattttgaagaaaattggcgacggacgaaaggtttctttcacttgcgacagttcgagtgtcgcagaaaacactcgagtgatagtcagactcaatttggaatcgaacggtaattaagcaaaaaaagacactatttcaataaccccaattaagaaataagcattcttcaaaaggaccaaagcaaaatcgaaggtgaaatttcggtttggaaattcatcggctctttggttggcacttattgtgcggatgatcaatcggttaatgagttgacggaccaatggcttgcgctggcctcgtctgtccgaattgatgaactttcaagacagatgagcgttcatttgggggcacacgatttcctcaggtggaaaagggatgggtcaatagtgtcacagcaaaacgtgcaaaagatacacacagcaatccagaattttgggactcagaaaattccaaggtcccaccccccccccccccgaaatgaaaatttttaaagaatttccagcaaccaccaaacgaaaatttattttccttaaaacggccaaaatagggtcatttttacccagcagcggcaaaaaaaggaagaagaaaaggtctccaggttggccccccccccgaaatgttttcaagatacgcccctattgccccgtgcattattttttaatttaagctctcaacacgccatttgcttgcccgatttggtgttacgttgttgtttttttgataccaaaacgacggctgatttgctgaattggtccagcataaaggcatccaacaatgtgcagctgtgggcgaaacgagtcgatgatgcatgtgcgaacatttga

SEQ ID NO: 80237 - DNA, 220 bp, Heterodera glycines
  Genomic contig location: Contig_ID=SeqID_15897; Location=1645..1864; Strand=+
  SCN-specific regions: Sequence locations=1-37,59-220
tgttttggacaaattgttggccgaaggacacaaattgatgttggctcagtcattttacgacgcgtcagttgtgctttgtaaggctgccgaattatcgtgaggctttttgcacgtcaatttattattttgtttcgaaatattttagctcaaaatttttcggcgattttgctcctcagtcattcttgcctcatttcaattacggcaaagcactcattgaggt

SEQ ID NO: 80238 - DNA, 793 bp, Heterodera glycines
  misc_feature (223)..(223): n is a, c, g, or t
  Genomic contig location: Contig_ID=SeqID_15898; Location=561..1353; Strand=+
  SCN-specific regions: Sequence locations=1-311,333-515,547-793
atggactatcagcgcgagcaaagggcggcgaaggacaaaggcagcggcaacaaattgcgactgctctcattggacggaggcggcatcagaggattggtactcattcaggtgaggcacagacggaagggcaatacgcgtaatgatgggtactgaattacttcggtgtatacatgtgcaaggggtgtctcagcctaagggccatacataggaaataaaacaggcngggggggggtggtgtcgggaccgattttttcatccgaattctaaattttctctgttgtcaactttttcgattaaatttcgcggcgcgcattttctaaaaattttgggaaccagggaggggtgtggttcggcagtgccgacaggcgccgctgatgaaaattgagtgcaatttgttaacaattcgccaaaatggtcgatttttggaattttgagccaggcaacgaccatttatttcgggataggggtggccggcggtgcctattactgctattcttaacagttttctaccaaaaaaccattttgttttttaaattaatgtattttgaagtattactgctggacaaataaaatacaggattaccattctcattgtgtagttttttttattttttgcttttttcaggtaaccaactctgatggagccgcagtggaattagcaagaagaatttgccatgacaaaaaagttccatttttccggatcacgcctcaactgagagacgaaataaaaatcgacaccacagacaatgtgcaacttataaaaatgatgtggaaggcaaaggtgggagaatga

SEQ ID NO: 80239 - DNA, 90 bp, Heterodera glycines; identical to SEQ ID NO: 60804
  Genomic contig location: Contig_ID=SeqID_15898; Location=1498..1587; Strand=+
  SCN-specific regions: Sequence locations=1-90

SEQ ID NO: 80240 - DNA, 204 bp, Heterodera glycines
  Genomic contig location: Contig_ID=SeqID_15899; Location=57..260; Strand=-
  SCN-specific regions: Sequence locations=1-204
atggaaatgaccggcggtgaccatcagctcaaccattttgtccagcaactccaagcagaaattcagaagcagggattacaggaacaggtcgatttcgtcggttgtttaccattttattatttcttttagattttgaaaatgaacaatcgatgtttcgacctttgcatcaccgattcgcgtcttccgagcaaattggacggaagg

SEQ ID NO: 80241 - DNA, 208 bp, Heterodera glycines
  Genomic contig location: Contig_ID=SeqID_15899; Location=459..666; Strand=-
  SCN-specific regions: Sequence locations=1-127,152-208
atgtttatgcctatggaccacaacattcaacaacaggtccaggcctccgcttctaggaaggcccgtgacgactttttcacgttcatcgcttgtggcttcatcttggagatcggtgtgcatttatctcttttattttttatatttttattttctcaatttaggcactcgcgcacttcgttatgttggattcgattcttttctcgtctaa

SEQ ID NO: 80242 - DNA, 1022 bp, Heterodera glycines
  Genomic contig location: Contig_ID=SeqID_15899; Location=1713..2734; Strand=+
  SCN-specific regions: Sequence locations=1-9,31-143,165-470,492 -528,550-1022
atggcaatttgtaaagcgattgacccaaaagcaaggcccaaaaatccattcggccattttgaacgacgtgcaaatgttcatccttcgccacgctcctcccaccactgtgttcttcccagacccatcgcgtcattcgtccgacgaggattggctgctgctgtactcaagcgcaagggatgggatgagcacgacgaggtgggacacatgggaaattcagagtgtattcaaaaccttgggattatgtcgacaaattctaggaattttagaacttttgaagaaaatttaataaactgaaaaataattatatgtttgggatttcttctttaattacggattcgacagatattttcttcttattcaagtcgattttccgccagaaaatttttttatgatagctaaataattggaaaagccacagtttaaacaaaaagttttgatgtataatttcaccgatatgctccaaatgtttctttatcattttgttgttttttaattcttgtagatttgaagcaaaagtgtttgactataagggcccttccgtgctgatccttcgccaaacttcaaacgatatttacgcaattgcgacagatgaagaatggaggtacaccaaacccaacggaaaaagggcgatcgatcggaaattggggggatttgcgaaacgatttgaatcggggagccattgtcccacttttttgcgtgccaaaacaatcaatggatggactttcccatcccattccattttttaaaggcacacctcaaaagcatttggtggtccctattccgtgctgttccaattttcgccccaattcgtccgtctccaattccctccgcccgccatttcttgcaatttcaaggcccgctcttcgccgcttggcctttcctatggcaaccgtttgctgatcgaagaggcgatggccaacgtcgggggaatggaagtgtggggctgtgcaggcgcagagacactgagggaacagagcaaaacgaagcaaaggcacgcacagcaggcggaacgaaatgcgaaa

SEQ ID NO: 80243 - DNA, 696 bp, Heterodera glycines
  Genomic contig location: Contig_ID=SeqID_2533; Location=1692..2387; Strand=-
  SCN-specific regions: Sequence locations=1-319,341-463,485-696
cggaggaattggaaagacagagaagtgtcgtcattattggcatgccagagcacaacgacagttcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctgcatggcaaaaaaaaacaaaacaccattcgggctgctgattcgtctctgcaccatgtccgtctccgtgaatcgctgacaaaggcacaattggaggaacgccgtcgcctgcatttgcaatgcgttgaaaaacgacagaaagatgggcaagattggattgtgtatgctgggaacgttattttgagagatgaagtgcacatcttccggagtcagtcaattcgtgaatcaaatttttaaattttacaccaaatcacaaaaaaaacaaaacacttttacaaaaagagtagattacactttccggtcggaagaagaaaattcttaccaaaatataaataattctaattcactaccactaaacaaaggggatattaattctttagaaggttttatctgttgcttaactaatattcgctctataatgaacaaaactgatgaaatttcactggctttaataaa

SEQ ID NO: 80244 - DNA, 663 bp, Heterodera glycines
  Genomic contig location: Contig_ID=SeqID_2533; Location=522..1184; Strand=-
  SCN-specific regions: Sequence locations=1-13,35-156,178-204,226 -471,495-536,559-663
atcagcaaatgataaaattgtaaaacattgttctgttgaaggtggcatattttcatcagatcatttagcacagctttttgtgctgagtgttccagaaataagaccaaagcctaaagaaatttgcctaagacggtttactccgtctaatgtatcacatttaaatgctgtaatttctgctagattaagttctctttctctttcacattttagtataaatgaaaaatgctgtgccttcaatagcgccttgttgaatgccttgaatgagtgtattccaataaaaaaattactaaaaaaaagatttagctccaaaatatccacaacatttattggcatccattaaagaaaaggcaaaattatatagacagtgtaaaatttatccaacaaaaaaagcactttatgatagcattactttacatataaaaatccaaaccaaaaaaatacataatttaattgaacataaggctatttcaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaagttgtcctaaacgatttaagtttggacaactcctatg

SEQ ID NO: 80245 - DNA, 1041 bp, Heterodera glycines
  Genomic contig location: Contig_ID=SeqID_2534; Location=665..1705; Strand=+
  SCN-specific regions: Sequence locations=1-154,177-396,418-561,583 -595,617-927,949-1001,1029-1041
atgtcagattgtatctgggaaatttacaccgttctggataaaattaatgcagagtctgaaagggttgagacgatgtggcttgagattgaacgttctaaagatttcgatcagaccacaaaacttgaggagaaagtatttaagagtttaaacgaaaccaagaagttgcatttcgagtcccgtcggattcatactaaaatattggagcaagaaagcagttcagtctatagtgttgggatttattgagcttcacgagtaaaatggaggcaattcagtataattgtcacgtaattaacaaatttgggatcaaaaaacatattacaaagtttattttttccggtgcatctgattgtgaatttaaacaatctctagaaaaaatattagaaaatgcatatataaaagaatcaggaatttttaaaacaattctaaaactacaatattctaattttctagtagtcttgccactacgattatcacaggaaaatacaattgacgttcttttagaacaacctatattttcacacttttttaccattggatgataccgtaatttttgaaataacaattgttaattttaataatgacaactatagaccaagaaattaattttataaagacacaagtcgaaaaggcttggaaaaggggtagaaaattagttagagaagcagataacttggtatcttatgcctatgagctttcgaaaatagctgagaattatattacataactaaatacaaaaaatttgatgatttgccaacgagcagagaaaattttgaaaaaagccaagaattttttgatagctatcaaaatcaactcacaaatgttagaattgacttagaaaaattaattcaaaaaatacttgagcctaaacaagtagagcgagaaatattctttacaccctaccgtaggggacagtccaaaattaataagtcttatgaaatatattatacaccctattatacatcgacaattaaatgaaatattttacattccatatagaagggattaaaatttaaaaaatcttaattccttaaaaaactctaa

SEQ ID NO: 80246 - DNA, 1224 bp, Heterodera glycines
  misc_feature (1196)..(1196): n is a, c, g, or t
  Genomic contig location: Contig_ID=SeqID_2534; Location=3831..5054; Strand=+
  SCN-specific regions: Sequence locations=1-234,256-342,364-656,678 -870,892-1224
atgttggatcacccagagaaagtggaaaaacatatgtatgtggtaccgttttctgtaataaagccctgggtctccgttttctgttcgatcgttaaaagtggacccctctaacggaacaaattgtagtaattatttgagcccgggagccgcgcaagatttttgtcttgggctctcgtacttacaattcaatgacattgaaatggttttaacgcaaaatcaaattgttactgagattctgacctcatatgcttttgtgccaaaattggcactgaatttgccattttccttatgggtagaattgttgatttattcacccgttttcccgttttaaacaaacacctgcaaaaggagaaggatggatttatcacaggggatgttgggctctaagggccttggaaacaggaaattttggaggctgttaaaaaatatccaaatttacaacaaaaaattcaaaggcttttagcttcatttgcggcgactgctggctttcgctgttccatttgctgccacctgacaaagttgggcttgaaattgcgctgctcagctgccgttttgacgctttggttgatgagcacttcaaaacgcggcattggacattgggcattattgaaattcgcaacaagtttcggcgttgctatcgggctaccggcaaagcggaaatggaaattttaaatgccgaaggcaatgcgatgccaattccggacagaccattgcccaacaaagtcgtcgggttcggcataatttgcacagagtaagtagtggtgatacacatatgtttacattcttattctcattgagaaaatttgtattaaatccaaaaaattagacaactcacaaaatttttagcattttgcgcgggaaatggttcagaaagttgttacaaagtatctttattgaccaaaatatcttaaagaatgactattttccgattattttttacgccgcgagtagagtgtcacgggaccgggacctggtactgaaaaacacggacaactgaataccgaagtcccggttttgaccagttttgactgggaccgggaaaagtcccggttttgccaaaaattcccggccccttgatactctaaccgcgagccctatgattatataatagataccaatgttaaatttagttgacgttgacaaaagttatgaatagggaacagatttttaaggacgaaaaagtacaaaataagggncttaaataagtgcgaaaaaaattggtta

SEQ ID NO: 80247 - DNA, 440 bp, Heterodera glycines
  Genomic contig location: Contig_ID=SeqID_15901; Location=1550..1989; Strand=-
  SCN-specific regions: Sequence locations=1-223,246-276,298-381,411-440
atggagacacaacttggccaagaaaatggaaatgatttggctgtggaccaaacgaatcggacccccattaaggagattgaaaaagccaaatctccaattggccgaagtcaaaatgcgccgcgaacatcagcacgcgccaatagggcacctcagcgattggacatggacccgtcgaagccgaagtacgacatcatccggccatgacatctcgcgcaggagggacttttccaaagaagggaggtgttggataagggaacacacaaattattgattatattttccctttctttccctctcgcattgtctctatccccgccccttgaccagtccataaatatgtctccctttcccccactccgggcattctcccagtcattccaccatttcattattttatttatttattccctgctgtcctccatatttatttgtttaataaa

SEQ ID NO: 80248 - DNA, 1139 bp, Heterodera glycines
  Genomic contig location: Contig_ID=SeqID_15902; Location=276..1414; Strand=-
  SCN-specific regions: Sequence locations=1-527,549-809,863-1028,1066 -1139
atgccccttggccaacttcccgttttggaggttaacggcgttaagttctcccaatccctggccatttcccgttaccttggagaaacttacggtatttacagtaattcctttttgattgttgttttatgtatttgaacaaaaaaggactatcgttcaatgatccgctggaacgtgctcttctcaatatgatcgtcgatcaaatttcagacactcagaacagcggtgccttcaaagaatggccaatggtccgtttggacttagtgccgtgcggagataaggtaattaattagcaagaaaacattggaagggcagggaacagcggatttgaatcagttaagattcaatcagtgtaccatcggtcaattccatataattttttttggtcgtcgtcctttttagtcgctattttaggcggcttttttccgagaaaagatacgcccgcagttggacggatgcgcgagtttagtcgagaaatatttggtggagaaaggcgacggcattttgcttggcaaagacaaagtgggactaaaaaatcagcagatcacaatcagtgctgaatcaaccgcacatttctcttagatcacttgggccgatatttatgccgctgaatttttcgcaaaatgcattgattttggagaaaaagactgcctcgaggcgtaccctcaaattaaatcactgatcgctcgcgttcaaaatgagcccatcatcaaggaggtacggtagaaatacaattaatccgaaaaatcacaaggccaatttaaagcggtttttgccattttccatgagaaattaccacaaaatatttagagatttaaaaatattaaacaacaaattgatttaaatacaaaaatttttttttatagtaatagcataagtttcaccttcagcacattgccgcccgagaggaaaccaaattttaaaggaaagaaagagaaaaacggacggacatgaaaggataagccaaatactatgacaattgtgctaactgtttttgcacattaactaattaaaaaattttcaattcttaggggtgtattttcccgattttattgcatttttaatggaatttttcgaaaaaaatgccaaaaaaggcatttaaggcacgaaaatcctgaaaaaggcaaaaaaggcataataaa

SEQ ID NO: 80249 - DNA, 112 bp, Heterodera glycines
  Genomic contig location: Contig_ID=SeqID_15902; Location=169..280; Strand=+
  SCN-specific regions: Sequence locations=1-112
tagagaccgcattttgaagcatatgccttttttttttgcgcactagtttcgatatattaagcataaaaaacgctgtttccacttggtttgaggcttctacgttgacttttat

SEQ ID NO: 80250 - DNA, 847 bp, Heterodera glycines
  Genomic contig location: Contig_ID=SeqID_15904; Location=558..1404; Strand=+
  SCN-specific regions: Sequence locations=1-147,191-400,423-791,813-847
  Gene Ontology: Mol. function=diacylglycerol O-acyltransferase activity; Cellular component=integral to membrane; Biological process=triacylglycerol biosynthesis
atgtcaagcggacttcacagcaattttttgaatcgctgtaagcaaacgattggcgttttgttttatcttggccttatgcttctgcagccgctcattctgctcgcagttgtcgtttcgttcgcctcgtccccaatattttggtcaaccaaaaaaataaaaaataaataaaagaaaaatattttaaatatttgtttgcttttcttcaggttttgcgcttctctttacctcatttggtatatttcggactttgaaacgccgcgcagtggcgcccgcttcagcgaaagcatttacaattggtcaatttggaccgatttggccaactttttcccaatcgaagtgattaaaacagcggaaatcccgcccgaccgaaattatatttttaggtaacttttgtgccaagaaaaaattataaaaaaattttagtgcccatccccacggcattctcggcacatcgagcgcaattttgttcagcacaaatggactcaactttagaggactttttcccggcatcaaaatgcatcccgtgactttgggaatgaatttttggatccctttccgacgcgaatttattttggcaatgcgtaagtccaatggttttttttaattctgtaattacttcatttagggattatctcaagcgatcgggagtccattaaatacgttctctctcttcccaaggaagggaatgccgtcggaatggcaccgggcggtgccgccgaggcattggaagcccatccgggaagtcaccggctgattttggccaacagaaaagtgaattctcgataatgaattaaaatttattttcgtaatttaagggattcatcaaattggccatccaaaatgggta

SEQ ID NO: 80251 - DNA, 375 bp, Heterodera glycines
  Genomic contig location: Contig_ID=SeqID_15905; Location=468..842; Strand=+
  SCN-specific regions: Sequence locations=1-71,93-104,177-287,333-375
atgtcttcatcattggtcctaattttgcttgtccatttttgtctcgctaccaatgaatcggaggataaaaacaatggcatgttttatttcaatgaagagggaatatcatttatatcgccattattaccatcattagcttcatcctcttcctcattagcttcatcctcatcatcttctaatttcaatcaaatgacattttatcaagcaattcaacaattgccatttgaagaaaacgaagaacttttgctgttgtgttcattttctgaagtgaacgaagacaaagtaccaaataaatttaaagattatttaaaaatgcatttaatatttaatttgggcacattttctaatttagtactattacaaaaccaacgatag

SEQ ID NO: 80252 - DNA, 676 bp, Heterodera glycines
  Genomic contig location: Contig_ID=SeqID_15907; Location=463..1138; Strand=+
  SCN-specific regions: Sequence locations=1-145,167-375,414-444,466 -488,512-676
atgaagcccgaagcgaggaaggagggaatagagcagtatgggatgatggtgacgtacgtgtcaataacataatgccaagaaaatacgaaatggcaataatacaacaataataaaagaataaaataattttcaatgatgtgttttcatatttattttttttattttagttatttcaacaatattttgatctttaataagtgggaagacccaagacaagttgcgacaaaatgtgatggataccattgctttcttatgactgatcagaatgaagtaaacgttttggcagttcggtacttggacaatcagtacgaacgggcaaaacgtgctaacaactggtacaatgagaaagttgtcgaaattgcaaacgtcatagagtaaattattcaattataaattaaaaataattttttaaaccgctagcagtttgaacaaaagaaatagaagttttagttagcttaaagagaaaaaattgttttagttagcttaaagagctttaaattaaaacctttttgaaacattaggaaaattaaatcatatataaataattagggccgccatttataaaattctgcgccttgacacgcacaaataagcatggaaaatgggtttttagcttagtttgggatttctacgatgactttatatgaatttcggaaaaattcttaacaaaactgaa

SEQ ID NO: 80253 - DNA, 796 bp, Heterodera glycines
  Genomic contig location: Contig_ID=SeqID_15909; Location=1..796; Strand=+
  SCN-specific regions: Sequence locations=1-11,34-68,91-409,438 -447,470-493,515-519,541-796
cgttgtcggcttcagtcccacgaggagttggacagtgctcactccaaggcattgggtgagcatgggaaggaaatcttttgatttcaaattgtggtttaagaggcctccgaattctttttttaatcctagaaattttcaatttttcccctttctttttgcttttcgtcagccaaatttttttctcaccgcaaaattttgcgtcaatttttgtccttaattttcatggcatttcataatactatacaatacaatcagcaagaaaaaaaaacgatgggttcaaagactaatcgccccaaatccatcggcggttgttccattctttcgcggacaaaacgagcgttgcaattgcggcaaaacctgtttaagtgtcaaatgttgtgtgtttttttgcacacgccgacattttattcgttttattttgggagaaattttctttgcctcggcagccctttctttgttctcttttcttgcgcaacactttgaagggagtgaaagtgaacaatgatgaaaatgaatgggaagcaatggaaaattttaaaaaatcgccaaatttggttgcccaaattgttcattttttgcacacattttcccatctattcccccaaggcatttctggacgtctccaagtgttctacaagggccaatttatgctgacggacgcgccggagggcgctcgggacgaaacgccgggggcgacgccgcaacaacaacaatgaggactgaatggtgatgatgatgatgatggttgacctttgatcgatggtcgctttcatgttttttcttcatgggggaagca

SEQ ID NO: 80254 - DNA, 1090 bp, Heterodera glycines
  Genomic contig location: Contig_ID=SeqID_15911; Location=2051..3140; Strand=+
  SCN-specific regions: Sequence locations=1-212,234-349,383-412,614 -817,839-863,886-887,916-974,1008-1090
atgtgttggaagaggtacaaaagtgataaaagaggtacaaaagtgatgagaagaggtacaaaagtgattagaagaggtacaaaagtgattagaagaggtacaatggtgattagaagaggtacaaaagtgattataagaggtacaacagtgattagaagaggtacaatggtgattagaagaggtacaaaagtgattataagaggtacaacagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgcccccccccccctcagaacatgtcccagaatccccaatcacacagggattctgagggcttaacgatgtcaaacgtaaaatctgatcacgtattcgtgatcagcggcctaaataacccctaaagacatgtttttggaagatttttgtcgaaaaaattttttcactcaaaaatcctggtcacccccctttggtcccgaatcccaaaatcacttttatttttataaaaattcttaaaaaagtgataaaaatgccaaataaaatttaaataatagagcaaaaaactgcggatttttgtagtattttatttttccagaatatcttttcagaaccgagttatgaatttttttctgaaaattcgaatttttccagaaattctggaataacttttttccttttttagatagaaattccaa

SEQ ID NO: 80255 - DNA, 1330 bp, Heterodera glycines
  Genomic contig location: Contig_ID=SeqID_15913; Location=33..1362; Strand=-
  SCN-specific regions: Sequence locations=1-1330
agtagagcccgctctctgatggccattctgtttattgccataaccttctatcgcttaccgtccttcatggtcgaacttcagatcaaatggcagcccgtgtttcgcattcagaaacgactcgaaaccacagaagttaaaggggcgaccggtgtggaaaaccgtagtcatacggtgccataccgtatcatgggctaaggcaggggggggggagtttgcaccgtcaaatctgtgccggctgagctttcctttggcccttattggccatgccattgcaaatgctcatcgcttaatctttggcttgtcagatgctttctccctatcgcatttggctttattccgtcatcgatcccatcgtttcgcattttctgccctttgttctgatgtgcgtcttttcgctgctcacactgtgtgaaattgtgaagagtcgacaattcgcctatgctcagttcagtgtctcatgcgactcgcaaggcgcaattgtgaaaaggcgaaggtcgagcagttcaaggcgagtaaacggagaaatgttgggaaaattggggagaaatggtagaaaaaaccaggaaggatacgtgggaaaagctacatattttaaaccgaaaggcaattcactttaagccatccattgcgaaggcgaatcgacggcgtacggcaaaaacaaggcaatgtttgtgagttgggacggaagaatatgccgctttttgccgattatagtggccaaatgacattactttgcaaattgtcatttgccttttcttcagaatatcgggcaactctttccatcgttctgatcattttgctttatctcgtgctccattccatggaattgtacattttggctcggaaatggcaactgcttgcccaggtgggcaccatttcaacacatccaattgcattttccgactttatgggttctttcaaacatgactttgatttgccggctttattacaacgcattgccattttctgttcaggacgattgtcccacccgcgccgattacatccaatcgcacgtcagcaaaatcctctcggtcctttccgcctctgtcaatgcctttgtgttcatcgcattcacaaatcgcatgagaagtaaggcttaaatcaccaaacaaatcgttccggcatttcatttccgaggatatccccggggaatcttttttacatttgattgccattttggcatgccccctctattcattcttcagcttacatccaaatgctcattcgacgaacatcgcgcagtctttcgtcaaattccagtgaaccgccattacataaaaataagcgaaacacgaacagtggcatttcccgtgattgatgtttagaaaac

SEQ ID NO: 80256 - DNA, 710 bp, Heterodera glycines
  Genomic contig location: Contig_ID=SeqID_2537; Location=1383..2092; Strand=+
  SCN-specific regions: Sequence locations=1-54,104-265,287-397,419-710
atgaaatacggtggtggtggaacaccgacagcagcagcaaattttgaccaccaccagcagcaacagcaacaccaccaacgacaacaacaacagcagcaacaacgaggaggagtgatcgctggcaatacaaacaacgccaacagcagtaacaacggcggacaaatgttcgtcatggatgggcaaagctcggtaagtgatttgggacatgggtgatcactaatcacttgtcaaatagtgatctgatcaaaaggtgggggcgggggtaaagctgggattttgatcacttttggcaatatcaaattgaacacaattgatctgacccacttgatcactttaatgataaatctgatcaccttggctagtgatcaaaaagattaagtctcactcatttccaagctgatatgatcacatttattttggttgatcaatgtttgattaattaatcgattattattgttgattaaattcactaattgacaatgacaatcttcctctaatttattagtgattatccttcaccttttgctctggtcactctttgtaccaaatttcccccgtctgttcaggtgatcaaaacggcaccgccgtgccgtgccaatgccagcaatagctcgtccaccaacagtgccatgatgatggacttttcgcccaagcaggagcccatcgatttggccccgctggcacatccgtgccttcaggtcagtgcttga

SEQ ID NO: 80257 - DNA, 3614 bp, Heterodera glycines
  Genomic contig location: Contig_ID=SeqID_2537; Location=4065..7678; Strand=+
  SCN-specific regions: Sequence locations=1-684,706-799,871-922,969 -1000,1035-1096,1119-1220,1242-1328,1350-1619,1641-2067,2089 -2135,2157-2176,2200-2314,2425-2977,3001-3017,3050-3481,3503-3614
  Gene Ontology: Mol. function=specific RNA polymerase II transcription factor activity; Cellular component=nucleus; Biological process =embryonic cuticle biosynthesis (sensu Insecta)
atgcccacccagctggagcactactatgtggcttcctccaagggtggcattggcatgccggccggctacggcgccaccgctgccggtcccgcctactacgagtacctcaacgtcggctcggccgcctatccgacgcccacgcaaccaggcccgtccggcgtcgccggcggcgcgtccgccgcgctgctgcaaccgaccgcggcggcggttgtcgcgctgcagggcaccgctgggggccaaccgcacgcggcggcaccgcaccaggtcatacagagactttaagggctcaattgatcagagacgaccaattggtcactgatcaggggctggtcaaaatgatcattgctttgggtgttcatgtgaatttgcatccgggatgtgagccgatttcgaattcctgttcccggcacttttgcaggtcttgcccattcttgattctcgaactttatgtgaaagtctagtctaccaattcgaatagagctccaaattatgaaaagcgtggattaagagtccaggaaaatccagggcttggttggacccaggttcagattgagccctaaattcctattcgaaatttctgaatttttagatatggactttcatccctggtcctgcagaacatgtgcaatatttcattaatatcaaattttgtaattgaatttaattagggaggttttaacaattcaattggggaaggggaattgagcttagaaagacgggaccgaaccgccggaataagccaagttgtccttgacagcaagggcatagccaaccccttggcttcggggtgggttgaatgtatttttatttttttaataaaaaatcttaataattttattttaacaatttcttacttaattattatattttccaggactggccctacatgtcctattcgtccgtagccgcccacgccggactccaccagcagcaccagcaacaactgcaagcagtacagcaacagcagctaaacggctacctggacgtcgtcatggagcaccagcaacaacagcaacaacaacagcagcagcaacggttgtattgcggtggcattggcaccggcggcggcaccgccaatggtgcggagattttcttgttttttatttttttatatatttccctcatttttttatttttgatcattacctaatcacttttggttcggctcttcaggtgtatttaatttaggtcaagcaaattcaaattttagcggattattttggaaaatttcaaagttcttgagaagagaacataagtcgaggccaaaaaaaatcaggaagccttttgaagagcctgatcacttttcagtgggatcgtcgaaaattttcaatgggatattttcttcacatatttcaagtgaattgttgctttttgatcgctttgggcactttaatttgtccatccctattccgatcactttttgtcttgatcatttttcaattcccgatcactttatgtctttgggaccgtttttcgttcattacccaaaaagacgaggccattataattcattgtttgccactgatcaaattaacacaaagcgttgcgcaggtaaagcgatggacgcggtcacagccgcaacgctggcggtgaacgcggcgacgggcggcattggcacggtgggcgccggcggcggcggactgctgtccccggtggactcgggcatcggcacggaactgtccctgctcgagcacgccaaacaggtgagagaattgctgattgatcagtcaaacttggtccagggattctgatcacattttgttcaattgatcaaaattttaaaaacataaaactagcgacctgtttgatccacggggcagatttttctgatcagtttatgattttcctattaaaattttcagcctctgttagtcagatctgaaaagtgagaaatgctaataaggctgatcaataattatttttaccaacttattatccctgcaattggatctgacggtcttctatattgatcagatattttctttgccagtatctgatcaaccagaagatctgctctgattatctgataaaaaattctaagttgatcgctgatttattccgatctgataatttctttgccaacatctgatcaatcggctctcttatctggtctgaatgatctgatcagaattctaagctgattgatttgagctctcagatttctaatatctgaaatttgacctgatcattttcccagttgcacgaatttttcgcgcccggctgttccctggcgtccgctgccgtcctgcaacttccgcagtccgtccaagcgcagcagccgtcatccgcctcctccgcgctgcaatccgtcatccatcaccagcagcagcaacagcagcaggaactcgttgccggagtagtacaacaacagacgcagcaacagaggcgggatcacaacaacggccgaagtggagccggcagcagtgaatcggtgaggcattttttggcatggcattttggcaagaggggggccgcacgagattctcggtctcaaatctagagaatttctctgtcttctatgtctcggtcttgaacccttggataagccccgatttggtagaaagtctcgaaaaaggtcggctctcgaagagccataattggcagtgtgatgtcgggaatggaaaattcatggcactcgcgagacgcaagattggcattagcacacctgtccaggcagggaaacaaggatgggatttgtcaatcccgagaatgggtgggggcccagattttcccatttcagtccaatcaaatctctctctattcccatttcagtgccacaaattcccccatcccatttcagtcccaccaccgtgagtcccaacaccgggaacagtccctgcccattgtgatccccaaattggaaaatcctttgggctttcaatacgctttggaggcgcccatttccacgtccattcggaaggaggacgatcggatgacatatgtgaacaaagcaagtgatctgtggaggcgtttttttaattttcattaatagtttttgttcgaaaaatcgaaaattcatttttttaaattttcatttaatttattttttcctccattttcagggccaattttacaccgtttcgcttgactacatccccgacctgcactgtcccctcaaaggcttaaccgtgagggttggtttattgtttttttgaaattttcaaatttttttcgaaatagtaaaaaccggtaattgccattaaggatggtttaatatattttcccgagactcttgagcattttttttaaaacacaaacacctccttccattagagcaaatctcgaagcttttgtgactgattttccaataccggcaaccattaaaaatagcggtttcaatttctggaccaaaatccaggaaaatccagatccaggaaaaatccagggtgccgaaaaatagcctggatcttgacctagatcaaggaaaaattcaggcctggatccaggtcgaggccgacctctaattaccaaggcattttgtaattaattaattttcccattttcagagtcaaattatggtcgttttccgcgaggacaaaacgtttgaggacgagctgaggacgtggatgttgtggcacaaacggcaacattcgcacaagcagcgaatcatcgaa

SEQ ID NO: 80258 - DNA, 1660 bp, Heterodera glycines
  Genomic contig location: Contig_ID=SeqID_15914; Location=148..1807; Strand=-
  SCN-specific regions: Sequence locations=1-655,677-792,846-1059,1081 -1323,1356-1424,1446-1660
cgatttcttcaataaacgtgttttgatggtaaatcggaaggccaaggattacttcgagggtttctttgggactgtcaatttgttcaaaatgctgcaaaaagtggaattggatggctttttaaaataccaattgtatttgcatttttcttagtttgacttggacattggcacggatgtgaacttgtctctatatgaaaatgatgtgccaacggaccataattgtgccgacggcgaacgagcgactgccgccgccgtttggggacattttgggcggggacgggcggcacaattcgaccgaccacagtgctacaacgacaacatttggtatctgtgcgatgttctgcaggagttgttctgttcgtttgtcggtgcaaaatggtcagttcttttgtctgctcaccaaatggacatttcgttcagttatttgactcctccgaacacttccgcaattgcgccacattgggaggacaacggtcgaaaataaacgattaattaattatattcacaaccaatgctttttagatgcctttttgcttcaaatcgaaggacggaaatattttaaagtttattcccccgcaagtgataaggatacttcgccgttggattcgagtggcacaatgagtgaatcagattttgatggacgcgagccaacttttgaaggatggctggaacaaggcgacactctgtacatcccgaaggggtggattttcaaggtgaaacctaaatattagcaaaacaaaagtccctttattaaggcgagtgccggtgacgtccattcgctctgtgttttcggtgccttttccttcttttcctttgtttattttcccatttttaagtgtccatttgtcgtggccattctttcaccgactttcttgagaaggcttccgccgaattcgttaagacaatggtttcgggctcaaaacatcttcgtaagaatttgcctccgcttttgttcgacatggccgggaatagcggaaacgattacccgggcgaagaaacgctcgaggagaagtgggacttcttagcaatttgttttgctatttcaatattcctcctttgttctctcagaattattcccgtcgctgaagttttctctcgtaaatttggtgagaatttcgctgccttcgttccctcttacatcgatttgatggcccgcgaattcttccgtttcgctttacctccgcttttgacccctgaggaagaaacaaaaatttgttttggcggtgctattgactcgtcgttggacattgggaagaaaacggaggtcagattggtgcgaaagcacacccaacggtaagagactcctctgaaatcaatcccgaaaatcgattccatttacttttagacttctttttgaaaacgctgaaaaggcattcattgttcacagaatggcaaattctcgaagttgtgaagaatatcccgaaaaaacaattgattttcccattgaggtgaagagactgactgacagtcgtcggcttccaataattaattgcccgttcctttcagtttgaggacggattcgtgactttggtcgactcttacccgaattggttggaagtgggcgagttgggcttggaatcgcaagaagcgaacgtcgaattggccaaacttttgttcactaatggcattttgttggtgcaacgggaaaagagttttggag

SEQ ID NO: 80259 - DNA, 131 bp, Heterodera glycines
  Genomic contig location: Contig_ID=SeqID_15915; Location=161..291; Strand=-
  SCN-specific regions: Sequence locations=1-12
atggaagtgatcggaggaaggaaagagaaaggaggaatgtgggagagaaagaggagactgaccgaaggaagaaagggaagggattggaggaaaaaacgaggaagcctgatcaaagaggaagagaaagaagg

SEQ ID NO: 80260 - DNA, 159 bp, Heterodera glycines
  Genomic contig location: Contig_ID=SeqID_15915; Location=395..553; Strand=+
  SCN-specific regions: Sequence locations=1-159
atggctccgttgtgtcgtcacgcgtccttcccaatcggatcggctccccctgcgaggattccctcccttattgtgccgtatgggtggcctccaacgaacgaatttgtgtcgattcaaaagcgacgatggaaagagaatgccggaagagttgtctatttt

SEQ ID NO: 80261 - DNA, 530 bp, Heterodera glycines
  Genomic contig location: Contig_ID=SeqID_15916; Location=103..632; Strand=-
  SCN-specific regions: Sequence locations=1-274,296-300,326-530
cagagcagagaacacacgcaaattttgggcagtgaacaagcggccaaagtggtcatcggattcactccgtccgattgcgcctattataagaacttcctgcgcattgagtgcaaatcgcgcgatgaaacgcgcgaatattacgtaagggaaatggcacattgtcaggcatttgcaattaggacacatttttcgatttgttttaatattatacagcgcaattgagaaattcttaaaaggggcttaacaaatattaaaaatccgattttcaatgatgattttatggttatagagatatactagtaaatgaattgttcagtatataaattcctgattgaaatgactgtattttaaactgatttgtgagtatatttggaactgacctaatccttcgtcagtttttggtccatggttacggcggacgtgccgtggtggagccgacgatggaggaccgaagcgcgaacttgtgcttctccacgaacggtcaatttcaactgattgtacggtccatttcgaaatttcgtttttggctg

SEQ ID NO: 80262 - DNA, 1176 bp, Heterodera glycines
  Genomic contig location: Contig_ID=SeqID_15918; Location=987..2162; Strand=+
  SCN-specific regions: Sequence locations=1-294,316-720,824-967,989 -1058,1106-1176
atggctgccaccggcgggtcctttgtttgtcgtcggtatttgcttaatgacgacggtaagtgatttgaaatggagtcattttggaaggtgaaaagttcaaataagttggaaaattttaatcataattaggattaagagttggcaaattttgtaatgaactctaatgacccggttcttcttcagaagtgtccgacactttcgacatgttggacatggacaaagacggacgactgagtcgcgcggaaatcgccgcactgctgcgcactgcgaatgtggaaccaacgcgcaaggagtggacttccttttccagggagatggacaaggacagtaagtgccattgactgtttaagcaagttccattcatatgggagaatcctgtacagtatgataggcatttgacgttttgtgatgctcgagaccgagaattttcctcccgagactcaagaaaaaccgagacttttctcgagtcgtgactttcaagtgcttttccacttcccccttttttgctttttttatttccattcaagagtctggcaaaatcaacagagagtcttttggtaagtttttggcattttgtacgaaattctctcccccctccctttaccttgcgttacagtatcttatctgcgttgtcctcccatcaaccgaattactgtcaaagagttgcgcgaccatttttcgtcatacgatacaaatggaaacggtacaatcagcagaggtaaaaacagaagagaaaaataattaaaataataataaaacaaacaacaaaagtaaaaaacagacaaatgaatggaaaatgggcaaaaaaaaaatacaaaaacaatttgcaggagaattgaaaaatatgctggcgaatattgccaatttgcacgacgacgacacaattggccaaatgttcgaacattgcgacttggacaacgacggacggctcactttcgacgagtttttgcggatgattcggagagagtaaaaaatgaaaatttccaaatattttggaatttattctgttaattattgtatatgaatatatatttttgatttttgtcattataaaataattctttctttttttatttttatcttttccttcttttttctcttttttagttaatttttggcgctccgccgtttaaaaaaatgtaatgaccgatcagtcgactgatttcattgccctta

SEQ ID NO: 80263 - DNA, 943 bp, Heterodera glycines
  Genomic contig location: Contig_ID=SeqID_15918; Location=2442..3384; Strand=-
  SCN-specific regions: Sequence locations=1-499,531-564,590-943
atgcacacactgctgaacgatgagtacgtgatggacgtgtgcacggagttggagacgcgcggcgatgactttgtgctgattctgactcgtagtgtaagtgagactgactctgaccaccctcgcgatcccgaccaatgctatgccatccattccttgagtttctattccatgcttttcacataatgccatgctattgcaattgcaattccattgcatttccactttttttccgtttcgcttttcattttcccgctttatctaaggtttggcttcatccgattcgccgtgagagtgacttgtgcaccgatgcactgttcttccaactgttgcccaattacctcgccggtctccccgtttctcttcgtgcggatggttccgcaactgcggcacttttggtgcatttgtcgaaaattcctttgattttcattgtttaggaggacatggcaattcttggtgctttgcttgtgttaagtgctcatcaaaatgatgcgaaaaagtcataaataattttaaaatgttttaaattatttctagtgatttttaggaatgatttgtctcttttcgtcccaaaaaatgttttgaacagtgccaatcgaattctttcacacgaccaatggcttaagcgcatttccggccgtgtccaaaggctgagctgctcgaacttcgcgtgtttatccccggcgaaagcgcggcaacgatttttgggtttgaaatgaaaaaaaggaaggaaataatgccaaaaaaaagaactcatcgaacgatggcatttgttcggcgccgccttttattttgtgcgtcgcgtttattggggtaagcggacgaacgaatgaagcgcatttaattaccaaagttaaatccgaaattcgcaaaagggagaaatgagtccaattcgacgccgggggcggcgattcttgcggaaaattgtgtgttggcggtaaataaa

SEQ ID NO: 80264 - DNA, 77 bp, Heterodera glycines
  Genomic contig location: Contig_ID=SeqID_15919; Location=648..724; Strand=+
  SCN-specific regions: Sequence locations=1-77
acttggacatttcgtggcctggacattttgtgggtcagcgagccgaaggcccccgtacgaggccgcgaagcggccga

SEQ ID NO: 80265 - DNA, 347 bp, Heterodera glycines
  Genomic contig location: Contig_ID=SeqID_15919; Location=1096..1442; Strand=-
  SCN-specific regions: Sequence locations=1-1,24-160,190-320,345-347
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaa

SEQ ID NO: 80266 - DNA, 513 bp, Heterodera glycines
  Genomic contig location: Contig_ID=SeqID_15921; Location=1222..1734; Strand=-
  SCN-specific regions: Sequence locations=1-281,304-368,440-486,508-513
atgaaaaacgaatttaagcaaaaaggaagaaaatattcgacaaaagaatggaaacaaaattatgccgaaatttgtaagaaaattggagttagccaaggaataattgagaaatggaagaaacaatttggaattcgcagcaagagcataacggagaaagaaaaaatggaaaaaatcaaaatttattggcaaattaaaaaagaaaatccaaaaataagtgatcagaaaattgcaaaaatgataaacacttcggcaaagaatatttgcatatggaaagccaaatttggagaagaaaatttgcaattttagaagacaattgaatttttatgaaaacattgctagcaaatttcccaaaaatttcattgattgacaaattttatttaaattattttgttgcattaattttttaaaatttgcttaaaatttttttttctattaaattcttgccaaattacggtgcaaatttgtagaaaaattggcacaattcgccaaattttccagcaagggcagaataaa

SEQ ID NO: 80267 - DNA, 727 bp, Heterodera glycines
  Genomic contig location: Contig_ID=SeqID_15922; Location=66..792; Strand=+
  SCN-specific regions: Sequence locations=1-171,204-406,438-469,510 -516,556-727
atgcgcgcaacgcacgtcggaatatggcatcaccggatgtgggactcatgcgtgttccactacatcacgcatgattcggcactggtgacttggcattgtggcgaatgcaacagacgttcttttcaaacttttgagtttgcaatgggcgacaagacagatcggtgagttaggttaaaaattttataatctttataaataaaattgactaataaagcgagttaaatttatttatttagttggggacgttatttgctgcaccaatcaaaggaacggcgccatgtcgtcaacatcgacgaagccgacgttcatcgggaattcatgctgatgcgcgggacgggacactacaaccttttttactacaactgcaagcactgggccgaagaatttgtgataaatagtgagtttaattgaaaacattttaaaaaattggaagttttttcttaaatggggcagtcgtcaatgcttagggcaatttctcgaattgaaacaaaaatgaaaagcacattttgttatcggaataattaaagaaaattaaaatttaattctatttaaattccccctccctttttctctcacttcttccttttccttctgttactcccctctctttatagacccgggactgaagtgtctaaattacaacgggactcaaatgaccaatgtattttcatgaattattattagtagggattctttttttatgtaagaaaaatcgcgaaatatgtaa

SEQ ID NO: 80268 - DNA, 1194 bp, Heterodera glycines
  Genomic contig location: Contig_ID=SeqID_15922; Location=852..2045; Strand=+
  SCN-specific regions: Sequence locations=1-114,136-231,265-652,674 -754,942-1194
atgtacgaaaatatgtaaataaaattttttttaacggttacttttttggaaaaattcttcgtaaagggtgaaataggcataaaatgcaataaaaatgacccaaataggcctagaatcacattttaatactttaaaattaatttttggtatctgtttttgcaaaaaaaaaattgattttttagaggtatatttctcagtagaaaaatcccaaaatatgtaaataaaagtcccacttttgttcacaaaaaagaaagtgtttttcttactaattgggctatggagaatccaggaaaaaatatgtatttacataaaaaaagaatccctaattattagggctatttttacacgcatagaattattttgaatttatagcgtgtccctaaatttgcggctcgacaaatgcggccccagccaaaaatcgacatttttggcccgatttttgcggttctacattttttaactgttggaaatcggaaattagcggcccacaccagaatcggatttttgcggccaacggaaaagggatgataatttggcattctgttagtcgcaaaatcagattttggcttgggccacaaatgatgggtttttggggccgcaaatgtcggggcctccgatttgctgtgcataatcaattttcatttaaaaatcgattataattatttaatttttagttacggggttctggtgatgatacaaactgagctttggggcccaatttcaaactcgatttggccagtcgctgaggaaggacatttgatcatgttatgttttctttgattttctctttcattattaaatttactttttattttatttcatatttaaccgatttcatcattttattgcatttttttttatattctcgacttgaatataaattttacttttttattttattttttaaaaattaaaaaaacttgttttttaattttttatttcggcgggtgagggggtaattaacttttcctacggtctgatgtaaagggtttccgagtttttcaattttatgccgttttatgcactgtttcatttttcttatgctgtgcccgtccgatcattgatctgctgatccctttcccatctgctaatgcactcgccccaattgttttctcaattttccaaaaatgcccaaatatgaacataaaatctgcatataacttgtatcattattgatcagacagcgccgatgta

SEQ ID NO: 80269 - DNA, 216 bp, Heterodera glycines
  Genomic contig location: Contig_ID=SeqID_15923; Location=39..254; Strand=-
  SCN-specific regions: Sequence locations=1-216
atggacaaggacaaggacaataaggacaaaattgagcccaacggacgaagcgatcatccaaatcggccatgccactccgctggtacaaaacgggatggagtcggcacaaaaaacgggattctcccactcttcgaatccaaagcaacggcggctacagtttcggcccgcacacgatacacgccacagttcaagactttcgatgtcttaattgtttaa

SEQ ID NO: 80270 - DNA, 350 bp, Heterodera glycines
  Genomic contig location: Contig_ID=SeqID_15923; Location=52..401; Strand=+
  SCN-specific regions: Sequence locations=1-350
acatcgaaagtcttgaactgtggcgtgtatcgtgtgcgggccgaaactgtagccgccgttgctttggattcgaagagtgggagaatcccgttttttgtgccgactccatcccgttttgtaccagcggagtggcatggccgatttggatgatcgcttcgtccgttgggctcaattttgtccttattgtccttgtccttgtccatttggctgtggtccgtgtccgccgagacttgctatttgcctcatttggggtctgtgatcaatgtcagcgccgtgttagtgttttgtccagtcgtattgtctcctcaatgtaatttcgggttaatcgttggcacggccttaacacatca

SEQ ID NO: 80271 - DNA, 780 bp, Heterodera glycines
  Genomic contig location: Contig_ID=SeqID_15923; Location=1224..2003; Strand=-
  SCN-specific regions: Sequence locations=1-184,206-244,266-565,587 -746,768-780
atgctgtcatattttcgaaaatttgtctacggatttgccgaaatacatcaacccatctacgagttgacaaaaaatgaaagcacgacagaatggggaccaccacatgagaaagccttggaggaattgaagacgaagctgatgacggctccagttttagctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaagaattttcgaccatatttggaaggagctggaaaatcgacagtgatcacggacaatttggctttgacatcattattccggcggaaggacttggaagggcgactcagtcgataccaattggctatcatggcattcgatgttgaaatcattcatcgccctggaaagcggaaccaattttgtgaccatctttcacgatacttggacgacaacgacacacaaattaattggctgaaaattgaaccaaaaatttcacaaagtgaaatgcgcgaggctcaaaaacaagagacggacacacaaaagagacgggaaactttgaagaaggatcaaaattcagaggaaccaaatgaattctctggaaaatggaaacttcggaagatcttttgtgtgcaatggacagaggagaatggaaaatttatgtgccaagcagtctga

SEQ ID NO: 80272 - DNA, 764 bp, Heterodera glycines
  Genomic contig location: Contig_ID=SeqID_15924; Location=2190..2953; Strand=+
  SCN-specific regions: Sequence locations=1-327,365-636,667-764
atgatggcaaatgtgagggaaaggatttatcggtgtctttttacgctgtcggattttttaaaggggctcaagatgttcaaccataaatttatgtggagtcaaaacgaagaagaggcgggcaagatccgcgagcatggtcagatgttcgtcgggggctttgaagtgacgccgggaacaagaatcggcggctttgagatggtgccgggcccattggttcgcggtcaactattggcttttattaatgatctgaatgatcgatttgggaatgctaagaaggattgtgtgaagctggcggtgtgggcgcaccgcgaattggtttgatttttgggagatgagatgagagggagaagaggggaggagagaattatgcaaattggttgggggggaagagtgaatgaaaatgggatgagggagatggtgtcatggcgctttgtacaatttctaaggtgcgcattcatccgttttttgacgccaatggccgcacggcccggctgtttatgaatttgattttgcgccgcgggatgcgacgcgggccggtcacgcttgatgaggggtggcgacaggagtattaccgctgcttgaggcaaagggacctcgcaagctttgaggcaaaaatttgatcaatctgcagggcggaaataattaagaatttttaaaaattttaatgggaaaattgttaaaattatatatcatcccaccccttgatttatttaatttatgttcaaccatttcatttcacatattttgtattgttatttgtttca

SEQ ID NO: 80273 - DNA, 669 bp, Heterodera glycines
  Genomic contig location: Contig_ID=SeqID_15925; Location=18..686; Strand=-
  SCN-specific regions: Sequence locations=1-461,483-630,652-669
atggacatagatgcgctcaagagaagggtcacgacacttgagcggcagttgcaggaacatgccaacccgcgcactggtcttccacttcccggcactttcgacggaacaacggatttttacaattatttgaaatccttcaatcttgtggcaactgcacatggctggaaccccgcccgctgcgttcaaattttgcccttgtatttgcgtggttcggccaaggccatttatgatggcttagaccaaaatgtcaagacaaactggaaggatttggtcgacggtcttgcggacaaattaaagaaagtctcttccgggctgatggcacgacaaaaattggcgcagagaagacaattcgcgggcgaaacattggatgaatttgcgcaagaaattcgaagtttggtggcaaaagcctacccggacaacacattggagatggacttggccaccttagctttgggtgatcgcgagaatgaagtgaaggaagaaaatgcaaaacggattcagcaattccgatcggaaattgcgcgcgactttttcagagcgaatatgctcccggagataaaagagagggtcatgtacatggaggaaccccaaaacctgatggaagctcttactcaagctaaacgagttgagcaaattcaaggaagcttggcgaatgatcagtggcggatg

SEQ ID NO: 80274 - DNA, 2880 bp, Heterodera glycines
  Genomic contig location: Contig_ID=SeqID_2538; Location=1694..4573; Strand=-
  SCN-specific regions: Sequence locations=1-66,89-227,249-442,467 -585,608-803,825-917,940-1141,1163-1292,1314-1509,1532-1684,1706 -1848,1878-2308,2333-2880
  Gene Ontology: Mol. function=cation-transporting ATPase activity; Cellular component=integral to membrane; Biological process=mitotic spindle orientation
aaaactaaacgataaatacccaccaatcccgaagcgttgccagtctgctgagagccgaattgagccataaaaattaatattttaataagtaagagaagtacgctgaaaaaatgggattagaaagagatgcataaaaccatcaagaaattgtctatcaatttttcaaaatcttcagcaaatacatgaaattttaggtgaggcatgtcccgaaaataatattaatttgactgatcagcaacaacaacagcgtgtactgttcggaaactgtgacgccggcgactcgttcaacgggctgttcgagaaccctgaacaggaggtggactttgtgctcaaaacgagaacgtttaataattatttgttttttttgctgtttttaaggttgggtttctgtgccgaaacagcggacactgaacacattttggagctgcacaaagtgccggaaaccaatggaagatttgcccattttccggcccgttgttcgcctcgccaactaatcgcccagttcatcgacattcgaagggcgccttctcggttaaatttactcttatgccgattttgaaatattccttgagggtcctttcctagggatggcgaggaaaagagggaatgaatggctcagttggttaaatttgcttttttgagtgaggcctgggttcaaacccaacttcaattaacataaaataagttatatttaataaaatagctctgatgaggcattaaaaaatttcgacattcattggtccttcatcataaacgctaattttgaaaaaattcaatcgatttttggggatatttcgaccaataaactgaaaattcagttgaattgacgaaaaatccccccctcccccctcgaaggcgtcgtgaaattacacacctttagtagatatataagttttttaaaacagcaaaatggatggaaaaatggtgacaattatgccagcaatttccccgctttcagctcgctctccgagtctttgccgaccatgctcatgagccggctgaacgtcgtcgactgtggaactgtgcagtgcccagggggccacggaatttaccaaatttgttcgacaggtgttattttacgaaaaaatatgtgtggccgtttctgttacaaaggtttatgtttattcttcttttttgtacaatttttcaaaaatttacttctctcttttttttttaattctcagaaacatcagaaaaaatgatcattttatatgtttcatcatcatgttttttccttgaattgtatatctattgtttttttcggtcgtttgtccatttagtttatttcattgccatattcacaaaggtcagaaatggcacccatccagggacggtcccaggaaattttggcgttgggtgggttcgcccccggacgatgacacattttttaccttccaggggtaacaatttatcaccaaaaatgataattttgttgatttttggaaaaatttcgcgaatttttttttgagaaatttacgtgagggaaaaccgaaaattttagcgaaaattcaattttcccttttctttttcaggtactcttccaacagttcaaattctttctcaacctgtacttcctgctcatggcctgcagtcagttcttcccggccatccaaattgggtctccgatcacttattggggtccattggtcagttaatgtttcccccaccattttatgggttcaaaaaatgtttcagggttttatcctgttcatcacactcatccgcgaatttgtggacgacatggtccgactgttgcgcgacagggaggtgaacagtgaaaagtatgcttgagggccgtgttctgatcaaaagcgcgtacgttttccatcgttttttttttgaatttggaaaaaaaataattaaaaaatcaaatttttcgaatccgggccacggaaagggatgaaaaatttgccttttgtcacgtaatgaatgtcactttaagcgaaatccatgttggcgatttgatcatcattgaaaaggaccgtcgagtgccggccgatgttgtgctgatgcgcaccaccgaaaagtcgggcgcgtgtttcatccgaacggaccaggttttggcgtccgaaaaaaacttgctgaatttgttgatgggtttagcttgatggagagacggattggaagctgcgcattgccatcccgtacacgcaaaacctgttggacgacatgcaaattttggacctgaactgtgaggtgtatgcggagaagctgcagaaggacaaccacgcatttgtcggcacataccgggtcagtgtcatccaaaattccagggaaaattttgaaaaaattttaagcgattttttttgggaaaatttttaaaaaattagggtaggagacgttacgggtggggggagctctatctgtggagaatgtgctgtgtgttgtgggccaacacagtgttggcaagcggtacagccattggactggtggtgtacaccgggcgggagacgaggtgagagccaaccgacaccaatttttctatacaatttttttgccaacgtttttggttgatgccgcctctatcatttacaaataaattcagatcggtgatgacgacattgcctgacagtaaagttggcctgctcgatcgagaggtgagcaaaatttgggggaaaatgttttaaatgttgaataaggggctacaaacaaaaggttacccgtcaagatttccagtaaaaggcccggtattttgaaaaaaacccaggctatttaagacctggttttccgagtcgaacccggaaaatttgcttgttaccccaccaaaattatcattcatttcgttaaatgagcccccccctgaacaggcgaacaactttaccaaatttgcttcctgttcgtgctcactttgtccgctgtgatggtgctgatgaaggggca

SEQ ID NO: 80275 - DNA, 1597 bp, Heterodera glycines
  Genomic contig location: Contig_ID=SeqID_2538; Location=5047..6643; Strand=+
  SCN-specific regions: Sequence locations=1-395,426-552,575-1044,1066 -1519,1541-1597
atgggtggccaaaaaaaaatccacttggtgtacgccgacaaacctgtcagtgcactggaggaggaatttaatgccgccgggaagctgtatggccagcctgtgcctgcactcggcgcgtacaaaaatggccgctcaactccaattgagccgcggctggactattcggcgcagtccaacgctgacgaccacccaggacttggctacaagtgtggccgttggcaggttaatggcttttaacaattaagctcttaaaaatgtgttttttttgcactccaggtcgagggcatggtgcccgaaattctcgaggaggacattggcgaacgtgtattttacacacaagcccaggtggagcaaatgctggacgactttaaggtagcttttaataaatgggcgagatttttttaaattttcattaatttaaaaaagcatttttctacgattttattactttttttaaagttatatgtgggtcaactccacagtgaatgaaaagttaacaaaatgccaaaaaagactatttttagcgctaattcaattaactgatcatgatcattgcctttttgtgattttattcactcataactgccttcttaatttgattactgattcagtcataactagggatgggatttctaagtttttacttatttttctgcggctttaactgaacgagaaatacacgaaaaacacattttttgtctgaaaattttgcgttttcacgcccttattcgaccttagaaatccttatttttgatgttcgcccttaaaataagtttttgcccttattttggcgttttgtccaaaatttattaacaaaaatgcaataaaaaacgaaaaatacacccctaagaatcgacccaaaaaaatttcgaaaaaatacacccctaagaatcgacccaaaaaaatttcgaaaaatatacccctaagaatcgacccaaaaaaatttcgaagaaatatacccctaagaatcgacccaaaaaaatttcgaagaaatatacccctatgaatcgacactaaatttttcaaaaatagaccctaagaaatgaaaaattttttctaaaatatagcttatttgtaactgcaatcagtgaataaaattgtttgccttagtctgaaattatttcatgtaaaaaacagcaattttaaaaattataccctaaatttgaaactttttcgaccttattttcgcccttatttcgcgaatttttcgcccttatttacggccttattttggactttttcacccttaaaaatcccatccctagtcataactatgacatctaaaaatatggatgaatatcgcgaaatttagccataaaataatgacaaaaaaaacgcaaaaacatgaacataaaatagcaaaaatatggtaattttgcaaataaggttacaatttaaatttcttcagatttgttaaatattaagagcgaaaaacaacctgagaaatgaaaaatacgcttttttgacataaatttataaatttgacgaaatttaaaatttttcaacatttccacgaaagtttcaaaaaatatttttgtggtaatttttttgaaatttaggggtcaaaaaaaccaattttcagacggggctgttctaa

SEQ ID NO: 80276 - DNA, 387 bp, Heterodera glycines
  Genomic contig location: Contig_ID=SeqID_2538; Location=7249..7635; Strand=+
  SCN-specific regions: Sequence locations=1-163,187-387
atgacaaagaaggtgttcgtcgagacggatgctgcggtcgatgggaggcgggacgcaattttggctggtgcccgccgtaaagcggcgttttatcagctgaaaaaaggtgtcgtcatgaggatggacagcatgtatcagcaacaacagcagacaggccaaattggacagaagggggagaatgaagcggagcaacagcaatggggcaaagcgcacacggaggaacaggccgcttttgaatttgtcgacgttgttgtgcatcccgaggaccttttcgtcaacgaaacgcacagcacttccacctttgtctaccaagccggcgacaaaattctccaaaacaattcactgcggcacagaatggcgagatttctgttgccaccaggagaattg

SEQ ID NO: 80277 - DNA, 629 bp, Heterodera glycines
  Genomic contig location: Contig_ID=SeqID_2539; Location=378..1006; Strand=-
  SCN-specific regions: Sequence locations=1-231,255-578,602-629
atggtcgctgacggtgtgctgagcgagttggtgctgtgcgagtcgcgtccaacagtcgccgacgcggcggcgtcagcggagaacgctgggccaccagcaggcacaaccggcgacaatgagacgtcgccacaaccgcaccaccagcaacagtgccatcgaccgcagcgagtgtatgacgcgttgcggcaacggtcggccgaagttgcggactttttgatgcccactgacaatgaggcggaggagttgggggagggcggtctgttctacgcgtgtggcgacgtgaagaacatgagcagagagttgtgggcatgtctcagcgatattttgcagcgcgagaaaggcgagcgttatttggctgacttaaacagggacggcattgagcccatggttttggttgagacaaatcccgaatatccattcgttaaaaaaccccaaggtcgggcccactcaaaatccctgtggccgcaccccaattcggcccctaacccgacagggaaatcaggatagatttggtcgacttgatcagaccgaaaattattttttttccaggcttttcccctgtcgaagcgattcatttgttgaaaaaactgcgtgaaaaggagcgcctaattgaagatgtttggtcctag

SEQ ID NO: 80278 - DNA, 287 bp, Heterodera glycines
  Genomic contig location: Contig_ID=SeqID_2540; Location=759..1045; Strand=-
  SCN-specific regions: Sequence locations=1-287
tcctcttccaatacactttggcaatgcggtgcgcccattccaactgcttttggcccgctgttgcgcacgcgcgtggtgcgtaacgaatgcgtcactcggacggacacgggccgaattggcaaagcaaaatgggagttggaattggcactgatcaccactgatcaggatggtgctgatgatcagcaagaacaacaacagcgtgaactgctcgaaagctgtgatgccggtgactcgttcaacgtgctgttcgagaatcccgaacaggaggtggactttgtgcttaaaag

SEQ ID NO: 80279 - DNA, 590 bp, Heterodera glycines
  Genomic contig location: Contig_ID=SeqID_15928; Location=411..1000; Strand=-
  SCN-specific regions: Sequence locations=1-31,101-123,160-262,284 -324,346-437,515-590
atgatccctaacaataaaaacactttttgcggagaaagagagaaaaagagagatcagcagagagaagagaaaagagagagaaagaccgagacatggaaagtgcaaagaaaatcttatgaattcataaaataataattattgtattattttgtaaaaaatgcaccagaagagttaaatgaagaaagatgggatggttcacttatatttatgatggacggcggcgagcacataaaataataattcacggcaaaacggtgacccaaaaaagaaacaaatttgaattggattttgcttatcccccaatattcccattgatttttatttcagcaaaatgatgacccaaaaatgtggggagagattttctcaaaagaaataccttcacaatgtgcaacagatagagaattttgtacacaatcaaatgtcaagtgttcaagatgaaaaattgaaaaatatttaaagaaatttagagaatacttatatttaaaaattttttgattaaaattaaattttaaaagataagattcataaaactttgaaaaatattccataatattaaaatatcaaaagaaaaattatcaaaaaagaataaa

SEQ ID NO: 80280 - DNA, 62 bp, Heterodera glycines
  Genomic contig location: Contig_ID=SeqID_15929; Location=865..926; Strand=+
  SCN-specific regions: Sequence locations=1-62
aagtccatgcgctgccccaactgctgcagtatttgaagcagcgcccgcaaggccgctgatca

SEQ ID NO: 80281 - DNA, 538 bp, Heterodera glycines
  Genomic contig location: Contig_ID=SeqID_15930; Location=184..721; Strand=-
  SCN-specific regions: Sequence locations=1-72,99-110,239-297,359 -390,441-538
atgagcagaatggtcggacacacaaaaccaacctcggaaaaaagaaaccggtggacgcgggggaaagattaataaatattaaccatttattttcaaaaacgtttagaatgaaataataaaaataaaaagtatacatattatattaaattaatttaaaaaaatatataacttatcaaaacaaagaaaaattaaaaatataaaaaatttaatgaattttataaatttttacatttaatttgttgaaaacagaataaaagtttttgacttgcctcctcaatagcataatctatacaatacatatatttatttattttttaattaataaaaaaattataaaacatttattgttaataaaaatcgttttttataacagttgtttagatgttaccgaaaattaaacattttcataattaaaaaataataataatttaaaaattttagaacatccattatattcaaatctttaaaaacagctagatttatactataattagtaaaaaaatgagatatttttttatttttctgctactttattaaa

SEQ ID NO: 80282 - DNA, 57 bp, Heterodera glycines
  Genomic contig location: Contig_ID=SeqID_15930; Location=1655..1711; Strand=+
  SCN-specific regions: Sequence locations=1-22,48-57
atgttcacatctattaatcctctcgttctttttcttctgttttttgtggctggcgac

SEQ ID NO: 80283 - DNA, 181 bp, Heterodera glycines
  Genomic contig location: Contig_ID=SeqID_15931; Location=1532..1712; Strand=+
  SCN-specific regions: Sequence locations=1-181
caaacgcagaattaaagtacaggctatagggaagctattcccgaaggattcggtctccccataaatctgagcgcatcggttcggggggactgccccgaaaacaaaaaaatcgattttttcaagtgtccgtttggggtactcaaacaattatggggagcaaaaatccaacgcagaaaaacta

SEQ ID NO: 80284 - DNA, 770 bp, Heterodera glycines
  Genomic contig location: Contig_ID=SeqID_15932; Location=842..1611; Strand=+
  SCN-specific regions: Sequence locations=1-530,552-735,757-770
attatttttaatggcaccgcccgtcaaaaaaaagaaaaagttttcctccgacaatcgccgcctcatttcttctaccggaattggtgaacatgaacaacaatcgatgggttcacttacgacatcgtttggaaaacggcaaagtctttttcgacatgcaaagaaaatgaacaaccgaattttgaggaaaatgtgagaataattgggctaaagttatgaatttcaatttaaagtctctcaaaatatttttcccgcatttagctggatttgcactgatatttggatggacactttcccgttctttgaccatgcccaactcggcctcaaattggcactgatttcgccacgtttcgatgttttagtagacaaacatttcaattgccaatctgaattgacaatttggagagaaataacaattgtcaaggacacaggatcagaattaaatctaactgtacggattggtggcaaatctgtgcaatttcctttgcccgaccgttcgctgcccaacaaaattcgctttgataatcttaatattgagtaattaaaagtttcatggcattattaactggtaaaggaattcatcccgttttcagttacattgaccattccgtcctcgtgtttctccgtgccaataagcaaatttgggacaaaggcaccaatttgagtttgtatgtgtgctggtcacacaaccagaacgacaacaacaacaatttcctgccaatttgggatgtttttgtttgtaaaatttggcccatttttgcgccaaacattcg

SEQ ID NO: 80285 - DNA, 91 bp, Heterodera glycines
  Genomic contig location: Contig_ID=SeqID_15933; Location=422..512; Strand=+
  SCN-specific regions: Sequence locations=1-91
taccgtatatgctctaattatagcccagtctctattaatcccgcagtctccaattatcccccagtctacgaggtgttttgaaaaataatcc

SEQ ID NO: 80286 - DNA, 465 bp, Heterodera glycines
  Genomic contig location: Contig_ID=SeqID_15936; Location=229..693; Strand=-
  SCN-specific regions: Sequence locations=1-65,87-206,228-436,459-465
atggaaaccgatttaataactttggtaaaagaaggcgattttgaagcgggtaagttaataaaacagaccctaaaccagtggggaggggcggcgaaggggttgcgtattgcacccctaacaaattggtaaacatagaaatttctaaaaaatttcaaggaccaccgaagcaatattatgtcgattactcaatttttttctaattttcatcaaaaacccaaaacctctaacatcactggcatggaataggttatgtatacatttgcatgcctttcagttaaaacacgtgtggacagcggcgaagattttcagtccggggattttagacgcaaaacgccgctaatgcatgctgcgagttctaaccaattacaaattgctcagttccttattgaaaaaggagcacaaattgacaggcgagacaaatccggtgcggtttaatcagcgattctcttgcttcagctcaataaa

SEQ ID NO: 80287 - DNA, 317 bp, Heterodera glycines
  Genomic contig location: Contig_ID=SeqID_15937; Location=1413..1729; Strand=+
  SCN-specific regions: Sequence locations=1-47,69-317
atgcttaaaaatgagaattggaattactttaatttaaatcatgttaaaatggttgaatggcatttgttggcattggcacttcgcaaagatggacaatgccaaaaatgggaggaaatcgaagacaaatgggaagaatggaagagcgaatttaacctttcatttggaaatacgaatgaaagtcagaaatttcaaaaattaatggaagaaattaaagaaaaaatggaaaatttgaaaaaaataatggaaaagcgtgaaaaggaatgattaaatgactataatttattttatcggatcatcgcaaatgaaaacaaagatta

SEQ ID NO: 80288 - DNA, 117 bp, Heterodera glycines
  Genomic contig location: Contig_ID=SeqID_15938; Location=1396..1512; Strand=+
  SCN-specific regions: Sequence locations=1-117
atgcgaatttggccctcccctttcgttcttccgtcccttcccctcgcacttttcctgcccatttgcttccgtgtcgttctgttgttgcgcttcggcgccggacgcgacgacgccgcg

SEQ ID NO: 80289 - DNA, 417 bp, Heterodera glycines
  Genomic contig location: Contig_ID=SeqID_15939; Location=176..592; Strand=+
  SCN-specific regions: Sequence locations=1-180,205-339,395-417
atgtccttggatttcatgaattttccccgttatgtccttgaaaatcggcatacccgtccttggaaacggatcattgacgatgagagccctgctttaaatgttttttgatcgattcaacacttttgaaaatttccaacgtttattcctattcatgccggtaccgttctattctacaaattgaaaataaataaaataaaattatatggatcaatttttaaggcgcttttaaacttcgaacaaaattattgggacgccaacgcttgtcacactgacctagaaatcattggtgacaaaaatttgacggttcattataaggaaagagcatctggtaattttattccaaaaataaaattaatgggctaaatttaaaaatgtattttttacttcgaaatttaagcgaattgaacaatacgttta

SEQ ID NO: 80290 - DNA, 814 bp, Heterodera glycines
  Genomic contig location: Contig_ID=SeqID_15939; Location=814..1627; Strand=+
  SCN-specific regions: Sequence locations=1-100,122-545,567-814
atgatcttccgctctataaaagatttcttcaaaaggttggcgtttcgtcttcgcaaaacatccatttttgctgggcattggttcatcggacattttttactttgaaatttcagtaaaaaatgggggatggtaaacgtatctcaaggatgtataattttaaatttccatgaatttcagtggcgtctgcttcggatttggcgtaaaaaagcagccaaaatcggacgaaagaatgtatgatggcgagggcttctacacatatgattccaacggcattttttggattaacggttcatacaaaggaatgtttgagagaaatgcttacggtgttaatgacattgtcgggtgtggcgttaatttggcaactcgaaaaatatttttcaccaaaaatggtcatagaatgggtaaatttaattttacaaagtttttggatttattttaattattttcaggcgctttcgatttcgattcattttctgatatttaccaattgtttccattcgtttctttgccttactggagcgaaagaatagaggcgaattttggcccattttaaattcaatttaaatgtgaaaaaattcactaaaatgttcttttgtaatttttatgatcattggacttcaaattgtaaggatttttcgaagcatttctctcaatttattttaaacttcaatattattctttttttcgctttgatttatccaaccaacaaaaagcgattaaaattatatcttcagtcatttgattcgtttgggattttggggctcagtcaaagggcccatggctttccccgattccctcccaaattcaatccgga

SEQ ID NO: 80291 - DNA, 884 bp, Heterodera glycines
  Genomic contig location: Contig_ID=SeqID_15940; Location=170..1053; Strand=+
  SCN-specific regions: Sequence locations=1-130,198-208,261-406,429 -437,575-701,723-884
atgatggacaaattggtgcagcaaatggacaaagaaatagatgaggtgagcttgaaatgtgcttaaggaatttataaattaaatttaagctgtctttaaacatcggtgctggtcacaatgacaacaaaatcattggtgaaagaatttactgttaaataaattataaaaatatttaataattacctatattttaataagcatagaaatatttaataacattttttcaaagcatatatttcattttaaaggaaaaacaaaatgtcaacaagagtccgccattatgccaaggaaaggcaaaaaagtgaacaatgtcagtgatttgctacgtgggcgagaaatccaccgccaaacttccaccgtttgggtaaaactttgatgccattacgttttataaatatgccaatggtcagcaaatctaaaaacaaaaataaattcacatattatttaaagtattaatttttttgtccattttaaacttattattttttttcgaaaattaattaaactattaagagaatacttttttatctaataatagaaataaattaacattaacattcatatattaaaaaaagaatatgggatattttttattgatactttttcaaaagattttgagattttttaaataacatattctattgtacaacacttaaaaatacgaatatcaataatataaatttttgatgtttttaactagtgttattaattttattaatggactaccgtatcttaaggcgtttagtagagttcgacctggacctaggtgcaagcccggattttccctggttcaaggtccaggctattttcctggacatggatttttgttcacaaatttagcccctgttgaaattggataaatcattacatgctttttctcatga

SEQ ID NO: 80292 - DNA, 508 bp, Heterodera glycines
  Genomic contig location: Contig_ID=SeqID_15942; Location=94..601; Strand=+
  SCN-specific regions: Sequence locations=1-119,142-471,493-508
tactgttggaagacgtacctcggcccgttgctcgaacaaccgaagagcgacgatgaggagaagcccaagccggaaggaggcgaagaagcgacgaccgccggcgacaaggaggagaagaaggctggcagcaagggcgacaagcacaagaagtctggcagcaagggcgacaagcacaagaaggacaagaagtctggcagcaagagcgacaaggacaacggccccgctgacgaaaacaaacagccgcaaacgagtgcttatgtaagtttatcgcgtcttaaattaccgcacataattaattttttatcaggcaactcccacctaagaacttcaccaatgacgcattcgactgaatagaagacaacagatgaaaacaaattcagtaaccacaacaacagccaaaagcaaaccaacggaggaaaaagaatgggaagcgatggaaacggattcgaaatgatatttaatgccacaaaatatttgtatgtgtattatacataggtatatccggtca

SEQ ID NO: 80293 - DNA, 1880 bp, Heterodera glycines
  misc_feature (63)..(64): n is a, c, g, or t
  misc_feature (72)..(72): n is a, c, g, or t
  Genomic contig location: Contig_ID=SeqID_15943; Location=1..1880; Strand=-
  SCN-specific regions: Sequence locations=1-140,162-689,712-828,850 -958,982-1283,1313-1621,1680-1880
aaatttataacaggaggggaaatctttgaaagatttaaaaatttaccccagaaaactctttanncagaaganaacgaaaatataaactatgaagaagaaaagaaaatcgcagaaaatttgtataagtctatgaacgctgaccaaaaaattatttacgaaaataaaacaaatagcatcaggcaaacttaatcctaaattaatttacattgatggcccgggtggcacaggcaaatcatttacattgaatgcattatatcatttagtacgtagttataaaaaacatatgactagggctggtaaaaatatggatataaaatcgcgaaatatggccataaaatatggaccaaaaatcgcaaaatatggacataaaatggcaaaaatctcaaaatatggaaataaatggcaaaaatgtcaaaatatgtacataaatttttcaaattcccagccctacatatgacaaacatggcattttcaggaattgctgctacattattaaaaaatggtagaacaatacataatcgatttaaatttccgcttaatcttaatgctcatattatttctggagttgttcaaggcactaaagctgccgaagaaataataaaaagtgatttttttgttatagacgaagcgccgatgacaccacgatttgcacttgatgctatcgagaaaaaattgcgtgaattaactaactgtaaacaattatttggtggcaaaacaataattcttgcaggtgattttagacaaacgttacctgtaaaaaaatttgcagtaagaagcgaaattattgacctgacaataaaaaagtcaatattttggagtaaatttgagcagatgaaattaacaataaataatcgggctaaagaccaaattttcgctgaacagatacttgaaattggtaatggaacttttggcgattctattcaattacctaataattgtatcatagccaacgattcaaatttaatagatgaaatttatgatgatgtttttaaagaacgtaattttaatgaattaaaaaatcgtttgatactttcaccatacaatgatttggttgatcaacataacacagctgctttagaaaaatttcctggtgaatgcgtgacttacctaagcatagatgaagttgaaacaactaataattttccagttacaccagaaataatgaattcatttaatgccccgggattccctgttcatgaattaaaattgaagctaaactgtaagataatgcttctaaggaatattagcattgaaaacggactttgtaatggaacaattttacaagttaaagaattaaaaaacaatgtattaaaatgtataatacttggtggtgataaagatggttctgaagcttatattcatagaatttctctaataactgaaagcgaatttcctgttccattaaaaagacatcaatttccggttcgcttagcttttgctgcaacttttataaaaggacaaggtgcaacatataaaaaaattggagttgattggacgagacaaagtttttctcatggtcagacatatgtagctttatcgcgtgttggttcatggcaacaaattaaagttcaattatcacatgaaaatctaaatgcaaaaattgataacattgtatggaaggaaattttataattttattaaacatgaaaatacgaaaaacaattaataataaaatatttggaaaattgaaattgaaaaggagcttttaaggtaagttaatcgccacattaatgaggggggtgtggtgtgtgatagggcgggaccctattgtccctctaactatcacagaacccctcggctcctttgacacccatgctttggtgcgttctcgccgcgggtgtgatagtaggcttaaaagccgaagccaaaaccaaagcaaa

SEQ ID NO: 80294 - DNA, 474 bp, Heterodera glycines
  Genomic contig location: Contig_ID=SeqID_2542; Location=419..892; Strand=-
  SCN-specific regions: Sequence locations=1-110,159-474
atgctatttctttgccttctacagtatttattactaataaatacagtaatctatggacaagagtcaaatggtggcggttacggtgaaagttatggttattgatgacccgtaaaaacccaaatgaaacaaaaccaaatttaagctgtaaatggcaaatttggagaaggaaattggcaaactggacgattcgaaggccaacatggccaattcagaggcagaaattggcaaaatggccaaaacagagaacaaaatggtcgatcggaagttaacattttgacgagccaaggaggaggcgcaaatcatcgtcaagcagcatcaaattcttgtgatcagattcggaagagcccgtcaacagcgatcgaacagctgatcaaaggcagactgatcaatccgatcgaggacaattcacagcgttatacactgtacgcagcggactttgccaggacgaacaagtccggcggatgttttcctcag

SEQ ID NO: 80295 - DNA, 3383 bp, Heterodera glycines
  Genomic contig location: Contig_ID=SeqID_2542; Location=821..4203; Strand=+
  SCN-specific regions: Sequence locations=1-70,169-263,286-340,363 -400,422-1052,1074-1287,1321-2007,2042-3322,3344-3383
accatttgactcttgtccatagattactgtatttattagtaataaatactgtagaaggcaaagaaatagcatatttttattttgttttctaaaattacatttttattttattttctaaaaattttaacgaaaaatccaaattttatttaaatttaaatttgattttttgaaatgaattgaagatgaccttaatttgtttgtgtatttttaaacattttttggcaataaaaaaatatttttcagttaatttatgtgtcaacaaattttattaacaattagggagggctccgactcaatttgacaaattacccaaaacgaaatgaaaagaatgcgcatagacaaaagaaaatgaattaattaattggtgaaaatgggaccaaaaaaaaatcattagtggttttaaaattgtcaaaactttttcagaataaacacaattaattcaattgcctaagtgtattcttaattggcctaaaaaatgtcaaaacggtttcaaagtttaatcaaaaaaaaaagtaaatttttgaatcttttatccaaaccttttttagggtttgaaaaatttcttattgaaaaacaggaaatcgagaacatgaagtcggtcgaacattggaaagagtacaaaattctctacaaaatacaaaagtccacatctctacgacttacacccatgaggtatgggcacttcaatttcggtgttgatcatttctactgtaaactgcaatattttcttaagaaatacagtactttttgtagacaccgaaattgaagttgacatatctcagcgggtgtaatttgtagagacctgaggtcttttacatattgcagagctttttgtgctctttccaatgggtctactcaaaattttcaaaaaaaatttcccaaccccctaggaatttttttttctaaaatgttcccgattttcagtattttggggtgtctagatcactatgaaggagtgatcggatcaacttgttgttaaatacttttttgatcagcatcaaaacttatgttagcatgaattatttcagatttttctgtgctctcaaatttgagattcaaaaactggtgttaaacatatgcaccactgaaaatggggtatggtacacaaagtcaactgtaattcgggtttgaaccgatattttgcttaatgattggtatcatttgaaagccattaaaaattatacaaaaaatgtcaaaacatttggtcatcaccaaccatttaactttttatgaagccaaatttctcgaaaaggctagtggtgttagacttatgctcctaactgtatgcactgtgaaaaaatttttaatttttaactttgttcacaaaatttattcacactcatacataatatgcaatgaagttttgtatggaaatgtcaccgtttttgactgcctcaacttgacctcaaatttgcactgattccacgtttcgatacgcgctggtgtacaaacatttctatgacataacttaattgacaatttggagagcaatttgcaattcgcaagggcaatggaatgccgaaatcatttttcgagggcaaatcttatggattcatacttggaaaaaaaattttccttgtgcacaggttttcttaaaatttttgcataggctagactatttttgaatcttttctactaaattttattttttagaaatttgttttctaacgttgtctcctgcatttttacaagggcatttttttaattagaggtcgtttttggctggcatttcactctagtaattgttttctttgtcatcacgcgtgttttttgtttatttttaaagttctgtgctttatcaaaatgcaaacatatggatgggcggagcgagtgagtaattgaaggctaattaatattgctgttcgagattctcggggtcaagtctcgttctcggaaatttttctgtagcgttactaattaaccgtaggtttgggtaaaactgcagaattgcagctcgcgccaattaaaaaaaatgcgaataaggcaatacgagatgcactactctgaattatgcattttattttaattctgcgcataaataaatttttggcattatgattcatccattacattagcataaactagcggtaggggtcaactgcgtctgatcaaacaaaattggtatcattcgaaagttctatatatttagaagataatgcaagtcttttataagcaattaagaaacatgaaaaaaagttaataattgaaaactgcagaaaagccagaatttttgtataccgtaaatccgctatttgaaggcccgggccttctattgttcaacccctcccaaaaggggcctttaattggagggggccttctaccagagaggggccttctattgttcaacccctctataagtcaaatgtgaattgcctattttttgtacctctatttattcattataagcatttttacattcaaatttcatggtaaatttgtaattttgaatcaatttagttaaacaaatttgcttataccaatttctctataagatggacccatcaattgaatgtggcaattcaactaatttagtaaagcctcgtttcttattcatttgttcgaataatttttattaaggtctgctgcttttgcaacaaacccacgtctggtgctcacgctgtgtccctttgttttactgcctaagaagagacctgtgcctgagattgtcaaacgttttaagaacgatttagtgttgtgctggtgtggccgtacatggatggacaacgaactaacgacaaagtttttagaggaagtgcgaatgcttatttatgtctttaaagaaattatgtaattaaggtgcttggcggttttgcattcaggacccggcttctcgtttgggacagctttcgttgtcacatcagtgacgataccaagcagacactccgacgtttatccatcgaatctgctgttattcccggtggcactacgaaatacattcaagtactagacaattcaatttaaatcaaagaaaattattttagccaccaaacgtgtgttggaacgcaccgtttaagaacaaatcaggcaaatttacgatgaatggatggtgaatggagagaaagaaacaacgtcatccggaaatatgaaggctccgccaatggagacttgatttgggacaagacgaaagcgatgtctctgtcgacgttgctaatgaataatatattgatcaaatttaaaaactgtgttttagggggcctttaattggagggggccttctaccagagaggggccttgtattgttcaacccctcccaaaaggggcctttaattggagggggccggccttctaccagagagaggccttcaaatagcggatttacggtattttattttaaattgtttttaaaggggctattccagtttacgcgtcctatcagtgaccat

SEQ ID NO: 80296 - DNA, 893 bp, Heterodera glycines
  Genomic contig location: Contig_ID=SeqID_2543; Location=1..893; Strand=+
  SCN-specific regions: Sequence locations=1-300,323-395,417-709,731-893
  Gene Ontology: Mol. function=proteasome endopeptidase activity; Cellular component=proteasome regulatory particle (sensu Eukarya); Biological process=proteolysis and peptidolysis
cactttcacagacgcgttacggtgacgcggccattcgtcgcgcggtgccgttggccctggcgctgctgaacacgtccaacccgcagttgacaatcatcgagacgctcagcaagtacagccacgacgcggacacggagacggcacggaatgcaatctttgcgctcggattggtcggcgccggcacaaacaatgcccggattttggcaattctgcgccagcttccactccaatgaccaggtaattattgaaaatgcagtaataaatgctaagtttagtgcagtaattagtaacaaggaggattttgtttctttgccactttttataaacgggaacttgggccctgacaaattccaccaaaagatatttcaatgatgatgatttttcatgtagagcatggttgatttactattgccaatttcggcttttttggctccgttgccgaaagtgatcagaaaaaatcgatcaaatgaaaattcaaccaaaaataccttaaaatttagtgccattttttcttacgttcaaatgaccatttttcatgggttcgggtccgttcggcagacgatgaattattttgatttttcttctaggtattattccacctagcaactttggtcgattttttctgatcacttttggcaccggaacaaaaaaagccgaaaattggcaacagtaaattggcaatactctacatcataaaagtgtcagcaattaatttttccatgaatttctcttgtttttaaaaaaaacattattttgcacaaatgcacatccaacacacagaacacgatgatgctgctacggatcacccagggactgatgcatttgggcaagggcactcaaacgttgaacccattccaatccgaccgtcagttgatgtgccccgcaattgtgcc

SEQ ID NO: 80297 - DNA, 1315 bp, Heterodera glycines
  Genomic contig location: Contig_ID=SeqID_15945; Location=375..1689; Strand=-
  SCN-specific regions: Sequence locations=1-36,58-255,278-284,319 -334,366-607,639-821,872-1060,1084-1315
  Gene Ontology: Mol. function=hydrogen-transporting ATPase activity, rotational mechanism; Cellular component=integral to membrane; Biological process=negative regulation of locomotion
tgttcgtattaatatgcaaaaggaggagatgcatgtgatacgaaatggacgcaatgcgacaaaacatgacgaagtgcactccgttgacgaggcacatgaccatgtcagtggtgcaggtggcggtgcgcatcatgatgaagtaaattaattattattatggcgatggaattcatggaatttgaaaaatggacgaataaaatccaaaaagaaaaaaaagaaaaataattgataatgtaaaatgaccatctattttatgattttattttcagatgtcaattaatatttagaatgaaacaaataaaatatttaatagaaattttggcatttttaagtcaaattaattattatttaaatataaaaaaattggccacatataaactctcaattaaaaaaaacggaaatgatatgagttgattttaattagtcgggctgggacaaattaaattttttcatttgggtgtcatttttcgtcaataaatttattgttgatttttggaaaaaaatatttcatttttttgcgctttttcaaaaattttccctaaaactttttcattttaattgtttttaaaaagtttttccatttttgttatttattttttcttgacccaaattttaatttttgtaattttaattattttggaaaaatgcattcaaaaaatcgaaaaaatatcattatttgcaattgtaatccatgaataattttttataatgttatgagcagttaattattttttacacgacaaatttttttatttttcttaaatttggccaatatttctgacttttttcaatatttttgtcaatatttcggcattttttcgtaaatatttatttaaaaatttaaatatttcggtatttttaataaatatttgtcccagccatatcaattaggtccccctaatccctaaatttctcaaaataggtgcttattggtaaggtctctttataaatcacgaataatcaaatgaattccgattattttttttagtctttcggcgacattatggtccaccagtcaattcacaccattgaatatgtgctcggctgtgtgtcccacacagcttcataccttcgtctttgggccctttcacttgcccatgcgcaactctctgaagtgctttggactatggtaaataaaatacagtaattttacagtttattttttaaattgtttttttgcattaaaaattgtttaattttcaggtcctcaaaaatgcttttgcctttcacctcggtgtcgccggatactttgtgctttacttcatatttttcgcttttgctgttctgaccttttcaattttggtgctaatggagg

SEQ ID NO: 80298 - DNA, 1846 bp, Heterodera glycines
  Genomic contig location: Contig_ID=SeqID_15946; Location=145..1990; Strand=-
  SCN-specific regions: Sequence locations=1-110,139-163,229-238,272 -287,452-573,603-629,652-923,947-971,1031-1041,1063-1154,1207 -1391,1414-1423,1445-1445,1467-1471,1511-1680,1719-1846
  Gene Ontology: Mol. function=transporter activity; Cellular component= integral to plasma membrane; Biological process=negative regulation of locomotion
atgggactgttctccatccatgccggtctgctgtacaacgacgcgtttgccaaatcgttccaaatttttggcagcgcatgggcgaacattccatataagtaaaagaaaagaaatattaataaaaaaaaaacttaaatagtaaaacgaataaaaattgaaaaataataaaataaaattaaaaaaaaaagaattagaaaattaataaaaaataaaataacaaaaataaaacttcaaatcgtaaatttatttagaaaaaataaatattaaaaatcatgagctaaattagaaaaataaaaaagaaaaacatttaaaatgtttattaaatacaatatattagaaaaaaagtaaataactttaaaataaaattctttaagtaaaacaagagaaaaaattaatttaaaatttcataaaaaataaataatcataaataaaattaaaaaatatataataatgaaatttgcagtgacaccgaaattgattcatggctgagtaaacccgaagaagcggggaaggaaatggaggtccatttgaatccgatgactgcttatgaccgggctagaggaccatatccggtaaattacatttttaataattaaaaaattgccaataaaattagcacgaattaattaatgatcaatttagtttggaatggatcccgtgtggaatttggcggataataataagctaaactttttgaattcaatgaaaatgaagctcagtgtgattgttggcatcacacaaatgaccttcggagtggcactttcatatcgtaattataagtaatatttcttccatcaatatgatttttttggaaattctattttatttttcaattaattttagatttttcgaatcgccaattgaagtgttcaccgtgttcattcctcaattggttttcatgtcctcaattttcatttatctgtgccttcaaataattgccaaatggctgttcttttgggtggagccgacaacaattttaagtaaaaagcatctattttaaaataatttaatattttttattaattattttgtcttttattggaataaaataatattttcccattttagctcaagattatcccggaccgcactgtgccccttcacttttggtaagaaaattttttttaatgaacttaagcgaaaacaagagatgcattataaaaaaaaactattaaatgaattttgataatttagattatttatattcacaaaaacgacatttataataatattcagaggtcgtaaatttttattggcacaaacgaccacttctaagacctagaccccaaaaataagattttcataaatttcttcgcgcgacgtttccactctattggtactatctattatttcgtccaaatcactaaaatttttgcaccatttgaatcaaattttttaagaacaattaaaaatagcattgggaatttatttgcataatttaccaaaaaatgcatctctcatttattttaccaaatatataatataataaatatttttatttatttttttagattggtctcatcaacatgtaacgttttttctataaaaaaatcttttaaaattgcattaaattgcccaaatcaggttcatgttcaagtctcgcgatgctggttttcaagacgacaacgggaaggaattgcctggttgttacctaaaccaatggtaccctggccaggtgtgaattttataaaaattaaaatttaaaatttttaaaatttcttagtcatttgtcgaggctattcttgtcattattgcggtcctatgcatcccgattatgctgtttggcaagccgttccacattttaatgcatcagcgacgtgcaaaacgtgcagtctccgataatatg

SEQ ID NO: 80299 - DNA, 1995 bp, Heterodera glycines
  Genomic contig location: Contig_ID=SeqID_15947; Location=770..2764; Strand=-
  SCN-specific regions: Sequence locations=1-162,185-188,210-461,483 -516,539-703,725-737,759-821,843-853,875-1370,1392-1511,1535 -1565,1603-1995
atggttttttatacaacgccctttttcatggtttttattaacgactcagcaccctatttaagactaatcttatccgaatccgaggtaattggtaaatttttatgaatggcattgaccatggtcatccttttattatttcagaaaaagaggaacatcagtatattgaatagaaaaaacactttgcaggtcccaaatttcaacagaataaagaatttaaaaaaatttttcaatataaaagtaagtgtaatttgaattttggtggaaaagtgctaatcagttggaaccaaattactaatttaagtgaattatgaattttattcgaaaagtgcttaatttgtgttactaatttttggtctctatttaggatcaatcttaaattcttgacatgcgactgctaactttgctttgtgttgcgttcattattcccacagtattttcggctccaaaaaaggataaatcggttaaacttttaaaataaaaagggttcactatagagatgtgatttaagatgacttagataaatatattgtggttttttggtaggttgataaaaaaattcaaaatgaagatttgaggattaccgatcaacccggatttcttgccagttcacatttctttaaggttttttgagccaaatgagaatttttttaattcattgaccaataatcacatctctagtttaatgcccaatttaaaagaataattttccgaaaaattttttcttggtgtatttaactgttaaaaaatatattcttacatattcttttaagagagttttcatagtggaaaacgctggtggccgtactcaagtaacttaagagtaaaacaaatgaaaaatatttttagcttacagtgatttttgtttctttagattgcaattccaacaaatcggatgagtcaacaacaaaaagtgatataatcaaataattaccattattaatcacttaatgatctcttcctttaagcaaatggaagaagcggaccccgctcaagtgattagaatacaatttaaaaaaagaaaatgataattgcaatgtttagcttgtcaaaaaagcgaaaagcgaggataaggatgagatacttgaagcaatctctaaaattcgggaaatgctcgaggacagtctaaaaggtaacgcggacgaacagctgatcgacgaattggtctcagccgacgttttggatgctctcgtcgattgtttgtccaaagaccacgcgtcacggcccacactcatggcaaatgccatggcggcactcgcaatcattgtgacacgaaaagaaaagcttgtttttgaaatacaaaatgttatggattatttgaattattggctaatgaattcgacggacgacgaagtgaagaaaaatgctgtctcaattctgaagaaaatcatgcccaatgttcggattttggctgggatatgagatagagtatttactgaatttggtctccttgaaaagggggggggggtatttccatgggagaactctaaattctaaatcagggaggggctaattttttcaaattcacttttaaagacaaaaaaattatttagagaaaactgcaactgaattttaaagaattttaattttaaaaatatattttttggtgggggagactttatttttaacgctcgtctaaagaggtttttttgaggggtgggggacgtggttcttattcattagtgggagctctaattcagcaaatacggcaaattattcaaaaattttagcttattgcgaatgcaaaaagcagagatatagaagagagacttgaagcaatctctaaaattcgggaaatgctcgaggacagtctaaaaggtagtgatgttcgagagtctcggtctcgagtctcgactcgagaaaagtctcggttttttttggtctcggtctcgagtctcggtctcgggttttcagtctcggtctttgagactttcgagactcgagaccgagactttttttacacccctaatgatcggctttttgtaagttagaaataaa

SEQ ID NO: 80300 - DNA, 113 bp, Heterodera glycines
  Genomic contig location: Contig_ID=SeqID_15947; Location=2778..2890; Strand=-
  SCN-specific regions: Sequence locations=1-113
ataaaagtcaacgtagaagcctcaaacgaagtggaaaatgcgttttttatgcttaatatatcggaactagtgcgcagaaaaaaggcatatgcctcaaaagtcggtctctagtc

SEQ ID NO: 80301 - DNA, 591 bp, Heterodera glycines
  Genomic contig location: Contig_ID=SeqID_15949; Location=102..692; Strand=+
  SCN-specific regions: Sequence locations=1-25,448-559,586-591
  Gene Ontology: Mol. function=structural molecule activity; Cellular component=cytoskeleton; Biological process=N-linked glycosylation
agagtcagcaaaggccaaatctgaaaaggaggaaagaaaagacaaaaggaaggacaaaaggaaggacaaaaggaaggacaaaaggaaggaaaaaggaaggacaaaaggaaggacaaaaggaaggacaaagggaaggacaaaaggaaggacaaaaggaaggaaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggaaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacttactcggattgagagtcaaaagtgaggacgaattggaggaatgacaaagggcgaagtgacggagggcatttcgcaacgaatacctaaggaagaagaaggcaaaagtcaacaggggaagaagaagaaaagaggaagggaaaaa

SEQ ID NO: 80302 - DNA, 884 bp, Heterodera glycines
  Genomic contig location: Contig_ID=SeqID_15949; Location=77..960; Strand=-
  SCN-specific regions: Sequence locations=1-231,274-274,301-412,835-884
gtctgtccgtctcagttgccttctctctccgtctcttcgtccgtctccgattgtgcgccctcgcgaattaatttgctgtggtctttgaactcgcgcgtcccctctctgctgctgctccaacaaagggcccacaaactttgccttctcccaatcgaagtgccattttcggtgatcgctcacagcacggaactgttcaggcaaagcaaaaagagggcatttccattccatcgcattttaattttattatttccatttttttaaattttattttttcccttcctcttttcttcttcttcccctgttgacttttgccttcttcttccttaggtattcgttgcgaaatgccctccgtcacttcgccctttgtcattcctccaattcgtcctcacttttgactctcaatccgagtaagtccttccttttgtccttccttttgtccttccttttgtccttccttttgtccttccttttgtccttccttttgtccttccttttgtccttccttttgtccttccttttgtccttccttttgtccttcctttttccttccttttgtccttccttttgtccttccttttgtccttccttttgtccttccttttgtccttccttttgtccttccttttgtccttccttttgtccttccttttgtccttccttttgtccttccttttgtccttccttttgtccttcctttttccttccttttgtccttccttttgtccttccctttgtccttccttttgtccttccttttgtccttcctttttccttccttttgtccttccttttgtccttccttttgtccttccttttgtcttttctttcctccttttcagatttggcctttgctgactctctttactccgacattttatactttt

SEQ ID NO: 80303 - DNA, 1259 bp, Heterodera glycines
  Genomic contig location: Contig_ID=SeqID_15950; Location=1034..2292; Strand=-
  SCN-specific regions: Sequence locations=1-51,87-101,123-321,344 -380,419-498,539-559,595-613,644-831,859-913,935-1163,1185-1259
attttataatatgtgtgcttttttacaaaagaaattttgcattttgttgccatggaaatgggaaaagggaaaaagaaaaagtcattggaaatgacattttcgacattttgaaattgaaattgcatttccaattacataatttgctaattgccccccaaggcgtgcaatcgagaatggagtggcgattttgagaaggagttcgccatgaatgcctccgacttttacgactttccgttccatcccaaagtgttggactacggccaattcttggcctactgtcgattggccgaccgacagacgcaatgtttcatcgaacgctgtggggatcaggtgggatcaggtggaggaggggggggggattaaaagattaatggatttagtttaaaaattaaattttattaataaataattttaatttccgactttccctctttttgtctcccaatttctcttacattcttctgttttgtcttttttcttccagcaaaatgctaattgctttttccccacaaatatttttgttttccctttttcccatggagtgccgaccattttcaccaatttttatattttatttttaaattcttattttttccaagagagtgccatttgatttttccccacttttttaattttaaatttgttctatctttcccccccccctttcccatagagtgccgaccgcgtcttttccccgtccaactttttgtgcactttcaaacgacaacatttcctccgcgctcgttcttgtctcgaggacagtgagcccatttcctttctgcgctgtgatcagaaatgccatccgccgaaggaagggactgaaaatgcggcgaaggaaagggaaagggaaaagggcgctgaaatgggcaaagtttactcgggggacgaaatggacgggtacgagagggagctgggcagagtgtgcgcatttcagcactgctacagccaatgccaggagcaaattgcgagtaaacaaagcgaagggaaaccacggcacaatggccaatttgtggccaaaaaaataaaaacggtcgaaactttacccattaatttcagcccaaatttgccctccgggcccagccacgctggctgccgaattggtacgcacttatgtgcaatggcattcggctgatctgctggactggcacattctgacgggcaacgaactgcggatgccccaaagctgtgccaaattggccaaatcaatgacaacggccaagggacccgacccggtgctgaaggcgatgctggtggcagtg

SEQ ID NO: 80304 - DNA, 2370 bp, Heterodera glycines
  Genomic contig location: Contig_ID=SeqID_15951; Location=129..2498; Strand=-
  SCN-specific regions: Sequence locations=1-812,834-1082,1113 -1555,1577-1698,1720-2370
atgccgcagctacctatggacagagttcggcggcgcattccattcgaatcggtgggccttgactacctcggcccgactgtgaccctcgacgcgaacggacaacgacaaaagacgtgggtcttgctgatcacgtgcctgacgacgcgagccatttacgtcgacgcaacacgagacttatcggcacaaagcttcatctccgtcctgcggagattcatcgcgcgccggggtgccccgagtcggattctcagcgacaatgccccgaccttcacagtgatgggaaaaacgctgtccgacttcggcatggcgggagatgatccgcggcatttttcggactcccgtggcattcagtggcgtttcactccccagcacacaccgtgggccggagggatatttgagcgagcggtccagctcgtaaaacgagctttgcagaagacgctgggcagtgctgtgctcggctatgacagcttcgccacgttactcgctgaagtggaggcaacggtcaactcccgaccaatcacttacgtcaacagcacggcgggagagcctctcccgctccgcccaatcgacttcatccaagagaatgggcggctttgggtggacccacccgacacgactggtcaggcacaggacgaacggcgggacccgccgcacaagcagctagccaggcaatggcgggagtcacagcaacgactcgaacatttttggcgacgatggcatcgcgagtacctaatgacattgcgagaaaaagccggatggaaccatgctcagcggagggtgaacgcacccgggacaccgaaggtcggagacatggttttggtggaggataaatttcacccgcggaacctatgggccatgggccgaatcgaggaactcagaggatcggacgggcacgttcggagcgtgctgatcagaatggcgaacggaagaatttgggggagaccagtgaataaaatttgcccattggaagaagcaccgccaaaaatgcacgaccaagctgatcaagcagtacatgaaccatgcggagacgacgcacgggcagttgagactcagagcgaagagaggagtcggaacgaactctcggcagcaacaaaagaagaagaaaatgaaggaaatgtgagcgaagaaagtgccgaaaagcgaggacgagaagttgaagctgtacagcccgacggaagggtcaatcgagaaattcggaacgacaattctctggggaatggccccgacgatccggacgagaaatgcgacgacgcaacggcgacggagaaaatggcagttttcgaaacagcggcagaagtgccttcggcagcaccaggagaaacgggatttttggcacacccgcattcggctccgagacatgagaaaaaatatttgggagatagttcgacggccccaggtctcctcaatgttcctacaaagtttcagccgaatccgacgagatctgaaggcggagataggtttggtgcagacggacctcaagcagttcagacagccgaaagcggggacgaatttcccgaagcaacagcggtcgaacagcaacaaaacgaattcgaaagaactcccaacaacccagaggaggaagtacacgacgaacaagacacccaaggagttcaagcagtacctgaagttgaacccaggaaatcgaccaggactcggagaaaccgagcagtttggtccccggagcgtcatgtaccacgaaaaagggggcgccggtcccccctggtcgccttggcagtgctgctgacgctgctctgcccagctccatcatgggcgtgtcagcccaccctacgagcagcgccgcaagaaccagcggagccaggaatgtcaactacgatgctgccatgccacatgcagtgcacgaggcgcggtgtgaggacagtcagcggacaactaatggagaagatcgaaatatgctgcccggacggttgctggacgaccataccgacgtcgacagtgatcaactacgaactaccggacgaaatgctcatccacggctactcctgcagcggccaatgctggcgggggttgggccccccggtcaacgtcacacagcgatgcccagcgagggcagagtgcgaattgatcagctgcgccttctgctgggaacagctagccaacccgacgtgcaatccgaggtgggcgtctaccctcttcgggttcggcgcagcactaatgctggcagcgctgggctgctgttgctcaattgcctcacgattctggtcgggagcgacacttttctcccgagcaatcgcatggggagtcagctaccccatcactttcatcaactgggcgacaggacgacacctcccaaggccaacggcgaaccaaatcgagagtaaagtgcggaagggagcgagagtcgcacgtgcagag

SEQ ID NO: 80305 - DNA, 588 bp, Heterodera glycines
  Genomic contig location: Contig_ID=SeqID_15954; Location=13..600; Strand=-
  SCN-specific regions: Sequence locations=1-96,125-450,472-588
atggacgtgccattggccgcaccgccttaccagcggatggcatcactgccaccggtgctgccatccggccattcatcatcagtggcacaaatgccagctggcggcggcggcggtggtggcggcatcagttttggcaccaccattcagcaacagcagcaagtaaatgtgccaaaagtgtgaagaattaaaaccgggtgtaacgggagaactccgcgcgggcgaagacggcacgagttttcaatcaactcattgatcagtaaacgggattttgccccgacaatccctagtaaatatatttttggcccgacaatccctgtactggtctctaaaatcccgaaaccctttccggggtttacccaaaatcccattttccctgatttactgtgtaaaaattgaaaaaaaatcattgattttccaaatattttaccaaactcacagcgcccatatcaactgtaccatcatcatcatcatactgttcagcaacagcatcaaaatgggatgccgatgatttgtggtggtagtggcaacagtgccacaaatggcaacacaattaatgggaatgccaacaatgactatgcggcatttgtg

SEQ ID NO: 80306 - DNA, 701 bp, Heterodera glycines
  Genomic contig location: Contig_ID=SeqID_15954; Location=1106..1806; Strand=+
  SCN-specific regions: Sequence locations=1-236,258-701
atggaccagcagcagtgcgcccttcaactcgccgggcgcacggccgcgcaccgcgtgcccgccgtccgccgttttatgcgcgtcctgcagtccgatcagctcgtgcgcgtcgtaatggacgcggaaatcccagcggcatttcaccgtacaaagaagccaaagcaaaatccagctgaacaggtagaccaggtcggcaaccaggcaccacagcagcaacggacgctcctccttctggcaaacaaaaagggtggcttttatacggaatttggaaaaaaattgggagccctgaaaatttcgaaaaaaattccgggttacctacccgtccttcacccgaggggcaggcaattaattgttatgaaaaatgaatgcaaaattgggtttatccagtttggtgtccatatccaaagccaaaaccggtcatgaggggggaggggagggaggggaggatttttgtgagtctcggaaaatcgggggcataaaaattgaactacgtgcctttgccagaggggtaattaatttttgaattttttcttttccaatctttggtacatttccagaaaattgcctgataaatcaatccgatggcataaaaggcgggtgctttgatggccgcgattgttagcagaaggacaatggccaacacgtggggtgtatatccgtcacagatgatctcacgcccataggaccaaccaatcgaaaaa

SEQ ID NO: 80307 - DNA, 80 bp, Heterodera glycines
  Genomic contig location: Contig_ID=SeqID_15955; Location=737..816; Strand=-
  SCN-specific regions: Sequence locations=1-80
atgaaggacagcttcggccggtgggctgatcgaatgaaagaatgtttcggagacggcacattctcattggcaccttcaat

SEQ ID NO: 80308 - DNA, 1516 bp, Heterodera glycines
  Genomic contig location: Contig_ID=SeqID_15957; Location=48..1563; Strand=-
  SCN-specific regions: Sequence locations=1-225,265-297,319-393,416 -429,452-452,666-742,768-797,819-1164,1186-1516
atgccggacggcactcgtgtgaccgtcaatgctggcaatgatgagaattggctgggcgaggtgaagaatggccaagcggaagtgtgtggccaaatggcacgcttcagcgacctgcgctttgtcggcaaaagtggtcgcggcaaaaatttcaatttgaccatcactctgcacacgcatccgttggcacaggcaaaaaaaatcaaacatttttacggaaaatcgaaaattaaaattatatataccccctcaccctcaccctgttcaggtcgctattgtgccaaatgccgtcaaagtgaccgtggatggacccagagactcgcgcaatgcctcggttaaataccatttaaacggtgcggtgtttatttaatttcttcgataccgtcgagaatctcgaaaaataattgatatttttgaatttattttcacggaaaattttattttctatgtacaagaaattttaaaaaatatatttaaatataaaagcctttgaataattttagataatttaatttttagaaatcttttaaaataaaaaattaatttgcagaaatattttaaataatttttaaatgctttgaataattaaaataaatttttaaaaaatagtttaaaaataataatgttaataaccttttaaataaaaaatcgaaaattttaaattttaaggccaacatgtgccgcgaaaattgcgttccaatttggaattggatgccatgatgggacagctgaagaaggccgcccaacaacagcagcaagtccagcaccggaatggcatcttcaaatccgcgccgccaccgccacactttgtgcatccaaattttttcttgaccgcggcacgccaaccgcagttactgagatgtccgccgacaatgttgcagcaacaaaatggcaccggacaaccgccatcatctcagtcccatttctccccgctgtcagtggccgtgccgtccttgccaatgatgccgttcatgatgcccgctgctgcatcgctgcattcatttgcactgttgaacggcaacaacatgatgagcaatcgaagtacggtaacatcgcagacatacgtttaattaccgtaatatttggcttacagtatgtgaaaataatcattgcattgccataacgagtggaatgcttattattttctgtatagagttattagggctgcaaatatgccataaattttaacttgacagcaaaactctttttttaagcagcctttcgacagccgacctgtgcatttggcaacaacagcttgcttgacgcaaaactcgccgacgctggcatgacgcctccggcaactaccgtaactccggcggtatcgtcggcaccacgcccccagcagggcttcatcgccgccagcccaccattacgacactgcgcaactccgtccgcgttccgcgcactgtccatttttccggacccaaaaatgatggcatcggcagctggccctatttcacggctgcgccccggccgcggtgcctgcgtgcgcttctgccgccgccgacaatggccagtg

SEQ ID NO: 80309 - DNA, 2162 bp, Heterodera glycines
  Genomic contig location: Contig_ID=SeqID_2544; Location=1501..3662; Strand=+
  SCN-specific regions: Sequence locations=22-91,117-159,183-1206,1228 -1239,1261-1371,1394-1443,1465-1630,1731-1842,1871-2006,2030 -2048,2070-2101,2131-2162
atgaaggcgcgccccttccccatcggcacaccgcacgtgtggaccggagagcagctgtggcaggcgggcgcccatgcgtttgaaggtatttgtagctgctgctgctgctttggtccatattggaaaacagcattttcagcttctgctccacctccagcagggctttgtcctcctcctgctctgccatggcgccgcccggaggacaacccgttccgcggcttcctcttctgccgcgtgctgccgccaacagcggaggagctgggcgatcgcgagccgctgctgccctaccgcacccaggcggatggacgtctcatcttcggcctgtgcgcgcgttgcgccgagctgcgccagcaacgaatctgtcatcacacggagcgtgagcgtgcgtggaccgctgcctacacgcacgtggagctaaatcgcgcgctgtccatcggctaccgtgtgctgagcgtccatgaggtgtggcactacgagcgctgggcgtcaccggacaacggcaacgggctgttcaccgaatacgtgaacaccttcctgcggctgaaggcggaggcgagcggctggccggccggctgtgacaccgaagcggcacgcgcggagcacatccgccaatttgcggagcaggagggcatccatctccggcccgacaacattgggcacaacccaggtctgcgtcagttggccaaggatttgctgaactccctgtggggcaaaatggcggagcgtccggagcgcgacgaggtggtgtacaccaacagcgcacgcgacttccacgagctgctcatgcgtccggagcaggaggtggtcagcttcacccacctcaacgaccagctggaccgctgtgtggtgcgcaagcgggagccgttcgcacgggcgccggagcacaacaacttggccgtcgcatgttttgtgacgtcccatgcccggctgtacctgtacgactggttggaggaggtccgacgggtgggcggtcgatctctgtactgcgacacggacagtgtgctgtacgtgaagcagcgtggcgctgaaggtgtgcgcgagggcaacgcgttgggtgacatgaagcgggagctgcccggccgtcgcatcatcgacttcttcgccgccggcccaaagaactatgggttccaacacgtggacgcgtgcacgggcggcgacctgaaggcggagcgcaaggtgcgctcttttgagctcaactatgcggcggaccagcagctgcagtatgagcgcatgcggcagctggtcatcaaccactttggcgtcgggtaaataatatgacaccactcccctgttgggtcgaggggggggggggggcactgaggcactctgaacacacacacacacacacattttttgatgattttcaggcagcaccatcaacaacaacaacaaaggggtcccgcggctgatgctgctgacggaagcgatggccaggaggagcgcaccatctctgtgccatgccagcggtttgtgcgcaaccgccaggcggacatcttcacgcgtcgctccacccgcgtgtaccggcccgtgtacacaaaggggcgcgtgcttcggcggggtgcagcagagtgtgttggtgagtcacaaaagaaaacagaataaccaaaagggagaatagcaactagattaccacacacacacacacacacacacacacacacacacacacacacacacacacacacacacacacacacacacacacacacacacacacacacacacacacagcaacaacaatttcaatttttcagatgaagtgccgccgcaatccatacgcactcgcccatttggatggagctgttgtgccggtgacgtggaatcacccgacagctcagtgatgaacgaggaggaagaggaggaagagcccatgcaaatggctcccgatgaagctgaccagggggaggaagaccgatggggggagcatgtttggccggaagaaattgctgatgataatgatgagccagggcctgaacggaagcgtgcaagggtggaacagtgcgtggcaccgccgccgccctccccaccaccgtcgccgcttcgcgagccgcatgcggagccggagccggtggccggctgctccacatgggatcagatcacacggcacacaaaacatatttgtagaaataatttttaattttccgccatttaaaatatgcaca

SEQ ID NO: 80310 - DNA, 322 bp, Heterodera glycines
  Genomic contig location: Contig_ID=SeqID_2545; Location=115..436; Strand=+
  SCN-specific regions: Sequence locations=1-2,31-166,190-208,230 -261,291-322
atgaacgaggaggaagaggaggaagagcccatgcaaatggctcccgatgaagctgaccagggggaggaagaccgatggggggagcatgtttggccggaagaaattgctgatgataatgatgagccagggcctgaacggaagcgtgcaagggtggaacagtgcgtggcaccgccgccgccctccccaccaccgtcgccgcttcgcgagccgcatgcggagccggagccggtggccggctgctccacatgggatcagaccacacggcacacaaaacatatttgtagaaataatttttaattttccgccatttaaaatattcaca

SEQ ID NO: 80311 - DNA, 1369 bp, Heterodera glycines
  Genomic contig location: Contig_ID=SeqID_2545; Location=1380..2748; Strand=-
  SCN-specific regions: Sequence locations=1-323,361-378,403-463,495 -589,627-678,738-1295,1334-1369
  Gene Ontology: Mol. function=phosphopantothenoylcysteine decarboxylase activity; Cellular component=smooth endoplasmic reticulum; Biological process=G1/S transition of mitotic cell cycle
atggacatgttccggttcaacgttcataacgctgtcaaagacaccgacgacgccgccgccgactctgctgcacacgatcaatgtcaacaacgccaacagcgcgaggttgcgtctcctcgcacaatgccgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctattcagtgagattgaaccgacgcagcagcagcagcagcagcagcagaaacaacaacaggtttgctctaaattggtgtcggttatttaattttttatcaagaagattcaggggcgtacagcggaaatcatcgcaccgaaagtggagctgtccgccgaggacaatggtgatgatgatgatgatgatgatgatgaggctggacaacaggtcaaacaggaggcggacaggaacggcatggatgcacatcattcaaattgtgcaaaagggccccttttgttcattgatgaacaggagaatgaggaggaggagagtgaggaagatgaggacatttcaacaacgcatcgaaggcaaggcatggactcatcatttgactacgaagacgacgacgatgatgatgacaatgacaatgacgatgatgatgatgatgatgatgatgaaatggaatcagtcagcggatgtgcggaatcggacaaatgtggtcactgtcaccacccgcatcagctaccacgaaatgctttggaggtgctcaaaatgccactcattgactacctgtgtgcgctgaaccatggatgcagcgtgggagagctgcaggccttgttcctgtccaagggcgcacgtggtcgcatgctcacccatctgcagaagcgctgccttctgcgcactgtccatttgcgccccaccgagcgcaacatcacactgcacgcgcacaattttagtgcacggagcgccagtctgacctttgcctgcggtggttatctgaacctaacggtgagtcagccacccatttgaccaagaaacaatggataattaaattataatgatgtccgtccatcttcggcttcaggtgcgtcagtattttttcgccaaacatggcgttcggcttcgccatccgagtcttcccactctggtggaatttggaggtggaatgcatgcttcttactacccgcttgagtgcatccaggtgcacgtcgcggtgactgcaccggaggacgctgccagcaccacctccaccaccactaccaccaccaccaccgcatcatcgactgcgtgtgtccgcctcacaaactaa

SEQ ID NO: 80312 - DNA, 798 bp, Heterodera glycines
  Genomic contig location: Contig_ID=SeqID_2545; Location=2928..3725; Strand=+
  SCN-specific regions: Sequence locations=1-39,66-798
atgaagcagcagcagcagcagacaaaagagcaacctctccgccatcaacaagtgccccctgttttcaagcatccgttcacaatgtgtgtgtccgggtgtacgggcagtggcaaaacgaaatgggtattgcgaatgttggccaacctggacaccctggtcggccccgcacacatttcgggtgtgctctactgttatggggaagtgaatgaagacgtgcttcgattacagcaattggaaactgagtcgggggatgaggaggagaacatggggggtcaaccgcggcgacgctgggtccgcccctgccacgcgcttcccgatgaggaggcggtgaagcgggcagccaaagcgtgcggtggcagactgctactggtgttggatgacctgatggtcggcatgcgtgccccgttccttgacctgctgttcacccgtggctcgcacaattggggcgtcagcgttgtgttgatcacacagcatctgttcacgcgagagctgcgcatcgcgcgcaacaacgcgcactatttggtgttgctgaggaacccggcaggggcgctacaggttcgcacactgggcatacagctgttcccgggcccgggtgcactgcaccattttctggaggcctatgatgacgcaacagcggacccgtttggctatctgttgatagacatgcaccccaccacacggcctctgatgcgtctcaaaacgcatatataccccgggcagctgaccgtggtgtacgcaccacgtgtatcagcagcaacggtagcaacgacaagcatgttcaatgcggaagaacactag

SEQ ID NO: 80313 - DNA, 1048 bp, Heterodera glycines
  Genomic contig location: Contig_ID=SeqID_2545; Location=4271..5318; Strand=+
  SCN-specific regions: Sequence locations=1-69,91-100,122-364,387 -393,416-612,652-882,904-950,972-1022,1047-1048
atgaagcacacaacccgaatgttgttggtgccggaagagatgtaccgctccctgttgtcaaaggcgccaggtgctgctgctaccgatgctttggatattacacccaccaccaccacaacaccgattgaacacgttgccaaacgcatggcgcgcgtggcgcgcactgcacagcagacagcaacgcgtgcattgatgaacgacgatgaacgcctgatccactaccagcaggagtacaaacggttcaaaaagctgttggcagatgagcaggaacgaccggcacctgtccgcctcaatcagctgccgaatgatccggcctcaaaaggggtgttgcgtgatgcgctgacggaggccgccaaaacattgcaacaacaactaccgcagcaactgcaacattcacctccctccttgacaaagcgtcgcaggcgtacaacagcggtggtccctgcccgggctggtgttcattcgacgccgccagtatccccacagccccctgcagcagccgcagcacctcaacatccagagcggcggcaagacaaagacaaatccggcattactggacaaaaagggaaaaggaaacgaaccaccaccgcctcatcgtatacgtcagccgcttctggagcagaaaaagaagaagaacaacaacaacagccagcagctgcatctacatcatcatcaacaggcgccgtcgttgttgccggagctcagcgcctgggtgaggcggagcagcgacgaaaacagcaggcccttgactacacgtcacgtcacgcgggcacgctgggcatcggtgatggtcagcaggtgtacaagttcatgcatggtgcataccgcccgatcaaaaacagcagtttgcaagccgtactcgcctatcattttacatctgcccaacaaccacaacaacaacaccatcggctcaagcccccgcccggctaccaaacgttcatcgctaacgctaaacagcatccacagctgtcacacctgctattccccacctccagcactagcagcatcagcggtgaaggacatggtggtggtggtggtggtggtggac

SEQ ID NO: 80314 - DNA, 468 bp, Heterodera glycines
  Genomic contig location: Contig_ID=SeqID_15960; Location=466..933; Strand=+
  SCN-specific regions: Sequence locations=1-21,46-127,161-170,200 -266,289-438,461-468
atgaaaaaaagtttttatgagcagaaaaagaaagaatttattgaacgatttgatgaatttaaaagtttatatagccaaggcaaacagaatgaatttgtgaaggaattgggaatttctgaatttacatttgtaaaatggaaaaaagaattgattccaaattaccacaaaagtaaaattatgattaattaaattaaattatgaatttcgtttaagagcataataccaatgaggacaaattgaaaaagatgaagcaatattttgaaattaaagaaagaaatccaaaaatgagcgacgaaatagtcgctaagaaattgggaatttcacaagacacgctgagaatatggaaaaagaaatttgcttccacttgatcaccgattttaatttagtaaaaatgattttcgatgaaaaaaaaagttttgattttgaagagagattttaaaattttttgacgaaaatgttttcatgcaa

SEQ ID NO: 80315 - DNA, 588 bp, Heterodera glycines
  Genomic contig location: Contig_ID=SeqID_15961; Location=1520..2107; Strand=+
  SCN-specific regions: Sequence locations=1-588
atggccagaccaagaggcggtggaagaaacccagcaaaagcacgcggtgccagggcaaagcgtcgcatcggcaacaaaagaaaagcggccgcagggactgctgcaaacgtgggttttattctgctgctgttctatgcaatacatccatcatttttttctgtttcattttttggcactcagagtgaaagccgaaatttcatcattgcttcattttgtaatgaattttgcctcccttttcaggttcaagctgccgacaggcgccccatttgtccgatctgcttgaagaagatgaccggagtccgtcaggtgcgcaccatctgtgaccacgtgttccactacgtctgcttccaccgttggctcaaatatcgcctgttttgtcccgtctgtgagcgcaactttcgcacggaattgtatcatgcgggaaacgccgtggttgagggagcgtacgccgacggacacgttgtgctccgaactgatggtgaacagagcaacagtggctaattgatcattgatcggcactcacctccaattgtgatcggacaaaaatgatattaattgtatatgtacatatatatcaacactcggaca

SEQ ID NO: 80316 - DNA, 88 bp, Heterodera glycines
  Genomic contig location: Contig_ID=SeqID_15961; Location=298..385; Strand=-
  SCN-specific regions: Sequence locations=1-88
atgccaacgccaagccgtgcccgggtgtatgccgatgtaaatgtaaacaaaccgcgtgaatactgggactacgagtgccatcagattc

SEQ ID NO: 80317 - DNA, 254 bp, Heterodera glycines
  misc_feature (216)..(216): n is a, c, g, or t
  Genomic contig location: Contig_ID=SeqID_15961; Location=2743..2996; Strand=+
  SCN-specific regions: Sequence locations=1-199,223-254
atgtcagccgacaaaagtgacgagctgtgccaaactgttgcagaaatacgacagggaatcgatagaaaaggtaaaaattatcgactaattaatgagcataattaaaacatttgacacaataattaatccattcaggacgctgcttgtttaattcaatgcgcagaagtgttagggccggaaagaaaagatgaattttgagaaaaaaattaatattanattattggaagaaattattttataacaaattatgaaaa

SEQ ID NO: 80318 - DNA, 1425 bp, Heterodera glycines
  Genomic contig location: Contig_ID=SeqID_15963; Location=850..2274; Strand=+
  SCN-specific regions: Sequence locations=1-110,133-1024,1046-1425
atgaccaccattcggtgcagccgtgtgcaccggacaaactgcccgaatactccagcaacattgtgagttgttttacacgtaaaactttttctttgtcaaaatgtctagaatttcacaatttttaaaattttgctatgggaaggctcctgaaaaaaacaggagaattcaaaattggcgatattttttttttgtttcattaaatttttgtgtcaacaaataaatggttataatcaaaccattgaactattgcgcgcagattggttggcatgtcttgggaaaattttgaatttttacaaactttttataaaattgctcaaaattttcacaatttttcatttttcccattttccaagggccatgactcctaccgcgccttccgttccgcttacgtcaattcggaggtgcgttttgaaaccaactcgtgggaacagctgaaccggcagtgtccacaaattttgctgtacgccaacacgttcaaatgcctggactttctgatgcgcactctgatgactgtcaatcggccggttaagcggggcccactgttcaaaagtacgcaggccaaacgctatcagctgagcagacacttcaggttgacaaaaagcgtagaaaaaactcaggggttggatttaagcaaaaatttaaatttccggtactccgaaaaaataagcggatgcgccgccaactttcaatttaattttttttttctaaatttacaaccgggcatttttcatttgtaaattttgacttgactaacggttcgaaccctgtttaaaaaaatgttttataataatatggacaaccaggcctgggctgcgggaattacctccctccaaaaagactcttatttattatattcaatacttttttttcaggaatgtccaattgatggcgtcgatgccccgctttctgatctcttattggatgtcattttcctcttcccatggatttcgtgtgatcagcgactcgttgcaatttgcttgcgattttttgctgcaaattcatcctgatcagtcaaatgtttggcacagggaggggggaagaaaaaccaaaattttataaatgtttaaattttaggacggcctcatccgcagggtcaggacagcgtggaaaattctgcacacatcggccgagttggacaatgcccaaattcatctgtacggggaccagcgaccgccgggcgtggaggaggacctgatgaacagctccacctcgacggacagcgcgaattcgtcctttttcgtcggactgtcccgcctcatctacatccgaaagttgcagaacgagatggtcagtgagtgtgcgtacaatgacaaaaatccttcccccaacggtcggtcccagggatttgtttcaaaaaaagttcggaaacccgattgctttttgaaattgtaagctaatagagaacacataaggctgtcgatgcta

SEQ ID NO: 80319 - DNA, 818 bp, Heterodera glycines; identical to SEQ ID NO: 15964
  Genomic contig location: Contig_ID=SeqID_15964; Location=1..818; Strand=+
  SCN-specific regions: Sequence locations=1-129,151-204,226-818

SEQ ID NO: 80320 - DNA, 833 bp, Heterodera glycines
  Genomic contig location: Contig_ID=SeqID_15965; Location=1253..2085; Strand=-
  SCN-specific regions: Sequence locations=1-207,313-496,520-538,561-833
atgaacggagtctgtcgctgccaattgtcaattctgtgccgacaaataatggagcagtgattgggaaagaggaggacagtggcaaaggcggcggagcagtatcagcacaaccagaagaagaacagccgaagaagcagcagcaaaatttgacacattcgccaacacctcaaattcggacaaaggcacaaagccaaaacaacaacaaagaacagaatcaacagagacagcactaccaccagcagcagcaaaagcaacgagttcaggcagtaccagcaacacaaccgcagagccaagcagcagtgacagcagcagacggtgccgactcgggcattggctccgactcgcccaggacacacacccaacctctgagtcaacacgaaataatgccagaaatgacgtcaacgtctgttcaacaagcggacgacattaaggaacggcattcctttgaaaacggacgggacacggacgaagtgcgaattgaaagacaattcgaattgtgaaagaaaaattccaattttattcaggtgccaacgttaaatcggaaaatgtcaccaccgccggtgccaccgaaaagtcgcagaaattcgtcaatggatttggatgaaatggagcccaatgacccgatgcgaagtgcctatgaagattcaaccatcggccgtgatcattccgttcttccgccgggtgcccggccgacgttcggccggaagtattctgcccaagggacggacagaatgccggagggatcgtcgagcgatgagaaaggggcgacggaagggacgacgcggaaagtgtgtccgatggtacagcccgaattggtggccatgggaaggtga

SEQ ID NO: 80321 - DNA, 1481 bp, Heterodera glycines
  Genomic contig location: Contig_ID=SeqID_15966; Location=1854..3334; Strand=+
  SCN-specific regions: Sequence locations=1-661,683-1100,1122 -1321,1363-1481
atgcatgttgggcagcagcggctgccgctgagagacttgccacaattcgaggaccatccgcaaaatgtgccggtaattttgggtcgatttttgctgcgttttctcaaatttctgcgtgctttttttcaggctgttcgggtccaaccgatgcaacaaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgtttttttttgttgcttttttaattcccgaatgcttttttcaggccgttcgtgtccaaccagttcaacaaccgataccactgagagacgtgccactatttgtcaacccgccaccaaatgtgccggtaattttggctcgcttttgttacttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacgtgccgtatcatccaccagaaaacgttccggtagttgggtcttggttttcatgcgttttctcatattttcggatgcttattcaggcaatccaaccacggcaacgaccgcgccagctgagagacgtgccactattcgaccacccactgccaaacggacagggtaatttcagaccctggcttctacctaacaccgaaacatcttttcttaagcaaatacatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaattccgtcacctaaattgtttcaaaattattaaaattttaagaaattagatgctaaacctaacctttgacatagattatgaaacaatgaaaagaaatgacgaaatttttgctttcatgtcttttgaaaacaaaaaaaattcaaaaaagggggaggggggtaccatcgacagtattaccgtaatttttatatggaaatcggataaaaataatgacaacactcgaaatgagcacaaaaaatatgaagtgaacgaaaagtggtgaaaagtgttctgttatttgtcgcggaaaacaatcttttggcaaccatttttgagtcacacgtccgaaaaaagggagagatgtgtacaa

SEQ ID NO: 80322 - DNA, 610 bp, Heterodera glycines
  Genomic contig location: Contig_ID=SeqID_15967; Location=867..1476; Strand=-
  SCN-specific regions: Sequence locations=1-129,165-524,573-610
atgaatggaacaattacggtgggggtcggtttagtctggcgttttagtctgaggcgatgttttagtcagggggaaggtttagtctggtaagctgtttttgtgcgacatggattctaatctgttttttcgaaaaatattaaaatttaatattaaaacatatttaacaatgtatttccaacaaaaaacaaaacattgaaaaatgattacaggcgcattttataatttcgagataatgtaccaacgagaaaatcgatgatgctatcgggattaacattgacattggcttgataattgtgatcattttgtttagccgggttactgttattgatggcattgtaaccccgcaagagtcgaagaattcgcgcacaggcggcatcgccagcctgaagtccaacgatatggtttcaggtgaaaaacccggccttcttttgacaatcagctgaagcatacgtgttcatcgctgcacactttttagtgtgaaggcagtacgtaatcgaaaactccaattaattcgcctaaaacacaaaaaaaatatgaaataattaaaaaaataagtttatatgataaatatacattgtcttaaccaaataagaattttttgacaaataaa

SEQ ID NO: 80323 - DNA, 1819 bp, Heterodera glycines
  Genomic contig location: Contig_ID=SeqID_15969; Location=338..2156; Strand=-
  SCN-specific regions: Sequence locations=1-478,500-626,648-912,934 -1260,1282-1476,1499-1608,1631-1651,1687-1707,1729-1819
ggaattcacgattgtgacaaccgactataacaaagtattgaaaatcgcggacattggcaatgcttcttcttccaatccgttgaatgaggagccattggcacaaattgtccgttggcattgggaccaaaacggggcaccgaaaatcattgaagtaagcaattttttttttgtgcggaaatcactccctgaagagttgaagacccaggactaaaatggctttggcacttaaccttccaaatggtaaaaacgcataaattgccagaaaattacatatgaatcattcctctcggcttgtaaaaacgaatccgaaagttttggacaaaaaataaattgaaaaaacttatgggtcctccctcataacttccgaaaatgcgcggagggttgcgagcggcgccccacctactggtcgccgtagttgagtgtgcgctagtttttagcgcagtaggcaaaattcaaattttcaaaattttatgcttttaccattttttcaaccaaaaactctaaaaaacgttaaggtttttgaggacccataacttttttcacgttctttacaagccgagagcaattgattgatatgtatttttctggcaatttatgcgttttaccatttatagttatggggcgcattttccccaaaaatcttttttgaaatatttatttttttgaatgatagcggcaaaatgcgtactgataccaacaattaagggttagtcccaagagatgttgcaggctttgcttaagagaaccagaaatttaaacaaatgcgatctactaaaattaacaacaaactttgttttagacaaaaacattgaacaagggcagtgaagttaattttgccatttttgacgatacttcatcatttgtaattcgaattctcaaaaagcgggagaaaaagtcggaggagaaacggtaatatactaataataatagtaaaattccgattttaccaatagaaatacttaaccaaagcattttcgggagccgagttaagtccccgtcctcccgactattaattaattaatgtaccatttttttaaaattacttttccatttttaagtgcgttcccggcgccttccgacagctcacccgacgacgatttgaccgtgaaaattggtgaaaaacaggttaagaagctaactgtggggggggggcttgactttagaagcaggcataaatgggcaaggggagggtcagaaatttgcctttatgaaatgaaatacccctcaacccgctctatcagagcaaaaatattatgaaattgaaaaaatgccccaaatttctatgacaaccttttcttcaaaaaaagttttttttttgtttcgattttctttgcccttccaaaaataagtcctggtcagataattgataaaatgattttgatcagatcactaataatattgataagatcggtgattttgatcaggtcgctgtgtccgcccattggctgatgaccgtttccccggtgatcagtcgcatgatgaaggagaagcagcagcgaatgatcactttggacgagttgggcgtcgacatggaccaattcattgcctttttagagtccatcttttatatgacaaagatcggaccttttctgcccaaccgtaatcctctgaaaaataattatcctctttttatggattaataggggataaattttcaaaaatatgaaattttaatttttggtgaacggattcccaatttgtagcaacaaatgtgctggcgctgctcaaattggctgactacttccaggtgggtgccctcacttagcaccttattttaaattattatgattcatattcatttttgcttaagggtaataaa

SEQ ID NO: 80324 - DNA, 794 bp, Heterodera glycines
  misc_feature (783)..(783): n is a, c, g, or t
  Genomic contig location: Contig_ID=SeqID_15971; Location=5..798; Strand=-
  SCN-specific regions: Sequence locations=1-124,166-582,607-794
atgctcggcgagttggagctgctgctaaccccagcggcggcggtgggcgaggaagacatggcacaacagcgcaacaacaacagtgggcacaacaaccaagtgaggaaatggggttaattaatggaaaaataaaaaacttaaaaaaatgttaataaataaattattcattgctcttttcaggcgcgcatttcgcgagtcagcggtgccattggtggtggtggcacggcacacactgacagtgccacttttgcaatggcacaacggaatgtgaggaggggcaggggggttaatttccagcaaatttgagggttgaattttgtaaaaattcttatttttttttgatttttttttacaggcaccgcacatgtcggatggccgtggtggtgttgctgtggatggacgcgcatcacgggtggacaatttggccggcatttctgtggcccaaccgccgacaattgctgctggaaacaatgtcagttgtggttttttttggggggggggagtttgatggctattttaaaaaaatgaaaaacaggccaacaacaacaaccacaatggcgccgttttgcagcgctcattcggcggcagcggtgacggcagcggcggtgcttttggctcggcttttggagctgtttcgggtgtgccggtgtggagtgtgagcagtgtgagcggggcttatgagtggggggggggagggggggggagaagcgaaaaaaaaggcttctttgggctgtttccggttttaatgctttttcaaaaaaaatgctttcaattttcagcgcnggtgtcaatga

SEQ ID NO: 80325 - DNA, 430 bp, Heterodera glycines
  Genomic contig location: Contig_ID=SeqID_15972; Location=487..916; Strand=-
  SCN-specific regions: Sequence locations=1-430
atggccacgcgaaaacggccacgcgaaaacggccacgcgaaaacggccacgcgaaaacggccacgcgaaaacggccacgcgaaaatggccacgcgaaaacggccacgcgaaaacggccacgcgaaaatggcaacgcgaaaatggccacgcgaaaatggcaacgcgaaaatggccacgcgaaaacggccacgcgaaaacggccacgcgaaaatggccacgcgaaaatggcaacgcgaaaatggccacgcgaaaacggccacgcgaaaacggccacgcgaaaatggccacgcgagaacggccacgcgaaaacggccacgcgaaaatggcaacgcgaaaatggccacgcgaaaatggcaacgcgaaaatggccacgcgaaaatggcaacgctaaaatggccacgcgaaaacggccacgcgattggggggaggg

SEQ ID NO: 80326 - DNA, 193 bp, Heterodera glycines
  Genomic contig location: Contig_ID=SeqID_15972; Location=1061..1253; Strand=+
  SCN-specific regions: Sequence locations=1-193
tttataattaagtgagtttataaactaaattaaggttctttcaattatataatatggaccagcagcaaaaaattaaaacaaaaagaaacaaagttaagttagaacatgacggcgcactctatgttttcgaacaattgagcgcagattgacttaagatattttggcgatgtgagtttcatggcccgtcagacaa

SEQ ID NO: 80327 - DNA, 2249 bp, Heterodera glycines
  Genomic contig location: Contig_ID=SeqID_262; Location=102..2350; Strand=+
  SCN-specific regions: Sequence locations=1-63,86-143,165-493,515 -784,806-1008,1030-1121,1143-1267,1290-1403,1492-1633,1655-1683,1710 -1787,1811-1854,1877-1889,1912-2050,2073-2218,2246-2249
atgatttttgcttgtgatgaagtgacaaatttagtcgctggaacaaatgactgtgcagtaactcaagaaggaaaaattgaatgttcttatgaccaaacaacccaactctctattacacctgaacacttaacctgcttaaaactcgacaatacaaaaactaacaccactatggaaacactacaaattacaatagaaactttaacaataatttgcaccgaaaaatctgattattttacgagaggttacgaattatcttcgacatcacaaaaaagatgctcaggcgctgggaaatgtaccggccaaacttgtcaatcagtaaaaatgtcagaccggaatcccgaagtgaatgatcacgctaataatcaaccaggctattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaggcgacaattaaattgtctatcaatccagaattaacctattctgttgacttgaaacccggaattttaacacacattggtgacgagtctaatagttctatatctgtcacactgacttcgacttcaattccaccgacgccgttatttggttcgacatttattatagttcgcgaagaattaaaagcagcaatagttgcgaacggaaatttactcaaaaatatattacggtgtaaaaacaaagaagaagcgcaaagttttagttgcacttttccaccagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacatgtcccgatggtaagactgaaattattttgaaagctaatctggaatacatacaccaacaagatacaaaaatcattcccactaacaatactaatgaaaaccccactattggaatttcatttgaccaagtaactgatatattaaattttatctattcccttattaaagccaattttttcaatatatttattattatcatattcatactcattatgattttcctaattccatgtctactacctattctatatagaattatgtgtcgttgccttcctctttcgcgcgggagtgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattataaaaaactatcgaaaatataattacataaaaatgaaaaaaaccttttgaaatgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaatgagaaattgtagcgtactttggtgcaaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctgctcgagtgccctccctttcctttgccattgtgtggccccttttggaccagccgttgcccgaatgcccttccttttcccatcgccgtttcgccgttctgaccccttttgattttgccacattttccatttgtgatttatttactgtcaccgtttttgtgcccccttttccccgttcacattatcatgtttgtcccccatttttcgtttccctcaccgtcccgattgggacggtttaattacccaagtttgaggtcgacaca

SEQ ID NO: 80328 - DNA, 182 bp, Heterodera glycines
  Genomic contig location: Contig_ID=SeqID_262; Location=1885..2066; Strand=-
  SCN-specific regions: Sequence locations=1-54,77-89,112-155,179-182
gcacagacagagagcagcgaaggccgggtgcagtgaaaggcggtgggcgggtgccgggaaacttcggagggaaccgtttgtctcgaatctgaaatttccggaaaagtccacccctttaaatacgattttttttgcaccaaagtacgctacaatttctcattttaattaaaatatgtttttgt

SEQ ID NO: 80329 - DNA, 217 bp, Heterodera glycines
  Genomic contig location: Contig_ID=SeqID_262; Location=2331..2547; Strand=-
  SCN-specific regions: Sequence locations=1-217
tgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggtgttcgtccaggcaaatagaccaagttgggcacaattttaataagagtatgtttattgtgtcgacctcaaacttgg

SEQ ID NO: 80330 - DNA, 566 bp, Heterodera glycines
  Genomic contig location: Contig_ID=SeqID_263; Location=100..665; Strand=-
  SCN-specific regions: Sequence locations=1-74,96-443,471-566
atgacgagcagttgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaattcttgtcgtggcgacaagaaatttgcgtcgaactctgcggggtgaaggggacgtgaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaa

SEQ ID NO: 80331 - DNA, 6659 bp, Heterodera glycines
  Genomic contig location: Contig_ID=SeqID_263; Location=1478..8136; Strand=+
  SCN-specific regions: Sequence locations=1-213,250-805,827-997,1020 -1255,1277-1478,1512-1907,1929-2180,2213-2711,2733-2880,2902 -2938,2960-3110,3134-3736,3759-3832,3854-3957,3985-4073,4095 -4439,4474-4693,4729-5425,...
  SCN-specific regions: Sequence locations=...5447-5570,5592-5868,5890 -6325,6347-6354,6377-6409,6432-6659
atgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagcaaaatcatcttcagactcagacccggaagatgaatcaaatgattatgaacatgaaaatgaagacgaagtagaagaacaagaagaagaaaaggaatatgaaagtgacaatgaagacgaatcgccagaactttctttgaatgaccaaatacaccatgatcgtataccatttgtcaattaccgatcaagaataaagcttccaccccaaacgcttacgcattttaatggcaaattctcccaatggcccagtttctgggatgatttcaaatcctcagtggacaatgacccaaatttagaaaatatacaaaaactcaaataccttcgagggctcttacatgatgaaccgtacagaatagtgtcaccgtatcctcttacgaataaaaattacactatcgtaataaaattactaaaatcaaggtacggaaacccccaattaatcagagaaaatcttcatagcgaattacgcaacctcaaaagacccactgaatccacaattgattaagacgatttattttgttaattgaccgaatcattttacaaatgaaatcccaaggggaagacataaatcaccctcaaatcaaacaatcaatcgaaacgaaactcccctataacattagacttaaattgaaggaaaaattcaaaatctattcaacaaaagaaataatggaatttttgaatgatcatacccaagcacgtgaagacatagaaagaatggaagaatcgaatcgccaaatccggaatttcccctctaatagaccaccccaaaacggagtacagagacaattctatccaaatttcccacacaatcaaatgaaaccaaacccatggaatcaacagaacacatcttcctctccttttccatatacttctgcatttacaacgaattcaaacccagtacgcctggcacagtttaaatcaaatccaacacaaactagaacacaaaataaaatattttgtcgcttttgcgaaagagaaaaccatgcaagtaaagaatgcaaaatttattcaactcccgaaaaacgaaatgaacgtgtacgtgaactcaaactttgcctaaattgtctaaacaagggacatatggtcaatgattgcaaatccacttatttatgttttaattgtaaatacaaacataatactctcctctgcacccgtaaacaaactcagtacaaaacgaaggaacaaaaaaccagagtgaatatggctcaaaattacgaaaatcgtgaagagacacagacattcatgactatggattatgataaaaatttatataattatgaggaagaagaattacttatgactactgaagtcaatgttatcaatccagacaagcctaaaataaaaaaggaaataattttatttgataatgggtcacaaaaaagttatataaccgaagaatgtgctcaaactcttcaattaagcacaattgaggaaaaattattagcaatttccactttcaatcaaaataagccaaaaatcattaaatcaagactagtcaaagttggcattaaaacactaaaaggtgaaatagagtacttaacactacaaacagtggagaaaattactgatgttacaaaaatggttaataaagaaacagttgatgtattgggagtaaaaattccaatcagtcatgcacgtcctcaaattctaattggaatcgaccattattggcacttcatgttaccaaattcacaaattcaactacttccatcaggattttactcaataaatacaaaattaggaaaaatattatcaggaaaaggaaatattgaggacacaaattgtaattcagtgacagaaaaaagaaaaagggatgaaacgaaccaaatacttcagaaattttgggaattagaaaacattggaattatcgactcaccacatatgacggatgaagatacagcaatgatacactttgataaaaatgttacatttaaaaataacatataccatgttcgatggccttataaaagagagaacccaaatttaccaacaaattttggattatgtttgggaagactaagaaatgtagtcaaacaactaattaaaaacaaaaatttggaaaattacgacaaaatattacaagagcaaatggatactgacgtaaatgaaattgcggaattaaaatcaaataatttgcttcattatcttccacatcatccggtaataaaagagagctcaaatacaaccaaaatacgaccagtttttgatgcgtccgcaaaacttaaaggaaataattcactaaatgatgaaattcaccaaggaccaaaattactaccagatttgtgtggaatgattctccgatttagactcaaaaattacgtattaattggtgacttggaaaaagcatttttacgagttggattaaatgaattagacagagacacaacacgatttttatgggtaaacaaatcgtacttgaatgaaataaaacaaaaatatcgagaaattgaaatgagagacatcgaattgagacgattcacccggataccattcggagttaacgcttcaccatttttattaactgctgtagtcaatctccatctctcaaaaatagatgagatgtttgaaaaattcaagacacttaaagttaacggagaattatgcctaaatgataaagaagaagaatttaaaaatctttgtatagaacttaaacaaaatgcatatgttgataatttcgtaatgatgtgcgacaatgaaaaggaaataaaattcaaacattattggagtaaacagatatttaaactagcatcaatgaatctgagagaatttatctctaatcatgaacaaagtaataaagaaattcaaaagctggaaggatcagagataccaaaagtaacaaaaatgttgggtataaaatggaatgttgactctgatgaacttgatcttcaaataaaaattccactaatgagtaaagacacaacaaaaagacaaattttgacgatgattgccaaaaatttcgatcccatgggatggatttcaccagtaatactgaaatataaactatttttccaaaaactatggcgatcaaacaaagattgggacgataaattagatgatcaagaaattattgaatggaataatatttcaaacacagatataataaccataccacgttcgcctttcacaagtcaatatttaaatcattcaatattacacattttttctgacgcttccgagttggcttatgccacttcagcttatttacatacaaacgaccaagtgaatctactattcgcaaaaacaaggcttactccattgaaaggcctaacaattcccaaactcgaattattggggttattgatagccgcaagagccgccaagtttataaaaacggaatccaaattgaaccttgaaaatacctatatttggtcggactcaaaatgtgtactcagttggttgaaatgtaaaaagaatttaccaatttttataaaaaatagagttgaagagatacaacaaattgccttggaattacacatcacttttcattatgtaaaatcagcagataatccggctgatttggcttcacgaggagcaactatgagtgaattaaaatacaacaaattatggtggaatggaccaaaatggcttaaactggaaaaggaaaattggccacctcacagcttttacagtcctgatcaagaagaggctccatatttagataatacagaggaaataattaacactcaaataaatttaataaaaaacgaatataacggaattatcgaatgggataaattcagttcatggcttaaaataactcgcatttgtcaaactttattaaaattcatatttttcaaattagagaactctaaaaaatttaaagaaaaatttatttactctaaattcgaaaatgcattacaattaaaaatcatggcacaaaaaatgctaattcgaattattcagagggaaatggaaccaaataaagaagaagaaagacagttaagaatttatctcgataatgatatgatactcaaatgtgaaggacaattaaaaaatgcacaaattcaaggtgtcaatcccatttttttaccaagaaaacactatggaactcatttgataatcatggattatcacacacgaaatttacacgcaggtacaatgacaacattatcggaaataagaaaaacttattggataccgaaaggaagaagaattgttgatcaaatacggagacaatgctatcattgtaggagatataatgccaaaccttttcaacaaccacaaatgccaccattacccaaatcacgagttgaaataacggaaccatttcagaacattggactagattatatgggaccaatacaaataaaaaatttcaatgaaaaatgctggataatcttatttacatgcttcacaacacgaggaattcatctcgaattagttacttccttatccgtccagcattttctcaatgcatttagaagatttatatcaagaagaggcacacccaaacatgtatggagtgataatgcagcacaaataaaacttgcatcaaaaattttaccagaagtgttaaaattaagagaaattctcaaagacgaatcaattaaaagttattttttaaatgaaaatataaattggacattctctatagaattagccccttggcaaaacggagcaattgaacgacttaatcagaatgtcaaaacagcaatgagaaaagtaatcggaaaaagatttattgagtttgattcttttcaaactctgacttgtgaaattgaagcgttagtaaactcacgaccaattacatttatatatgatgaaattaactcttatcaaattcttagaccaatcgacttcatacttccacataaaaatttatgtattcctccgattttggaaaatcaggaaactaaagacccaacatattacccaaaaaagacttcatacgaccaaacaattgaattatggaagaaaaccacgaaattattagatgactattggaaaatttggactgatgaatatataccaagtctaagagaacgttataaaatcgaaaacaaaaatccacgaaattgtatgaaatcttttccagaattgaatgaaattgtaataatacatgatcaaactcccagagcaatgtggaaaactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaaagacaaacatattattaaacgacgcccaccttattgtggtgaaaaatgtaaatgtccagagggattcaaattttgtagttttgcatcttacaataaaatcaaaaatgaatcagttgaaaaaattaattaccaaagcattatttcgttcttcaaaccaaatatctgcgcaccaaataaaactgaaaactgcccaatcatgaaaagaaaattatttaattcaattgttcttcatgacaattcaattcacatagtgaaaacattaaatttacttttttcccaaattgactcaataaacaattttcgttgttttggggagggcaatctgacgattggtactccaatttactgtcgagaacatgactgttttaaaaataattcattcaaacaaatatatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaattatacaattataaaaaagaaccctcaaaaagaggaaataatttatttacccccaaaacttacatcctttgaatataaacctgtaattaaatttataagtaacccagataaatcaaatgagaaacaaatcacatgtcaatcatctcccgtatgtgaattaattaactgtcgattttgtatggattatcttaaaaacccacaatgtgtagaccagattcactgggcattaatgcttgtaattataatgataattttatgttatttcattaagcctccaaattattcgaatactcacacgttttatccattggattttacaatttatttttaa

SEQ ID NO: 80332 - DNA, 2009 bp, Heterodera glycines
  misc_feature (1947)..(1947): n is a, c, g, or t
  Genomic contig location: Contig_ID=SeqID_2546; Location=1973..3981; Strand=-
  SCN-specific regions: Sequence locations=1-154,176-1186,1227 -1274,1296-1589,1618-2009
atgccgcaccatccggtgagcccgcagcagcccgaaagaagagagcaccagcccaacttcatcgctgcccaagttgcttgccctgagtgcattgacaacggcagctggcgcagcaggacaacagcaggctgtcgaatttgtgggccgcatcgaactgttgccttttgtcaacgccgctttgtggacacgcacgtggaccatcaggtggtggtggccgacgacaatccattggtggcatttgtgcattggctcgtcttcgaactgccgatgagctacgacacatacgcctactcacactttggcggacggttcgacatggtgctcgtctttcgcgagctcttcagaattggctttaacccagagatgctgagacgagtaaaagcaaaacattttttatggtgataaaatttcaaatctttagggcaacaaaatgtatgagatgaaagtgcgtaagcagaagaggcgcaacccaaacgtcgtcttccgggactccttcaacctaatgccttgctcactgacagcgctcgtcccttcatatgggctggaggttgaggacaagccgttcttcccccacctgtcgaaccgaccggaaaactacggcagggaaatccacccaacgcccgacgactacatggccagcggtatgatgcccagcaaaaggcggcaattcgatgcgtggtacgccgagaaccgtcatcacccgttcaagctggatgaggcattagcaaggtggtgtttctaaaaatgttgccaaagcccactcattttggctctctcagctattgcaccaatgatgtggaaatcttgatggccgctctcgtcgcgtttcgccgtgaattcttcgacatttcccggcggcaagaatacgtggacggaatagacgatagggagaaccacaacggaatcgacgttctgcgcgaatgcatgaccatcgcgggtgcatgcatgcgtcacttccgcaccaaccacctgcccgctgagcatctggccatcgtccctgagcgcggctatgacaacgcgcagaaccagagcctgctcgcgttcaggttcttccactggtacgcggaggagcacggagcggaggtgcaaactgcccactcagccggaggagagaagcgaataggacagtattcgctggatgggtggattgaggcggaagggtgcgccattgaagttaacggtacacaaatttattttttatttttatttttatgaatataattttaggctgcacttggcacgggtgcaaaaagtgctatcccaacgacaacatgttgctccccagtgggaaaacagcgggggaggtgcgcgagcgcgacgccaaacgtctggaatttctgcggcggcaagtgaaccgcgtggacgtacactgggaatgcgatatccatcggatgctggagcggagcagagaaatgcgcaagtcgtttgctgattatgtggatgatgggccgttggtgatccgggacgcgttcatgggagggcggacgggaccgctgaaactgctgcgcaaagcgggaccaggagagaagatctcctactacgacttcacgtccttgtacccgtatattaagtatgtgtggtgctcgtcgtttttaaataataaaattttgaaatttagtttcgtcactcgctaccccattggccatccaaaagtgcatgtgttgaaccggcaagtggattggcgcaacgcagcagacaacccctacccattggcactgctcaaagtgtgggttgtgccaccccgtcgcgtcgacgtgcccgttctgccggtgaaagttggagagcggctttgtttcccgctctgcagcacttgtgccaaagagaatccgactggtggtgtgaatcccaactaccactgtgagcacaatgacagacaacgaggatgggtgagcacgtgcacttcgattgagctcaacacggcgctggacgagggctacatcgtcacgnagggtattccgcgtgctggagtacgagcagagcgacgacaaactgttccgcccgtacattga

SEQ ID NO: 80333 - DNA, 451 bp, Heterodera glycines
  Genomic contig location: Contig_ID=SeqID_15976; Location=301..751; Strand=+
  SCN-specific regions: Sequence locations=1-278,303-383,405-451
atgtcttcatcagaaacaaaattggatgaaaaatcaaacgaaattagcaacaatgaattgatgggagaaaacaatgccaaggatggaaatgtgaaaggtttgttggtactttttcagtttaacggattttaaatgttcgaaatttaaatataagtacatttattgcatttaaaaagtatgtgaaatctgtccgttaaactagaaaagtaccggtttctttacttcatttgatttttcaattttttaatatccagaagcaaataactcaactgacaaatcagctgaagcagaagttcacacagacgaagcccagctgggaattgctgcagttgacccaaaaccaacggacttttcggaaaaaccaactgatattcaaaagagtgggaagccagaggaacaacagcaacaacaggtgatagataacatctcaagtacgattattagatgttga

SEQ ID NO: 80334 - DNA, 655 bp, Heterodera glycines
  Genomic contig location: Contig_ID=SeqID_15977; Location=123..777; Strand=-
  SCN-specific regions: Sequence locations=1-352,374-655
atgtcccaaactgaaaaggaactactggcagaaaaggtggacaggcagcccaatgaggaggcgaagccgacagcttctctaaatttgttcgacctcagtgtaatgcccgactcagaaacggttagaaccatcatttgcctgtaattttgaaaaaaaaacgaactatggactcactttttatatggttttgctatttgtgtcagttttacaaagtaggaatggggagagtatggataacgaaaagcatttcaaggtctgattttagagcattgaactcaaccaaatgcgagtggacgctgtgccggacttggcaaggttcacccaattacaggttcgttcgaataaaatgtccatttttttataaaaatttaatggagccaaaatccggcgctatttgcaaagagggcctttttgaattttttttcacttttttttggtcaatttttgtttttgtttttttgacacataatgatgaatattaagtattaacagcataattatggcgaataaaaaatatattcacgattttttatctcaaaaaaattttgcaaaacaatagggtcccccctttggtttttgataaaactcaaaatttgtcaatttttaactagcgctaaattttcttttaaaatgtttttttcagtttattaaatag

SEQ ID NO: 80335 - DNA, 1051 bp, Heterodera glycines
  misc_feature (981)..(981): n is a, c, g, or t
  misc_feature (994)..(994): n is a, c, g, or t
  misc_feature (1028)..(1029): n is a, c, g, or t
  Genomic contig location: Contig_ID=SeqID_15977; Location=2305..3355; Strand=+
  SCN-specific regions: Sequence locations=1-107,143-392,415-576,598 -1051
  Gene Ontology: Cellular component=membrane; Biological process=signal transduction
agacagaccctaaaagcctttattttttcataaaaatttgctcaaaatcgcgaaatcgtatagtattatagtatgattaccaaattttggctttatgttctacattcaaataaactgaataaacaaaacagaaacaaaaacccgaacccataaattgcacaaacccggaaaaaccagtaatgtttgggacttcataacaaaaaatattggaatgtctgctgctgtaaaaggatcatggacattgaaaacgctatttctcgcggcttttctcatccgtttattttttattttttatgctcgatttcatgattattattttgaggcgagtttttactgcttttttcattaaatttggtttgactcattttgtttcccggtttcaaatttattacattttcatttgtaattgcttttcccttttaaataggtaaattttactgacattgattatgaggtgtttaccgaagcggcccttttggctcgtgaaggacattcgccctatgaacagcctgagtaccgttacacgccattgatcgcttggctattggtgccaaatggacaattcgccgattttggtgtcctttttatttactttataataaaatgagaaaatcagacgatttttatctatgaaagcgaaccaataactttttgcaaaaatttaggaaaactagttttctgtgccactgatgttcttgtcgcattcctgcacttacttatattggaaagtcggcaacaaaatcaaagaaatccttcctcgcaaaatgaaggcaaaaccattcattcatcatccgtcgtcttccgtcattttggcgtccttttctggctgttcaacccattcaccgccatcatttccgcacgtggcaattgtgatgcgatcatttgtgcactcgttttgttggcactgtttttactgatccgtgtgtggcagcggaagaacgatggcataaccgccacatttctgcgcttggcactggcggncgttgttcacggngccggtgccacccattttcgcattttccctgtgnngtcgacgcatttattgtatttt

SEQ ID NO: 80336 - DNA, 208 bp, Heterodera glycines
  Genomic contig location: Contig_ID=SeqID_15978; Location=1697..1904; Strand=+
  SCN-specific regions: Sequence locations=1-66,96-208
atggttctgctatcacttttgccaatttaaacactgttaacgccaaaaatcagcaggtggttatagattaaattattataaaaaaataattatttggaaatatttaagcgcaaaaagatgaacaaccgtgatcattttgaattggaattgagtgccgaatcggatcaccgatcaccagacaaatcatcaaaatttcagtaatcaatta

SEQ ID NO: 80337 - DNA, 1706 bp, Heterodera glycines
  misc_feature (981)..(981): n is a, c, g, or t
  Genomic contig location: Contig_ID=SeqID_15979; Location=544..2249; Strand=+
  SCN-specific regions: Sequence locations=1-240,308-363,396-401,445 -456,478-645,678-703,745-746,768-1047,1111-1136,1158-1320,1394 -1414,1482-1570,1594-1595,1668-1706
atgtacgaggaaagcttgttgggccttggacttgaacttgagcacgcaaatgcaactgcaattgtaaaatttttattcccaaaattttttttctttttttccactaattatttaattaagaatcccaacatcaaatttgtgctaattcacgccccattcaaagtgctaatgcgtcaagcggaattaatgatggtccgaatgccagtgcataggaatgacgtgagaaaggtggaataaaatatttattaaactattaattaatgattcaaaaaattcattaaataattaattcattcattaaaaaattgctttctatttaaattggttggtactacttccccatcgaattgtttttaaattttttagcgattttgtaaattaaaaagaaacagaaattcatcaaaattttaaataaattattgaaaaattattcaaaaaatttttcttgaaattttcgtataagaaaattatctaaaattttttttgaaattttctaagaaattctttttgatggttttgagtagcactccagcatcatttgtcctgtatggttcgaatttttgtttaattttttgaacggtatttttgtatattttaagtattattggaaaaaaggatttgaccctgctgccttggaaatgtttcaaaaattaaatgaatttattatttataaatttctccaaattttcaatgaatctgcgagattttttaaacaaacaaattaaaaataattaattaatttaaggaatggaatttgactgatggttttgtgaatgcctgcttgaagcggcttaaatttctggactttgacccaagaataaagaaacggattgagccagaaacttatttttgtcaaccatttgttgcgcaacactttgaatggtgggtaattaattaattgtggtactaattagcaaaacgcgaatttacatggaaaattttttaataacaggaaaaaaagctcttattttgcttaattgngaagcttttaagatgaatttttacattcttatttcccattaactaacataatattaagtaaaaacgttaaatattaaaaataaaattttttaattttattagtaaattttaaaaaaatattttttttttctttgacagttttgttggctatgaacacccggagacatttttcacccgagctgatcgggcccgtatggtccacgatttgttgatcagagcgcggtatgaccgtggtgaaagcatcaacaaattgcgatttggcatcgacaaactgctcaggaacaggacttacacagctgcattcccacttcatgatgtgaaatttggattttcttatacaatttttagtattaaaaattatattttaaattttaaattaattcatataatttttgtttacaaataattttttctgtttgttaccatttaacggttttaatttttttataaaatccatatgaatattttaattgataatatagaaattcttatttaattttggatttttaagaatgagttgagaattttcaaaaaaatttttagaacggaaatgttaaaatcaaaacacattctaggaatgggatttcttaaatgaacatatttgtttaaaacggaataattaaaatatttaaatcatatttttaatttactccaattatcattaaaatatgattaaaatttttaaacctaattaaacttttaatgcaacataattaaggaattga

SEQ ID NO: 80338 - DNA, 2346 bp, Heterodera glycines
  Genomic contig location: Contig_ID=SeqID_15980; Location=1..2346; Strand=-
  SCN-specific regions: Sequence locations=1-464,486-747,769-839,863 -1696,1718-2346
cagaaatccccagaaaaccaccacaacacgggaagcgcgaagaaatgggcgcagcttctagagtcacgaaagggtgggctaaatgtaagaccaaaacttattattttacatgatccatgtttagggtggatcaaggtgctaccttcgtcgagccaagaaaactgccaggaacagccggacaaaaggggaggatgcaactcatcacaaacgtttgtctttttctgtagtgttcaaaagagctaatactgtgggtttaggcacacattctcaaactgctgggtacgcaagccatctaccactacgaggtgaccatcaacgcagtgagcagtcgttcggaccgaaagtgttgcgtttcagagccgagtggtccacgggatagggacgagtatgtatgcgttgcatgcttggtaaacatctgtttagtttcccattactcaaccgtcgtgacaaatgccgtgaggtcttctcggcattctacaggaccatggagcagtcactgaaagacaccgggaacttactctactacgatttatcgaaaacaatattcacgttgaagaagctacagatcgaggtttatggctttgggagttggcattttaatgataacacatcgtttagtcggaaggaaagttcatgtttaacatcggcacggtgccaaccgcagaacgcccagacgcggcacggtacaaacattatgaattcatcatcaggccagcgacgggcttcgaggttaacgacttgtccttcatcacaaacgacgtgtcgaaaatggaacgatcacttgagcaattccttgacattgcaacggcgcagaaggccaacatggacgggcatgaatttattcaaaccaataaacatgttattttaacaacattttaactattcaacgggctaaattcagaggtgtagtccaaatccaaatttcaaaaattaaggagtcttaaaatttgaatttaacccaactgttaagaactcaaatgacttcttattcagaaagcaattcatcgggttttcttcgtctcgtgtttacttattggcgccaaccgactatgggttcggagccaacgagtgtcctgtcttcgattccaaccactcattccttggtgtaggagtgaacaagggatgtcgaatcgttgaaggtttgttctttttcttttagttaactcattagaattcaggcgaccaaggccctggccaaatgacacctgccatcgtcatccaaactaaaaaggtttatctttatgggttccatcagtcgtgcccataattaatttataccatgttacattcattgtcttagtccgccttccacattccggacatgtgcattttggacaaagcaaagacgctcctttttcgagagaatcagggaagattcgagacaggcgattttactcaaagtgactacgaggcgctttgcaatggccttgtcggtatgctaattataatgcgaatgtgtttgatgtgaattattttatacccattctccaggaatttatgctgaaccgcgctatggaacttctggacgattttttcgcatcagtgacattacaaaaccaaacactggaaatggtcttaacgcggagaacacattcatcacacaccaagtcagcgggaagatcagcgtcaaacaatatttcgaggatacctatcggaaaacgcttcagtgagtccactatccaacacgattgctttcttaaaagaaacattttggtaattatttctcgatttcaggtaccctaaagcaccactcctcgtcaattatcgcagaattggggacccggcgtattatcccatggaggtacaacagacaaggcaacaatttaattaaaacacttttaggtttgctttgttttggatggtcaacgcgtcaaaagttctcaacaaaatcctgagcaaattcgtgtaggtgtttagcgatttcatttttaatcgtcattctattccaacattaacaataagtgtttaggaaatgatcaaagagactgccattccgcccaccgttttgcgagtgcacaacgaacgggtgaaggagtcgcttcagttggtcaacaacgaatacttgacgaaagcgtccgttcattttgacacaacgccactccatgtcgattaccgtgttcttggtccgccagcaactctttatcggaacaaccatcgtgtcactcctgccacgtcaaactgtgaatggcgtccgggtgacgctttggtgaatgcacaaattggcacctgggtagcctatgcgtttgggaaccctgtgggtgactcggtgcgacgattaggcttaaccgaaacgatgtggaggtaattagcgctgaaattcctgatttcgtttcatgtaccaaaaaa

SEQ ID NO: 80339 - DNA, 633 bp, Heterodera glycines
  Genomic contig location: Contig_ID=SeqID_15981; Location=1802..2434; Strand=+
  SCN-specific regions: Sequence locations=1-109,131-633
gtgagtgcgggtggtggtcggcagaatggtgagttttccgggcccttcagttcccatagtgtgctgccgtggttggaacaccaaaagacatcgcgtccttcttcggtggtgattgggcttttgggccagcggatcaacttgattcctgggcgtggccgttgttgtggacgtgatctgtacactgtagttgttcggtagtccatggtccgtgacattggtgtcgtcgtggttgtccaggcattgggccgtgtggttgctttggttgaccaaattgttgagcgtgttttggttatggtcgccgttgtgcgtggtggatttgtagtcgttgtgcgtggtggatttgtagtcgttgtgcgtggtggatttgtagtcgttgtccacggtggatttgttggtgccggtggagtcgttgtttgcggtggatttgttggtgctggtggagtcgttgtttggctcagactccgattaagggcgaggactttgtcaatgtatcgctggacgtatggactgtgttttgttgccgtcctcttgtcacgttccgtgaataggttgaggaagttggaaatgtagccgccgtgccatgttttgacttccgcaaattgcttttgtcgagttggttgtccttttgccgaa

SEQ ID NO: 80340 - DNA, 1574 bp, Heterodera glycines
  Genomic contig location: Contig_ID=SeqID_15981; Location=998..2571; Strand=-
  SCN-specific regions: Sequence locations=1-111,133-640,662-1574
  Gene Ontology: Cellular component=secretory vesicle
atgccggagccaatggagttggaccaagagcccgggacgtcaacgtcaacaagttcagcccggcccggaacgtcaacaagtcaacaagtgatcagctcgttaatgctgatcagcctcctttgccttctcttcaccagttcggcaaaaggacaaccaactcgacaaaagcaatttgcggaagtcaaaacatggcacggcggctacatttccaacttcctcaacctattcacggaacgtgacaagaggacggcaacaaaacacagtccatacgtccagcgatacattgacaaagtcctcgcccttaatcggagtctgagccaaacaacgactccaccagcaccaacaaatccaccgcaaacaacgactccaccggcaccaacaaatccaccgtggacaacgactacaaatccaccacgcacaacgactacaaatccaccacgcacaacgactacaaatccaccacgcacaacggcgaccataaccaaaacacgctcaacaatttggtcaaccaaagcaaccacacggcccaatgcctggacaaccacgacgacaccaatgtcacggaccatggactaccgaacaactacagtgtacagatcacgtccacaacaacggccacgcccaggaatcaagttgatccgctggcccaaaagcccaatcaccaccgaagaaggacgcgatgtcttttggtgttccaaccacggcagcacactatgggaactgaagggcccggaaaactcaccattctgccgaccaccacccgcactcaccgcgcaatggacaccactgacaatcacgctgtacaccaagatccatcgaccggaaccaatcgcaacggcatggcactgcttcatcaaaacgacgaaggaaaattattacacaacatcgtcggcgataagttcgtcgaaatcaacaaagaatttccgttggtctccaaacgactctgccaacgaatggcacatcaacaagaatgcccactcgccaaaacggaaatgcaccacgttggcaaccacatttgggcaacaaacgaccaacttcaagtggatttccctggaccaatcactggactcttcaaagggaagcaaaccagctcagtaacaaattgttttgcgcaaccagcaacactgttcgtcaaatggcacagtctccaactactgtcgccaatccatcgcgcagaccactgcaattacgcttccgagtattgccagctgcaaaacaacagttcactcatctggacttcagcatgtccaaacgacaattgtttcatgtgcgatttccaagaagccgaagaaatccacggagaattcaccaagctcaacggtcaaacaacagcattttggatctcggatgatcgacaaaaggcactgaccttcaccgagacgcatgccgtgcaagcatgcgacgggagacaaatcgtcttatcagagcagaacttcggcattccaaaagagcaattcgacatcatcatgagcgaccacacaagaccgaaacgcaacgtgcaacccgaacaactcgcttcacagctttccgctgctcaacttgcacaacaatggcactctcacagctttacttaa

SEQ ID NO: 80341 - DNA, 1311 bp, Heterodera glycines
  Genomic contig location: Contig_ID=SeqID_15982; Location=1243..2553; Strand=+
  SCN-specific regions: Sequence locations=1-264,286-522,544-574,596 -685,713-929,965-971,993-1001,1031-1125,1149-1311
atgattggcggcgctaaaattcttttttccgctttcatttttatgataaacattgaaggcattttcagcacttacggagatgatttatatgcagatatttgggaaaaggcttttccaaaaaattcacaaaatttaatggcaaaatcaaaaaacggcaaaaaagttggaaatgcgcaaaaaattattgtaaagcaaaaaaagacggacgaaagacaaataaaattgggtgaaaaaaatgtaaaaattgaagaaaatgagggggggacgacagcagcagaagaagcaaaagtcaggaatgttcagaaaatgctgaaaatagtaaaaaatgagccaatttttgacgaaaagattcaaattgatgaaaaaagcggccaaaatttccaaaaaattcaaacgaatttaaaatttaagcaagcgaaaaattggccaattaaaaatttcgaaccaaaaaccgaaaaatatgaagaagaatttgataaggtgaatggggaaatattggatgaaatagccgaaaaagcaaaacaaaacgcataaaataagtttaataagaccattaatgctaataagtagagaagagcggggccgggaattttgggcaaaaccgggaccgggacttgccgggacctgagaagccgggatcgggaccttggaggaccgggaattctcgtcccggtcccgctctactgacaaaaaattattttatttttcaaaaggagaatcaaatgtccggaaatttgttgtatccggcattttaaattttctctgaaatccaattcctagtaataaaaaagataaatcctaaaaatcgcattgaattagtgagcattcccgagaaaaacaaatgatacgatcactgaaaagtcaatgtttaaggaatatgaagaaagcaatcggataaagcaggcaaattccaaagacaaaagcaaacattctgatcattttgatgaaaaagaaatattaaaaataatcaaagaatttgacaaaaggagagaaatattgaaaaacaaaaacatttacaattggaaacaactgaagctaattgaacgagaaattgccagggaattggggacaaaattttacagaattcgagactggaaaagggaatttggactggtgaaaagagcgaaaaaggaggacaaagaaacaaagttggcactgattgaacagtttgacagaatgaaaaatgagcgcaaaatgaaaaagggatacaaaaatgccgagaaagtcggcattgaatgtgaaattgccaaggaattggggacacatcgggacaaaatttacaaatggaaaagcgaattattaagtgggtga

SEQ ID NO: 80342 - DNA, 1884 bp, Heterodera glycines
  Genomic contig location: Contig_ID=SeqID_15985; Location=483..2366; Strand=+
  SCN-specific regions: Sequence locations=1-302,339-925,954-1287,1328 -1465,1501-1792,1815-1884
atgctgttgccaaatggaaaatcggccggagaagtgagggagcgggacgcaaagagattggaatttctacggaatcaaattggtcgtgtggacgtttattgggagtgcgagattgagcgaatgcttgctggtgaccgggggatgcggcaaatgttttcgaaatatgttgatgatggtccactcgaaatccgagccgcctttatgggaggacgcacgggaccattgaagctcttccggaaagctcgggatggagaaaagatttcatactacgacttcacttctctctacccgttcatcaagtgaaaatatttattttattattttcataattataaaaacatagctttacgactcgctaccccatcgggcacccaagagtgcatgtgctgaacgaagaggtggaatggacaacatcggccgacaacccctacgatctttcacttctgaaagtttgggtcattcccccgcgaaactgtgatgtgccggttctcccagtgagagtgggtgaacggctttgctttccgctttgcatgaagtgcgccagcgatcacccgacaggcggagttgatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaatcgatccaataaagatggagccgaacaaagggaaacgatcgatagcaaagctctgcttgaataacttatgtatgttgtctttaaatatattatttttaaataaatttctagggggtcgattctctcttcgcaactttgggctgtcgcaaacactcatcacagatgaccctgtggttctcgctgaatatttggacaaccggtcgctcgaggtcacagcgattgacgaattggacgctgaacacatactgatcagttatgagaaaaagaaagagtgggtcgaggaacatgcatgttccaatattggtataataatttatgaaaacaaaattcaataattaatttagtaatatctctttggacaacttcggcggctcggctggtattactaaaggcaatgcagaaggtgaaaagggcaccaggctgtgagctactttataccggtaataaaaataaataaatttaaaaaatgaaaattatttttcagacacggatagcctcattttggtccatcctcttgaggtgtgtccattgcaaacggggcctcatctcggacagttcactgatgagtacccgaaccatgagattgaagagttctgttcaggcggagcaaaacaggtacatatttaataacttataatttactaatttaaaattcagtatggtctaaagcttcgccgaaaagctgctccagctgacgctgaaagcgaatatgttctcaaagtgcgaggaatgacgctcaactatgacgtcattcagaaccaagggcttcgatatgagacattcaaggaaaaagttctgcgatatggtgagaccggtgaacctcagccgatcaacattacttacccaaactttctccgtcccagcattaagaatgggagggttacgtcttatccccttcacaaaatttataaaccctttgtcggtaaaggtattgtcggagccgaccttagtgttttagattttggccacacattgtaatcatattgcgcatttcctttgtatttttcatttttttgtaagcatattaatgaatggaaa

SEQ ID NO: 80343 - DNA, 621 bp, Heterodera glycines
  Genomic contig location: Contig_ID=SeqID_15985; Location=2672..3292; Strand=-
  SCN-specific regions: Sequence locations=1-92,114-621
atggcttgggattatgagtggggtgatgagtataaaagctttactccttcagcagataagctcattcttgtattcttgtcaaaaatggttcttctcagtgtgttctgtgctgagcttctcaattgccgagtttcacagcttcgcgaccgactgaaccatcctgaagaccgcacttacatattaaattcactaaagggtcgcaaggtcacgacaacatacaaggacagaaacggaatgaccaagaccttcttcattggaggtttatcggaaaagggtgctgcacttacaatggcctacggttgtctctctcgccctttcaacatcaacatcgcagctcatttctatgctcggcatcgcatcaagcttcatcatccttatatagtctgcataattgaacgattctcaaaaggaaaagaggatcggctctatcccatggaattgcttgagcttactgaggacaaccctatttggcaacgatggtcaggacccttattcgcagagagggacccgaccccatcacacacgtcgggtcggtttgaaaatgatgatgatgataatgatgaaacgttaaaagatgttggccgcaatcagtgcacacaatcgccagatttattttggtga

SEQ ID NO: 80344 - DNA, 1027 bp, Heterodera glycines
  Genomic contig location: Contig_ID=SeqID_15986; Location=394..1420; Strand=-
  SCN-specific regions: Sequence locations=1-445,467-546,568-1027
atggatgcaatagaattaacgtcaattttgatgcaaaatcgtcgatcggcccaaatctttcggggatgttatgccagcgatcaattaccttcaccaggcactttggagtatccagcggcgttaattgtaaatcgagaccctcacaacaagaaaggatctcattggtgtgctatttacgctaggggattggaaggaccagtgatttatttcgatagtcttgtcttaaccataccccctcagattagcgaaaattttttaaataaattcaaaaatggtatacaaaggaatgccaatatgtatcaatcaccattgacatcaacatgtgcacatcattgcattgtatttatttaccacatgtctattggacattcatttccaaattatttacgaattcttgactccaattcaccacccgatttatttgtaactgtgatgcttaataaaataattgaaaattaaagtatggcttgggattatgcgtggggtgatgagtataaaagctttactccttcagcagataagctcattcttgtcaaaaatggtttttctcagtgtgttctgtgctgagcttctcaattgccgagtttcacagcttcgcgaccgactgaaccatcctgaagaccgcacttacatattaaattcactaaagggtcgcaaggtcacgacaacatacaaggacagaaacggaatgaccaagactttcttcattggaggtttatcggaaaagggtgctgcacttacaatggcctacggttgtctctctcgccctttcaacatcaacatcgcagctcatttctatgctcggcatcgcattaagcttcatcatccttatatagtctgcgtaattgaacgattctcaaaaggaaaagaggatcgactctatcccatggaattgcttgagcttactgaggacaaccctatttggcagcgatggtcaggacccttattcgcagagagggacccgaccccaccacgcacttcgggtcggtttgaaaatgatgtggatgatgatgaaacgttaaaagat

SEQ ID NO: 80345 - DNA, 559 bp, Heterodera glycines
  Genomic contig location: Contig_ID=SeqID_15987; Location=638..1196; Strand=-
  SCN-specific regions: Sequence locations=1-559
atgatcccaaaactgtcctattctgttgcaataaccttcaaaataattacaaaatcgtcatccttttttaattttgatgaaaatgtttgcgtcgttgggctggatagaaccgcgatcacttttccttcaaccactgagccatacaagcgattgctttttgaaatgggaggccaaattgaaatgctgtgtttaataatgtgtttcggtgtctccgtctgttggcttctcttttcccactcaaattgttcttttagtccaaaatgggctatcgccagggcgccggcctcggggccaaagagcaaggcatcagcagaccgttggaagtgagtggaaacggcacagactttgcttttcttattttgtcgaagttaaggtgcaaagaacgggcaaaaacattgggctgatctttggcgaggaaggcgcctcgacggtggtcacttcgttggaggaattggtgcctgaacagcagcaccaaccgaacggatgatgaacaaaactatcccaatttgatttttttgttattttcatttttcctcaatttttaatttggaataataaa

SEQ ID NO: 80346 - DNA, 1229 bp, Heterodera glycines
  misc_feature (1198)..(1198): n is a, c, g, or t
  Genomic contig location: Contig_ID=SeqID_15988; Location=24..1252; Strand=-
  SCN-specific regions: Sequence locations=1-51,73-161,183-342,365 -982,1006-1056,1078-1143,1167-1205
atgtctctgtacgacgacattggaattgaatcatcaacatcagtgcaggtcaaagaagagaatttggagaaaaaaggttaagctgacaaatgggacagcaaatgaatgaataataaaaagaaaaaaatgacaatttgacaaggatttttttaaattaaacatttgaaagtgcagctgatgactttccgacaccaaactctgctcaaaaaccccaaaatgtcaccgtctcagcagtgtcagcggtcaacaaaatgaatttgtcctttctcaaatcgcaactcgaagccaagaaagccattctacagaatgcggccgctgccgcttcgcaaaatgttcggcaatttttaaagctaaaaaatgcattttcatttggccaattttgccatttattcggtacatttttctcagaaatcagcccccggcgttgccttcgcgcagccgttacccgccactcttccgaatatgcctcagctgctgaacaagaagggcggcacgttcaagctgaagccacacaaagcaattccattgcccatcgattcgaccggcgctttcactttggtgccgaaatcgctgaaagaagacaaagtaacagactggaaaagggttttcggcatttttgttatgtcttaacgactattttttgcattttttgaatgggattggccatggtagaaaattaaatgagtgagtattacgtgtaaggattgtatttttatgatttttttttctttgatcatttctctgccaactccgtcggattgtccggcgattgcgccgccaaaaatatttttgtgtttaattgggcattactttttccctataaaggtatttttgtttggtgaactgatggtggaagacgagtacaacccaaccgcacccactgattattcgtcgtttaaacagaaaaggtaaaattgcaccaaatggatgaatggccccgacttaagagaattgtttcaacatttttttttggttttcttaaattgggccaccttttttcattttctgtcaacaaattttaattttagggagcaacaacggttaaaggtaagcatttaataatatgatttaaaacaaatttactcttaattgaattccattcattttgatcggtttttcctttatcggaattctttccaaaattggtttctaaaaatgtctttttatgtttctaaaaatggtctttttatgtttctanaaatgtctttttatattttattattaataaa

SEQ ID NO: 80347 - DNA, 648 bp, Heterodera glycines
  Genomic contig location: Contig_ID=SeqID_15989; Location=810..1457; Strand=+
  SCN-specific regions: Sequence locations=1-25,47-99,124-205,332-648
atgttcgaaattttaaaagttgcaattttatcaatattttttacaagtatttttgctgaatatttatatgattctgtccgtatcagtgaagcacaactttctgttaaaatgaaggacaaaaaggacaaaagtcgaccattgggaaccgtagagtaagctcaaatcattggcataacagccaatatttaataatactttttatcggaattaaattaaaaaaataaaaataaattaatctcgaaaaaacatttttatatatgtataatatacgtagtacatatttattatttattcattaatttaactattttcaattttttaatattttttagtgtgccgctcaatgaaaaactctcaaaattggtgcgtctcagcaaaaacttcatcgctcaaatttcgtttagagttagcatataaaacactcaattttcaatgccatttgctaattctcagattgtcgacggtgccaacggtcgcccaattgaaaatttgcaacaaaaattccttcgcttttcccattcaaaatcaccagaacatgaagtgttttttgttgctaaagaacacaaagaatcgaatggtcattaccaacttgaaatggtacaaaattttctttaaatttctttttttttcaaaataatttaagaataa

SEQ ID NO: 80348 - DNA, 436 bp, Heterodera glycines
  Genomic contig location: Contig_ID=SeqID_15990; Location=399..834; Strand=-
  SCN-specific regions: Sequence locations=1-153,187-282,305-328,352 -381,406-436
atgagggaaatggtaatttatcgcttgggcgatggtggtttgacggccagcattgtgaggtacataaaagcaatcaaatgattgattaactctttttgatttatgggtcatgacaacggaggattctctaaaaaatcaactcaaaatcatttgttttttaataaatttttaaaaatatttttttttcgttaatttaaatgtacattaaaaagttggaaaattgcaaaaaattttggtttatcaaatcatataaatgtcatacatgcttcctttttcaattttcagtttttcacctacaaaggccaaggcggaaacccgaacaatttccaaacaaagagacaatgtgacaatgtgtgtgggtgttgttgagagacaaaagagcacagcaaaaatggacaaatgggcgaaaatatgtagccaaaatatgaacaaataa

SEQ ID NO: 80349 - DNA, 113 bp, Heterodera glycines
  Genomic contig location: Contig_ID=SeqID_15990; Location=2257..2369; Strand=+
  SCN-specific regions: Sequence locations=1-22,44-113
cttggcattcgcactttgccctcctttgtgccgcatccgctctcctcaaatggcgacagaatggtaaaaggacggcgtggcattccattcatccgactggcccccaaaaatag

SEQ ID NO: 80350 - DNA, 6174 bp, Heterodera glycines
  Genomic contig location: Contig_ID=SeqID_2549; Location=1..6174; Strand=+
  SCN-specific regions: Sequence locations=1-70,92-114,154-305,331 -521,632-643,1127-1136,1325-1976,2006-2094,2116-2398,2421-2956,2979 -3148,3170-3494,3516-4601,4623-4760,4801-5384,5406-5720,5742 -5762,5784-6174
ttattatttcttttaaatagaatttaaatgattaaaccattcatgttaaattctggccacaacgaaatgataaaatgacaaaaattatcatttttaatttacaacactgtgtacatttttaatttttaacttttttaaatttttttaaatttactaagacatgtttatatttccaaaaatataaattcactaataataattgttgataaaataataattttcgctaccatacgtcatcggctggctcctaagatacgattgcagacagaaaacttattaagacaagaaatatactcaaaattcagaaataaaaaattattaataaaaaaacagggctggaacgcggacagaaagaaggcgtgagtagttactagcccccttttccgttgttggaaaaccaccgttccaaaccaaagcctattggttaaccaaaacctattgaatgggtgtaggagtgaacctaaacctattggatgggtgcgggggtgaacctaaacctattgaagggttttgattaataaaaaataaattaaattaaaaataaattaaataataaattataaataaattaaataaataaattaaaaaaaaaaaaaatttttataatttaaaaaataattgaataaaaaaagctaagattcattctctctctctctcactatctttcttttctttctctctctcactctctctcttatctctctctctctcacactctctctcttttttctttctatctctctcattctctctctctctcactatctttcttttctttctctctctcactctctcttatctctctctctcactctctctcttttttctttctctctcttatctctctcttttctctctctctctcactctctctcttttttctttctctctcttatctctctcttttctctctctctctcactctctctcttttttctttctctctctctcattctctcttctctctctctctcactctctttcttttctttctctctctcactctctcttatctctctctcactctctctcttttttctctctctctctctctctctcactctctctcttttttctttctctctcattctctctcactctctctctcttttctcttgctctctctaataccacacaaaaatataaataataataataataaataaattaaaaaattaaatttaattaaaattaaattgttaaaataataatagttaaaaaattaataaataaatttaaaataatagataaaaatttaaaaataaatgaaaaaaatttaagaaattgataaattataaaaaataataataataataaacacaaattataatagtcaaataaaaaaaaaagctgagagggcgctacctattgagtcctaccgtttcagtccttgactagtcaatccggggtcaaaattttgaatttggcgccaaaactttaatttttcgttatttttgaatttgagaaattggtttagttttggcggatgcctattggaatgtttttatagggcttcgctaatgtttaaaaggggaggggtgggcgtcagcttcgggagggaagcgacgccgggtcatttgagagcacgcaggggccatttgagcgctcgcacttgtcatctatgcgcccgcaggtggtcatttaaatgtccctttactgtcaccaatactccatcctaatggaggggtagaggccgtcccttatgacatctctccccaaatgaccatttcgttctcaccatctgtcgcgaaagcgaagggttaaatatgtctctttggcaacctgccaaataaccattttagctttagccccgcccactttaactagtataaatagccgcccatttccagccaaaagtcaacttctcccattcattcgcgaaaattctacccacattcattgcttgcgcgctccgtcaaaaaaatatttaaactaacaaatttgcaactaaattaccctttcatccaatattcaacttataaaaaaaatattttcaataatttttctattacaactataaaatttacatttttctaattcagaatattctttcatattatcttatatcatctataaatcataaatttttcattcatatattattattcaaataaaatgaagcgtttttccctctctcaaaattcttcctcctccttccccaaaaaatcccaaccaaataaatgcattcgtaaaattgataacctcacttcaaaaagtaaaaaatatcaactggtgcgctcaaaatccaaattcgtcatcgaggaaattgacaaatgtgctgaccccgctgcggagctgcgctcatgtgtgcaccattcgatcgaggaggcgatttcggatggacaaaacacactaggcgcaacaaataaggtgggggttataatttcatcggaacttttagaccagggtgacatcatcctaccaattacaccaattaccgcaaatgtcgtggacgctgttttcaaccagttttgcagtggagcagagcaaatcgaaacacgtcaacttatatggtgctccctttataataaccgtcaccgttctaaacaccaatggactaccgcgacaacggacaacaaagggaaaagggcgaccgcctgtctcctcacaatcgcacattttcaaagtcaacaacaacgacaactactgtcttttttacgcgctggaactgatgcgctactactcattatatatcaggggagtaatttcaaggaaacaatttagatggctcaaagataaccaaaccacggttttacgacaaaaggcgctacaactactccgcgaggcggggatccctacaacagagacagagtacgacgcggaagtttatatgcatcaagtgcaagggttgtggaacgtcaagtatcccggtgagtacaaaatatttatttttaatgactatcagatgcgcccaatcaccaaatccgatatcaccgactaccagtttcccattcttctctaccacaacaacaaccactttgacggaattaagacaatatcgaaatttttcaacaaaaaaaactactgtctctcctgcgagtctccgtactacaagaaaatcgagcactcattaaaatgcacttcactctgtcacgggtgccgtgaggtgggcgtcgactatccctgcgatccccagcaaggatacgtcaaaaagtgtgagcactgtaacaacaccttctacaacaataactgctatgggcgacacctccacaaggatttgtgtaccaaatttcaacgctgtgaagattgtggggtaatttataacataaaggttcatgggagtgttgggcataaatgtggggaacagttttgtaaactttgcaaacaatttcatataaaagaagacgaagatgagatgaacccctgcacgaaatgcttcatccaaccccttaaacaacaaagaattaagtcatacaggatcatcgcatacgactttgaggcgacacaggacaagaaggtggagaaccggttcgagcatgaagttaactttgcagcggctaccatcatctgcacagactgcattatcaacggcgactggaacaaatcacttcagggaaaaaagtgccaaatttgcggtcctcaccgctcaatcaccttttcaccctttgactacacggagacaacagtcgaccaaaaaatcatcactcaacaagcgctacgcgaattcgttgaatggctcctttttgaccacaacaaaaagtttccaacagtcgcgtttgcacactttggggggcgctacgacatgacgatgatcatcaaggaggttttagcgcaaggaattcacaacccggacatcatcaaacaaggaaatcgcctctacgagctgaaaatcagggaaaacgagcacggcccactcaccatttttcacgacagctacaacgtaatgcccatcaaactatctggcctcatcaaatcttttgggcttcatataaaagataaacagcactttccccatatgttcaacaaatcatcaaactacgataaggtcctccagcaccttcctccacgtgaagactattgccctaaccaaaagaagaaggcggatctgcagaaatttgacgactggtacagcaacaacctataccaaaaattcgacctcaaagaaaaattacccgaatactgctgcaatgacgtccaaatccttacccacgccctcgtcgaattacgccgggaattcaaacaactgacacaacggaacggaaagcacgggggaatcgacattctttgacaagcaatgaccatagccagcgcctgcgtcaaaaattatgcactcaaccatttgaagcccaattcactcgccatcgtccctgaaaaaggctatactccacaacagaatcaaagtgcactggccatcaaatttatcgactggtactcccacatcaataacgtcaacattcaaactgcgcactcccgttacggcgaatatgtgtttaagcgtgaaggacagatataccaagtggacggctacatcaaagggactaatgggaggcgggacaaaataatcgaggtgaatggctgtctgtggcacggttgtgaggagtgttttgacgagatggacgacgaaacgaagatgccaaacggaaagacgctgcgggagattagggaaagggaagagaagaaacatgaaatattaagccgttacgtcgacttggaggttatttgggaacacgaaataaatgagaagctgaaaaaggacacagcaatgagggagtttttcgacaactggaaggaccgctcgccaatcaaaatcagagacgcttttcatggaggacggactggaccaatgaaactactccacacagctaagccgggacaaaaaatcagctacaaggacttcaccagcctctacccgtggaccaatttctctacagactatcccctcggccaccctaaaatcatcagtgtcccaccaaatgagcagacggtcaactggcgctctccatccgacaacccctacaaaggacttctcaaagtgctgcttctacctccaaacaacaacgtcagcgtcactgttatgcccgtaaaatttgatcaacgcctcctcttccctctctgtgagaagtgcgccaaatacatcaccaacaaatacccaaatggcctcaaggacgacaactactccgcccacacttcaaccccaatgaccgcgccttcgtgtccacttgcacccatcttgagttaaacgcagcattggaggccggctacacagttcgcaaagtcttccacgtcctccaatacgaccaatggagtaacaatgtcttcaagtcttacgtgagcgaaatgatggccctgaagatccacgcaaccggcttcccgtcatggtgtgagagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgaggaatctactttcgaaggcggtaatcaacaatgacccttttgttctccgccaatacaccgacgacaagaaaattgatattatggacattgagctgatggatgaggacaacgacgtattcatgctcacctacaagccgaaagaggagtttgtcgacgaaaacaaatactccaatgtcgtcatctcactctacacaacatcaatggcgcgtctatacctttacgaagtgttaaaaaaagtggccgacactcccggatgtgaaattctctactttgacacggacagcatcatctacgtgcacccagaagccaacgacccactcccgacaggaaaaggacatctcggtgagctgactgacgaaaagccggaccacaacattttggagttcatcagcgctggctgcaaaaactacgggctgaagttggaacgtaaggacaatggggaaattgagtacgacttgaaaataagagggataacgctggatgaacaaacagtgcaaacgatccattatgacagtgttaaagatcaaattttgcgttatgggtccgatgaccccgcggaccccattattgtaacttatccccattttattcgccctaatctaatccaaggcaaagtgtacactcaatctctaactaagcattatcaacctgtcttcacaaaaggtattattaatgattcattccaagtcctcgaatttggttat

SEQ ID NO: 80351 - DNA, 1251 bp, Heterodera glycines
  Genomic contig location: Contig_ID=SeqID_2549; Location=6906..8156; Strand=-
  SCN-specific regions: Sequence locations=1-23,50-91,117-1251
atggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtagccaatacctaattaaactttgcccgccagtaaccaatacctcgtaaggttcggctctccggtagccaatacctaattaagtttggcccgccagtaaccaatacctcgtaatgttcggctctccggtagccaatacctaattaagcttggcccgccagtaaccaatacctcacaaggctcggctctccggtagccaataactgagtttgcgatggtaaggagcaataatgaccgaatatgtgttggagaggaagggtagagttgaggaaaccaaataagtgaaggagaggggggtgaggtcactgcgtcatcttatcctgtaaatcgattcctctaaaaggaacaaatggaaagaggctaacgccaactgttttcttaacaaaatcctatatttagagattttggtttcgggtttatttgaattattttccttttctccgtaatacactttctctactcttctatatctgtttactttcactgttattccttattaatttcagacctacatattgtctaaataatcgtttccattagctatttttcaatatattttcttccaacactatgttttattctcgaaccgttatcttccaagtgttcgtattcttgttctttatcaaactattctcttccctatacattacctaatgtttgccttactaactcatattaaattctcactatttaatattgactctcttcaaccacatttctgagttctctatctctatctcttacacccattattaattgtccttgattctatggtgcactacaatatcctcatatgatttcttcatttattcctattacaagacctgcttcacgcatacatttagcccttatctaccctttctcgtcacatacagtcagtcagctgtttgtcaaacctactttctattctcggttcaatcttagattcaaaattgtctatttctcttgtttcctttgaatattacttattcaatggaattgtaaatgttccttattataattagaattattttacgttgaattaggcaaggagcattgtttgtgtttatgattaaaattaacaagttttatataagttaataaa

SEQ ID NO: 80352 - DNA, 594 bp, Heterodera glycines
  Genomic contig location: Contig_ID=SeqID_15991; Location=269..862; Strand=+
  SCN-specific regions: Sequence locations=1-61,158-198,256-302,349 -384,436-443,498-521,543-594
atgccggcatcagttgacagtggcaatccgcccaaacccaaattgaaagactatcagaaacagcagctgaaggatgaaggagagaaggaagcggaggagaaaaaagagtaaaaaaaaaaattaaatatttaataaaaaaacaaataaaataaaaattcaagcgaagacgaagaatggaggagggtaataagcacaatgaaatataaaattaaatacttaaactgaataatatttttatttttgtaattaaaaattctcagaactttaatcaacatagaaagggtaattttcgatttcaaatcattaaaaataaatatatttaaatgcaattttatatgtataatttttgccaaccaattttcagttctaaagaagactatgaacagaaagagcagcagctgaagaagacagaagagaagcaagtggaagaggaaagcgacgggtaaaaataaataataaaaaatgaaaaagtaaattatttatttattataatattaccatttttgctaaatgcatttggcatataatttataggaaaatgacggtgccaaccgacgaacacaccactcgtcggcggcgtgaggagagcgaagg

SEQ ID NO: 80353 - DNA, 516 bp, Heterodera glycines
  Genomic contig location: Contig_ID=SeqID_15994; Location=488..1003; Strand=+
  SCN-specific regions: Sequence locations=1-190,233-243,267-327,392-516
atgaatacagttcgcccgtgttcaatttttacgacattacatacgtcacgaaattatacattggtaaaaatatacataatgataaactttctggggtttttaagagtacacaacggtttcataagtgaaataattaagaaaatactgctcgttttccctaatatttgataaagaaaatatttagcttttgatatttttcaataaatattaataagttgatttatttaaataacccaattctcattttctttattaaatgtttgattttttactagttttctcaaaaattaataaattttagcttgattttgtttgcattttttcttctaaattattttttaatatgatattttggatttataaatttttaaattaaatttaagaaaaattactctcaatttttgaaactgtatgcatttttttcatattttatatacataaatgcattttatgtacatatattatagcgtaagtgatttttttatccggccatccaaatacataattattacccaa

SEQ ID NO: 80354 - DNA, 372 bp, Heterodera glycines
  Genomic contig location: Contig_ID=SeqID_15994; Location=1144..1515; Strand=+
  SCN-specific regions: Sequence locations=1-372
ttctcaactggactgaacacaacagtgtggaaattcctgccccctctttctctctgctcctcagtttcttttttctctctttttctctctgtggcagcagcagagggcaccggccggccacatcaactatttctccacctcattttctctgtccacccaaacgactttggatttaacgacgtatacgcaccgcacttttactctcttccgtactgatcaacctccacatttactccactgtttctcaacttcacatttctctgtcacgacagacagcaaaacgcggcacactgtgggaatggtggggaatgccagacactgtccacgcccgggcgggtggggaaacggcgtcagtgaacacgagcgcgaccg

SEQ ID NO: 80355 - DNA, 1316 bp, Heterodera glycines
  Genomic contig location: Contig_ID=SeqID_15995; Location=1204..2519; Strand=+
  SCN-specific regions: Sequence locations=1-225,247-256,286-565,587 -886,910-944,966-1105,1127-1168,1190-1316
  Gene Ontology: Mol. function=aspartic-type endopeptidase activity; Cellular component=extracellular space; Biological process=digestion
atgacgccggcggcacaatttcccggatttcggcatgccgagacggaagtgccaccgtcgtgccaaaatttgtccaaatttgatagccaaaaatccgcttcataccaagagacgaacatgacattttcgattgagtacggacttgggtttgcggccggcttaattggccaagaccttgtgcaggtgagagatggaaaaatgagacatttggatttgtacaattagaaaaatttacaaattttgttacaaaattgtgattttttaatttttaataagaaattttttgaaaatcgggaacttttttcataagaaattttttggaaattgtaaactgaattactaagtttatcaaaaaaaatcgctgaaaatttttttttataattcttttttgcaatttttaaatttccgaagatttttttgaaaaatttctgtttgaaagtttttgaaaagtatttcagtttgcctccgattccaacgaaacagatgggctgagagtgtgtcaagcctactttggccaagccaatcagaaggatacccaaacaccgacattcaacggcattttaggccttgccctgaacacaatcaagcaaaatgtggaccctcttttcatccaggcctacaaacagggcctgttcaaaaagccgttgttctcactgtatttggccacccaaggcgccgcgaatggcacattagggggaggtgaggcatggcatggcactttttgaatgggacccgcaaaaaaatgtaatcagaaattggttccatctatgttggaattagacgctctcgatcccggaattctttttttgttggtcaatccttggtctcggactactgaaaatggctaattgtggttttgcggaatttatgggtggttcttagaggcctatgggaatggttgaggaaatacttattggattttaatgaattttattaagaaagcgtttaaattttaaaattatgttggccttggtaaaaataaaaaaattactgaaacacagtccgagtgttttggtatgatgtcattttaattctttaaaaaatggtgttttaagattactgtacccaaaaaccattgccactatttttttaacgattaaggggcttattaaaaattaatgaagcctaattttggacgctttttactttattgatttagtcctgatatgataaaattatttgaaacttcgttttttttattagttttgactttgggtgatgtggatgatcaaaattgtgcaccaatcaccgattggattccaattacacccaacagattcggcttatgggagttccacatcgatgtgagaagctaa

SEQ ID NO: 80356 - DNA, 3404 bp, Heterodera glycines
  misc_feature (2803)..(2803): n is a, c, g, or t
  misc_feature (2830)..(2830): n is a, c, g, or t
  misc_feature (2890)..(2890): n is a, c, g, or t
  misc_feature (2905)..(2905): n is a, c, g, or t
  Genomic contig location: Contig_ID=SeqID_16002; Location=278..3681; Strand=-
  SCN-specific regions: Sequence locations=1-530,553-588,610-844,866 -1141,1163-1206,1274-1416,1438-1571,1602-1823,1849-1916,1948 -2016,2048-2233,2256-2640,2682-2858,2880-3011,3160-3222,3267 -3300,3327-3404
gacttatttctggttattggcagattaaaatggacgatggtcaagaataaacagcttttgttactgagtttggtttgcatgagttcacgtcatgccatttggcttttgtaatgcggtagcaactttccaacgcttcatgacccatttatttggagacaaattaaatgattcgtttttgtttatattgacgatgttcttgtggcatacgaaacgttcgaacaacatttagagcacttaaagtttgtttttgaggacataaatgaggctgggctaaaattaaaagtggctaagtgccaattcagcatcgaggaactccaatttttgggccatgttttaactcgcagcggaataaaaatggacgaaagtaaaaccgattttggacatgccgatgctaaaatcaaagaaggaactccattcatttttgggattcatgacctattataggatggttctatggctgcaccactatttaagctgctaaaaaaggacgtatcgtttaaaatggataacgccgaaattgctgcaatttcaaaattgaaaggaaaaattctgagttatgttgttctttatttttccgattttaaagctgctatggaagacctgacacgaaaatttttgattatgacggacgcaagtaagaccgggatatcagctgttctttgccagcctgatcaacaaaatcgcattcgaccaatatatttgcatcaagacaatgtaataaacacgaatcacgatacagtaccacagaattagaggctttggccgtcagattcggcgtgaaaaaatttgcacaatatattacaatgattccgacaagagtattaacagaccacaaagcattaattcctatgttcaaaagtaaaaacgagaccggtaatgcgcgcgttgacaaatggataatggaattaagctcacgttttattttggaaattgaatataatcccggcaaaacataattgcggatgttctttctcgttcgggcgcattaaaaccgaaagaaacagcagaaaataaaattgtgattggagaaatagtcattagaaatgaactgagctatgttggaaatgaggccgaaatttatttaaaaagaatatttcctttataaagctgataaaaattgattcttatgcaaaaaaaagacaaaataatttataaaaaataacctcgtcaccatttcaaaagttaaaattgatcttcacctttttgaaaaaaaatattatgaataaaacaaaaagtaatatattgaaattttttctttttaataaaataattagtagtaaaccatacgcctccgtagcaacctgacactaattagaagtgacaggtggctggagggcgggagtcaattagtgactaattgattgaccggatgggggggcactaattggtcagataattgtaggggtggagggggtcaaattaattaattattaaattgtgggagttcgaaacccaaacctattggaggttttcaaatttacatgtaattttgatggccgacatgaaaatttttgattgatcagtgatgtgacagctgctggatggagggggggggggggagcagatgctagaaataatgaaaaaattttttattaattaatgtgaatatggggtggtcccttaaacgatgaacggcagaaaagggaaaatgacgccgtcaataatcctttcccaccccctcttcgcttgaccccccaaaatgcaggagagggacgccaagccatcgattcactcataatttaatgcaatagcctcgccatttatcttttcatttatgtatttttcaacgttttttaatttgctatatttcttaattgtttatgttttaaatttaattaatttattatagaattcattcgctcttcaattttcattttatcaattcgatttcgactttttgtcttcaccaattacagtaaataatttaaaatttctttaaaaaattttcaacatttcccaaactaatttcagtcacgacgtgttcgaacgcattgctgcttaaagtgtttttgaaagtaaatttttttgaattaataataattaaaatccgatggtttcccaccgaactttcagcgttcatcaacacaatggtcaaattggttaactacgacgatgacgaaagcgacacccagcaaatttggcattcgaagaacgtccgttggtggaaaatgtgcagcaaaatgcgtgagtgaatgcgggtggggttggttcattttcaagaaaatttttacagttttgcatttttaaattattttagcgaagctgaacagatggaaaatgtggtggaaaatgcgtgagtgaggggaatgactttaactgattttgtcgacagttttcaaaaaattttaactgttccagtgaaactgaacaaatggtcctggtgatcccggacacaatttcagtggaaaatgcgttagttatggggggtgggagatagtcaaaattcttcgacgacacattataaaaataattcatttttaggctcgtgtcgatgctgaacgccacagggccattggatgagagttgcggcacaaatttggatgttcttccactcgagagtgttcgaccgaaacgccgagctgcattgcaggctcaaaaggcattgttaatgctggttgcgccaaaaaagtgagtcaaatcaatttaaataataatgaaaatattaattaatttttttatttgcagcagacgcagtttagcctcaacgccccaaccatccctctcaattttcacatacacaaatgatgctgcagatgatgtcaacgcaacaacgcagtcaacaaagtcccagctttccaacacntgcaccgaaaaggcgccgtgccgaatnggagagcgggtcatttttgaagtaagttttaagattttaaacaaagtcacatttactatntaataatttcagtcncaatgtttatcaattgggctttctcctgatggtgttgctacgcctacaaattcgcctcagccagctgcttcgtccgcttcttctgccgcttctgctcctctcattgcttcttcttcttctgctgctgcttcttctgctcctctcgttgcttcttcttcttctgctgctgcttcttctgctcctctcgttgcttcttcttcttctgctgctgcttcttctgctcctctcgttgcttcttcttcctccgtttcttcggttgtgtacaccgcgagacagaaacaacaccacggcaaaaaagagcgcgaagcaaaagtaagttttttttcatttaaattaatattactattatttaaaaataataggggcgcatgtttgtggatgcgccagtggggtcgttcggaaaaagggtttcaaaaaacccgaaaaagggtaaatatgaagttgctaaaattttggcaacttcaacatatcggtgccggggagaacaaaggagaatgtt

SEQ ID NO: 80357 - DNA, 449 bp, Heterodera glycines
  Genomic contig location: Contig_ID=SeqID_16005; Location=62..510; Strand=-
  SCN-specific regions: Sequence locations=1-449
gaaaaaatgtgcaaagagagtgaagagcccttcaaatttattcccgtctgctgctacgaagatgcgcaggttctttttttcaagaagcacagcgatttaagcatcgttccatgccgttaaggcgattcgtgcagttgcattccatcccagtggggggtatttcgctataggcactaactcgagaaatttgttaatatgccgatatcagtcttacgaacgtcgaacatcgcttaatgagtgaggtttaattgatttggtcattatgatttacgttagtcaatttgccaataatcagtgatttcctccatggatttgttcctcctccaactattctaatgagcagaagcaaacatcaccgcgggtctgtgtattgtgcagcatttaatcagactggcaatttgctcgcgactggctcaaatgacaaaaccattaaactgatggccatgcag

SEQ ID NO: 80358 - DNA, 2544 bp, Heterodera glycines
  misc_feature (2523)..(2523): n is a, c, g, or t
  misc_feature (2525)..(2525): n is a, c, g, or t
  Genomic contig location: Contig_ID=SeqID_16006; Location=272..2815; Strand=+
  SCN-specific regions: Sequence locations=1-18,63-318,344-403,435 -614,646-670,698-721,744-763,786-906,933-1066,1088-1164,1187 -1273,1339-1361,1412-1512,1535-1566,1660-1803,1849-1909,1932 -2042,2069-2544
atgggaaatgatgatgaagtttgtttgtttgtctttcaacaaattaaaaaatattatttgtagagctcgacattttgaaaaaaaacatgggacctggacttggattccatatttgccacgaaactggcttcctaaaaaaaacccaaaatccatgtcaaggaaaagcatggttttcttgggctggatccagggcctgtacctggatttcctaaacaaaaaaaacaggaaaatccaggccctagaacaacccaatctcgtcatgggctagatccaggcctaaatctgtttttttttgaaaattggttttaaaacgcaaacaaatatttaaaaataaattaattaacaaagaaaaatccatgcctcttggatccaggtccaagttgagctcaaatcatttgcttacaaattaaaaaatttatttatttattaatttaggccgaatcaagctcaagtagttctaatggaacgccccgtgacaatcattatgataatgaccataaacctctgatcaaggctgaaattgctgctgatctttttgtattgcttaatctcaagactcaactacaagtaagtaacaaaataatttcattcacaaattataaaataggcaatgcaaaaaaaaatttattttaattaacaaatttagttaacaaaaccataaaactcaatcaaaaattttaattttaattatatatttcaattgtaaatgaaatcattttgttttttgaacaaagaaaattttagattaaagatttttagcaagaaaaaaaataaataaattttaaggatcaattagggggtgtatttacgtttttttattgcttttatttaaaggatttattgccgaaagtactgaaaataggcaccaaaaatgacgaaaaagacataaaaatgggcgcataatccttaattattttataaaaaaaatatttgttttagatggattatatgacaaatgaaagtacaacaatggaattagtcaacgagttcaacaaaaaatatgccaattttgtgatggaattgccggacaatttgatgacaaaaggaaaatttgagaaaacattgcataaaattaatgaaaaattggagcaaattcaattcaaaaacgaaattgatattgttgcaaacaatttgttaattatggtaaaattagaaaacaaattcaaaaatggcattgaacaaattgaatgtggcgaaaatgtgtacgaagttgtccaatatcatctcgaaagagtgaattcggaactgtatcgccggtaaacagaaacaattgttttatttaataaatactatttaattagatttttaataaaaataatattggaaaaaaaattatttccttgcgaataacaactatattgtaaaaaaaaagtttttttttctaattaattaatatgattcaaaattatatgtaacttttcctggattctatatattttgggaatttgcacttttcgcgtatattttgtagttttctgaggattttttatagaaaattttggtggctttttgaaaatttatataaaaaatcaaaagcgatttttttgataaatatacacctaaaagtttattttaatgttaaatttttatttgaaataaaattttaaaaaatatttaatttatttaaaatttaaaataattatattctttataatttaagaaaacattacaaatacaaactattgctgttgtcaaaatggaatttgccaattagcacccaaaaattagtgaatgtgttcgattcaatccaaatcattctcactctttgtggctttatggatgaggttgcagtacatcaaggtcttaattatttaattcaataaaaattaattaatttaaaatttaaaagcagaatttcatttagatactcgatcaatgatcgcaaaaatgatggccgaactgaaggaagttgaaaaaagtttggcccaaaaattggaaattgatcagaagcttttggcgcaaatacaaagattggatcgaccaccaagtccttgggaatgccaggatgaaatgcagatgatggcgaggctcgttttaaggggaaaaaattttaaattaaaaaaaataagttatcccaactctcaaaaacctattttttactaaaatagaaaatctcgaaaattaaatttagcataattttcttatcatatttcattaaaatttccaaaaaaaaatttcagggcgcctaaaggacaccgccgaacaccttatgccttatttttttttgaaaatttgatttataaatggcaaaaattgtctttttcgatgcaccactaaaaattcctgcttttctccccggcgctgaaattttttgtaaaataataatttcattttaaacaattatcagccattttttttacttaaaataattaaagattggaccacaatgtgatgagtcatgaaaaaatttcgctgatttatttgcatgcatgtgcacttagactgaccacagaactcggcattttgatcaacgagttggaggaaattggcacagaatggacgagtgccgacgcaattgacgangntgttgaagtcggctgctga

SEQ ID NO: 80359 - DNA, 518 bp, Heterodera glycines
  Genomic contig location: Contig_ID=SeqID_16007; Location=571..1088; Strand=+
  SCN-specific regions: Sequence locations=1-112,134-267,289-290,312 -331,353-430,479-518
atggaactttccaagaatgatcagacgatgagaagcaatgtggtgcaacatgagggtccagcaatggaatccgttgcttatgaatcggacaatgaaattttaagacaggtaggtgtataaacaacttttgtaataaaaaaaagtgatcgtcaacaaaccccaataaatagcctgcacaagaattaccaagattttttgttttcgaacttttttagtaattaaatctgatatcattattagtagagctcgacatttttaaaaatgcctgtacctggacctggacctggattccatgttggacctggacctggatttcctggacaaaaatccaggtccaggaaaccaggctattcgggacctggattttttgaaactaattttaaaaatcaaaaaaaggtttgaaaaaatcaattaattgcttataaacctctaaaaatatctaattaataataataatgtgtttttaaatttatttaatctgtttttaaaacttgaaaaaacatcggtcacttgaaaaa

SEQ ID NO: 80360 - DNA, 1177 bp, Heterodera glycines
  Genomic contig location: Contig_ID=SeqID_2550; Location=4393..5569; Strand=-
  SCN-specific regions: Sequence locations=1-5,29-180,204-487,511 -851,873-1001,1023-1177
  Gene Ontology: Mol. function=GTPase activator activity; Biological process=signal transduction
gtgcaatttaccaaaagtttgggcagaccaccgaggaggagctgttcagcaacgactcctccaactgcgcggccttcgacgaatttctctccgtcatcggccaccgagttcagttgcgtcattttgacggttatcgtggcggactggacaccgttcatggacagacgggcaccgaggtacggtggggcagagtggggcgggcatacggtaccgtttgcttaatttcctttttcagtcggtgtacacacagtttcgccagaaggagatcatgtcagtttcaattaacaaataattagtattaaaaataggagagtgagaggaaaccaataaatccattttattgtgtatttcaaccaaaaacttaattgtccttttaattcggacatcccattagcccaattagctcttccccggcttcttcaggttccatgtgtccacccttttgccgtttaccattggcgacgcgcaacaattgcagcgcaagcggcacattggcaacgacatcgtggccattgttttccaagagcagaacacacccttctgtccggacatgatcgcgagcaagtacaaaaaagggcaacattcagtgcctaatttaattattttctttttttccaaagctttctccacgcctatttggtggttcatcccattgagccgggcactgaccgcacgcgttaccgcgtgtcgatgacagcgcgagacgacgtgccgttctttggcccgacgcttccgcgctcttccataatttggaagtgccaactgcgcgactttttgctcaccaaactgatcaatgcggaaaacgcggcttataaggcggaaaaatttgccaaattggcggtattatggcaattttcattttctgaaaattaatcaaaagtttgttcaggaacgcactcgggcatcgctgctggatggactgtactcaaatttgaaagagcgggcccaattttacggcatggcatttttggattcggtggacagcgcgacgaaacagcagcaacaggagaagcaccaccaccaatggcaaaacaacgggcaaaaaccatcaccagcacagccaacagcagcaactgatgaacggaggaacgaacccaacgttttgttttccattggcactgcgctcgttctgatgctcctcttattcaatgatcaaaagagcaaaacacatttttga

SEQ ID NO: 80361 - DNA, 1262 bp, Heterodera glycines
  misc_feature (1178)..(1178): n is a, c, g, or t
  Genomic contig location: Contig_ID=SeqID_2550; Location=1..1262; Strand=-
  SCN-specific regions: Sequence locations=1-135,157-658,680-831,863 -941,985-986,1009-1262
  Gene Ontology: Mol. function=tRNA isopentenyltransferase activity; Cellular component=mitochondrion; Biological process=tRNA processing
aaaagccttcaaccactttttataatttgtggctgtactgggacgggaaaaagtgatctcggcattgaattagcaaagcatttcaatggcgaagtaataaatgcggattcaatgcaaatttacaaaggtttgtctcgaatataatataaatcactaaatatgctatacgacaaggtcttgacatagcgacgaacaaagtgacaacggaagaaatgcaaggcgtaactcaccatttgatgagtttttgtgatccgtgtgagtccaattacaacgtccatcactaccgcaacgccgttttgccattgatagaaaggctatgggcgaatggcaaattgccaattattggtttgttctaatgcttaatctaagaaaattatgagtgctttctaattacgaattttttcatcatacatatagtgaacaaacagcagttttttttattagttggtggcactggttattatatggaagcagcaatttattatgacaatttggtacaaacaaacgcccaaaaatcaggtctttaataacattttgatgattcaaattgttgccatttcagacgacctaagaaatgagctgttacaaaaatttcccacctgcgacttattacacgaggaactcaagagagttgacccaatatcagcaggggaagtacacaaaaatgcaaagtttaaagtgctgcgagctttggaaatattttattcaactgggcaaacaaaaagcgaacaccataaaatgcaaagggaaggacaaggcaagcgaatgaactttcaattttatacaaaaatagcacatttatgaacaaatcgtacttttccgtttgggggtcacacattcaaagtttaaaaaagccaacaaagcgcatgtgaatattcaaaacagcgcttcagctttttaattcgaatgtgggcccgcaaacggaaacataccaccaaagcaattaatatttaaaaaaacaaaattcttatttttttttataaagcggaaataaatgtaatttttctttttacgagaaaaatcatacatctttttatgcatataaaccaattaagctgcgaattttcacttggctggccgtctccatacaaaaagcacattactcttcactttggacgccgacaaagaagtactaagccagcggttgaacagccgagttgacgacatgctcaagcggngcttaatcgaagaacttgactcattttacattgaggtaaaccaacaaattttaagaaactggtaacaaaaaataatcaaatgct

SEQ ID NO: 80362 - DNA, 395 bp, Heterodera glycines
  Genomic contig location: Contig_ID=SeqID_16009; Location=221..615; Strand=+
  SCN-specific regions: Sequence locations=1-217,240-277,301-331,353-395
atgccaaagaatatgtattacggttgtgcagcattgaaagtcgtagtcctcgacgcagcatgtgctcgccctcctccctgcttttcgtatgcagctcccccaaccgcagttgcatttctgttccagcatgtcacaggcgttggacacttgcacaacaagaggcggtgcctatgaaaacgacaatttttttttgttgaaaaattatgcataataaaatataaaattatcttttttgtgaatgtttcttaccggagttgttgttggggtctaaaagcagatatatataaaaattaaatttttgtacatttctcattttgtgtgccacatcgaataattctcattttaaaaataatcttttcgaagttaaatcttaataatacagataattgcttaaa

SEQ ID NO: 80363 - DNA, 1009 bp, Heterodera glycines
  misc_feature (616)..(616): n is a, c, g, or t
  misc_feature (844)..(844): n is a, c, g, or t
  Genomic contig location: Contig_ID=SeqID_16009; Location=633..1641; Strand=-
  SCN-specific regions: Sequence locations=1-86,108-138,167-1009
atggccccaagcctcaaacttttgatccaattcgccatcctgatcgccgcggcatcgcatgccatcttgggtaagtgaaaaaaaacaaaatttttaatatgacaaaagattttagagacaagaaagaaacttttttggaataaatttgaattaataaaaaattaatctgatctttgtcttaatatgtgtgttagttgattcggatctaatgtctcaaggccaaagccaatcccgtgcttggcgaaccagcatcccggaaaccaagggccagaacggaagcgaaaccgaagacgagcaagccgtttacgaatccgacgcaagccgaatcaccatcccggaaaccaaggaccagagcggaaccgaaaccgaagacgagcaagccgtttacgaatccgaagaaattcgaaccagcatcccggaaaccaacggccagagcggaaccgaaaccgaggccgaccgacccaataatagaaaaacggatttggcaaccaacggacaaagtgcagccaaaaccaacccagtggcaaaacaaatctgggaagagctgtttttggtccggggaaaacggcaggcattagacccatttactggtgttgcaatcgagattgggaaaggngctggaaatgcgttgcaatacatgcatggaaagattgtggatgggatcgcagtggtggtgaagaaggctgcctgcaagggaatccaaaaactttgttcgtcttgtggctatggtgcatgcatcgaacatcccgggtacacagctgacgccatctgttgctcaaacaactttgaacttaagtgctgtgaaaaagtaagaatctatttattatcggaacattatagcttntaatggcacaaatccaaaaagggctgaaaaatgggcaaaagtttacaaaaatcaaaaatccagcaaaaattgtgctattttgttaaattttaaaactgaaacatgaattttcggctttggttttggaatacacaaaagcgaatgttgcagaaaaatgggattaaa

SEQ ID NO: 80364 - DNA, 1080 bp, Heterodera glycines
  Genomic contig location: Contig_ID=SeqID_16011; Location=297..1376; Strand=-
  SCN-specific regions: Sequence locations=1-92,114-142,217-1080
  Gene Ontology: Mol. function=receptor activity; Cellular component =endoplasmic reticulum membrane; Biological process=calcium ion transport
atggtggacgaatatttggaaggcattcgacgccgggcacggcccggggagcccgtgctgagagaaagggcagaaaatgcgcatgaaaaccgattgacatttgaaattgtgaatttggcaaaggcaagggagactaatacgcaattaattgctttatcaatttcattaattagccaattaattaattgctttatcaatttcattaattagccaatttgctttcccttcaggcgctggcccactttggcttctacgatttccaggaattgttaaaattgtcacagaatttgttggtaattgtcgacagttgttctggcagagaacagcagcgatcattcagttaatgataaaacggaagcaaaatttggacgtaaaaatgggcactttcagataaaaacaccgatcgggcggaaggaacgcggtccaaactgatccggcaactcaccaaaaagttcagtcaacaactcgcgtacgaccgcgcgtccaccgccgatcccccgccgctccttcagtcgctgtccatttcgacccatcatccgctgctgaagcgcacatcggccaccggcaaagacttccgcgccgaaacggaggcggcggagagtttggcctgcgcgaagatgagccgtgagatggtgctgcagacgaagctgctggtggccgagctgcttcagttcatcatggatatccgacgcgactttcgcattaccaccgccctcgccttcttcaaacggcacttcccctgcggcgacagtggcgaattgtccgcctcggcaccacaaatagacgagcaattggtccagcgaatgtgccgtgccgtgttccgatggcaaaacggcgattccttcgagttggacatggacagggagcacggtcagcaactactgcgcatccttctccagatgaccatgagtgacttcgttccgcttaccagcctgtcgctgcaaattctctttcgccactttacccaatttcaagaattggtcgaagacatgggccaggtttggcgaaatgtgaatgtcaatgccaattttgaatgtttgatgaaaggtgcaactgctggtgtccaacaaggaagtgcag

SEQ ID NO: 80365 - DNA, 642 bp, Heterodera glycines
  Genomic contig location: Contig_ID=SeqID_16011; Location=2629..3270; Strand=+
  SCN-specific regions: Sequence locations=1-150,179-186,209-290,314 -387,409-593,615-642
atgcagtggattaaattcaactgcacgctttgcccgatcggtctgcattgtttttatccgcgcaagtacgcaaagcctgtgctttgtgcgcatcccagcgtccgtaacatcaccgactttttgagcaccgggcagcttgaggaagctgcaacgacagcaacaacaacaacaccatttccgacaactgccgtggtgtcggcggcggcggcagaatgcgcacctccgcccgcgcagctgaccgcatggatcgcggtgtgcactgcgctgctggcgcttttggtgattgctgaggtctgttaattttgggcatttatccgctaaacccctattcctcaattaagcttgtgcgcgccggattcaaagtgcgcaaatttttgaaggaccgcgccttcaaaaaagggatgctgcgccgccatcgccagcgtgagtttctcgctattacatttttagcaaattgtaattaacaatttatacaggaatgagcgccgctcgtcggaaccgccagccggcaagcgcaccgactccgctgatcttgccggctatgttggccggcgtttctctgcgcccgacgggcgtcaatttgactgtggaccgagggaaaatcccagaaaaaacatcaaaatggtcacaagtaaatcatga

SEQ ID NO: 80366 - DNA, 2608 bp, Heterodera glycines
  Genomic contig location: Contig_ID=SeqID_16013; Location=329..2936; Strand=+
  SCN-specific regions: Sequence locations=1-140,163-642,666-1788,1821 -1947,1988-2495,2517-2572,2594-2608
atgcagaaatatacattcatcaagtgcaagggttgtggaacgtcaaatatcccggtgagtacaaaattttcatatttaacgattaccagatgagcccaatcaccaaatctgatatcaccgattaccaattccctattcttctctaccacaacaacaaccactttgacggcatcaaaactctttcaaaatttttcaacaaaaagaactactgtctctcctgcgagtcgccgtactacaagaaaatcgagcactcattaaaatgtacttcactctgccacgggtgccgtgaggtgggcgttgactatccctgtgagccccaacaaggatacagcaaaaaatgtgagcactgtaacaacaccttttacaacaacagctgttatgagcgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgacgacgacgggatgaacccctgtacgaaatgtttcatccagcccctaaagcaacaacgaattaagtcatacaggatcatcgcatacgactttgaggcgacacaggacaagaaagtgggcaatcgtttcgaacacgaggtcaactttgcagcggctaccatcatctgcaccgactgcattatcaacagctactggaacaaatcacttcagggaaaaaagtgccaaatttgtggacctcaccgctcaattaccttttcaccttttgactacacggagacaacagtcgaccaaaaaatcatcactcaacaaccgctacgcgaattcgtccattggctcctttttgaccacaacaaaaagtttccaacagtcgcctttgcacactttgggggccgctacgacatgacgatgatcatcaaggaggttttagcgcaaggaattcacaacccggacatcatcaaacaaggaaatcgcctctacgagctgaaaatcagggaaaacgagcatggccccctcaccatttttcacgacagctacaacctaatgcccattaaattatctggcctcatcaaatcttttgggcttcatataaaagataaacaacactttccccatatgttcaacaaatcatcaaactacgataaggtcctccagcaccttcctccacgtgaagactattgccctaaccaaaagaagaaggcggatctgcagaaatttgacgactggtacagcaacaactatgaacaatgcttcgaccttaaagaaaaattacccgaatactgctgcaatgacgtccaaatcctcacccacgccctcgtcgaattacgccgggaattcaaacaactgacacaacggaacggaaaacacgggggaattgacattctttggcaagcaatgaccatagccagcgcctgcgtcaaaaattatgcactcaaccatttgaagccaaactcactcgccatcgtccctgaaaaaggctatactccacaacagaatcaaagtgcactggccatcaaatttcttgactggtactcccacatcaacaatgtcaacatccaaactgctcactcccggtacggcgaatatgtgtttaagcgtgaagggcaggtataccaagtggacggctacatcaaaggcacaaatgggaagcgggacaaaataatcgaggtgaatggttgtctgtggcacggttgtgaggagtgttttgatgacttggacgacgaaacgaggatgccgaacggaaagacgctgcgggagattagggaaagggaagagaagaaacatgaaatattgagcaggtacgtcgacttggaggttatttgggaacacgaaataaatgagaagctgaaaaaggacacagcaatgagggagtttttcgacaactggaaggaccgctcgccaatcaaaatcagagacgcttttcatggaggacggactggaccaatgaaactactccacacagctaagccgggacaaaaaatcagctacaaggacttcaccagcctctacccgtggaccaatttctctacagactatcccctcggccaccctaaaatcatcagtatcccaccaaatgagcagacggtcaactggagctctccatccgacaacccctacaaaggtctgctcaaagtgctacttctacctccaaacaacaacatcaacgtcactgttatgcccataaaatttgatcaacgcctcctcttccctctctgtgagaagtgcgccaaatacatcacagcaaaatatcccaatggcctcaaagacaacgactattcctgtccccactttaaccctaacgaccgggccttcgtgtccacttgcacccatcttgagttaaacgcagcattggaggccggctacacagtccgcaaagtcttccacgtcctccaatacgaccaatggagtaacaatgtcttcaagtcttacgtgagtgaaatgatggccctgaagatccacgcaaccggcttcccgtcatggtgcagcagcgaagaggagaagagtgaatacattgaggagtgctggatgaaatttggaattcatctggagaaggagaagatgaaagctgaaccggggaagcg

SEQ ID NO: 80367 - DNA, 934 bp, Heterodera glycines
  Genomic contig location: Contig_ID=SeqID_16016; Location=1054..1987; Strand=-
  SCN-specific regions: Sequence locations=1-53,77-437,460-691,737 -842,864-934
catttcaatcactgggactcaacccaccagcatttcaatcactgggactcaacccaccagcattccaatcactggcactcaacccaccagcatttcaatcactggcactcaattctcctgcatttcaatcactgggacaacccaccaacatttcaatcactgggactcaacccaccagcatttcaatcactgggactcaacccaccaacatttcaatcacgggactcaacccaccaacatttcaatcacgggactcaacccaccaacatttcaatcactgggactcaactcaccaacatttcaatcactggcactcaattctcctgcatttcaatcattgggacaacccaccaacatttcaatcactgggactcaacccaccagcattccaattgccgggactcaatccaccagcattccaatcgtcgggactcaacccaccagcattccaatcactgggactcaacccaccagcattccaatcattcaacattcgaatcaccggcacgcaatctcaccaattattcggcatcactatcataagaactcaatatcattacttcaagttcttccctaatacgtttttatcttaatattagcaaggtacgcgatgtggctcggcagtttaacggcctcattttcagtcatcttactctccatttgggactctcttcaagcttcagcacttattattttaaaacaaacaacagaaaacaaattaaaataacaaatgcaaataataattttaaactatttcttctgcgctttgtgagaaacaaaagtcatgtcatcgctctttcttttcacaggcgtagtaagacaagaaacatcaagaacgactttacaattgcaaacaacaacatccgacgaaagcacatgaatctgcatagcctcatctaagcaacaaaacaaacgtcaaataggaaaaaataaa

SEQ ID NO: 80368 - DNA, 603 bp, Heterodera glycines
  Genomic contig location: Contig_ID=SeqID_16018; Location=605..1207; Strand=+
  SCN-specific regions: Sequence locations=1-90,114-243,276-603
atgccatttggccattggctccctcagggaatggcctttccccgtccaattggccgcagttcggccccatttgtgggcctggggtgccgacaaagagcagtcagtgctcttccgttggttcggcgtcggccttttctcttcgctttccatgccaattatttcgcccggttttccccaacaaaatgccggctttaacatcaattttcacacagcaaagatcatacagaaagcgatgcacgaaggtcattcattcattcaaacattatgaattgttttgaaattaaattgcattttcagcattggcacaattggggggaaacccgtcggtacataattgggaaaagctgcttcagaagagggcattcagcgacatggtataagctagcagaaataggacgaacttcacactttgagcgaaaggattttcagttttcggcatttttggaaaggattttaattgtatttgtggtgaattaatttttgttttcctaaattttttgaaattgttatttcaattttgtcatcctaaaattcattccttggagggttgaataacgttctttcaaatattataaagagatcgcctctttccctgaaccccaa

SEQ ID NO: 80369 - DNA, 593 bp, Heterodera glycines
  Genomic contig location: Contig_ID=SeqID_16018; Location=1487..2079; Strand=-
  SCN-specific regions: Sequence locations=1-70,92-406,428-593
atgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgatttttttttgcgtaaatacacttggtttttccaatttttagcacatatttttgcattttttaacacatatttaggccttttttttggtttttagcacatattttgggtttttttagcacatattttattacatatttcaggatttttagcacataaaaattccagccctagtaatatgcgaatattttttgttgtgccactccttcatctccgcgctagtgaaatttgtggataaaaaggaaatgacaaatatgaattcgacatttacggttcggtacatgcaataaatttctcaaaaatcgctaaatttgctgatttttcatttttttgtgcctattttggtgcttttttgatgggtttttggtgcctaagctgtttttttgaattcgagaaatgtccattttataaataataaa

SEQ ID NO: 80370 - DNA, 883 bp, Heterodera glycines
  Genomic contig location: Contig_ID=SeqID_16019; Location=143..1025; Strand=+
  SCN-specific regions: Sequence locations=1-307,329-684,709-883
atggacgtgttcaatcggttgctccctcggccgggcaatggcaatgttcagttcaaaaaactcagacatacgtcaaattccgccagcattttcgcatctgacgaagcgacgggtgacaaacagcacaacgacgaaacaacgaacaacggaatgatgccggcgacgaattcgccacgggttgaactcggattgatgctgagcaacatcagtgctgaaatgcgacacgggcaaaacagcgcaactgaaggaaacggaaaagcgaatgggacggggtgagaggaaatgaatgaatgaccaataaatatgaaataaaatgacaaaaaaggaatgcattattataataaatgaacaaaatgttatgacaataaaaaaaaggaaagaaaacgaagcccaattcatagtcggacgacaaccaactcgtaacaatgagtttgatttttgcaggaagcagaataaaagctttgtggaagaaaaggccaatggaaacggaccgtcgtcagaagtgaccgctttaagcaaagggaaaagcaacggaacggccaaaggcggcggaaaacgctttctctctgcgcttttgccgggaaagagaaagggacgacttggcctttcagtttcggagcctcgactaaattttgacatcgaaccgtccaaaaatgactttgagttcggcatttattctgagagcacatttcattctttcttttttaagacccacggaaatcgaagggggagaaaatgcgaaaggaggacaaattgcggaccatcaacagaattttggggagaggaaccgattatgcgatggcatttcggacggaagtcgcaaaagtcggccgaattttgcaggggcacttcaaaaggtggcattttggagaatacgctttag

SEQ ID NO: 80371 - DNA, 1114 bp, Heterodera glycines
  Genomic contig location: Contig_ID=SeqID_2551; Location=157..1270; Strand=-
  SCN-specific regions: Sequence locations=1-733,756-1044,1067-1114
atgccaattgaaccatttgaattggtgaacgaagtgacaaatgagaagctgacactgacgaaggatgaaaatggcactggtgaattcaattggctgttggagagatgcccaattattggggagactgcggcggcggttcagaaacagcagcagaagaaggacgaaaattcggatgccaatttgaacaaagtgttcttccgcctttacgatgacattgggtgagcagaaaggaggccttttttgtatgaaacacggatagggaacggtatcccatgtacagtactttcccagaatcttggcagggccatgggttctgttaagacagaacttcagtccttgttttgtcttttttgctctggtccatcccgaaaaccctgctggtccgggtttttgcaataattacgggctgtacttgcgaaaaagttatccgattcaaattgcgcttaatttaggccgctgtctccgccaggtcaaagcaatgaaaaagtgttctctttttccgggtccagtgatcagcggaagaagaaaaagtgatcattttgggaaatggccgatcattatcgagttatgaagaattggattgattgatgatgttttgtttgctctttgaattgttcaatttgacgctgacattttttgctattaaaaaattgaaaatttggcacttttttggtacttgtgggttttgtgtcaacaaaatttttctcttttaaagtctcgggattttatagaggcaagaaaagaacaaataccaagcattcataaaaaaatacaatgagaaaacacgaaattcaactttgttttccgagtgtatttgcgaattattttttccaatagccttaggtaaaaatttaaaaaaaacaattcttagactttaagcttatcaatagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaa

SEQ ID NO: 80372 - DNA, 59 bp, Heterodera glycines; identical to SEQ ID NO: 58131
  Genomic contig location: Contig_ID=SeqID_2551; Location=1896..1954; Strand=-
  SCN-specific regions: Sequence locations=1-59

SEQ ID NO: 80373 - DNA, 299 bp, Heterodera glycines
  Genomic contig location: Contig_ID=SeqID_2551; Location=1352..1650; Strand=-
  SCN-specific regions: Sequence locations=1-17,41-107,129-299
atgaatcgacggtaaggaattttttaaaattacaaaattttcatttacccatacatttttttacgaatctcagttggctttgtagcgacgtgtggatggacattatgccatcgtttgaccatgctcaactcggcctcaaaatggcattgctttccgaccgtttcgatgttttggtggacaaacatttcgatggcaaaagcgaattgacaatttggagaacaatcacaattcgcaaggacgaaggaccaaaagcgaaactgtctgttctgatcgattctgttccccgatggaattgctga

SEQ ID NO: 80374 - DNA, 384 bp, Heterodera glycines
  Genomic contig location: Contig_ID=SeqID_2551; Location=2069..2452; Strand=-
  SCN-specific regions: Sequence locations=1-305,329-384
atgggtaaggccaaggcaaccgatgcagaaattaggtttcctaaatttttttgtatatattttttgaattttggtcaaaattttaacatttttgatcgcaaaacgacggaattgttcaaattttatttattgttaacccaactcaaattcctatttttacaaatttaaaaaatttagataagtttcaaaaaagttatggccaaaaatgtgtaaaaactggttgtttgtgtgcttttggccataattttgctcaaacttggccaaattttttgaaatttagatgagcaaatagaaaatgttatgcttttgaataataccaaatttttaatttggttcacgttgacccaacttatgaccagttttttgttgaaaatttccatttga

SEQ ID NO: 80375 - DNA, 450 bp, Heterodera glycines
  Genomic contig location: Contig_ID=SeqID_2552; Location=65..514; Strand=-
  SCN-specific regions: Sequence locations=1-38,61-175,204-450
atgattgccattttcttcgtccatttgttttttattggcattcaaggaactgaagaagacttattcgcagatttatggaaaaacctgatacccatgaagcaacaaaagttagcaaaaaattacgaaagaaacttaaaacgcgaaaattggattcatcaaaatatccgtaatgctgataaaaatttattaaaaacaagcttaaaagctgaagatgttagcagtgagcgtcaaaatgaagaagatattaagccaaaaatattagaagaaatcaaaaaagagacattttcggacgaagaacaaaatgcaatgaatgtaaggacaaaattaaagtttccaaaaaaagaaatatacgacgaaatgatcagtgatggcattgacgagaaacaagccggtgatcagagcaattcgtgttcttcaaaaactgacgatttgggtcactcttctgattcg

SEQ ID NO: 80376 - DNA, 755 bp, Heterodera glycines
  Genomic contig location: Contig_ID=SeqID_2552; Location=2189..2943; Strand=-
  SCN-specific regions: Sequence locations=1-135,157-437,459-527,554 -614,641-755
cccttaatgaaattgtgccagaaggccctgagatgaatgatgattataacgaagaagagggaaaagcagtcagtttatatgagaaaatgactttttaattgacaagaagcattttccactattatgcaagacaataaaaaataggtaatttttcattgcttgaggacaaattgacaaagcgaagcatttgagggacaattataaatttaatggcagcctcatttttgttaatgagaaaatgagagagtggtcgaaggaaaaagtgggtcaaaggaacataatttgatgaaaatagatagggcaaaaaacctttgtaaaattgaccattttacattttgaaaaggaattgccaaaaaatgaaaaaggcccgacaaaatttataaaactaaaaaaattaagacaaaagtgtttaaatattatttgcctttttatccctattttgttttttgcatcatcaggagaccggaaatattaaattttctgatcccgctgctagattggtgcagtattgaaattccgaaaaactcataattgaaataaaaagttctccaaaattaagtaaccaataatttgagtcgtgggggaggagggcccgttggtgcctataggcaccaccaggaaaatgagaagaaaaaagaggtgtgtgggcggtgccgagaggcgacactggggaaaccttgaatcccgtacaaaaaccaaattttcagatcctgttgcgggattgggattccaaaaatcaggaaacaagtcaataa

SEQ ID NO: 80377 - DNA, 904 bp, Heterodera glycines
  Genomic contig location: Contig_ID=SeqID_16021; Location=215..1118; Strand=+
  SCN-specific regions: Sequence locations=1-197,227-369,393-464,520 -857,879-904
atgaaatgtccttcaaacgataaattctatccaatttatgagccattagtaagtcgtttttcaactcaagaaggtgaccgtgctgagctgtgtacggaggaactccccgctgatgaagaatgcccggaaggtttccaaattggcatttcgatgttgaacggacaaaaagaagactttacatggcagacttgggtattacattaaataaaaataaattttgaaaaaacagcttattaatatgacaaagttgattccttaggattacaagttttgcaactaattaaccttaattaatcaataaaaaaaagttttggtaaactgaagagtaaatgaattttctcattcatttaattaggaaaatatttttgcttaaatgatactgaaaatttgtacggtcgatttgaaaatttatgccaaatttattcatgcagaattaaagcaaattgtttaaaaaacaacacctgaatatttaaaaatttatgcataaaattattaaaaaactaaaataattcttatatagggcgcattttgggtgaataacatcaaatttggagagaataacgttatgtataaaaaagtagaatttggcgttcatttcaagctggatatatccccaaaattaaatgaatcttcgaatattgtctaccgagtgaatgtatattgcgctgacaacggcaatttggagttcaaaacattcacaaaatctgagacagatgtggtgttcagttccaattacaaaacctacgagcaaattggggcagaatatgtgccttccagctcagaggggaaaaaatgtaaaaaatatcaagtcaaagtttggccgagcaatgagaaacggttgagttacataaaagagaagcaagaagtgggaaatgcggtaacaaattccatttgttatacataa

SEQ ID NO: 80378 - DNA, 388 bp, Heterodera glycines
  Genomic contig location: Contig_ID=SeqID_16022; Location=998..1385; Strand=+
  SCN-specific regions: Sequence locations=1-359,381-388
atgaaaaattttgggctatgtaattatttactgaaaaaggccccgttggtggtttttatgaacaacttagtatcttatttattgttaaagctttcatgagaactacatttagctcttggaacccgagtttgtcgcaagcggtgtgattacaaatggcaaattatataacaatgttaaattcccggttcacttcaatttgatcattgagccgtcgttggaccatgaggcagaaccaatttattacgtaaaagtaaaatgcaatggcaaagaatcgaacacattcaaaacatttactcacggcaacacgaaagttgtgttgaatgtgaaaggttgtacaaaatttgacatatcagtgagcaaaatggacagagaaagtgaaagccccgag

SEQ ID NO: 80379 - DNA, 1649 bp, Heterodera glycines
  Genomic contig location: Contig_ID=SeqID_16023; Location=122..1770; Strand=+
  SCN-specific regions: Sequence locations=1-520,542-723,745-962,984 -1283,1307-1505,1527-1649
  Gene Ontology: Mol. function=transcriptional repressor activity; Cellular component=nucleus; Biological process=regulation of transcription from Pol II promoter
atgccgtcaatttcggctgcaatgattgccgctgcctcagcgtcaacccaatttcctccggcgacactgtcaaaatgtaagacacattaaggtatttgctgatttttcatgtcttttaagggcactccattgttacgcctccttcttcgttggcccagggaggggcactcgaggagtttctccgtcatggtctcctggcaccgcaggcttcgtcgtttgcgccttcttcgggcagaggagcagaaagtgtcgggacgagcgcaatggctgctccaacgtcatttgatgaactgtttcaacctaaaatgtccaacacttcttcgtcccctcggacctttccactgaatcagccacaaatgcaccagcaaatactagcgaatgtcccacagagaaatgccacgggcacaaacatttcacatcagcaacaggtggaacggatcaattgtagcacgggaacaaccccaggcatttgtctgacaatgagagggtgccggaaaaccaagcagtctatttccggtactattgcatttgttttttgtttagcaacggcagcaaacacaacaaatttctggggcgtctgcattaaataaacaaatgcacacggaccatcaacaccggcaaccccatcaagcagtgcaacaacacgcaatgttggggcaagctgcagagaaacagcaaattccgcagcaaatgcaacaacaaattctgcaaaatccggttcatcaacaacagatgcagcaacagccccaaattcagcaacatcaattggcccacaacagccgcattttgttcacacaaatgtgccgcttcagccatcgccgcaacacattttgcccattgctgaaccgcaacaacaccaagaacaagtgcaacagttagcgcagcagaaaatggtgaagaagcaaagcagcgcaaatgtgagcgggattattgggcgagggaagcaaaagaattgcattaaatgtcaaaatttaacagaaatacccagtgctgtggcaaggacaattggcaatgaaaaacgcggacacgctcgtccaaatgcttaaggtgtttagttgggtggaatggccttttgaatctccaaagttcacaggtctgtggcaatgaatcgctcgtccaacaaatgaacgccgaactttcctcggtcaacgaaaacggaattcccctcctgcgcattaaccaacggatgcgattggagcacactcatttggaaagtgagaatagctatcaaaatgggatcggtttaaaaaaacctaattgtcccctactgttagatttaatccgaaaaatggagagggaggacaaccaattggcgctgatttgtgttccttgcggccgggacagagaggacgtggtcatccaaacacagaaaatgaacatctcgttcatcgagtacttcagttcgaagagtgccgccggcattgtcagctcgggccccgtgagttcaattgttgcatttatcatttgactggaagaacgacccatcaataatagactcaacagccaagcgcaatggtggcacacatttttccgcccagtgatttcagtcggatgctcctgtcgcgaaatgcgccgaaccttttgaggacggtggagagtctcaacgcgggatacctctttgtgatactaaccaacaaatagagcactga

SEQ ID NO: 80380 - DNA, 106 bp, Heterodera glycines
  Genomic contig location: Contig_ID=SeqID_16024; Location=538..643; Strand=+
  SCN-specific regions: Sequence locations=1-106
atttatgagccacccaatttggcaaatcggtctttttaaacgcattaaagaagatttcagtcgattgcttggagtgtaagcaaaaaaacgctattaatttttcatc

SEQ ID NO: 80381 - DNA, 77 bp, Heterodera glycines; identical to SEQ ID NO: 59738
  Genomic contig location: Contig_ID=SeqID_16025; Location=611..687; Strand=+
  SCN-specific regions: Sequence locations=1-77

SEQ ID NO: 80382 - DNA, 899 bp, Heterodera glycines
  misc_feature (50)..(50): n is a, c, g, or t
  misc_feature (67)..(67): n is a, c, g, or t
  Genomic contig location: Contig_ID=SeqID_16026; Location=1098..1996; Strand=-
  SCN-specific regions: Sequence locations=1-249,273-492,514-593,656 -804,826-899
atggctttcgaacgtattcgacatggcggcgataacaccagagaggcggnaagaacgaataagacanatgcggggagggcgtctaccagggatgggccgaggtttcgcttttcgcatttcgcattttcgcatattttggcttttcgcatttcgctttttttttcatttcgcatttttcagtttcgcaaatttcgcttttcgcatttcgctttttatttttcaatttggcccatccctggcgtctaccgctctgccttcaaatatgatgccttatgttgggaccatactcaacgctaagttcatctactcaaagcaaataagcatcaaggtccaagaatcgaatgattactatgcgataatttcccgattagcaaagctaccttttaagatggataatactgcgtatgcatcggcgcgtctttagtgaaccgacagatgcttaagttttcggaaattatgcattatcggtctcggattttgttatgtttttagaaaaaataattatattgacagtgcagcggtcaaactcatgtccttctgcgtccccttgtttccaaactatgatacggatagctactaactctttaactaacattaatttttgtaaaaaaatttaatttttaaaattattcaattttttatatttcaaaaaatagtgctcagtgatcattagggatgcgatttttaggtgctaaaaactgccaaaataggtaggttttaagttataaaaaaaccccaaaataggtgctaaaaatgggaaaataggtgccaaaaagtttcgaatttaggggtgtaaaatcgaaaattttcttcaaaaggcaaaaatattacgccaaatcattaatgagatacataattttcaaaatcaacaattctcgtcaaaaaattaaacaaataaa

SEQ ID NO: 80383 - DNA, 76 bp, Heterodera glycines; identical to SEQ ID NO: 59914
  Genomic contig location: Contig_ID=SeqID_16026; Location=772..847; Strand=+
  SCN-specific regions: Sequence locations=1-76

SEQ ID NO: 80384 - DNA, 793 bp, Heterodera glycines
  Genomic contig location: Contig_ID=SeqID_16027; Location=1796..2588; Strand=+
  SCN-specific regions: Sequence locations=1-418,455-603,626-719,742-793
atggtgagacaacggcggaacagacgaagaagggcgaaagggaattgacagcacgcgaaaagcgttttgacacgacaaaacacggggtagggaaatgcgtaaaatttgatgaaaatgaattggaaaacgaattttaaatcgaattattaaaagagaaaaatgcaaaaatgttttttttttaaattgggcatcaaatttattggagagagacttcacccattagactgcaatatcctaattaataatagcaattagtgacctaaaatttgttgtttttgatgttttgtctctccgcccgtcccggaattttttttaacttttttttctatcataattttctgcgctgaatacgaatccgagtttgtttccacgtgtggctcttttctatagcatgggagcagatcgtttcctgctccggaaatttagaaaaataaaattttatttaaaaaaattagatggagaaaaagacaggggaatgaattgcgcccctttggcatgacaattctcttttatcctacgctataatatgacaaaatgattagcgttttgttgtggaaatattaattcccaactcctccatcaccttaaattttttaatattcgggttttcccttttccaggtccccgactttcgccacgttgccgtcaccgatcagatacaaacgaagcgaagcgtttggcaagttccggtggccccacttggaatagtggcaaccgtgtaaaatttattttaaaaaatttcatgaaaatagtgaattttttgcaaaaaatcaacgaaacaatttttagaata

SEQ ID NO: 80385 - DNA, 320 bp, Heterodera glycines
  Genomic contig location: Contig_ID=SeqID_16027; Location=309..628; Strand=+
  SCN-specific regions: Sequence locations=1-320
atgaacacaacggcagcagtgccaatggcacaaaatttccgccttttttgccaccaaacgccaccatccgtcaattcggacggttccgaggcgaaacggcgccaaataaatgagccaccaaaggaggggtccggcggaggtatttttaatcaaaatcatgaaattggacactaattttttcaatttgttcagctccatccctttccgtcgacccgttcggctgggagccgaccaaatgggaacgctttttcctcgtgttgacgcggtgttacgagcgcagtgccgacattcccgcaattattccgttggtggtgcaatga

SEQ ID NO: 80386 - DNA, 570 bp, Heterodera glycines
  Genomic contig location: Contig_ID=SeqID_16029; Location=299..868; Strand=+
  SCN-specific regions: Sequence locations=1-217,239-287,310-331,375 -397,419-570
atgaaaacgatcgcactctttgcccttttaccgctaattgaaatactgctgatcgccatggtcaaccaatgtttatgtatgtttaaaccaaaattaccagcttctaatttaataattaagcattgacgtgcaaaatagactctttcattgaaattaaataaaaaagtacagtacacagacaaaacaacttacaaaaacaaagtcccacaaatccaaatgataaaacacagcattttaattcattactgttcgttcgtacattgaaaagggggaggggtgatttaatcaaattacaaataattcattttcttcggtcatcagcattttactctaaaatttttgaataatttttatattttttaattacattttttctgggtgatttgattgggaaaaattatgctttattcatttaattgaaaatcatataatttttaggcattgattgccgcagtggttacttctttggtaacggttacggtcgaactgaatccatggaatgcgctgggggaaaagactgctttgcggccaaatgccacaatggttcctttttatattaatttcatttaa

SEQ ID NO: 80387 - DNA, 332 bp, Heterodera glycines
  Genomic contig location: Contig_ID=SeqID_16029; Location=1243..1574; Strand=+
  SCN-specific regions: Sequence locations=1-125,147-187,209-277,328-332
atgttgaaacctaacctttgggctcggtcgataaatggcaccagtgagtaaaactaaatttattatttaaagattaagtatgccacttaaataaaaatttaaacataattaatgacaattaacaaacaatgaaaattttcaaaattttcaggtgtttttttaaaacagataaaatcgttttcagatgagtcaatcccaacaggtgactccattgcgctgcttccctcgctgcttcccattgtcattatggcgctatttggtcactttgttaaaactcattaaaatattttaaaaaaatttttgatttaaagcatttaatttaaataacatta

SEQ ID NO: 80388 - DNA, 363 bp, Heterodera glycines
  Genomic contig location: Contig_ID=SeqID_16029; Location=1642..2004; Strand=-
  SCN-specific regions: Sequence locations=1-157,192-273,295-296,318-363
atgtgtatgtttccatattttggcatttttccgaaaaaggtaggagttaaaaaatcatatcttgatttaacaaataatatgattttcagataaagatgggatttattctttccaacataatttagttgatgaagttgttgcatagtttaatttcaatggaaaagcacagatttttgaaacataatgttttttgcgttattggtcattattcccatcatttgcgacgcccaattgcaacttgcaccagttagttgtacgctcaacgcaattatctttttaatttcaaaaatcacaacaatttaaaattttaaaaaatacccgaacaacacacggaaaagcgaagctgtggaaagaaagaataaa

SEQ ID NO: 80389 - DNA, 758 bp, Heterodera glycines
  Genomic contig location: Contig_ID=SeqID_16030; Location=20..777; Strand=-
  SCN-specific regions: Sequence locations=1-415,467-616,639-758
atgagtgatcattcgtcggacgattcaagcggggctgagggtggcgacattcaggtgctcgcaactcacaacagcacaatttttttcgtattttcggataaaaccttgacaaaaaatattatctcttgagaccgggtgggcccggagggtccggcgaatttttactgggccgcccggtcccgtatttttttttttggtaaacccaggcccgctaaattacctaagctcggtccctggttgttttgaacgggcgtaaatttcacaactaacttgacttatatttgaaaattataattttttgccatagtatcattactgcaaaagcttttttgtcctgtttcttccgtcccggtccattttccaaattcccgtgcccggccccattggtttcaaagttcctatatctaattctctcaaattttcaaataaataaataacatataaaaataaatatattttttaaaaacatcctaggattgcagtttttaacttcactcactagttttaaacaatccaggtgacgacttttatggccgacgttgtgtgcagtttgccaacagttccgatagagggagagcaaaaaatgtcgtattacacagtgcttttatatttcggaaacaataacaatgactgtcgtcattgggtttcaacaattgtgagtttaaatgggtatataaaaattcgctgttgattcgccaacattttcatgcgatttgtcacgggcgacgtttttttcgtgctatcaaatgataaataaa

SEQ ID NO: 80390 - DNA, 1039 bp, Heterodera glycines
  Genomic contig location: Contig_ID=SeqID_16031; Location=9..1047; Strand=-
  SCN-specific regions: Sequence locations=1-64,86-165,209-266,288 -717,739-986,1008-1039
atggtgagataagcgcaaaaaacacattttcttcgatcaatttcgatttagagcgactttttagcaactattttcaactatttttgcttatgaaactttttaaacaactattttgacttgtgaaattaaaaaaaaactatttttcaactatttctgcttttcaacaaaaaaaattattatgaaaaatgcaataaaaaataaataaaatgcacctctaagaagcgacgttaattttttcaaaaaatgcacccccccccaagaatctgtttttcaaaaagcaaaaattctggccatgatttggcggacgatcgaaaaatttttacgcttgaaaattttcaaatgtgttgatttacaattgtgcaaccaaaaaggataaagatgagaaattttgcaaaattcacaaatttattggcatgctttccaatttttggcaactttttagcaactattttggagtttttcagtttttagcaactattttggcagttttttagcaactatttaggtacctatttcgcgttttttagcacctaaaattccgttccctgataataattatttcataaaatattgggcataatgaatgactcttgaaaatttcagagtcgcgggattaatcccataaaatccttcattttcaaaatacgcggaattgcggattggggcccggcaaaatcacgcgcggggatcccgtttcgctacgggctcgagatacggtgattctcatttcaaaaccatcaaaaatctcggaattatcatatgattttaacattttatacttatcgggaacgtaaacccaaaatacattgaaagaaatgattaaaatattgtcttaaattactgcgttttagtcgttcataatcatatgtgctcattttgaaattggccatgtgctcccgctcaatttgacgaaaaagtttaactgcttgcacataaaattcagcctcttgatttgttggcattggacaaagagtgtaaagtctggtcttcagtttctgttaaaaatgtttgcccaagagatttgccaaatattaattga

SEQ ID NO: 80391 - DNA, 1305 bp, Heterodera glycines
  Genomic contig location: Contig_ID=SeqID_16031; Location=1558..2862; Strand=+
  SCN-specific regions: Sequence locations=1-96,118-376,398-509,532 -561,583-733,755-1163,1185-1305
atgtcaacaaatgaatttatgctgcaaaaatttaaaacaagtaattaatacaggggcagggctcggattctttctttctttcaatgggcatcctttattttggttttaatccttttgaaattttgaccgtcctttatttcaaagatgcccttttatatcggcatttttccccattcccagacagctcctatcggcaccgccggacacttccatttgtcaaaaaatttttgaagaactttctcatgaataagtgatcggtcctttgaaaagggaatttggcggatccgagtcccgaagcaaaatttatttgcatttgaaaatatattatgctttacctttacagttgccggagacaatttaagcactactcgtattgaaaaagagcttcataaattgcgcattgggcctgaacaggggtacggacataaattacaaatttaacacttcgattatgccaactgtatagattgtatattatgttgcggtattcattattggatgcagactcgtaaaaaataccataataaaaattcaaatatgggcagaatccatccctgaagcttaaaataaattttttaaaaacaaccctcataatccgcgggggaaatatggttttccataatttaatgccttaataatttttattgcacataattcttgggattcacgaaattggaaaaacaaaataattgaggtcatcataaacattcctttattgtatcaaattttttggtcgaaaattaaggtgttggcttaaaaccgcaattgagggaaatgaatggctccgtgctgaacttttacgttttgccgattttgcacgacaagaccttttgaaaacggtaaaaagaaattcgaacatatgtgacagctctgtaaaaaacagctattctatctaagttttaatgataacacacttaaattcaccttagcgtgttaattatttattgataaatctttagacactcattgccacacaatgtgccaatataaccaacaatggcaacatgacagagatcgaaaaagaaatgaaagcaatcgaaacgctactgggggaaatttctcatcatatggcagattggattgaagaaaagcttgtaagtattgagaaataatgaaatgtgacttctgacctttttggggtcggaattcaatttttggataaccaaaataccaactttgaaaatttttgggtctggatttccaagttccaaaaattttgagcgttggaattctatggtactcatggttatgtttatggacaaatgctaaaccgagacaaattattgtactttttcttggatgaaa

SEQ ID NO: 80392 - DNA, 1879 bp, Heterodera glycines
  Genomic contig location: Contig_ID=SeqID_16032; Location=38..1916; Strand=-
  SCN-specific regions: Sequence locations=1-109,140-268,297-583,620 -857,905-1006,1028-1277,1334-1597,1627-1879
gtccgtctttcgccgtcaatttcgccgtctccgccgccccaaaaaaagccaacgaaagtggccaggcaattaaccttcgccagctcagatcgcacgcggacatcgaagtggatgacgaggaggaggagaagaagaacagacggcccgacgggagaagacgcaaagtgccaaaagtggtgagaaaccagcaaaattccaaaaaatttatcaaaaaatatatttttcccattcgttcgtcgtgaggggggggggggggggtcgaagcgaagcgggaaagagaaaaaattttaaaatttgaacaaaccccttagcaaaattcatttaaaatttcaaaaaaatttccccagcggtgcgtaaaaatcctaatttttcttataaaaaaatacgctcaaaaaattgcaaaattggttatttattggacaaaatctattaataaatcgcaataagatttcggcccgagataatttccgttatttttcagccccgccgttgtgataaatgcccgatggaattcgacgaagtgtggaagcttgaacgccattacagtacacattctgacttcaaacaattcaaagtaagtatctaaaaaatgtttattttcaaatataacaattaatttttaagtgtgaattgtgtccacatcgaacgcatcaaaaagcctacttgaagcgccacatgagccttcatcgctacggggaaaaggtgattctttattttcatggaaaatgacaagggctgatgatttgaatgcgattattatgggttttcaacaatattttttaaacaaatgtacaaatgctaaagtattttagaaatttcaagggaaataatgggcagggtgggataaatgttatggctaattaataaattaatttatatataaaaaaatattttatctttaaatgccttttcagtgtcgattttgtggggccccaattgtgccacaatggttcaaacatcatgagaagacttgtggtaagaatctctgcttatgaatttatttattctccttttcgcttttatgtatttgtaattaatgaaaagaggttttgcgtatttgaaaaggaccaatatctttccagctgctgggaccaatgccggtgctgctgatggaggtggtggcactctccggcgccaccaatcgccgccccctcccgcacatccgtcgcccgctcttccaccgccgctcctcgatcaccaacgggaccaacatgaggtgggtattgtttaaaaagcatttttaaacccaattttatcatgtagagcatactcgattctaattttttataacttaaatttttttaaatttcgaaaaaaaattacaatttttttagctatttttcaaatttatggttgatttattaactcttttcttacttttattactggttttttatttacaaatgcaaaacaaatgaaaaatttgatggaattacgaccaattttcaagatttactaacaataagttttttttaattttcaacaaattgctgaaaaaacttttttatttttttcgtgtggaatcctcctccctcccccccccccccaaaaaaatttattttttctcgaaaaattgcacaaccagcagagaaaggtgaaaattaaaatatgttttttttatttttaggcacttttaaatttccgccagaattattgcgatgccaatgcttgtcatgagaaactcgaaatcattggcgaccaaaaaatgactgtccgttacaagggaaatgagaagggtattttatcaaaattacttagtaaaatttaatatttccccttaaaaatggtatgggttcctgtttcccctaaaatcccgattttgctgttcaaaaattcctcccacatttttttaccacaaaattttcaaccgggaaataaa

SEQ ID NO: 80393 - DNA, 1260 bp, Heterodera glycines
  misc_feature (609)..(609): n is a, c, g, or t
  Genomic contig location: Contig_ID=SeqID_16033; Location=335..1594; Strand=+
  SCN-specific regions: Sequence locations=1-22,44-275,297-376,398 -511,533-933,960-1004,1026-1260
atggagaataataaatcaattgcactttctctctcagctgtttatgaagtgagtggaagagaaaaaaaatgctaatccgccgcgtgtgtaaagccatgaaaaagtaattaatttttaatgattgaaatatgtactgaaggggggggggggaattagaaatttttttgaaaataaaaaccaatgagaatcagtaaaaatcagttgttatgtatgacaaattagaaagtgataagagaatgttgatcagtcagtgatcagagattaattgcatgaaacccaaaaaccggaaacaaattactattataattgcatcattatatgttggattagcgaatagttaaattttatgacaattctcagaagaaagaggaacaaagtatttatttccaaatgtttttacgtgaaagtaattagtgaaatgccgaaaaaacattcgaaaaaattaaaaaattgatgagcctaattaaggtccctttacaccaacacgggagggggggggggttgcattagagggaaggagaaaatttccaaaattggtgaaaattcatttttttaaccccgcataaaattttaattccgccctttttcagtttttcaatgtaatcaacncacttccaggcgttgtcgaaagccctgccactgctgctgaaacgacgactccgtttgtcgatttgcgctgcgagcggcgcggccccgtgccgtccaccgtcgcggcggcgattgttgtgccgttgtcgtcctctgcgattgggatagcagcggaaagcgccgttggaagcggcgctgcttcaagcacatatgacggtagtgcagcggaagaaaacagagatggacggcgccatacgggagcggtggttgtggtaacggcactggaggagacggtgcatgacgaaaaactgcccgaagaatgggctgctgatgccaccttaaagcaatttaatttaaataattttttaaatcgaaaaaagtgccttaaaatgtcatttaatgaaaaaaaggaagaaaattcagtcttcaaaatgaaagaacattgtcgcttttcaatgtcaaaaattaatttcagttctgcccttaagctccacgagggacaacaaaataaaacaaaaaaagtggttaaataaatgcggggatatgatcagtggcgggaccaatgcaattagttttttaaaaatttttctcatagaattttcaacgaaaaattttttaaagattttttcttgaaaaatttctaagttttaaaattttaatggcactcgtaca

SEQ ID NO: 80394 - DNA, 606 bp, Heterodera glycines
  Genomic contig location: Contig_ID=SeqID_16035; Location=511..1116; Strand=-
  SCN-specific regions: Sequence locations=1-606
atgtttgtgaagactttttctcgttcggttcgtaattcaactcgctttttctactcaacaaacaccaaattggatccctcaaaatggcgtattgaagtcgcattgctcatttaccgtcctccagttgttgctccaccaatgacggaagttgaagaacaattttataggatgtctgaatttgccaatcagaagtcgtcttacaaatgtgactttgaacttcagttggaaaaagatgaaaagtcggtgttttatttcttttttgtttttgttttttcatactttgctttaaggctattggagaagcgacgacaacttgaaaacgaaggaagggaccttagcgcacttgacgaagaaattaatgtctcttctgctcaacttagagatgattggttcgagaaaagtgaacagcttaccaagcagtacaaactggattcgccacaaacaacgacggatgaggacaaaaatctaaagacttttggaaggatgcagcaaaaaaagctggctttgcttgtgaagcaacggttccctgatgctcttaattctgattatgtatcgccatggattttaccacagttaatacgaactggcgatgatacattgcgacag

SEQ ID NO: 80395 - DNA, 765 bp, Heterodera glycines
  Genomic contig location: Contig_ID=SeqID_2554; Location=1208..1972; Strand=+
  SCN-specific regions: Sequence locations=1-43,72-222,245-281,304 -432,486-765
atgtcgggtcaactcagagcaaaaataccgttacttaaccgagtgttaataaaagaaatacagaaaattaagtcaaaaatagaagaagggaattttgagtatgataaaaataattttgatgattgttctcgaatttttaataaaactaaagaaatcattcaaagaattgaaccaaattttgaaaaattaaaaattttgcaccaaaaatggcaaaatttaatgaggcaaatgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgaccaagagaatgaatcaattgatgagagcaagaaaacgatgatgaagaagccggagaagaagaagatgaagatgaaaaagaatatgatagtgatcaagaggacgaatcacaagaaatgcattcaagtgatcaaacacatcgtaatcgcataccatttgttcatcaacgatcaagaataaagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttatta

SEQ ID NO: 80396 - DNA, 4771 bp, Heterodera glycines
  Genomic contig location: Contig_ID=SeqID_2554; Location=2299..7069; Strand=+
  SCN-specific regions: Sequence locations=1-141,164-248,270-279,301 -759,781-1029,1051-1326,1365-1845,1869-2019,2041-2256,2280-2494,2517 -2702,2724-2978,3000-3153,3176-3219,3241-3585,3620-3839,3875 -4571,4593-4716,4738-4771
atggaacgaatggaagactcaaatcgtcaaatccggaactttccttctaatcgaccaaacccaaacaagatacagagacaaccatatcaaaatttctctcaaaacaaaccaaaatttaaccaaagaaatcaatatcaaaccccaattacaccttttccatatacttctgcattaacaacaaagtcaaaaccattgcatccggcacagattaaaccaatacctacacaaaccaaaactcaatataaaatattttgtcgtttctgtgaaagagaaaaccatacaagtaaagaatgtaaaatatattcaaccccggagaaacgaaatgaacgagtacgtgaactcaaactttgtctcaattgtctaaataagggacatatggtcaatgaatgcaaatcgacctatttatgttataactgcaaacacaaacataatactctcctgtgcactcgtaaacaaactcagtacaaaacgaaggaacaaaaaaccagagtgaatatggctcaaaattacgaaaatcatgaagagactcagacattcatgacaatggagggtgataaaaatttaccaaattctgatgaagaagaattgcttatgactactgaagtaaactgcataaatcccaacaaatataaagtaaaaagggaaataattttgtttgataatgggtcacaaaaaagctatataaccgaagaatgtgctcaaactcttcaattaagcacaattgaggaaaaattattagcaatttccactttcaatcaaaataagccaaaaataattaaatcaagactagtcaaagttggcattaaaacattaaaaggtgaaatagagtacataacactacaaacagtggaaaaaattactgatgttacaaaaatggttaataaagaaactgttgatgtacttggagtaaaaatcccaatcagtcatgcacgtcctcaaattttaattggaatcgactattactggcactttatgctaccaaattcacaaattcaattacttccatcaggattttactcaataaatacaaaattaggaaaaatattatctggaaaaggaactattgaggacaccaattgtaactcagtgaccgaaaaaagaaaaaaagacgaaacgaaccaaatacttcagaaattttgggaattagaaaacattggaattatcgactcaccacatatgacggatgaagatgcagcaatgatacactttgataaaaatgttacatttaaaaataacagataccatgttcgatggccttataaaagagagaacccgaatttaccaacaaattttggattatgcatgggaagactaagaaatgttgttaaacaactaattaaaaacaaacaattggaaaattatgacagaatattgcaagaacaaatggatactgatgtaaatgaaattgctgaatttaaatcaaataatttgcttcattatcttccacatcatccggtaataaaagagagctcaaatacaactaaaatacgaccagtttttgatgcgtccgcaaaacttaaaggaaataattcactaaatgatgaaattcaccaaggaccaaaattactaccagatttgtgtggaatgattctccgatttagacttaaaaattacgtattaattggtgacctggaaaaagcatttttacgagttggattaaatgaattagacagagacacaacacgatttttatgggtaaacaaatcgtacttgaatgaaataagacaaaattatcgagaaattgaaatgagagacatcgaattgagacgattcacacggataccatttggagttaacgcttcaccatttttattaactgctgtagttaatctccacttgtcaaagataaatgaaatgtttgaaaaattcaagacaattcaagttaataaggaattatgtctaaatgataaagaagaagaatttaaaaatctttgcatagaacttaaacaaaatgcatatgttgataatttcgtaatgatgtgcgatgatgaaaaagaaatacaattcaaacattattggagtaaagaaatatttaaactagcatcaatgaatctgagagagtttgtctctaatcatgaacaaagtaataaagaaattcaaaaattggaaggatcagagataccaaaagtaacaaaaatgttgggtataaaatggaatgtcgattcagatgaacttgaactccaaataaaaattccactaatgagtaaagacacaacaaaaagacaaattttgacgatgattgccaaaaatttcgatcccatgggatggatttcaccagtaatactgaaatataaactatttttccaaaaactatggcgatcaaacaaagattgggacgataaattagatgatcaagaaattattgaatggaataatatttcaaacacagaaatgatagccataccacgttcacctttcacaagccaatatttaaatcattcaatattacacattttcgctgacgcttctgagttggcttatgccacatcagcttatttacatacaaacgatcaaataaatttattgttcgcaaaaacaagacttactccacttaaaggcttaacaattcctaaactcgaattattaggtttattgatagccgcaagagccgccaaatttataaaaagggaatcaaaattgaatctcgaaaatacctatatttggtcagactcaaaatgtgtactcagttggttgaaatgtaaaaggaatttaccaatttttataaaaaatagagttgaagagataaaacaaattgccttggaattacacatcacttttcattatgtaaaatcagcagataacccggctgatttggcttcacgaggagcaaccatgagtgaattaaaacacaacaaattatggtggaatggaccaaaatggcttaaactgaaaaaagaaaattggccacctcacagcttttacagtcctgatcaagaagaggctccttatttagataatacagaggaaataattaacactcaaataaatttaataaaaaacgaatataaaggaattatcgaatgggataaattcagttcatggcttaaaataactcgcatttgtcaaactttattaaaattcatatttttcaaactacagaactctaaaaagttcaaagaaaaatttatttgctctaaattcgaaaatgcattacaattaaaaataatggcacaaaaaatgctaattcgaattattcagagggaaatggaaccaaataaagaagaagaaagacagttaagaatttatctcgataatgatatgatactcaaatgtgaaggacgattaaaaaatgcacaaattcaaggtgtcaatcccatttttttaccaagaaaacactatggaactcatttgataatcatggattatcacacacgaaatttacacgcaggtacaatgacaacattatcggaaataagaaaaacttattggataccgaaaggaagaagaattgttgatcaaatacggagacaatgctaccattgtaggagatataatgctaaaccttttcaacaaccacaaatgcctccattacccaaatcacgagttgaaataactgaaccatttcaaaacgttggactagattatatgggaccaatacaaataaaaaatttcaatgaaaaatgctggataattttatttacatgcttcacaacacgaggtattcatctcgaattagtcacttccttatcagttcagcattttctcaatgcatttagaagatttatatcaagaagaggcacacccaaacatgtatggagtgataatgcagcacaaataaaacttgcatcaaaaattctaccagaagtgttaaaattaagagaaattctcaaacacgaatcaattaaaagttattttttaaatgaaaatataaattggacattctctatagaattagccccttggcaaaacggagcaattgaacgccttaatcagaatgtcaaaacagcaatgagaaaagtaatcggtaaaagatttattgagtttgattcttttcaaactctgacttgtgaaattgaagccctggtaaattcacgaccaattacctttatatatgatgaaattaactcttatcaaattcttagaccaatcgacttcatacttccacataaaaatttatgtattcctccgattttggaaaatcaggaaactaaagacccaacatattacccaaaaaagacttcattcgaccaaacaattgaattatggaagaaaaccacaaaattattagatgactattggaaaatttggactgatgaatatataccaagtctaagagaacgttataaaatcgaaaacaaaaatccacgaaattgtatgaaatcttttccagaattgaatgatatcgtaataatacatgatcaaactcccagagcaatgtggaagactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaa

SEQ ID NO: 80397 - DNA, 754 bp, Heterodera glycines
  Genomic contig location: Contig_ID=SeqID_2555; Location=1881..2634; Strand=-
  SCN-specific regions: Sequence locations=1-65,115-754
atgccgacggcgacgccttggcggacgaatgtgctgctgtggggggctgagggccgcttcggctccgccgtggtcgtcgccgtcgtcggcactgtcgtcgtcgtcgtcgtcgtccacttgactgtcgtcatcaccactgacgtcttccgcgacgactgtcaacggttcgcccgtcagcagatgccgacgacagagtggacacgcccggctctggcacgcgtgcgtccacaggcagacgctgcaaaagcgctgaccgcagcagcccgtacatagcagcacattgtccgccaacggctccatgcagatggggcacgcttcggctccgacacccgccgtccgatgcacaccgtcggacagtcgtttgagctccgaatggtcgagcggtgtccaatcggcgacggtctcgtcgtgacgaagccaatcgtccagtgggcggccgtcggccaggatcacgtcgcgtgcggtcgccagctggtcgccgtacagcagccagtcgtcttccaccagctctctgtgatgcgcttcgtcggcccactgttggtccagcaaccgccagaagggctgccgttcggcacgcaggcgctgccgctccagtcgctgtcgacaacgtcgttttgagcgacgttgctgcttgcgtcgttccgccacggggttcccggtggtcgacgaatggtggaagacgactcggaacagcggacgatagccgggcgcacggagccgtgcgcttcgccgcggcttaagaatgaaaaataaa

SEQ ID NO: 80398 - DNA, 1096 bp, Heterodera glycines
  Genomic contig location: Contig_ID=SeqID_16037; Location=118..1213; Strand=-
  SCN-specific regions: Sequence locations=1-964,986-1096
  Gene Ontology: Cellular component=actin filament; Biological process =signal transduction
atgttcccaaatgacgatggctacgaatcggaagatgatgaaattctcttgccacctccgccgatccccccgcaacttggccaccctccgccaaatgtgccggtaatttcggtctcgcttttcgttgctttttctcacatttccgagtgcttttttcaggcagttcgtgttcagccaatgcatgttggtcagcagcggctgccgctgagagacttgccacaattcgaggaccatccgcaaaatgtgccggtaattttgggtcgattttcgctgcgttttctcaaatttctgcgtgctttttttcaggctgttcgggtccaaccgatacaacaaccattgccgctgagagacctgccgcaaattttccaccctccaccaaatgtgccggtaattttgggtctttctttcgattgctttttctcaattcccgagtgcattttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaatgggtgtgggaccaattcatgatgggcaacaaccactaccactaagagcgttgccacaattcgcccaacctccaccaaatgtgccggtaattttggctcgtttttttgttgctttttttaattcccgaatgcttttttcaggccgttcgtgtccaaccagttcaacaaccgataccactgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgcagtaccgcaatttgcccatccgccgccaaacttgccgtatcatccaccagaaaacgttccg

SEQ ID NO: 80399 - DNA, 606 bp, Heterodera glycines
  Genomic contig location: Contig_ID=SeqID_16038; Location=220..825; Strand=+
  SCN-specific regions: Sequence locations=1-606
atggcaaacattcgccgtaatgcggaggaacacctccgcagagaactacacgaaggtgccatgctttgcgcggcacatcttggcccattcacgaatgtccgtttcgacggatttttccgttatggaccggccaacacgcacatgtccccaggacggactttccgggagcattttcgtagacgcgggttccaagtgaacccgaatttgccatgcctccaagaatatggaggtttcagccacagccaacagggcattcatgtcgattattttccgatcgacatgatcaacattcaaaaaggactcggtgttggtccgagaccgcctccaactgaggccgaaattttacggcctcgccgcatccaagcctatttggcatttgaggaaattcctcatgagcaagaggagctcaacagaagagccctcttcttcgaggtcattggccttcgatcaaacagacccaacgatggcactgcaaaggaggaaggcgctcaacagacgcgccctcaagactttcaacgaaagaaagagttagatgatccacacactgatcgtcaccttgaggaccaaccaagaaagaaaacctccaacggaccaacgcgccattga

SEQ ID NO: 80400 - DNA, 575 bp, Heterodera glycines
  Genomic contig location: Contig_ID=SeqID_16041; Location=1527..2101; Strand=-
  SCN-specific regions: Sequence locations=1-33,64-149,229-231,253 -274,417-575
atgggcgcgccgatttggctgattgtgatgaaacttctggtgctgctgctgctgttgctgcggaagttccgggatcatgatacgcagactgtgatcttggaccggacgaaggaaatcaaacatcaacgatcaaagaccaaaaagcacgtgacgaagaagagacgaggaaaagcagagagacagaagtggaggaggaggaagaagaagcggcagcgcaagatgaagaagcttttttggatgagttaatctaaaagagaagaaacaggatgaaatggagagaaagagagaaagagaagaggaagtaaaagagagagagaaagaaagagatagtgagaaaggaaaggaagagagagagggagagagaagagagagagagagagaaaggaagaaaaaaagagacagggaaagagggaaagcatttgtaaaggggagaaaggaaattagcagcaaaaagcgagacaaagaaagaaaatgaaacgaacgaaaatgatgataagaaattgaaaagagaggagcaaaagaaggataaatcagcagcacgaagcaagaaggaagcaattacaaaaacaattaaa

SEQ ID NO: 80401 - DNA, 949 bp, Heterodera glycines
  Genomic contig location: Contig_ID=SeqID_16043; Location=1421..2369; Strand=-
  SCN-specific regions: Sequence locations=1-949
ttttttcgatggttttgtcgccgcgtttttcaccgaacgaaagaagcaattgtcccgcaagcgtattgaactggccattttctctcgaccgactgatgagtcgaagaatgccttcaaatctttgtggtctcttttcaattcgcaaattggcgcaatcacttctgtttgtaatgcttctgccgctgaccgtcgtaacgcttctgtcgctgatgagcgtcgtaacgccgaaaacaccggcatctacgacctgggcccgtatttcgacaccgttcccgactggcttgtggctccgaccttgcgccctgtcgatggaatttttggcttagagaccatttacaagtggatttacaatgacgaaggaggcgacgttgtcaaaactttcaccatgcatcctccggaggaaggggccgaaatccccgcaggggatttcgaaagatttctgttggtaagcattcattaattatgctgtgttcatgagcgttggcagtcagaccactaattttggcggcggggggggggggctaactctatcttcatttagtccttaccgcgcttttattcacactttttagagtaacaaattttgaggacatgctttcaaatatttctttcattttcgattttatggggctgcccttgcctacacttttgttgtatttcatcgtccaccgcttgaaaaactcaaaattttgacaatttttttgcgactaaactttcgctttctcattttcctttaagcatttttactttctttttgcttttttagggttttttccgtttctgtgatgacgcacctccccgttacatcgcaaagttcctacatggtgttgttgccgaagatgtccgcgaattttctatcacaaagggcggacattctctgagcatggactcttacgtggaagctgatgggaccaccaaagattggactttgaagtgttccaaaaactaa

SEQ ID NO: 80402 - DNA, 426 bp, Heterodera glycines
  Genomic contig location: Contig_ID=SeqID_16046; Location=1173..1598; Strand=+
  SCN-specific regions: Sequence locations=1-128,150-426
atgaaaagcgcaaatcaaaatgggttcggcagggcaacaatgaatgtatttgtagaggattttgcaaatcgtgactcgttggaatctatactactaattcgatgctgtaaattagtgagtccccattttaaactttactttttattgacacgaaaacttgcgaaaaaataaaatagaaaatggcagaaagataaccttgaaaattaaagataataaataataatgtttatgaaattgtttgcctggccggtaggggtcagttgcgtttgagcaaagcataaaccaccataacatttttctttgttagccagatttcatatatccggcatcattcccaatctctacatggaatgaatactccgaggatataatgctaagtgagcgaacatataacaatatggaagcctgaacatgaaccatattgca

SEQ ID NO: 80403 - DNA, 501 bp, Heterodera glycines
  Genomic contig location: Contig_ID=SeqID_16047; Location=584..1084; Strand=+
  SCN-specific regions: Sequence locations=1-18,40-157,179-292,327 -343,368-501
atgtcaatgcactattttattgccatttttgcatgcatttctcaaatttttggcactgcaaaaggaatgaactcagaaatgggatttcagcctcattttcaacaaaacccatcatcatttttacggaaattaggtaataatgccttatctgagcttttaaagtaattatttttcagaattggctaatggggtcaaaatgttgataccaattgaaaatgttatagcttttttgaaacagttttcccaacttaattcattgctcaattccgatgattttcgcatagtttgtttgttttttaacattttaaataattaaaaatattttagcaatgcgttgatattcaaattttacaaataaataaagaaatcaatgagataatagagacaaatcagctgaagattggacgagatttatgcagaattctttacaatttgttaatgagttgtaaggaaattggatatgaattggatggaaattctcgcttaaatgccccttctgcc

SEQ ID NO: 80404 - DNA, 2374 bp, Heterodera glycines
  Genomic contig location: Contig_ID=SeqID_16050; Location=27..2400; Strand=+
  SCN-specific regions: Sequence locations=1-557,579-2042,2095 -2332,2360-2374
atgcctgttccgacacacgtgtccgaggttcgatcatttttgggaatgatcaaccattaccaacaattcgtgaagaacatgaggttcatccgacagccattggacgaattgttgaagcaggacaaagtgtggcaatggtcggcagattgtcaaaatgcttttgagaacgtgatcaagattttgaaatctgatcagttgctgacacactatgacccggcacaagagatcattgtatcggctgatgcttctgagcatggaataggagccgtgatctctcaccgctttccggatggaagtctaaaagccatcgcacatgcatcatcgtccctgtcagcagcagaaaagaattactctcaaatcgagaaggaaggcttagcgattgtttttgccgttcaaaaattccacaagtatctcttcgggagacacttcgttctgcagacggaccacaagccgttgttgtccatttttggcaacaaaaagggaattaaggcttgcacagcgaatcgattgcagagatgggcaatcactttgctcggctatgacttcgaaatcgaataccaaaatactgctgattttggtcaagcggatgttttgtctcgcctaattgcgaagacaccagtgccggacaacgaagtgatcattgcaaacattcgtgagagcaatgaaacgggagtgttgaattttgttacgaaaactcttcctctcgatcacagtgatttggctaatgccgcgaaaagtgatcaggtgatcaaaaatgtgaagaaatttgtctgctcacattggccaacaaagaacaaaatggccgcagacattgttccgttccatcgacgacgagacgctttgaccatcgaggatgaatgtctgctttatgcggacagagttgtgattcccgcatcgcttcaaaaagatgtcctacaactcctgcacagaggccatccagggatgaaacgaatgaaagctctcgccaggcagtacgtttactggcctgggatggacgaacaaattgagaattttgtcaaaatgtgcaacgaatgcacaatggaagcaaagatgccggtgaagagtgagcttcactcgtggccgaaagctgacggaccgtggaaacgcgtacatttggactacgccggaccgtttatgggaaaaatgtttctcataattgttgacgcgtactcgaagtggcccgaggtcttcgaaatgcgttcatcgaattccgcggctacaatcgacaaattgcgatcactctgtgccagttatggccttcccgaaattttagtcacggacaatggcacacaattcgcttcaaaagaatttaaggaatttgtgaccgaaaatggcatcaaccatctgttctccgctccgtataatcccatgtcgaacggacaagccgagcgttttgtcgatacgttcaagaggacatgtaggaagatcaagggagaaggagcatcggaaatgttgaccacatttttggcaacataccggaccacgccttgtgaggctttgccggagtgcaaatgtccggccgaaatgttcctgcaaaggaaaccgcgcacgactttggacttgttgaggccaaagccaaaggcaccgataattcgagacgaggccatggagaagcaattcaataggcgccatggagccaaaccgagatcttttgccttgggcgataaggttctcgctcgtcatcgtctttctcagccttggcgtccaggaaaaatcacaaaatgtaaaggtgtgatttatgacgtcgaatttgttgatggaaagtatggacggttccatgccaatcagttgcttgtgagaagcactgacgaaaacggcacaaacgcattgaacgtgttcaatgatgcgtttgatttgccattggcaccaccgctggttcagcatggaggacaagcgcaattgcctgtagtggcacccgctgctgtcatcgcaccagccgtggccgaagaacccgtcgtggaggaagctgatcgagcccccgaagtgcccgctcaacgacgatcacagcgaaatcgacgaccgcctgatcgctacactccatcatgaacggacggatcagacggacgaatcgaacggacgtgtaagacggacggatcattggaagaaccgaggaaaagattttttttattggggaagatgttgggatcggtactattttgtccgcccattattatttttctctatttctcttccctccattctctcctctctctcttccctggttggtcccccataaataccccgcgccctctgacctccccgtcattcatttgtcacccatttattttgcttatattgttcaatcaatattcgccctttgtcctccgtctctcttctcttcatttatttatttatttgtgtcttcccaacttga

SEQ ID NO: 80405 - DNA, 1729 bp, Heterodera glycines
  Genomic contig location: Contig_ID=SeqID_2556; Location=64..1792; Strand=-
  SCN-specific regions: Sequence locations=1-94,119-303,331-432,454 -591,616-720,756-899,971-1114,1136-1182,1215-1729
  Gene Ontology: Mol. function=protein binding
atgttgagcttcatttatacagatgatttgagcgaactgaacggagaaaatgcaatggctgtgctttacgccggtggatttaattttatgtgacaaaaataaataaattatttaattagccaaaaagtacaatatcccctctctggtcggctcatcttcgcaaattcccatttccgaattgcgcaatgttttcttcgcttttgcccaggcccgtcttctcgacttgaaagtgggtaggaaaaattgaaaaatgcgaaagaattaaaaatttgctaatttttaactattttgtcggtttacattttccagataaataaaatacataataaactgtttagagtgatttttttgaatgattaaactcaatctcgtgaatttttccgtcttgaatttcgctattatttgcatttttttgcaaatattttcctacactaaaatttttacaaacattttttcgtttatttagaatgtataataaattaaggattttaagaccaattaattgctgctgtccgattgtgagaccgaaaaaccattgactttagacttttttttgtaaaatatgttcctcaaaaaatgaatgtttttttaagtttgtcaaaagccaaacaatcattagagggcttaaagaaatctcggtcttctaaactcgaaaacctagaccagaaaaactcgattcttttctcgctttggcactctcagagaaagactacattttaaagattatttttcctttaaattttagaattttgccaattgttgtttggcttacattggcaaaaatgcggacactttgctcaaatcggatgcttttttgcaaattgaccaaaaattgttgtgcgaaattttggagtgtgacgaattgcaaatcagtggagaaatttcaatttggaatgcggtaattttaacaattaaatttaaaaactaaattttattagtcatttaattatttccattaaatttttttaaaggcactccgttgggccgatgaaaaatgccgtgaaaatggcattgattgttcagcagagaatcgccgtcaaatgcttggcccggcactgttcaaaattcgctttccgcttttgtcaaatgaggaatttacgaagaaaattggtaaaaaataagtcaaaatttcaaactcgttctctgatgagatgccgtaaaatattcatagtttttgtggcgatttttaaaaatgttttttaaaatttatttttcaataagttaatacatatttacagttcccttcggtgttttatcaaaagatgaagtgatcgccgtttatcagttcaaatcccttccaaattgtcatgggatttccgacggaattttcccaatgccattttcgattaatggacggatttccgatcggaaagaaggcacagttttgatggacattgaaaaagtgtcagaatttgcacgagaggaggttgagagcagtcggtacagcgaaaaagtgtacataaatggacttccatggaaaatattggcaaaaataaaagcgaaaagtggaagcactgtcaatgagaaaagtttgggtatttacctttggtgcgatgctccaaaagaaggtgcaaaattactaataattaatatatataagcaattaattaattgatattgagcagaaaattggagttgcaaatgttcggcaaactttcgaattgtttcgcaaaagagcggagtgtcggattttaaattagaattaaatggccatgtttttgacaataaa

SEQ ID NO: 80406 - DNA, 1734 bp, Heterodera glycines
  Genomic contig location: Contig_ID=SeqID_2556; Location=3931..5664; Strand=+
  SCN-specific regions: Sequence locations=1-34,64-164,189-524,546 -807,832-1734
atgctaaggcgtcccagggacagcagcagtggtcctgtgctccactttttcttcatcgtcctctgcaatttgccattccaaattgatgctgtcggattggcaccggggctttactgtggcacggtcacttgctacgatggtgaatttgaagggataggaaatgcgatttttaatttttcaattttaagtgctcgaaatttctcgggatgacttcaacaagacggatttgccgaaactgtacagaaggatggcacgccaataccatccggaccgggtcaaacgtgaagtgagtgctctactaaaatggcaaataaccaatttcggaattgactcctgaaaagaatttcataaaaattgggaactcttccagtttatatggcccgaaaaaccatagagaggggggactcttttggtttgcaaatttttttatgataaaaattcatgaacttttttatagaattttcggcgtcgctaatcacgaatcagataccaattttgacaaatctctaacccaaattcaaataaaaagttgaaaatttaaaattttcggatttttttttgttgctcaaatttaagttaagtattcgaaattggattaaatagatgtcaaatcttgatcaggccccaaaactccccgggaacaagttttcataagttattagcacacaaaaatttagcaaaccaaaagggtgggtcccccttatggtttttcgggccacctaaactggaaaagtgcccaaaattgtgtcaccttttctccgccctccaattccatttttcatgtttggctttattttcggtcattaattttgcaattttttacaaatccatcccctaattttaaatggattcactgtttttcccctccaaaggatctccgtgaagagacggaggaaaaatttcggctaattgccaccgcttatgagacgctgaaggacgacgagacgcgcacatattacgactattatttggaccatccggaggagcgctactacaacttctaccagtactatcggctgcgcaccgcgccacgcgtcgacgtacgcattgtgatcgcggtcaccattctgctcatctccgttgtgcaggtgaacagcagggccgaacaggacaggacaagatggtcttgtacatgataggacgggtcctttgtgtttttgaaaaatgcaacagggccagaaattctaaaaaaacaggaatttagccatctgaaaccatggtccgggttttcaaaaattcacgactatgaaggtggacgctccgccggggtcggaaaaggtttgagtcaagcccggattgtgaaaaaattttctcatttttttgctgttatttgcaaattgacattaaaaaatatagctaccggatatttagaaaattgaccaattttctgaaatttacttattaaacttgtctttgttttacagtatctcagcgcccatcaaaagtaccgtgaggcattacggtatgccaaggagcaggtcaaattccggcacatggccatcgaaattgggcgggagcgcggggtgctcgaatttgacaagcaaacgggcaaaatgaagaagaagcagcggaatgggcaggactctgagcaaattatcaggtaattgggcattttaatttgtaatgtgccgcggaatgcttttgccaatgtacggaaaattgggcaccactgccacgtttttggaccataaactcaacaaaattggtaccatttgaacgctattcaatttacta

SEQ ID NO: 80407 - DNA, 442 bp, Heterodera glycines
  Genomic contig location: Contig_ID=SeqID_2557; Location=667..1108; Strand=+
  SCN-specific regions: Sequence locations=1-208,237-442
atggaggagtacatggcttgcgaactgtggaagcgggccgagttcgaccggtggaaggaggacaaggacaaagaggagaaggagcggctgtccaactcgggtcgctaccgccagtacaaacggttcatgaagaagcaggccgggtgagcatttttacaccgcactttttattgtacagtaccattgaacggcgtcgaattttgcaccgaaataattcaattttaattttaaaaaatgggaatttggcctgactttaaggggtctattgaaattgattcagaattttgccgggattagattacataattcttggttatcgttgtccccgcccctccatcctcactcaaaatccaattttagggattgctcattcttcaaacgaaatgaaccaaaaagcatgaaaagcgaaaaattggatgttgttgtcaaaagagcactataa

SEQ ID NO: 80408 - DNA, 1990 bp, Heterodera glycines
  Genomic contig location: Contig_ID=SeqID_2558; Location=1..1990; Strand=-
  SCN-specific regions: Sequence locations=1-138,160-295,325-421,444 -616,639-1076,1098-1162,1192-1215,1237-1713,1735-1901,1923-1990
  Gene Ontology: Mol. function=zinc ion binding; Cellular component =nucleus; Biological process=regulation of transcription, DNA -dependent
atgggtaggaagaagaagaagccgcaaaagccatggtgttggtaagtcgaaatcaaattagttttgatgggcatcattccttttgtttaaggtattgcaaccgcgaatttgaggacgaaaaaatactcatccaacatcaaaaggtttgttttatttgtacggtaacttaatttggaaatggaattgtcggatttcaatgacagagtttaattgccttttaattagctcgggttattaattttagattatatttctgagaataattcactcgattagttttcaactcccccctcaaaattgggctatattttaataataaatgtcgaaaatgcacctgaagaatgatgacacattcattccgactatttaattgcaggccaaacacttcaaatgtcacatttgcaacaaaaagctgttcaccggcccgggcttggccatccattgcatgcaggtcgaagaataatccttgaaaaatgccaaatattgcgaaataattccaccaattcgtcccgttgtattttgcaggttcacaaggaaagcattgataagattcccggcgcgttgcccggccgtgacaatgtgaacatcgaagtgtacggaatggagggcttgccgccagaatcgtaaatgaaaaacaaggaattaacggattaagagcatggcttttcagcactcgtggccatgtcgaggacgactcggacatgccaccctccaaaattccgcgccccgcctttccgcctggaatgtcgatgtccggcatggtgccaccaattgcggcgtacaaccaatacacaccgcgcacaccgtttggtatgccgtcctatggtcggtcatttttgtgaatactcactccaaatttgacgtcgaaattacggccaaaagggtcatttgcttgcttccaaagaattgtaagactcggcattaatgctgctctaaagcaaaacacagcaacacttattattggacatggattttgatttgtgtgtttgctaattgtaagccctataaaacagagcaattatacacttaggcaacgaaatgaaattttattccttcatccattcataaaaattctatttttatctctctccaattttggcattttgtttaagtcttttcccttttgaagggatgccgcgtcccggcactgttccgcttcctcaccaccaacaacaacagcagcaacaaatggccgcaatgatggcagcggctgccgcagcagcggcgggcgggcggatgccggcgacgtccacagccgcctcaattggcgcgattccgacaccaccggcgggcattgtgccaccgcctccgctccccgccggaataccgtcgcctgcgtcaggaggtgccattccgatgccaccgcaagcggcattcgccgcttaccaggttcgatggcgctggaaagggataaaaacccataattggacgagccgaaatttcaaccgacttcgaaatttttgatgtttgttttgctgatttcccgaatttttaaacgtctcctcgtaaaaatcagacaatttgataaacgaaatgcgtaaaattggcaacttttgtaggataaaagcatctccggtggaaagtatggcaccagggacgagccctctacttctgccgcgtcgtcgtcaacaatggtcaaaacattgggtgccaagacgcgcattgtgtgccaagatgaacagacatcgctggtaacagatggacagcaaaagctttgcaattttgaaaaatatgaatttctagttttctggaattttcgggggatttaccagctaatttcccccaattttccccacaataggaagagatgatggcccaacgcattgtgccgacctacacacgtgggctgatgccatttgagacgtagcggagccgaaggatcgcaacaacgaaggcgaagaatgtctgtctgtctgtcactgagtgtttccccacgagggcttttcggtaagtcttcgcatttccagatgccgagtgcactttctcttcc

SEQ ID NO: 80409 - DNA, 3085 bp, Heterodera glycines
  Genomic contig location: Contig_ID=SeqID_16051; Location=694..3778; Strand=+
  SCN-specific regions: Sequence locations=1-16,38-73,132-186,210 -285,307-382,404-526,549-836,886-1306,1354-1684,1706-2081,2103 -2104,2138-2210,2232-2312,2354-2684,2728-2763,2785-3085
atgatgatatattcggttttggtgattatttttatttctttcatcggttcggcaaagtctgtgaatttaggtgatttaaaataaatttaaaaaatatacatttatttttagaacaaatttttaaaaatattgacgagaattactcaaaattgttcaatcttccactcgatgaaaatgaaatttctgacagaaatttggaagcttttcaaatggaccaaaatttgaagttacagttggaagcagcaatattttacagtaatgcaaaggaaatggtaaatttgcgacaggatgggaagccaaagaaaattcgtgaacaaaatgccaacacattaaaagttttggttgaaaattttgctgcgtccagcacagtgtcccttgtaaatctgtgccatttgtggaaactttggcgcactttgggcgacacattgggtaacttttattaaccattttttgaaaataccctttggataggccaaaaaatcttttaattgaaaatttaagtggaaaatcccaaaattccaaagaatgtaaaaaattatttgaaaaatcgcgaccaaattgatttgaacggcgtggaatgtgatgaaagcattggccgaaaccgagtttttgtcagagacacggcacttgcgaatttcagtgcaattatcgcactgttgcaacttcaaaatggcaaactgacaattaaatttggaattgacgaggaatttcgaatgatgtatggaatttgaaaaataaatgcattttttcgaatttttgtgcctttttccgcttttttgtacctatttcatgccaattttttggcgtttttaataattacttaggcttaaaagtggaaaaattatttattatcatattatcagaatttttaatatttaaaaatatcaattcaactcaaaaacaaggttcacacattttctagttttttaaacaaatttaatgtagtttttttgccatattctggctttagatatttcataaaaagttttaaaaaacatttttttggcaaaaaaataaaatccctttcttatgcataaattttttatttaaattcgctgacaaaaggctcatacatcaaatttgcgcttaatattccgtaattctttatttttcagagatttgccaaattttttcaatgataaaagggcgaaaaaagagtcgaattttgcttttcaaatacgacatttacgttcaatggacaaaaataaattaatgattcgaatgaaggacaaattaagggaattaattggcccattttttatgaccaaattggaattaattcgaccgattgagatgaatttcggtgatttttattgaaaaataataatttaccgaattatttttaaattatttccctcaacagatattgttggtgacaatgaattggcgatggattatgctaaatttttgtcacaagaacatttggttgaggaaaaagccgtaaccaaaatatcagtgagaattatttttggcagaattatgcaaattttcgcccgaatttacgccatttgggagacaccgaaaatcaaaatattgaaaaaaacaattttaaatttgtggaatggaaaagaattgcaaacgattcacaccgatttgaaaatgccgggcctgaaagcagtgaccaaatatttcgaattttacctaaaattgttacgcattttcaattccagccaaggcattggcgagcaggaagagcaaattggggggttgttgccgactcaaacattcgccaaatttacatgggaatttgcggcaaaaaacaaaatgtttgagatgacatgggtcgcactgcttgaagaccatgccaaaaacattttgcggttgaccgagtcgaccacaccaaatgcattcaccgcacttttgaaggattcgctgatgaaggaaaagggcacaaaggccaaattgaacggcttttttacgaacaatacggaaaagggggacgaaatttacgaagcattggccaaaaagtaccccaaattgaagcagttaatcgctagagagggtttgtgtgtgcagggcttcggattggattccgaaggatttaccctcatttttattgcttatttgggggtcgaagagcatttttaggaaaatttttgtgttgttatataaaaaatataaacaataaaaaataattggcataatgtactttgtcagcttcaaaaaacattgagtatttttgatttcctaaaaatttggattaatgatagttttttatccattaaaaaacttttaaattcgcagttcagccctattcaaaacagaatgttttgcggataaaggaatgaatattaagtgatgatttcaaataaactgaaaatattctctccttttctcacaaattaaatttcataagactttcaacaattaaattttaaagcctacttaattgaaaataattcagagctatctgatgatcagattcgcgatctacaaattaggaattacatccgatttttaaacgtcacaagcagccgaaatgagtcgatgaaatcgagattcaagctcaatctattgctttattatcaatggtaaacattttggctgctttaattggggaaagggaaaagatcactggcaaattgaaaaatgagggatgccagttttgtgaaaatatattttcccctgttttctccatcatattaatagtaaggaaaaacacttccttttttgtatttgcgttcaaaaattttttctatgattttttaaaaacattttaaaatttttgtttacaatttggtatttatttggggcttttatacattttaaacaaatttatttaagaaaacttttttttttgacagggtgaagcaaatgagagatggtcaaaattcagcagaaggaaagaaagaatttgatgcaaaaatgggccaaattgaaattacgatggatttggtggcggatgaaaacatggcaattgaagcatatttagtgacagtggaagcgaacataatacaggaacttgagcagttcaagcagaacaaatttctggtcaacaatggcacgccaattaaacggcacaaagaaaagtggacgaaataacggaaaggtcgcccagattcagagaggcattgaaaggtgcaaa

SEQ ID NO: 80410 - DNA, 1228 bp, Heterodera glycines
  Genomic contig location: Contig_ID=SeqID_16052; Location=1..1228; Strand=-
  SCN-specific regions: Sequence locations=1-129,159-425,454-485,518 -761,783-925,1004-1049,1071-1228
aaaaaatttcaatttttccatgaacatatatttttatcccacccttatgaaaaactaagaaaattctttcaattctgcctaaatttatcacttttttggctattgtttgattgaaaaaaatttccagggtaaaaaaaaatttttttttttaaatttttccaatcattttttttgttgcgttccaggtggtatttcacactgttcaccctgagcggcctgttctccgtcacgttcagtgtcgtgttggcctacgtggcggacataacggagcgcagcgagcggacaactgcgtgcggtttggtgtccgccacatttgccgcctcgttggtcacatctccagtaagaaattggcatttttttccaattttttaattccaaaaaatcaaaataaaaatattacacattccgatatacattgtaacaagttttattttatatttatattaaattattggaaaatacggcgtgaaaaccaaaaatgttggttttaatttgaaaaaaaaaaaaatttttttttgctaaacctgcgaatttttttaaataattaaacattttgatttggagtgctaacatgatagcttttatttgactcataaaatggaggagaagggcttggtttttgaaaaaatttctattttggcaaaaataaataaaattttgatttgtgccacaggcgttgggcgcctatctgagccgtgcctattccgacgacgcggtggtgctgctggccaccggcatcgccgcgctcgacttgctgttcatcgcgctgtgcgtgcccgagtcgctgaagtcgccggttgccgcgggcggcggggacagtgccgagaccgactccggtggcacaggcaaaagtaaataccaaacacaaacacattaattataaatccgaaaaatgggatgaaaaatattccccccccccctcctctttaaattaaaaaaaatttaaaccgaaatttttcaaaaaaaaattttttcaacaattttttttatgaaaatttaaaatgcagggcggtatgtcaaaccctcgtctcacaacaaatagaaaaatgtaaaataaaattaaagcatttatggttgaaaatcggtactttcctcttctggggctacaatttaatattttttttccccacatattcatggcatttaggcaaatccgcccgatatcttcagtgtccatcctgaaaattgagggcaccgacccgctgtttgtgctgcgctttttgcgcga

SEQ ID NO: 80411 - DNA, 1452 bp, Heterodera glycines
  Genomic contig location: Contig_ID=SeqID_16053; Location=175..1626; Strand=+
  SCN-specific regions: Sequence locations=1-836,858-947,969-1452
atgggcacacaggtgaagaaaacggtgagcaaaaggaagggtttgcggccacaaacgtcggacagagcgccgatcagaggcgagctgagaaaggagagaatgccctgaaatgggggacaatttttgtcatggcatttgttagttccttgaatttttttagtttttccatgaattttcctgaatttttttaaatttttccttgaattttcctgattttttaaagtgtttccttgaattttcctgaatttttttagtttttccttgaattttcctgaatttttttagtttttccttgaattttcctgaatttttttagtttttccttgaattttcctgaatttttttagtaataatgtaaaaaatcttaggctggaaattttttgaaaattgattttgcataaatacaaaccttaaggcccaagatgagaccgttcattaagaatttgttggctggaaatgtttcggccaacacattgatcaccggaacagtcagaagaccccacgagaaaaatctgaaaaaaaataaaatggaaattgaaaaaaaaaaatattgctttgaaaaaatagtcccgtttttccataaattcccattaagattttacggaataattgcacaattaaattagccctcagcattaagaataagaaaacacagtcttcaattttattaggaatattaattctgttgtttgaaaattaatagtttttttacaaattcattgacgattaaatgatcagatacaatcacttttaatcgcttatttaaagctgtttaggcgatcagtgattaaaaaaaaacacttaattttgaacccgattttggacaaaggcgcaaaaattttgaatattttggacaaaggcgcaaaaattttggacaaaggtgcaaaaattttgaagattttggacaaaggcgcaaaaattttgaagattttggacaaaggcgcaaaaattttgaatattttggacaaaggcgcagaaattttgaagattttggacaaaggcgcagaaattttgaagattttggacaaaggcgcaaaaattttggacaaaggtgcaaaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcaaaatgtttgtactcgagaaaaatgacgattaacgcgtgcacaaggctggcctcgcgccgtacgcgtgccgaaccgacagcggcggtgccgagcatggcggccgacgcggcggacattcgtcgacggctgacacagaacagtgagcgggcacgtctgctcatactgtgccaaaaaagtggggagtga

SEQ ID NO: 80412 - DNA, 1018 bp, Heterodera glycines
  Genomic contig location: Contig_ID=SeqID_16053; Location=584..1601; Strand=-
  SCN-specific regions: Sequence locations=1-459,481-570,592-1018
atgagcagacgtgcccgctcactgttctgtgtcagccgtcgacgaatgtccgccgcgtcggccgccatgctcggcaccgccgctgtcggttcggcacgcgtacggcgcgaggccagccttgtgcacgcgttaatcgtcatttttctcgagtacaaacattttgcgcctttgtccaaaatcttcaaaatttctgcgcctttgtccaaaatcttcaaaatttctgcgcctttgtccaaaatcttcaaaatttctgcgcctttgtccaaaatcttcaaaatttctgcgcctttgtccaaaatcttcaaaatttctgcgcctttgtccaaaatcttcaaaatttctgcgcctttgtccaaaatcttcaaaatttttgcacctttgtccaaaatttttgcgcctttgtccaaaatcttcaaaatttctgcgcctttgtccaaaatcttcaaaatttctgcgcctttgtccaaaatattcaaaatttttgcgcctttgtccaaaatcttcaaaatttttgcgcctttgtccaaaatcttcaaaatttttgcacctttgtccaaaatttttgcgcctttgtccaaaatattcaaaatttttgcgcctttgtccaaaatcgggttcaaaattaagtgtttttttttaatcactgatcgcctaaacagctttaaataagcgattaaaagtgattgtatctgatcatttaatcgtcaatgaatttgtaaaaaaactattaattttcaaacaacagaattaatattcctaataaaattgaagactgtgttttcttattcttaatgctgagggctaatttaattgtgcaattattccgtaaaatcttaatgggaatttatggaaaaacgggactattttttcaaagcaatatttttttttttcaatttccattttattttttttcagatttttctcgtggggtcttctgactgttccggtgatcaatgtgttggccgaaacatttccagccaacaaattcttaatgaacggtctcatcttgggccttaag

SEQ ID NO: 80413 - DNA, 277 bp, Heterodera glycines
  Genomic contig location: Contig_ID=SeqID_16053; Location=1657..1933; Strand=-
  SCN-specific regions: Sequence locations=1-199,233-277
agtttggcattttaaaaaagcctggacctggattccatgttggacgtggattttccggacaaaaattccaggttgccgaaaaatatggcctggacctagggatccaggaaaaatccagacctgacctggatccaagtccaggctgattgtgagctctaataattttcttcgttctttttttagtaatttttctctcggctcttttatggaaaaatttaaaatataggctaaggctgtgccaaaaattgactgccaaagtttttatgaatttaataaa

SEQ ID NO: 80414 - DNA, 1174 bp, Heterodera glycines
  Genomic contig location: Contig_ID=SeqID_16055; Location=330..1503; Strand=-
  SCN-specific regions: Sequence locations=1-44,70-346,368-519,542 -596,628-722,744-794,816-1001,1040-1174
atgcgaaatggtgaaggtgggccaatctgatggatttcattaagaaaaatattttaaatttaattttttgaaaaaagaaattctccgtagcaaaaagagcatctgctcaacactccaatggaaaagcttaaatttagaaagtgttaatgatttgcgtgactaatactcaaaggcaaaaggagtgccaaaactgaagtttttgcctcatttgtggtgtttcattggaaaacgagtacttaaaaaataacagatttgataaatcattgatttacaatgtcatatgacaaatccaatatcagattcataatcaggagatcaacacctcggaaaatccccaatataccaatttttagcacaaaacaacaaagttaaattagggatacacattctgcagaattagccaaatttaatttttttttttctgcttaatcccatttattagctcaaaattatttgtttaggcattatttgaagtgaaatgtttgttgcgcactttctgcatctcattttgagggtgtgtatttaaaaataaattaaaattcgttgaaattaatgggacattcttccacaatcaatgcaatctctggccactaatcattttttgaatatttttattattttttttttgccaataagaacaacaacgtgtgctggcgaagaagccgctcattgagcactcagatccgctagtcggctgtgatctgaataaaatgccaacaatttgctggccaagttgtttcaggagcattcggagtttcgcaattactttgtgcagttagaatgaattttttctgaatttttggcccaaaattattcattttaatgtcatcgatttgcatggcttgaccccattcgcattttggctgttgtcgacccgacgccctcccccgccaaattctttttttttaaattggcctacaacaaagattaaaaaataatataggacaaccaaaaatatgtatagaaaaaatatgcgcatggaataaagaaagaaatttctgtaaatatttttatttaaataaaaaaaataattttttaacagcagaagaaaatattcagttttacaagctgagaaatttttggcaattcattttttaattttccttacaaatttcacttttatttttcaaatcattttgaccttttttctaataatttgtaaatttaaaataaa

SEQ ID NO: 80415 - DNA, 1559 bp, Heterodera glycines
  Genomic contig location: Contig_ID=SeqID_16057; Location=145..1703; Strand=-
  SCN-specific regions: Sequence locations=1-167,189-829,851-888,911 -1559
atggctcccaaacgtcaacgcgttcgccctgcctcggactacgtccgtaaactagattccgaaagcgtcttcaacaaaaagtttaacgtccaatcgtcaaaatcgtcctacatcattgaagacctgcctggcaatcccgagtttctcctacgtgcgatattcaccaactgtattctgtccgctgttcgactcgcccacgaaaacggaatcaaacccgaccgtcttggagccaccgtttcatccgaacttcttaacccacccgtctggatcccaatacgccaatatacctcgaataccgtcgacgcaattctgaatcgtttactggaggtggcacagtcaaagtcgcgtgaggggtcactatggggagcaccttttaccataacaacaacaacacttgacgccagcactcttcctcgacaacaacaaattcgcggtcgtgggtttcgtaccccaaagaatgttcgtcacatcgttaaagaagcaaatctcctgcgtgtccgaaacaacgactctttttgccttttctatgccctcgaacttagccgtatttaccacaccgatatgatgagcaaacaacgtttttccgagtatctcaatcaatactttgaccggcaacgcaatgacgtacgacgacttatgacttccgcaggaatcccattcaacctcaacgaatacgacgctgccgttcatatccctcccatcgtagactactggaatgcaacgtacaataaaatcttcaaagttttcgtctttggagcatctggcgagtacaagcccatctataaatatggaccagacaacttcgatacatcgatctctattttttacaacaataatcactttgatggaatccgctgcggtgtcggaaaagctgtgtttgggcgtgattgctactgttttccttgtgaatgtccatttgacaatgccaacgaccattctcggcagtgtaaggcccgctgcacaaactgtggacgaatcggtgtcggcaggccttgcacaccggacgacaactaccggaaagattgcgtcagctgcagcaaaacttttatgaatgctgaatgctatcaacaccacctcacatctaattactgtaccaaatcgaaaaagtgcaagaagtgcggtgtcgtgtgggactttgaacggaatacccgtgacggaagaaagggacacgtatgcgaggagaaattctgttggacttgccgcaattaccatgacaaggggcggggttgtttcatcaagaaactcaagccgaagcatcccaaggcattccgtctcatcgccttcgactgcgaaacaacgcaaaacaccattattggcccaaacaaacgtgcacacatcgtcaactttgtctcagcccacgtggcctgttcaatttgcatcaaaggaaacacttggcgtcaatcactgtccggccgtacggcatgcaaaatttgcggtgaattccgcaccatcacgttctcacaccgtgccttcaacaacactcaagtggactcaatgcgtgtgtgcgaatcaccgatgacagaatttgcgcagtggcttctctcgggatttgataaaaa

SEQ ID NO: 80416 - DNA, 1540 bp, Heterodera glycines
  Genomic contig location: Contig_ID=SeqID_16059; Location=130..1669; Strand=+
  SCN-specific regions: Sequence locations=1-295,343-352,376-456,478 -517,539-805,827-1001,1025-1070,1092-1540
ctcaaatgcaccaagaattcatgaagtcattcatggcattacttctccaacaacaaagtcacaattggataatgcatttggtggagaagaaaaaagcaaaaagtaattaaaaattgtcaaaatatttttaatgagtaatttcattttttcagcgtcatcaatgccaaccattgttcaacaaactattccaagcatccaagtcggccaaacccaacgcccggcgggagggaggagcggtgcccttcgtttggccaaatttccccaacccaacgcagttcaattttgcacgaaggagtaattaaatataaaagcattaatttattaaataataataataataaagtagctgtaactattcataaatatttagtacatcaaaagaaatccttgatttagtctttgcaactttgagaacaaatttaaatgagaaaagactcaacaaatgatttcaaaaatatataaaaattgaagatgaaaatgcatattattttatattgttcactttttgcattagatttcctttattttattaaatttctgtcttctatgttcaggattgtgactcggaagtgacaatttgtccaccatcggctcggaacagtgggcgaagtgcagcggtggcagtagcgagcggaaacggcgcaaaaaacgatgaaaatgccgtttatacggcatcatccccccctcgatgcacaaccgactcatttcgacgaaagatcaaatccatggaatgccttgggacattggtaagcaaaatgaatgtttttttgttctgttcatttttggctttatttgaaaaatggggcatgaaaagctttaaatataaaaattataacagatatgtaaacgagaaatccagtagggagggggaggggggggtcggagaccaaaaatttcaaagtcctccattttttgcttttcaaaactttttggcggcgtgcttttttaaaaaattttggtgaaggggggtggggagaggtccggtggtctgataggcgccgccgggaaaattttttggaaatttgagtgtgatttgttaacagattttcagcaaaaaagcaaaaaccttgttaaattatttaatttttttagtcagggggtgtcgactccctccccccctattaattaatgttattaaaagctaacagttcacataccgctcgccaataatcgtacaaaaacggcacaaaattcaggacaatttttcgacgatgacgccgaacaaataccgtaaaaacagtgccgacccgccggtggattgcaatggcagtgacgaggacgaaaatgaggaggacgatgaaaaacagtgccatcaaaaaagacgacaacggacagtggaggagggacaggaggaggaggacagtgccaaatatggacaacggagtctacaaaatttgcacaatttgcaccccacggccaatcgaattgctaacggggcaaaacagcagcaaatagggaaactgacaaaccaaaataacaacggcacatttggtggaggaggaggggtaacaacgcattggagcacaagcggcacactggg

SEQ ID NO: 80417 - DNA, 1615 bp, Heterodera glycines
  Genomic contig location: Contig_ID=SeqID_16061; Location=190..1804; Strand=-
  SCN-specific regions: Sequence locations=1-147,169-301,323-538,569 -1033,1056-1219,1241-1277,1315-1413,1460-1512,1591-1615
atgacggtggaatcggtccgcccaagccaaagtcgccggccaccatcgccgctggccaagaggagtccaacaaggtggcactgctcacttgcgccaccgcgtttccggccgaaaaacggtggacccatgtggcgggcgtgcagcatgtgatctgtcggagtggggacgacagccaaatttatgggattggcaagaacacggacaacgcgttgggcctcgacacgtggcaggttgtgtatttttgaaatttttctaaaaaaaattcacgaaaatttttgatgcttttattaattatttccgaaagttttccaagaaaacgtttaaaaaaattgaagataaatgttatttcagggcaaccatgacgaggagcactggcgctatgacacactgcagcacatcccattgccggacggagtgaacaccgtggccggcgtggacgcaacgctgggcgccaccatattttggacggatgatggtcagtcagaaaaaaaatttctagcaataagattctcgatagaaaatttttttgtgaaaaagcaaattttttttttttttttttgtaaattttggtggagagattttggggtgctcccataataaaacacttttcaattacaaaatttatctacattttggactcacaattcatagctgatttccacatcaacatttttttttttgatttttcgataaaaatttgttttcaggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatggtaggcatggaaaattagggtgcaccacgtttcacccctccaactttttggaaaaatttttgaaaaattcttattgtgttaatttgcaaaaatttttcgagcctttgcaccaaatgagaaaatggttgaaattttctgaaaaattgtatcaattttacagtagtaagacaaattttatatgaatttcatttcatttctaaatcaggggcctgctggatccaaaaaattggctaaaattttttgaaaaatttgattttttttttctttgaatttgtttttaagcgctttttctcgccgcgtcgattgaccaacaaccgccgctgtcatcagcttcaccaccaccaccaccacaacagcagaaggcccagcagcagaaacaactgcagaccaacggcaacggaatattggaaacaccgattgatggcaaagcttgattgattgatggatggatggatgatttttattttttgttttgatttggatcatcacaaatcattttttgtgtctgctgcccttctctaatttgtttgtcgtctcattttgtttattgttgctctctctctctctctctctcttcccccctctctctctcccctctccacactatgcgcactgcattgattggctttgtttgtctcgatttgtttggcttttcttctctctctctctctctcccgcttctcctcctgttgcttgcttttatcttcccttccttcatccctccctcactggtcaaaggcaaagcgtacaataaa

SEQ ID NO: 80418 - DNA, 823 bp, Heterodera glycines
  Genomic contig location: Contig_ID=SeqID_16062; Location=236..1058; Strand=-
  SCN-specific regions: Sequence locations=1-97,126-215,352-402,425 -475,588-649,672-753,775-823
  Gene Ontology: Mol. function=receptor binding; Cellular component =cytoskeleton; Biological process=proteolysis and peptidolysis
tggaatactaaattttccttctttttttgtttaatttcatttcaacagtttacctccaataaatggaagaaaaacaagtttttgatttccgtaattcatcagttcaaatttattgttaaatttggcgaacacttaattttaaatttcatcggttgtttaatgtctgaacttagtatagatcggaattttcaattttataattacgattttcagtgaaataattaaatttttattggaaataataatgaatgaattttctattttcattatatttttagaaagttttaataaaattaatttttaaaaaatacaaattttttttaataaaagataattaatttaatttttttacagataaaaatgcattcaaaacattttaaaggtggaaaattcaatacaattcttcattttgttcctcatcaatatgcttgggttgttgaacgtgcgggaaaattccatcgcattcttgagccggtaatattaaaattaaaatttttaaaattatttttcggtatttattaaacaccaaaaaatttaatttaataataaatatttaaatttataacaataatatttttaattttaatgccgtagtgattttattttataaaacaataatacggaaaataatttatttattgcaagaagtaaatctttttaatttaatttagggggtgcatatcgtataccctctcatcgacgagatacggtatcggcactgtttgaaggaaatgtgcattgaaattccacaacaagaagcaattaccaaggacaatgttcagctggatttggatgccatcctttacgtccaagtggtcgaccc

SEQ ID NO: 80419 - DNA, 380 bp, Heterodera glycines
  misc_feature (85)..(85): n is a, c, g, or t
  misc_feature (172)..(172): n is a, c, g, or t
  misc_feature (210)..(210): n is a, c, g, or t
  misc_feature (221)..(221): n is a, c, g, or t
  Genomic contig location: Contig_ID=SeqID_16063; Location=142..521; Strand=+
  SCN-specific regions: Sequence locations=1-39,61-234,258-380
atgtctgacaaccgaaacgaagcggaggagaaaatggcgaaagcaatgtaaaattaaaatgccaattttcaatttcaatttttanattttgttttccttttttcagttttatctctggcgacggttggctttgtgtgttcgaattgcttccggcttcacaacttggccttgnaattgcgatgatcagccacccgtttgacttctacgtgnatgaacacttncagactcgctactggactctgagatccatgaaaatcaaaatgaagttcgaagcggatggcacccaagaaatggatgttggccatgccaattggaatcgtttggaatacgcaaaagcccgttgcaaagaaaagcccccgatttcaaggccctttcattga

SEQ ID NO: 80420 - DNA, 647 bp, Heterodera glycines
  Genomic contig location: Contig_ID=SeqID_16064; Location=535..1181; Strand=-
  SCN-specific regions: Sequence locations=1-127,171-593,616-647
atggatgcttattttgatgttgacgactttggtcgagttgggtcaggaattgatccgacctttgcttaccaagaattaagtccaagcagtaatgagagtatagagaaatgtacggcaaaatcacacataaatctttaatttaattttttagatgacatctgggcccaaccaaaatcaccgtgtagaatttctatcccttcgaccatttctggagatcctgactcagattttttgatcaaaaattgaagctgaacttgcttgctttaaggcaggccaaaggttagaagtgaacggagacttattttcctggtggcatgaaaacgctgctcgtcttcccgagttgtcaaaacttgcaaggatggtccacagcattcctgctacatcagtcagctcggaaaggctgttctcaaaagctggacttatctttaccaattcacttcgaaataggtcaaaaatcaataaatatgtttaatttatttgctaatttaaggctttccggcaatactgttcgacaaattttgattgtaaaggtcaacttggatgcacttttactggcaccaaaaacgaatctgaatcagatgatgaaagtgaagacaaagaagtttttgagttttgaaaattttgtttacgggaattgaaaaaataaa

SEQ ID NO: 80421 - DNA, 190 bp, Heterodera glycines
  Genomic contig location: Contig_ID=SeqID_16064; Location=1952..2141; Strand=+
  SCN-specific regions: Sequence locations=1-14,36-54,78-140,162-190
atgttgtatcaaacatttttaataataaattattctaaattggtaggttttatcaaaatatatttaaataaatttttgctttttaggattggtttccagtcttattatataacataacttttttataagacaaaaaacattttaattgtttattttattatacagaatttactgaaaatttaatggctaa

SEQ ID NO: 80422 - DNA, 60 bp, Heterodera glycines
  Genomic contig location: Contig_ID=SeqID_16064; Location=1353..1412; Strand=+
  SCN-specific regions: Sequence locations=1-60
atgtcgaggcgcgacttttttgatgggccaacaccgaatccaagtctttctccttcaatg

SEQ ID NO: 80423 - DNA, 1854 bp, Heterodera glycines
  Genomic contig location: Contig_ID=SeqID_16066; Location=516..2369; Strand=+
  SCN-specific regions: Sequence locations=1-425,449-452,475-668,690 -865,894-966,988-1081,1207-1513,1536-1854
atgcgccgtgataagagcacgttgcttgtcatcgacgaagtcatagacgtacttgctgaagctgttggtttttgtgaaattattgtcaaattattcaaattttgtttttaaattgtgtgtttaatagctgttaagtttgtaaatatgaatttgataattagccaaactcctaattaggcatattaactcatggatttagcccagtcgtgttgcgcgctcgctgatccttttctgtaagggcttcggcgaattgagcggcgtagaaacaccgggcattggccgtttgcgatcggcgagcatgtgggtattagactcggttaaatgatagtcttgaaaaaatgatagggccgacaagcactgcccgaaaattttttttttttttgaaaagagctaacaactttttgggctacaaatttcaaggtattttctttttcactaatatataaatgtgatgacaaataaatttaagtttttaaattcataaacaaatcgcttaaatttaataagaaagtttaaaatgatcaaatttcaggagcatggaagaagctgatcgaccaacgcgcaaattttcatcgccacccaaagaaacgatcgctgaagacggtaacctacagaaaaaagataccgtaaaaattgctcggctgacactgaaaaaggcaaccgcagtctaaaagaaaatgcagaagaaaatgagcttattataagacaattatttatgcatttatttgttggtctcttgacctattgatatttggtataatatctattccaaaaaataacggtttttggtgatttttattgtaaaaaaatgaaaattaagcaaaaaaaataaataattgctcggcactgagaatgaaaatccccgaattaaaaagatttatttatttatttttgcaacaaaactgggcaaatcaaaccaaaatgatattcttgagaaatgtaaaggaattgctgagatttcgtcccgatagtgaaaatggcgatgattttttggcaattgagtctcaaaaggaaatgaaatcccaaacacattaagcatcttcaaataaagccgtacttcctagcaaaccgctaattgctgataaaataagatataaaattataatttaaaatttccattattactaattttttgccatataaaatcgataaaaaattacatatatcttaaagatataataattttttttgttaatttgaaattatgacgtatgtatgatatcaataaaaatcaatccaatattcatcatatgcataaaattttatagcaaacgaaattcatttcatttattcattaattccatcaattttatttcattttcattttttcttggctaattttatacaagaaattattgcgagtaaaataatatgcttattaatttaggctttaatcattttcagcctaatacatattacacaatcctgacttttcatatgactacttttcccacaaccgtcgccttcctcacaattttcctagcgcatttatcgctattttatgatgcgagggtaaattaattgattgtttatttcaataattagtcttttttttaattttcagtgtgatgattccttctctgatacattcacctcgcacatcagcttatattgatacttccgctaaacaaccgcaaaatttggtggaattggacttggaagaagtgcgcaagttgcagcaattcatcggacaaaatgccatcaatcacattgttgttgaggatggcatttttgccggaatgttctcctgtcaacagaacatcgaattccgattagaagacgaggccattatgggtgatggcaaaatgcatcgaatgctgttctcattcggagcaatattaagtgccgaaattg

SEQ ID NO: 80424 - DNA, 1434 bp, Heterodera glycines
  Genomic contig location: Contig_ID=SeqID_2560; Location=1..1434; Strand=-
  SCN-specific regions: Sequence locations=1-103,139-347,369-985,1043 -1205,1229-1434
  Gene Ontology: Mol. function=GTP binding; Cellular component =microtubule; Biological process=microtubule-based process
atgcgcgaagtgatttcgctgcacatgggccaagcgggggttcaaattggcaatgtgagtgacttttgatgggtggccaattgagcagcggtcgtcggttaaggcgtgctgggagttgtattgccttgagcatggcattcaggtgaaagggaagtgccgcgggttaattaggctaattaattagccatccgtcgattgaattgcgtttagcccgacgggcgaatgccgaccgacgaaaggtgaaaaggaaatgggggccgattgcttttgattcaaaaaaacgaatgtttggcgtagtgttggcgtcgaggaccattcgtacaacactttcttctccgagacgccctcaggtcatctgtgaaaaaggcagcgaaagcaacgaagtgccattttaggaaagcacgtgccacggtcgattttcgtcgatttggagtcgacggtggtcggtgaggcgattggccaacgaattcacatcatttatatcctccgattgttcagacgaaattcgaaccggcacttacagacaggtgaacagaacgaatggcacacaaatcatccgattgcaatgccaaaatgaccattggaaatgccaaattgaccccaacccccggaaaatgccgaaatgacaccctcacctccttttttagcttttccatcccgaacaatgtgagagttgtcgaggcattcattttgacgtgttaatgggctgaaactgttgcagtgatcactggcaaagaagacgcggcgaacaattacgcccgagggcattataccattggcaaggaattaatcgatgtaaggagaagagaatgagctaattaattgggcataatttgcgaactcaggtcacaatggaccggatcagaagtgggtgttgggccgatttgacagtgccattccgttcttaagaaatcgccgaacagtgccaaagtctgcagggctttctgattttccattcgttcggcggagggacggggtcagtgagtccccccccccctccttttctccttcatccatcctctttcacccccccccccttttcagttccggcttcacttctctgatgatggaacggtttgctgcgccgtttcacagtttttatttcaaaaaatcgttcagtctttccgtggattttggcaaaaagtgcaaactccaattcagcgtttacccggcaccacagatttccacctgtagaaacggagtttaaacaagaaaataaataaataactttcgtttccttcccgtgtaccgtaacttaccgtattcgccccattccccgaaaagcgatggtcgaaccgtacaattcggtgctcagcactcacacgacgttggaatattcggactgctcctttctggtcaaccgttatctgatcggatgcatttctggcaattttttataattcaggtggacaatgaagcaatttacgaaatttg

SEQ ID NO: 80425 - DNA, 880 bp, Heterodera glycines
  misc_feature (17)..(17): n is a, c, g, or t
  Genomic contig location: Contig_ID=SeqID_2561; Location=518..1397; Strand=-
  SCN-specific regions: Sequence locations=1-33,55-880
  Gene Ontology: Mol. function=ATP dependent RNA helicase activity; Cellular component=spliceosome complex; Biological process=RNA splicing
atgttagctacacaacncatcggttagaaaatcgccttttaatattttattacttcattaaatttcagaacttttctcattgtcgttgaaaccgaagaccaaattgcgggcactcattgagattgtgtccaatgccaccgaattcagcactctcccaattcggcacaaagaggaagtgacgctgaagaagttggccgaccgacttcagggacagatgaagaaccaaaagtggaacagtcctcaagtcaaagtgggaattgcgcattttgaagtatccaattcacattgactctttgtttcctcgttcaggtcaatttgctgctccatgcgcatttaatgcgcattcagttgagcgccgagttgaccaaagacactgattggattgtgctgaaaacggtgcgccttgttcaggcgtgtgtcgatgtgctttcgaggcatgcttaaattagttttcactttgaaaatcaactttgtgcttcaaattccagcaacggttggctttcgcccgccatccacgcgatggaattgtcccaaatgctcactcaagcgatgtattcaaacgagtcgtacatgaagcaattgccccactgcacgcctgaactgcttgaacgttgcaaggaaaaagtgagagtgatgtttgtgtagcaattgttgttatgtctgtcatgtattcttttagaaagtcgaatccattttcgaactgcttgagctcaatgatgaggacagagacgagctgttgcaaatgaatcaggcacagcttgcggatattgccgtcttctgtaacaattacccgagcattgaagtccgacatgaaattaccacgcaaaagtcgacagtgtcagtgatgatcattttattacaattcagttggaacattaaa

SEQ ID NO: 80426 - DNA, 1168 bp, Heterodera glycines
  Genomic contig location: Contig_ID=SeqID_16067; Location=1826..2993; Strand=+
  SCN-specific regions: Sequence locations=1-126,152-173,195-275,298 -419,442-760,782-860,883-976,998-1111,1133-1168
atgaaaatttgtacgaaaattgcgaaattttggattttttggggcatttaataaaattttctttaaaaatcctcaaaaattcaggaaaatgctaaaaactcagcattaaaaaacactaaatatttatatacatttacaattgaaatataatcaattctttcgatttttttgatatattttgctacctaaaaaactttttttttgtttctcctatttttatgcctatttaatgcctattatgagatttttcctgcctttttagttgcctatttcgcgattttttgtgcctagaaaggaatccctaatgaaatcaattgacgttattttttcggtataaaaatttcctctttatttgataataatccgttcgccattaatccgttagcaaaatatggattataaaagacagttttacgtttattgacaaataaaatcctctcagattgcgtcggttcgctttcatcttctgatttttagcttagctcatcaatggttatcgcgtgatttgcaaattcaactcatttgcttttctaatcattgcattatttaaatgcccaaatgagcagaagaccaagaataatgcaaaaaatgtaaaggcacaaaaaattggcagagaaactttaaataacaaaaattcagagcaggggaaccgacgtgggggaaacgatgggggtgggtaaaaacctgcgccgtttaattcacctcaataaggtcctcgccagtgtaccgcgtcggtggctcctgcgcaggaaatgccacggaaaagtcgtcaatgtgaaaagtgccgaacctgccaaacaaagcctggaaaaatgttttgcattcagttttcataaaaacataaattgataaatgaccataaaatgaaaaatgaaatcaagaataaatgagaataattttttgcccatctaaatgaaattcgcttatttcagtcaatgcgctcgtccagcaagtgaaccgaatttgcaactgtaagagatttttgtaaaaattaattaaccaaaaaaaccgtccatggtggcgaaaattttttttcattttttgggggtacaactgtttaaagggttttcggttgtctgaggatccgattctggcacccatttgattttataagaatagcttcattttttctaaactcaatattgttttattttacatgtttgactga

SEQ ID NO: 80427 - DNA, 1554 bp, Heterodera glycines
  Genomic contig location: Contig_ID=SeqID_16068; Location=440..1993; Strand=-
  SCN-specific regions: Sequence locations=1-288,310-378,400-630,652 -652,882-890,912-955,977-1085,1107-1124,1152-1554
  Gene Ontology: Mol. function=protein binding; Cellular component =axoneme; Biological process=N-linked glycosylation
atgggatcccgaaaaatcctgcgcggggtcccgtcctgcgccatttgttagtgtactgtatcgacatttttgcaccagcacaaccaaccatcttttaagcatctgtccaccgcattgtcatggcgcatcaattacatcatcgatatttccaatcttttggtggtgttcaactcgtccctcaacttcgtcatttactacaacttctcacgccccttccgtgccactttcctgcggcattttggcaaaaagaaagtactgctcgaatcggccgttgtgccagcaccgcggcagaaaagggacccccgggaagggaggaacggcacgcacaaagtgatggtcactgcacaacaactacgctccccactgatcggacgtaatttttggtcccatttaattttggtataattggtaccagtattctgttgaattttttccaaacattttggggaacggacggtaggcaccgcaccgcagaaaaaccgagataaaaatgaaaaaactttccaaatttcagtcgaacgctgcacctccgttgcgttgtgggaatcggatggccaaaaatggaacgaaactttgctgaaagaaattgagcaaaattcgctgggaagaatgggcgaaaatgtgcaacggacaaagagaataaaaatgaagcaaaaagaggtggaagaaacggatgaagaagaagaaatacatcagatggagaggaagacgaagaagagagaaacggaagaagaggaggagaaagaaaaagaggaagagaaagaaaagggggaagaagaggaggaagaaagggaagaccggatgaggaggagaacggaaggggaagaggaagataaaagaggacagagtaggaagatgaacagagaaacagaagaggatgacaatagacaagtgttggacagactgaccggaagaaaacacccatcacgaagagagtggaaaaatcaggaccaatgccacgaaagcacgaagcaataattttgtaaatattgttttttttgtactattaccacagggattttagtacgattgtatcaaaatacttctcattattttcaataatttaaagcagaaaatgcgggcaaaaacatgaaacataaagaagaggaggtgaagcgcgaaggaaaaaattaatttttatttaatttaaacaacttttcaggtaattccattttacactttaaattggctctaaattgcgaatcataatttgtcgactaattctgttcataattcacctaaaacttcataaatttcctttgggctcagcggcaccgtcagtcagcaacaaattttgaagaaatagcttatttgttaggaaatttccatgcttgacatcggaaatatgcgcatgggaagtaagcgcctaatttgtatttttttatcatcgtatagataattttgaataggccttatgaggattttaaaaatttaaaaagcgaatcacggcgtctgccagcatcaccgaacttagaattattctggctcatgagaacattgataaagttttaatgaagaccagaattaatttatggttttggaacacaaaataaa

SEQ ID NO: 80428 - DNA, 375 bp, Heterodera glycines
  Genomic contig location: Contig_ID=SeqID_16068; Location=692..1066; Strand=+
  SCN-specific regions: Sequence locations=1-151,179-196,218-326,348-375
ttcttcaaaatttgttgctgactgacggtgccgctgagcccaaaggaaatttatgaagttttaggtgaattatgaacagaattagtcgacaaattatgattcgcaatttagagccaatttaaagtgtaaaatggaattacctgaaaagttgtttaaattaaataaaaattaattttttccttcgcgcttcacctcctcttctttatgtttcatgtttttgcccgcattttctgctttaaattattgaaaataatgagaagtattttgatacaatcgtactaaaatccctgtggtaatagtacaaaaaaaacaatatttacaaaattattgcttcgtgctttcgtggcattggtcctgatttttccactctcttcg

SEQ ID NO: 80429 - DNA, 870 bp, Heterodera glycines
  Genomic contig location: Contig_ID=SeqID_16069; Location=474..1343; Strand=-
  SCN-specific regions: Sequence locations=1-218,249-298,322-454,476 -760,782-870
atgaaacgccctaatcctttgaaccttccaatgagtgagaaaaagcccaaacttcgtcgacgcctgccggctgaattgaacagcgagctgatcagtttcgtgccattagtctgcctatttgccagtgtgaagcgagctccaattggtcctgtttgttaccaattcgagtgtttccgtagtcagcgccaaaagtgctttgaatatttggtattttcaccatttttattttattacataaattatttttagaagggtgttattgcattattcgatgtgatgtttgaggagaaaaggacaccgaagaagaagaaagtggggagactgcttctacaggaagaactgccgcaggacctcagccgaaatgagctcctgcactacctgtgctacggacgactgggaacgaatttgttcgagacttattttgtgatgacccatgcaacaaatgtaagcgaaaatttttaaatttttaatgacaacacaaaatttttagtcaattgccattgggaatttgtttgggcttctgctcgattttgcaatgagctcaccaactccttggctcatgaaacggcccatttgctgtggaattttctaccgtcaacatttgccgtggattctgcaacaaccgatgaacgtaatgctttctcatggcttttttccggaggtccgaagtgatggttttgaatttttttggctgttcaacccacacttgaaaaagtatgctgggtatgtcagaattctccctgagcttagtcaacctgacaatttgcattttttccttagcattttctaagcattttacttgaccaatttattcatcattatcattacatacagatcggaatttgtcgatttttccattttctcaataaa

SEQ ID NO: 80430 - DNA, 676 bp, Heterodera glycines
  Genomic contig location: Contig_ID=SeqID_16069; Location=2306..2981; Strand=+
  SCN-specific regions: Sequence locations=1-676
atgactaacaacactctcgacaccattctcaaccagttcaaaaaagtggcgcagtccaaacaacagaaaaatgtatcgttatggggtgagccgtttaccgtcaccataacgacattgaatcgcaatggactgccacccaaacgtcgagtcaaagggggagctcgtcgtccagtcaaaactgccgttcatcaccgaattaacgaccaatgtctgattaaaattcgcaatcccgatgaccactactgccttttctatgcgctgcaggcaacaatggtcgacaaaacgtgcaattggcctcgctggaagttttcccgttacttgaacaaccaatacggacagcagggacaacttcatcgtgatgcagttgagctcatgaagcaggtgaaagcaccaatggacttggatggctacgacgcagatactttcgtgcctctcattgttgatcactggaacaatatgcagcaacaacaccgctttgctgtgttcatctttggatcgttgggacagtataaaccgatctacaagtacattgacaacatttacgacactccgctgctgttgtacttcaatgaggaccattttgatggtgtgcagaagcagggcggtctttttgggcaaccatactgcttggagtgtgagcgcccgtaccgaagaatgtcgacacacagtaaatcat

SEQ ID NO: 80431 - DNA, 92 bp, Heterodera glycines
  Genomic contig location: Contig_ID=SeqID_16070; Location=1795..1886; Strand=+
  SCN-specific regions: Sequence locations=1-92
atcaatccggctgttcggtttttggagccctccgacattttgtctcaatgggtcgtcgcttttcctggtcatttggaagaatcgactgtcag

SEQ ID NO: 80432 - DNA, 1184 bp, Heterodera glycines
  Genomic contig location: Contig_ID=SeqID_16073; Location=830..2013; Strand=-
  SCN-specific regions: Sequence locations=1-954,976-1184
atggtggccatgttctctttgttctgcggtgccactgaacccatcttcagcagttgtttgcctcctcacaacggcggctacgactatttgttattcgatgccaaagggccggaagctgattcagcacaatcactatttgctgcaacatcggcagtcccttctgctgctgttgttggtccttacccaaaatttgcctctggcaaattgcctgccgaaaaaacggcgccagaggcattgtcggcacaaacgccgcgcagcaaagaaacggacaaaaattggcacagaaaatggtgtggtataaaaggaccttctttgtccaaatccccttacggtgcttttcattaggtcagccgcttctccgtcatgcaaacctttccatgccaaagcggcttccgaaccgccgcccgattgcttcaacataacggcaaattgcgttgccaaaaaacatttttcatcattccgtgttaataattccgtctcaaaacggcctaagtacaatttctcctccattgttgaggaggagaaaaaaccccgacgaaaattaacaacaaacgaaacaattggacgaattgggcgatttatggtcctcagaaatgaatcaaaaaaagggatttaattttttgtccttttcagcacttcctcgagtcgctgaatcctttgaacggctttaaggacaaagacgacctcgagaattacctgtacaaccaatcacataaagtcgaaccgaaaaatggagaaattccaaatgcggtaaaaaactaagtaaaaaaatgattttacaaaatttatttcagaaaccaaaacaccctcccgaagcgttgaaatcgcccggtgttaagcagcaaaagactccgatcagtggcagcagcggcggcactttccatcgtttccctacggccaaatcgagtgcaaaatcgtccgcctcctcgccccactcgccgtgcaatgcgcccagtggtggtggtggtggtggtgcattgctgtccccgtcacacattaatgtgccgactcggagtccggcttctgctggctccgcttccggctcgtccatgtcaatggcattggccgaggacccgaactttgccatcgttgacatcagtccgggtgagattgtcgagagtcaaaagagatgggaattaattgcctttcctcgattaaggccaattccctcgatggcttggtga

SEQ ID NO: 80433 - DNA, 544 bp, Heterodera glycines
  Genomic contig location: Contig_ID=SeqID_2563; Location=285..828; Strand=-
  SCN-specific regions: Sequence locations=1-25,61-129,163-183,309 -387,447-544
atgagacattcatcttcaaagtgagttttaataaataaaaataaattaaataaataatttgctcaagttaagggcattttttgttaagaaatctcggcaattgccaaattagtatctcagatcaaaaacatttttaattaaaaaaaattttttgaaatttttgtcacttttcgttttcaattcatatatttattaatttttattaaattaatataaattattttatacaatctattataattgatgaaatatttcaaaaaaagagtcaaataaacattttacaaatttaaatttctattaaaattttagcttccgtattccgaattattgggcaaaacgttggaaattgttgcctatgattttgatcggcttagcaaagatgatcggtaatttatttttaaaaataaaataaaatttaaaaattatttttgaattttttttttaaagtttgggccaaatttcactgccattaaatggcatcgatttgggcacaacgacacaaaaatggacaaattttgaagcaccaaaggacgttgatgagctc

SEQ ID NO: 80434 - DNA, 456 bp, Heterodera glycines
  Genomic contig location: Contig_ID=SeqID_2566; Location=115..570; Strand=+
  SCN-specific regions: Sequence locations=1-9,31-120,142-317,354 -387,409-456
atgaggcataaaaattataaaattaaaggacaaaaaggagctttttggtcttatcgtcattttattcagtcaaaaaaagactggctttttgtaagtccttgaatggtcctgaactgtacttgaaaatcagaaaatatgtaagtccttgcattgttttgaaccagttttatagtcagtccttgaatggtttttagtcagtccttgaattactttttgtatgtcattgaattttctttatctacatttgaaaatcagttagtccttgaatggccttttgtaagtccttgaatggtcttgaactatgcttaaaacaactctttgttctgtagattaaaaaataattgcttttttgaaatcaaattatagaaaatgccgttggaaaatcgtttttaaatttggtttgaatttgtcggcacagaaaaaagttatgacggattaaaaaaagataaatgtgaa

SEQ ID NO: 80435 - DNA, 949 bp, Heterodera glycines
  Genomic contig location: Contig_ID=SeqID_2568; Location=84..1032; Strand=-
  SCN-specific regions: Sequence locations=1-207,235-372,436-484,531 -686,719-749,775-949
atgcacttttatgtgaaccgtgccatcaacgacactggtcacaaaagcaagaactaccgtagtgatggtggtgccaaaacaaattacggtaaggaacgggggcgggcggtacagtaggacacagggacggtaccaaggtggtggggacagacgggagcaggacaaaatgtcgcagcgccgaagcgtcgccggacaaaatgtcgacgcaaaaattttttttattatttttttaaagtttgaaaaagaattcaaaaaaataccagcaattttaagttatctagccaaattagaaaaaaatcgactaataataaaagggaaaaaaatcaagttttctttttgttgaaatttattttcagtaacacctaagttttcaaaaaaaaaatcttcaaaaaaattttcttaaaatttttgaaaaaattttatttatttttttttgccgcgcgcggcgttttgtcccggcgacgtttcggcggcgagacccgggattttatttttaaaattattttatgaaaaattgaattattaattaactagaaatcttgtaaaatcccatctatttttttttattagattgaacaatcccaagatttttaatcattgctaaaaaaaatctgctacggattgtccattactgacgaattttccactgacggattgtctgggcgacgggatccggacaaatggactaaaaaaaattaatttttttttagaaattttaggaacactaaaaactagagctcggcctggacctggatccaggtccaggtccaggccatttttcgacaacctggttttttgtccaggaaatcaaggtccaggtcaaatgtgaaaaaaaaatccaggtccaggcaaaacaggaaaaaacctggatttacctggacaaaattttagaatttattttttcaagtgaccgatgttttttcaagttttcaaaaacagattaaataaa

SEQ ID NO: 80436 - DNA, 592 bp, Heterodera glycines
  Genomic contig location: Contig_ID=SeqID_16080; Location=175..766; Strand=-
  SCN-specific regions: Sequence locations=1-592
attttatgctaattctggctcttttctaagaacccgtgcggaaatataaaagcaaggaagtcttctgcacgcctttgcggcctctgtacggcactggggccaacacattatgtgtcgttaattttatgctaattctggctcttttctaagaacccgtgcggaaatataaaagcaaggaagtcttctgcacgcctttgcagcctctgtacggcactggggccaacacattatgtgtcgttaattttatgctaattctggctcttttctaagaacccgtgcggaaatataaaagcaaggaagtcttctgctcgcctttgcagcctctgtacggcactggggccaacactttgtgtcattaattttatgctaattctggctcttttctaagaacccgtgcggaaatataaaagcaaggaagtcttctgcacgcctttgcggcctctgtacggcactggggccaacacattatgtgtcgttaattttatgctaattctggctcttttctaagaacccgtgcggaaatataaaagcaaggaagtcttctgcacgcctttgcagcctctgtacggcactggggccaacacattatgtg

SEQ ID NO: 80437 - DNA, 563 bp, Heterodera glycines
  Genomic contig location: Contig_ID=SeqID_16083; Location=2249..2811; Strand=-
  SCN-specific regions: Sequence locations=1-247,269-467,489-563
atgcgctatgagattaagaaggactaccgggtgacgaacccacgcgagctgatccaccaatacgcgaccacaacgcccgtgacagtgatcgacccgagcctggagaccacgcggacaatcacccgccaacactacacacagaccgtagaggaatcgtaagccatcgatgggacggactcccctcttttggacaattgccaatcacagattcgggccctacccgccctacacatccccgccaaatgtgccaagtccattgaaatttgtgcaacagttgagggacgaaagtgagcggatcattctctgatctgtcattgtttggtattgacagcgtaacgaacaatcgcttttaagcaatgaccgaaagtcaacgccaagcgaatcgtcagcagcaatcgatgagtgcgagttcgagagattcgaacttcgaacaacgcatcgaagtaaaagcgaagccgacaattgcaatgatcaaaatgcaaatgctttcaatttgttttggcaggaaattcggcgctcgacaagccgtcaagcgagcagtgatccgatggtggaacagttga

SEQ ID NO: 80438 - DNA, 884 bp, Heterodera glycines
  Genomic contig location: Contig_ID=SeqID_16084; Location=1..884; Strand=-
  SCN-specific regions: Sequence locations=1-199,221-884
ttcacaggaacgggaaactccgttttccggatacggcgaccgcgtgggttcgggcgttgcttacacgccaacgctatggaagggaggagaggtgatttggcttgaacttactaagaaaatgaaccatcaaacattttgagattagcgagtgaccactacttaattagtcacccgaccaatccgaattccgtctctcatccctccctttctctgctcagcttgtgactgatccggcgcttgtcaacaaatcgataaagcctcgacgcttttactatgctccgatcggcgacggtgtggtggccgccgacggagtcgaattgaagcgattgccgcgcgatcttacgccaaaggtggaagtgatccaacaaagaattgttgagaaaagtgaccgaggaaggcccggggttcgcataacggagaagacatggagcacaggaggtcaattggaacgtaaaacttagaggatttagaattgaatttgaagctcccacggaggattcgttgaaaggctacgggcacagcgacaaccccaatgaatttcccgcttcggacgcagggcgcgggtcgcgcgcatcggagccggacgccttcgccagcctcgctgatcagctgggcccctccgttcgcccaacgtcggcacaatccgctcctcctccaaccaaaaacggatttggaggagacaccggaacggcaccgaaggactggaaaagaggacccgccgaagacggagcagcaggacatccgaaaaattgggagggagacggtgggccgcgaatggggggacggggagcgggaagaccgaacggtggaggcggaccatacgatggctcaagccgttcgactccgttggacttcggcaaggcccctgcgaccaacggattggg

SEQ ID NO: 80439 - DNA, 1111 bp, Heterodera glycines
  Genomic contig location: Contig_ID=SeqID_16085; Location=56..1166; Strand=+
  SCN-specific regions: Sequence locations=1-111,133-189,211-581,603 -621,644-893,934-1111
atgtgggagagatgcaaattgaaggacgaagcaacggaattgggtgggcaaatgcaacaaatgacaaggaaatgagcgaataaaaggccaaaggttggcacagaataaaagcaaaaattggggggaaatgggaaaaagacggaatcagaacaaaattaattggcaggcagagaaaggcgggcaaagattggggggcaacccaaaaaagggacaaaagcattttcgtaattatcatttgccgggcttcccccccccccccccccaacagctagctgcatattcaaatgcccaaactaacaattagcatcgatcgatgacgggagaattcaaatttctatacttagcatttgcctcaattttttgaacttaaattaacaaaaaaagaatatgagtgcttttacaccaacttaaaattttttgcttccatacttttgcaccgccaaaaatttggtcaatttggttacggcaccttaactttttgatggcttgactaatcaggatagtttttctagattaatgttagtcttttgttttggcagagggaataatttcattcaaacacttaaatcttggaaaaccggtttttatttaaaaaattttttgcttccatacttttgcatttgactgtattaaattttgaaaaataaagccaaaaataacaactttttccaaatttttaatctattaaactcgatcattgcactttcacccgcgcaacgtccgcacgattcggcatatttctgctcgtgcattcgctgcccgtttcatcgtcacaggcagcactttgcccgaggcgaacaacgaacgcacggcaaggcgaatgatgttcagttgtgcccgtcaatggtcacagttaaataatcatattgaattggattttatctatgatgtagccacagttattgttgcatttgcaaaataatatttattcaaaaaggcaaatgtgaaaatattcattcatttgccaattcgttgactttttttacaaattctttttttacaaattgcggtaaattcccaccgccttttaacaaaaaaagtaattattattttcgactttgtttgccaaagcacaattgacagaatacttcgtggtcgagtctgaaacaga

SEQ ID NO: 80440 - DNA, 727 bp, Heterodera glycines
  misc_feature (721)..(721): n is a, c, g, or t
  Genomic contig location: Contig_ID=SeqID_16085; Location=2493..3219; Strand=-
  SCN-specific regions: Sequence locations=1-133,159-182,204-285,338 -580,603-662,684-727
atgtggatcattgaaagatttggccaacgtttcaatttgaaatgccgcggaaaggcagaaattgtggacgatattatggacaatattaaggttggcaaataaaggggggggggtaattgactaattaattacctaataaaaaataatttaatttattagagagggatttatacatatattggaaatgttatacttacttttatggggccacacttcaaatgtttgactcgtaattattcatttggcgcctgaggactgcaggtcaaagaatttgaagtgtgccccataaaattaaaatataaatgtttttaaattgaaactaaatattcaattaattgcataaaaatgtttcaacaatcaatttgatagaaactccgttttaattttttaagtaatttagagtttattgggtcaaaagtcagaattccaaagtggcctgaagagaaagcagaaactggtgaatatggacatttacgttcggtatttgaacagaatcgacgaaaagtgccgaccattttatgccaatgcctttttggacggtttgccatcactgaaaaatctgttctgccaaattcgcttttttatccaatcgactgcaaatcaattcagcatattcaaacatgttgctgaaacccagggatttgaagtgatgaagcagcgaatttgtgaataatgtttatatgcctttttatctatgttttttttcattttcattttaccnaataaa

SEQ ID NO: 80441 - DNA, 752 bp, Heterodera glycines
  Genomic contig location: Contig_ID=SeqID_16087; Location=401..1152; Strand=+
  SCN-specific regions: Sequence locations=1-74,96-337,384-557,595 -627,649-752
atgactcacttgctatacattcgaatgaaagccaacgactgtccgggggtcgcttttatccgatccggtgggtgctttttaattgctgtgctgaagaagtgcctggggtaaaaattggcacactgtaaaatggcggtttagtatacaatcggactgaaaaattactgtatgtccgctatttttattttccacgctatttcacaggatgtgacatctcattcatttcggagtcgttcgcacggaaggccaaccttttgggaaacattgaccgttccgattgcgagacaatattcgtgccggcttttcgaggtggcaaattgcttggctggtgagtgggtttttttaattttgaaaaaaatcaaaaaaaaataaaattttaaaatgtttttctttatcacctaggtcttccaatatttatacttagttttcgtttcacgttttgcagggtcaacgatgttcaagttcgtattgatgagctcaatttgcaatttgtgtaccgtttgggagtgatggcggacaaacatttgggaatgtaagtttggcgtattgtcttttacatatttaaacatttatttatttaaaaattaattttaaggtattgcccgaagaagttcgacatgctgtatgttttaaaagaagaatatttttccctacaattataagaaattgaaaaattattgggtctgcgccgaaatggcagcgccgaaacggcacttatgacccagttttaagccaaattttccttaaaaata

SEQ ID NO: 80442 - DNA, 659 bp, Heterodera glycines
  Genomic contig location: Contig_ID=SeqID_16087; Location=2227..2885; Strand=-
  SCN-specific regions: Sequence locations=1-187,210-270,292-484,506 -519,541-659
atgattgccgtaattgatatggtaggggcccataccataccccacgacgatgtcaatgactttgtttgtgaaaaagcattcaaattacaatttatgtttgaatccatcccgaactatagggagagaaaagtcagggaacatggaggaaatcccacccgcccccctcccccaaaaaaaaatgtcaatgttggtgggagaaatttaaaaaatgtcagggagtaacacatttattgttttttttaaacattatcaatctttttttcattttgcaaggaaataaaaaaccttaagggctatcgaatgataccaagaatgtttaggtacctaattgggccaaccttgacaaaagtaatgacaatttttttgtcgaagaacggggcattttgttagtacgagttggcctaatagtatgtacgacgtttggtgtcgtcgtccacaaatatgcacaaatgtcgaagaaaagttaaaatcgtttcttccatccaaatgaaaaaaggcgaggacaaatcaatacatgaggcagataaacttcagcagtagcagactgcataaactaacacaattatgtaaggtaatcctaaacaccaaatgacaagcaaacaaaaaaattaatgacacaaaattaaacaacaacaaaacgccaattttttgagaataaa

SEQ ID NO: 80443 - DNA, 105 bp, Heterodera glycines; identical to SEQ ID NO: 63572
  Genomic contig location: Contig_ID=SeqID_16088; Location=1018..1122; Strand=+
  SCN-specific regions: Sequence locations=1-105

SEQ ID NO: 80444 - DNA, 330 bp, Heterodera glycines
  Genomic contig location: Contig_ID=SeqID_16089; Location=1557..1886; Strand=+
  SCN-specific regions: Sequence locations=1-95,119-192,215-222,244-330
atgctgtcaaatttatctctacggtaaatattgatcataggccccaaactcaaaaatgcttaaaaacggtcagaatcgatgtaaaaaagtttgaaatggatagaaaaaatagaattaggggcgcgcttgcccattttcaggatgaaaagtgccgaaaatggagtgccaaactcagctggggctcaagtgaccgcactataaaaagcattcaaaagacattttaaataatttttctagggtaatttgtggcgctgatcacgaatatgacctttattttgcaaaattccgaaccccgaaccctaattcgaacaaaaatttgaaattcataaa

SEQ ID NO: 80445 - DNA, 1504 bp, Heterodera glycines
  Genomic contig location: Contig_ID=SeqID_2569; Location=457..1960; Strand=-
  SCN-specific regions: Sequence locations=1-23,50-91,117-609,632 -689,711-842,869-1504
atggcaattaattctaaaatatctgaaaaagaatgcaactttttgggtagcgataaacgttttttaagtaagtaactaattattacagccgcaaggattttagaaatgtataaaaacaaggaaaataataaaagatgaattttcggtagccaatactcggctctccggtagtcagtacctaattaagctcggccctccggtcaccaatacctcacaaggctcggctctccggtagccaatacctaattaagcttggcccgccagtaaccaatacctcacaaggctcggctctccggtagccaatacctaattaagcttggtccgccagtaaccaatacctcgcaaggctcggctctccggtagccaatacctaattaagcttggcccgccagtaaccaatacctcacaaggctcggctctccggtagccaatacctaattaagcttggcccgccagtaaccaatacctcgcaaggctctgatctccggaacactgaaaacttcattcttttgactatgaatttttatttttatgcaaattgttatcctcgtggtctaaaatttatatgagaataaaatatacctttcctattgatttggcaaaacgcataggatggaaaagggagtgtgtaaactgagtttgcgatggtaaggagcaataatgaccgaatatgtgttggagaggaagggcagagctgaggaaaccaaataagtgaaggagaggggggtgaggtcacggcgtcatcttatcctgtaaatcgattcctctaaaaggaacaaatggaaagaggctaacgccaactgcttgcttaacaaaatccaatatttaagatatttttggtattggggttatttgaattattttccttttctccgtaatacactttctctactcttatatctgcttactttcactgttatttcagacctacatattgtctaaataatcgtttccgttagctatttttcaatatcttttcttccaacactatgttttattctcgaaccgttatcttccaagtgttcgtattcttgttctttatcaaactattctcttccctatacattacctaatgtttgccttactaactcacattaaattctcactatttaatattgactctcttcaaccacatttctgagttctctatctctatctcttacacccattattaattgtccttgattctatggtgcactacaatatcctcatatgatttcttcatttattcctattacaagacctgcttcacgcatacatttagcccttatctaccctttctcgtcacatacagtcagtcagctgtttgtcaaaactactttctattctcggttcaatcttagattcaaaattgtctatttctcttgtttcctttgaatattacttattcaatggaattgtaaatgttccttattataattagaatttattttacgttgaattaggcaaggagcattgtttgtgtttatgattaaaattaacaagttttatataagttaataaa

SEQ ID NO: 80446 - DNA, 694 bp, Heterodera glycines
  Genomic contig location: Contig_ID=SeqID_2569; Location=3214..3907; Strand=+
  SCN-specific regions: Sequence locations=1-292,314-451,495-515,652 -660,682-694
atgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatggatactaaaagacgctgcctttccttaataatgccttagttcctttgagacatcaaataattccctcctaaacgataccagcgctgtcattaaaattttgaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttagatataatttacttaattttaatcaatactattgtatttattatttttattatattttaatacaactttaatttaatttttttattttatttttatttaacttttatttttaattttaatcttttttatttttattttactttttatttgaattaatttgaattttattttactttatttattattcagttaatttaaaggagttgttcagaacctctatcca

SEQ ID NO: 80447 - DNA, 589 bp, Heterodera glycines
  Genomic contig location: Contig_ID=SeqID_16092; Location=828..1416; Strand=+
  SCN-specific regions: Sequence locations=1-165,187-214,251-589
atggaagttcccgccgactattctcttcataaacacacttttccaaacgggacgaatggtttgttgggccatgggaaatgattgcaaaaagtacttttattcattttctcttgacattttgactcatgcttttggatacgattgatgctcttttaagagatgtcccagcagcggaggcagcaaatgtctcactcgagcgatgaacggagttgccaagaggaggagacggaggaggagcaggacgaagaggcgatgctttacacggccaaataccgtcatttgctcgagtattacaagcacatctccgaagttgtcattattagtggtacttattaaatttacggtatcaaaaagccaagaatttgaaaaaagtcttagataaagttgaaatggaagccggttttgtgctcgcaatcagcagtagtgaacttagcataagaaaaatattgtcagcttttttttttgcttttgattctgtaaacttaataagtaatttatttgctttgtttttgaaaagcattaatttttttgaattctaattaagatgaataatcgtctcagacatcgcatttaccatgtgaagaaggaa

SEQ ID NO: 80448 - DNA, 1024 bp, Heterodera glycines
  Genomic contig location: Contig_ID=SeqID_16093; Location=186..1209; Strand=+
  SCN-specific regions: Sequence locations=1-192,214-544,566-590,612 -790,812-1024
atgccaacatcgtcgacatcttccgccgcctcttcccccacccgctgccttggtcccctcttcgtcctcatcggtttgccatcaccacccacaacaaccaaatgtaagtaacgggtgtagttttttgtaaatttccatttttccgccgctaaccattcttattctcattgtcagcagtgtagttgttgctgtgtcagttcctccaacaacagcaattacgaaccgttgtccgaatctgatttatccgctgaggaattggccgagcggctcatccaccggcgctcatccatcgaccatttactgcccgaggcgcccgagccggacgacgacgccgacgctggtgaacaggaaaaggggaaggatcgcaaggaggaaaagagcaagacggagagaagagacgccgtttttggaaacagtaaacacgaaaaggaggaaggaaaggacaaaggaaacggaggagaaacccaacaacaacaacaaaggcagacaataacgcaagaagaaaaaacaccttccagtgaagacgaacagcataaacaacagatgatgacaaatacaactggtaagaatatctgcactcctggcccctaaattcctctaagatttcaaaatttaacaaaataggcaatttcagtaagatctgttgaattcttttcctgttgactccaaaactccttacttttaatgatggactcataattctttttagttgtaccaaatttcatgaaacagtcctctgacgacctgaccgaagaaaaaagtccgctggcaagtcaatcgcacaaccaacaacagccaccatcaacaacaacggcgtcgtcattttcgccgtcctcggcagtgacgccctttgtgcctgctgctattgcttcagtgtcaatttatgcagcgaatgatggtgaaaagagacgagaaaccgaagaaaaaaatgttgaccaaaataccactgttgccgaagatgagaatgaagatgacgatgaaatggaacaggaactgtagcacataccatttgatattagtttaa

SEQ ID NO: 80449 - DNA, 2461 bp, Heterodera glycines
  Genomic contig location: Contig_ID=SeqID_16095; Location=1..2461; Strand=-
  SCN-specific regions: Sequence locations=1-45,231-237,265-416,438 -467,489-822,851-1408,1456-1641,1674-1823,1866-1895,1950-2084,2107 -2176,2204-2294,2317-2461
  Gene Ontology: Mol. function=glycoprotein 6-alpha-L -fucosyltransferase activity; Cellular component=integral to Golgi membrane; Biological process=protein amino acid glycosylation
accgcaggacaatggcacaatttgtggacgaggaacgaccactagaaagtcaaaaagaggaaaaagagaaaagaaattaaaaataggcaaaatttaagggggaaaagcgaagaacgaaaaagaaaaaagcgacgaaaatcaaattgaaatggaacaaatgggagaacaattggaagcattgagaagagaaaatgaaagactgaaagaagaggtgaaaaagggaaaaggaattaaaacaattaaaaaataattaaaataaatttagaattcgaatttaatcaatccgacaaaagacgccgaccaatcggagaatgggcaggcagcagaactttactcgaaggagcacgaattggcacggagagagttgaacagactgatcatggagctactgtacacgaggtgtacggtaatttagcaaaataaaataaaagtgaaatttgagagtgggcagcagcagcagaaaagagcaattggaaggtcaaagagacggacagcaacttttgaatgacgaacaggtgattgattctgacacggtcgaagaatcggacggactgatcagacaatcgaagaattgatcaatttccatctctcttttgctgatcagatactccatttgttggcccactcgcgtcaatttgcgcacgtcgacggcgccgaacaatggcaccgccgggcgttggcacgcgtcgcttcgaacattcaaaacgcactgcacgcgctgcaacacccaaaagagtgcggaaaggcgcgacttctgttgtgcgaggcaaaagcaaaaataaaaaaggggaaggaggggtgatgatcgtcgaccaattcaaacgaccgatcgatcgattgatcaatcgataagcttgcctgatcaatcgatcgattgcttttgtttgatggatcgatggcactgaaaacggacgaatttcagctgaacaaagggtgcggcttcggctgtcagtttcaccacgtcgtttactgtctgttaatggcggcggccacaaaccgaacgatgcttttggagagggacggcgccgagtggcgctattcgcgcgacggatgggccgccgttttccgatcggtcggctcgtgcactttcgcagaacatgtaaaataacacagcattggacaaactttggacagtttcccttttatatcctcaattccgatttttctaagttttttatcccttcgaattttcaattttcgttttttttctacgctttttcccctcatttgtcaggtgcctttgtccgtcgtcgtcgatcagttcactggcattaatcagcccaactccccccgaatcgttcgtcttcccgtggtcgatgggctctcctcccgtccccatcaccttccactcgcattccccgcacaatttgccgatgttttgctcactcaccactcaaacccaccggtcattaattaattgattgattaattagtagtaattaattattatttaatattcatttaattcattctttaggtgtttttccttggacaatttgtcgcttttttaatgcgtaaaaatgaaaggacaaataaattcgttgaagaagcaatgcgcagaattcccttcgaattgggcaagtcaattctcacatttgctgtgctgaagaataataatttaaatgccttaaatattttcccttaatttaaatatttttattattaattattttccattttccctttttaggccccgtcgtcgggttgcaaattcgccgtactgacaaagtcggcactgaggcggcctttcatcatgtcaatgagtacatgcgatgggccgagctttggtttcgcacggagcaaaagaaattgggtaaaaagggaaaattataaaataaatacgaaaaataaaattaatttaaattgtttttacgtgcctttttaattctcttccctttattattaattttgttttttcattaatttaattacctttaataattaattttcttttcttggccttcccctgaaaaagcgcattttcatcgccactgacgacaaaacggtgatcgaagaagcgcggacggagtgggcaaagaagggattcgaaatttgggcaaacgacgaaagtgccgaaggtgggcaaaagggcaaaaaagggggaattggggacaaacgcatcaccgatcgtaatcattaaaattgaatttgtctgtccgtccgtccgatcactctctttctcccccactccttctctctttagccgctcttccctccaatcgatactccgatcggtctttgctcggtgtcattgccgacgtgcacattttggcgcattgctcgtaaattctaacatttttgcttattttaaaatgatttgctcctctaattgagcagatacattgtgtgcaccttcagtagtcaggtgagcctggggggggggggggggaaatgagacctaaagttaaaatagggacaaataaaataataccatttacatgctaaaaaactattcccgaag

SEQ ID NO: 80450 - DNA, 414 bp, Heterodera glycines
  Genomic contig location: Contig_ID=SeqID_16096; Location=399..812; Strand=+
  SCN-specific regions: Sequence locations=1-173,195-305,327-414
atggtcaaatatttccatgacagagacaaaagcttggaggaacaaagggaattgtggctgcagaaaattaggcatttgtctgatgaggaaacggtggatttattggcgggaacggacggaaagatgatgagtaatcggatattcgcgcaggtataatgaaaaccttattttttacaaaatagaggagttctggttttttagcgcaatgccgtgacccgacttgaggcctccggtgttcgtgtgggctatgtgttggcagagcattttgccaaggatttaccgcgcttctcgaacgaattggacaaaatgaagttcatctgcaaagagttctgggccagcactttcggaaagggagtggacaaactgagcacaaatcatcaggcaatttttattgttaactaccaatatttcaag

SEQ ID NO: 80451 - DNA, 370 bp, Heterodera glycines
  Genomic contig location: Contig_ID=SeqID_16097; Location=750..1119; Strand=+
  SCN-specific regions: Sequence locations=1-370
atgcccatacaaaggccacgattgaccgtcggaaacacttcggaagtgtacacgaaaagacccgtgaaagaagacgaaatggcgaactttccgatgagccaaaggacgaggaaaagttttgggctgtcgttgagaaggacagccaaaaatgcagaagcggccaaaaagtgagtgaaagaggtgaaaagacgacgacccaacctgcaaatgcattaagacaggaggacagattggcatttagcaatgaatgcacttttccaggaggaaaggcgcgaataaatacgccggcacttcggccaatgccaccaaagtgaaattgacgaagcgattgccggccaattgggcgctgaacaagctgaggccgtagtaa

SEQ ID NO: 80452 - DNA, 1486 bp, Heterodera glycines
  Genomic contig location: Contig_ID=SeqID_16097; Location=440..1925; Strand=-
  SCN-specific regions: Sequence locations=1-258,280-1217,1242 -1271,1314-1486
  Gene Ontology: Mol. function=organic cation porter activity; Cellular component=integral to plasma membrane; Biological process=carnitine transport
ccctcagggctgtgccatgctcaattgggtgctcgcacattaaagcattccgctccatctgcgctcccaaagtgcgttactgttcgggctgatgtgggtgctcggctactgtttggtggccccggtggcttatttcaccactaattggcaacaattaatcgccgctgcgtcggggccgtccattttatttggcattttctattttttgtaattcttccaataattttttatgtcaacaaaagcagcattttcagcacaattcctgaaagttttcactttttggtggccggaaagaaattgaatgacgtgaaaaaatgggtggaaaaggcgaataaatgcgcagcgaaggcggggacacgcgcaattggaagcacggaattggaccaattcattgggcaaattgccaaagagaaagaagagcaaagggacgaggaaaacgaacggcggaggtgggaacgaattgggaaaacgatttgactgatcagtgagggctaccgtaaccaacagaaagtgcagagatactgtatttcggaaatagacaattagcaaaagaaaaactaaagaaggaatctgatcgatgccacatttcgatcagccactcatttcccgccatcattgccccccccctcccctcccaaaatgccaacggtgatttaagcaatgcttcccaagtgcgccacttttggaccgatcgtactctgatcctctacctgaccgtgttctgctttctttggtcaacaaaataatttggtgcaattcaaagtgaaggtgaatctttccatgctcaggacttgcgacacttttatttactacggcctcagcttgttcagcgcccaattggccggcaatcgcttcgtcaatttcactttggtggcattggccgaagtgccggcgtatttattcgcgcctttcctcctggaaaagtgcattcattgctaaatgccaatctgtcctcctgtcttaatgcatttgcaggttgggtcgtcgtcttttcacctctttcactcactttttggccgcttctgcatttttggctgtccttctcaacgacagcccaaaacttttcctcgtcctttggctcatcggaaagttcgccatttcgtcttctttcacgggtcttttcgtgtacacttccgaagtgtttccgacggtcaatcgtggcctttgtatgggcatttgtacggccgtttcacaagtgaattcgtccaacaaacaaattctaatttattttacaattatttaggggagcagcatttttgcgccgagtgtccgagtgatggtaaaaaagtgaaaattcatctgaaaatcattttcgaaattaggcaaagttttcttccattgcgccaatgctttttttcggcgccttttcattcttcgcagggcttttcactcttttgcttcccgaaacgaaaggaaaggaattgccggagaattccattcgttcgtccgaataattttacgtattcgcaccgaaaaattatctacg

SEQ ID NO: 80453 - DNA, 1264 bp, Heterodera glycines
  Genomic contig location: Contig_ID=SeqID_16098; Location=57..1320; Strand=+
  SCN-specific regions: Sequence locations=1-100,143-265,300-388,410 -444,467-736,758-1264
atgaaattaccgttaccggtttgtctagtaccggtaccgccggtaaaaatttgcactggtaagaatgggggtctggtcgagaaaagagtaggaatttgtgaagaaggagaaatttttgagaaaaaattaaattttatttcatttagtcatgggagtacacacatgcacatgtggtgtagtggttaaactttctacctttcataattttttgcctgggttcaattccccacttggatagaatattcctcacattttctttaccatcattttaattaaaattttaattttaaaaaatatttcaacttttttctttcatgttaagcatcctaaaaacccaaaacttaatcaattggtcatttttttacaaattctgttaacaaatcgcattaaaaaatacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggccgctgatcccttgttttgcaataatctgaattttgaggtctacatctgaattttagtgttctttatcctaaatttgaaaaaaaaacttggtcaccctcaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctagttttgatttcttaaacatattgataattttgaaatttttggcacaatgtcattatttaatatagaattttttaagtttgacgcaaatttggaatggactaattatttaatttgctatatttagtcggcatccaattctacgaaaaaatgtcgttcagctgtttcgaacagtgcggtggaaagtaaaaggttttatctgtaagaatcgaattggcaatgtcgaaaacgaaatttgcgaaaagcggcgacagagggaaaacgaattggtggcgcaatttgaaatgaaacggcactttgaaatattgacaaaggcatgggcataatgcagcaaaagcgaagcccattttggaaaaatgataa

SEQ ID NO: 80454 - DNA, 75 bp, Heterodera glycines
  Genomic contig location: Contig_ID=SeqID_16098; Location=217..291; Strand=-
  SCN-specific regions: Sequence locations=1-75
tccaagtggggaattgaacccaggcaaaaaattatgaaaggtagaaagtttaaccactacaccacatgtgcatgt

SEQ ID NO: 80455 - DNA, 1170 bp, Heterodera glycines
  Genomic contig location: Contig_ID=SeqID_16099; Location=603..1772; Strand=+
  SCN-specific regions: Sequence locations=1-544,566-1170
atgccagcacaaggcactcaccaaataagtaaaaaattggaaccagcttatgctcttagtgctgttccaagcagtgctttgctccgccctgatcagcagattggcaaccattccgcagttagtttttatccgggtcaaatcgacccgaatgcgcagtcaactctgggtcttggccctgatcagtttcaccagtatctggcacaacaaagttatggcattggccccagtcaaataaaccaaaatttgatagaagcaaatcacctcattaactcagagcaattatttgggagtaatttgagagcacctcctgaagatgtgcagtattttaccaataaagagctcaaatcggacaaaacaatcattgattatttaaacagtcactgtgtgactgatcaaagccttttccttagccaaaatttggttgagcctttaaccgattcaaatgtttaccaagaccaaataaatatgctaattgcagaaaaccagttctttaatcccagtgatcaaacagagtcatatttgaaacatgatgaaaatttaaatcaaatgctaattaattttgtggcttcttcatcaccaaataatgatgaaggggattatcggcctcacctgctcaattcatttaatcaccagcagggattgttgcagcactcacctttggacagtgattatcatctgaatgatccctttggggcttcttcatcgtcgcaaatgcaaataaatccgtccaattatttccattatcaaaatgtgccgcaagattcagctaatattgatcaaagtgaagtcgaaacaaaaaacacggagcaaatggcaaatgaaaatgagaagcgaaagatgaaacgactaattgttgaggacgaagcaggcaaaagtgaggccaaagcgaaaatggaaaagcggacaaaaaatcagccaccagaagcagtgggacgacagtccgcttctgctggcgaattgccgggacggagttcaatcagtcaaagtgaaaagcaaattggtaattagaattcaattacctcttttataaagcattttgcaaattaagtccaacaagtgcttcacattgttggcctgactttagctgctcttggcaaagattcgccctccattgatcgcgttttgaatggctcaccaaatcatgatcaattttttgccattatgagagaa

SEQ ID NO: 80456 - DNA, 782 bp, Heterodera glycines
  Genomic contig location: Contig_ID=SeqID_16101; Location=259..1040; Strand=+
  SCN-specific regions: Sequence locations=1-18,201-216,768-782
  Gene Ontology: Biological process=N-linked glycosylation
aaagtggaagagaaagtggaagagaaagtggaagagaaagtggaagagaaagagaaagagcaaccgaaagtggaagagaaagtggaagagaaagaggaagagaacagaaagtggaactgaaagtggaagaggaacagaaagtggaagaagaacagaaagtggaagagaaagtggaagaggaacagaaagtggaagaagaacagaaagtggaactgaaagtggaagaggaaccgaaagtggaaaagaaagagcaagaggaaccgaaagtggaaccgaaagtggaagagaaagtggaaaagaaagagcaagaggaacagaaagtggaaccgaaagtggaagagaaacagaaagtggaagagaacagaaagtggaagagaaagtggaagagaacagaaagtggaagagaaagtggaagagaaagaggaagagaacagaaagtggaagagaaagtggaagaaaaagtggaaaagaaagaggaagagaacagaaagtggaagagaaagagaaagaggaaccgaaagtggaagagaaagtggaagagaaagaggaagagaacagaaagtggaactgaaagtggaagaggaacagaaagtggaagaagaacagaaagtggaagagaaagtggaagaggaaccgaaagtggaagaggaacagaaagtggaagaagaacagaaagtggaagagaaagagaaagtggaaaagaaagagcaagaggaaccgaaagtggaaccgaaattggaaaaaaaagtggaaaagaaagaggaagagaacagaaagtgtaa

SEQ ID NO: 80457 - DNA, 2874 bp, Heterodera glycines; identical to SEQ ID NO: 16104
  Genomic contig location: Contig_ID=SeqID_16104; Location=1..2874; Strand=+
  SCN-specific regions: Sequence locations=1-33,55-118,141-143,165 -945,969-1708,1730-2070,2092-2306,2329-2436,2458-2548,2571-2687,2713 -2874

SEQ ID NO: 80458 - DNA, 1380 bp, Heterodera glycines
  Genomic contig location: Contig_ID=SeqID_16105; Location=97..1476; Strand=+
  SCN-specific regions: Sequence locations=1-179,201-860,887-1306,1329 -1380
gaaaggcaaacataattgcggatgtgctttcacgttctggcgcactgaagccacgtgaatgggcggagaaaatttttagagttgagcaagtcgatggaaatataagtgcttctgtgccaaaaatggaaatgattgagtgggtcaacgcaattaaggaaagtgagctcggaaacctttaccaattcctggaaaaaaggaaattgcctgaagataagcgggaatgtcagcgactttttgacaccattcataaattcacactgataaatgcgccagaattaagaccagtgattacggcggaaccttttgagctaatatgcatggacattttatcaattggaatgtcagacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaacgggccaatcaaactattttaaatatgcttaaaagttcaactgattcaaattggtcctgggatgaccggctgccttttgtcacatttgcttttaacattactccctctgaaaccaccggattttcgccttacaatttactttttggccggccagtaaattttccgtcgtctgataatgttaattttactgtaaatccttcatacacaatcgatgaagaaagttatctgcagctctttcgtgaaaatttgttaaaaattttggaaaatgcaaaaaataattcggacaaatcaagagaacgaatggagaaatggtttaattcgcagccaaaagtgattttgcataagtaccaaaaaggcgaacgcgttatggttatttttccgggagctaacaaacgcttaacacataagaaattaaagtggaatatcttcggccctaccaaatcctcgaaatttccaaatcctcggcaaaagtaacgcctgctgataagaaaaatgctgatccgatttgcgtcccattagaacgtctgatcagagcaccagatggacttcctaatatttcaacaactccgcgcggcaaaaatgcttataaaaatgtgttaaatgtgatgacttttttgatttttgaagaaaaaagcatggaatttgaacaggaaaattttttgggaaaaacaaaaacttcatcagggacgatgaatttttcagaggaggaggaaaaaatggacattgccgaagcggagattaagtggacgatgacatgtgaaggcggcggacat

SEQ ID NO: 80459 - DNA, 399 bp, Heterodera glycines
  Genomic contig location: Contig_ID=SeqID_16106; Location=41..439; Strand=-
  SCN-specific regions: Sequence locations=1-399
  Gene Ontology: Mol. function=structural constituent of cytoskeleton; Cellular component=vacuole; Biological process=proteolysis and peptidolysis
atgtttccgaagccatcaaatccaatgttaccaaacccgatgatcccgaatctatcaaatgcaatggagccgaatccaatgattccaaatccgtcaaatccaatgttaccaaacccgatgatcccgaatctatcaaatgcaatggagccgaatccaatgattccaaatccgtcaaatccaatggtgccgaatccgatgttcccaaatccaattgtgcctaacccgatgagccctaatccatcaaatccaatggtgccgaacccgatgtttccaaatccatcaaatccaatggtgccgaatccgatgttcccaaattcatcaaatccaatgatgccgaatccgatgttcccaaatccatcaaatccaataatgccgaatccgatgttcccaaatccaatg

SEQ ID NO: 80460 - DNA, 56 bp, Heterodera glycines; identical to SEQ ID NO: 52733
  Genomic contig location: Contig_ID=SeqID_16108; Location=659..714; Strand=+
  SCN-specific regions: Sequence locations=1-56

SEQ ID NO: 80461 - DNA, 660 bp, Heterodera glycines
  Genomic contig location: Contig_ID=SeqID_16108; Location=79..738; Strand=-
  SCN-specific regions: Sequence locations=1-660
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttt

SEQ ID NO: 80462 - DNA, 306 bp, Heterodera glycines
  Genomic contig location: Contig_ID=SeqID_2572; Location=105..410; Strand=-
  SCN-specific regions: Sequence locations=1-306
atgaatttactaatcactgttgtacctctttttatcacagttgtacctcttctgatcacagttgtacctcttttaatcacttttgtacctcttttaatcacttttgtacctcttttaatcaccgctgtacctcttctgatcacttttgtacctctttttatcaccgttgtacctcttttaatcactgttgtacctcttctaatcactgttgtacctcttctaattaccgttgtacctcttttagtcactgttgtatctcttctaatcactgttttacctcttctaatcactgtgcacctcttctaa

SEQ ID NO: 80463 - DNA, 808 bp, Heterodera glycines
  Genomic contig location: Contig_ID=SeqID_2572; Location=1614..2421; Strand=-
  SCN-specific regions: Sequence locations=1-285,307-450,475-679,702 -717,746-808
atgccaaacattttcaaaatccttctgattgtgcttttggccgtcgtctcattccgtctctcggcttctactggtgacaaaagtaaaatattgaaataacttttgaatattccttccaattgtgtcaaagttcaccattttggtggccatggaaatccttattctgtgatgaaccctaaaaataattgacataaaattggtatttgctttaagaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggtagctaattgtgccaagttaacatgatactactgtaattcacttttccatgctccaccacctcctcctgtgcaatttgaaatgggggcaaatcgattagaaaaaatgagggcacacctacgcgaacttgctgagaaaatgccggtcaatgaatcgaaggtaggaattcggcttcagtaattgtctttttattatgccatttagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgtattgaatctttttagataaatctaaacccctaaataaa

SEQ ID NO: 80464 - DNA, 1002 bp, Heterodera glycines
  Genomic contig location: Contig_ID=SeqID_2572; Location=4859..5860; Strand=+
  SCN-specific regions: Sequence locations=1-330,354-671,693-890,920 -1002
atgtcgaatagtcaagaaattcgtagtaagattttggacaacaaactaacagcaatctcactcaaccgtcaaaggcaaagcgacttgccaagaatttaatcatttatacgataagccacaaaagaaggagaaaaaaaaatggtacttttatttcgggccaggacgttttcgcgtggccattttcgcgtggccgttttcgcgtggccgttttcgcgtggcagttttcgtgtggccgttttcgcgtggcagttttcgcgtggccgttttcgcgtggcagttttcgcgtggccgttttcgcgttggcatataaaagagaattcataactcgcgttttatttaacgcgtggccattttcgcgtggccgttttcgcgtggccgttttcgcgtggccattttcgcgttgccattttcgcgtggccattttcgcgtggccgttttcgcatggccgttttcgcgtggctattttcgcgttgccattttcgcgtggccattttcgcgttgccattttcgcgtggccgttttcgcgtggccgttttcgcgtggccattttcgcgtggccgttttcgcgtggcagttttcgcgtggccgttttcgcgtggttgcatataaaagagaattcataactcacatttatttaacgaaaatttgtttcactcttttttctaacgaatatttattttataattaagtgagtttataaactaaattaaggttctttcaattatataatatggaccagcagcaaaaaattaaaacaaaaagaaacaaagttaagttagaacatgacggcgcactctatgttttcgaccaattgagcgcagattgacttaagaaattttggcgatgtgagtttcatggcccgtcagacaagtgcaagggtatgttaatatattattttgaattttgaaaatcttttaaaattcaggacgtttgcacacggatttaaataacgttgtgcagaagttggtcgtgagttcaagattagaagaggtacaacagtga

SEQ ID NO: 80465 - DNA, 768 bp, Heterodera glycines
  Genomic contig location: Contig_ID=SeqID_16109; Location=430..1197; Strand=+
  SCN-specific regions: Sequence locations=1-59,85-768
atggtcaacaacgatgaatcgccacaaaggagtaaagcggctcagaggcagaaaaacattcaacaaaaagaaaaggacgaactgagacggcatcaacgcaacaaactcttgtctagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctacccacacaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaatgaca

SEQ ID NO: 80466 - DNA, 1600 bp, Heterodera glycines
  misc_feature (1575)..(1575): n is a, c, g, or t
  misc_feature (1590)..(1590): n is a, c, g, or t
  Genomic contig location: Contig_ID=SeqID_16109; Location=2031..3630; Strand=+
  SCN-specific regions: Sequence locations=1-1520,1542-1600
atggccattcaccaggaatgcccattcgccaagtctgaaatgacgaatcacgaagcacaattgtggtcaacgaatgacgaattggaagtcaacttccctggaccaatcgccggacttttcaactgctttgctcaaccagcaacacttttcgtaaaacggcacaatctgcagatgttttcgccagtccaccaagttcagaactgtcaatacgcaaccgaattctgccaactgcccgacaactcaaccctgatttggaaatcaacctgcaatggcaacgaatgtcaaacatgcgactacgagaaggcggaagtcatcaacggaaaattcactgcggcctacggagaatcaatggccacttggatctccgaagatcaccaaaaggcattaactttcgccaaaaatgcgccagaactcatcacctgcgatggcacacgcatcgtcatgtccgaacagaacttcggaattgccaaggagcaatacgacgacattgtcagcaccacgacaagatggaagaggcatccgaccagaacagctcgcatcacagctctcggcatcccaagtggcaacaagcgttgcgttaaatcagctctacacgagggaatgtcagcgaaacacgagggcagccaacccgactcttcaggccagacgcttactacggcaaccaaacatccaagctcgttggatcggcgaaacgacaatggaagtgtttccatgtgtcaacatttcgctacaggacatctcatacaggccaatgaatgactgtcgcctctacattcccgtgactgcgcactttcccgaccgagctatcgcagctttcttggatccggaacttcgcatcatctcgctgacagcacaacaggcaagctgtaatagctaccggttccatcatcttcaactgcgaagcaatcccaacatctggttatggattgactctcgaaccggcacagcacgacgaatgccgaaagactacgtccacgaattgtacgaaacaacgatcaaccaaacgaacagcaatttggaacttcatccattgatcttccacgcatggcaactcgacaatgagtctgacgcgacacgcttcccgcacatcaacgaattcaacaactcggagcagttcaaggacaagctggaacagcacattacagcaaggactgaagctttgggcgcgttgaagggcggaatagaaggattcactatgcgctggctaaaaagcctgatcgacgaagcaatcacgtggtggattcgagtcgcctgcgtttattcaaccttcctcatgctgcgcgacattgttctcccatgcactttggcgtatttgctcaatcccatccgagtgactcttctcagcctcgttggagtacgtccgcacccgacattccgacccaccgtttctaaaccactcgggatcgaagagggaatgccgctgcgtgaagtgccacgaacccccaaaccaccagcgcgcagggcagagcaccgatccatgtcaccaatcaaattggacatgattgccagaacggctcggtaccaacaaccacgaacacagagccatctcgacctcacagaagactcgccctttgngaggccgagacgaanagaattctga

SEQ ID NO: 80467 - DNA, 1045 bp, Heterodera glycines; identical to SEQ ID NO: 16110
  Genomic contig location: Contig_ID=SeqID_16110; Location=1..1045; Strand=+
  SCN-specific regions: Sequence locations=1-191,222-404,436-509,590 -637,689-697,723-1045
  Gene Ontology: Cellular component=cytosol

SEQ ID NO: 80468 - DNA, 258 bp, Heterodera glycines
  Genomic contig location: Contig_ID=SeqID_16111; Location=574..831; Strand=-
  SCN-specific regions: Sequence locations=1-258
atgggaaagaaaacgcaaagcaaacgatcaaagccaatggcaaacatcaaagtgaagatgtttacgagaaaggcaaacagaacggattggaagcaaaaacatgtggaattggagaagaagcttcgctggtcggaggagggccacaaaagcacagagagagggaggaaaagctcaaaaaagccgaaaatgctggacaagcgttgcaaagcgatcagaatgtgacaagcgttgtgcaatgagctaaaaatggaaaataaa

SEQ ID NO: 80469 - DNA, 1063 bp, Heterodera glycines
  Genomic contig location: Contig_ID=SeqID_16111; Location=1156..2218; Strand=+
  SCN-specific regions: Sequence locations=1-152,183-189,213-563,585 -622,660-1063
atgtgtacgatgggttcttcgttgggccatgacggtgttataattgcaacatttgctaatatttgtattatttactcttccgtcatttgctatttgattctttacgccaaattaaaatgggacgaacgaaaagcgaatggaataagtgaaatttaaaacaaattaaattaaattaaattaaaagcattcattttaatttatatttttaaatacatttgaatgttcaacccttctccatttttagctgttgtcgcctcacaacccttcattttcaagtcaatttcgctcattcttttgctccaagtcgtcggttggtccggcggaattatcgcattttttgtcgtttcaattcattttggggatgacgacttaaacctccaaaaatttctggccaacagtgtgattaattgcttcgtttgtgtgtgtgggacttttgaaacgcctgtcctattttttcacaggtaaaaacaagcaaaacattaaatcatcgtcacaaatgccatctctagcttaaaatggtggcaagattttcaaaaatggtggcaaaacagtggtcaaatggggtttttgttggatggttctgtctgtgacaaaaagacatccgttcgttaattaacccaacaaaataataaatataaatattaaatacataaatatttcagcagcgaacaccaaaaagcgatgcgaaaagaatggagaaacattgtacaattggtgaagaagtgttctccgacgacatttgggcgtaataacaaaactggcaccgccgttgttttggtggtcagtcggccaggcaaaccgacggcgaaaatacggggcgaattcggaccgttcaacccccgcattgtttcggcagcaccgaaattggcagaccaaacaacggcacactgacaaatgagtgccgtcggatcaatgcaaggtcagttcagcccccgggcactgtcagcagcagcagaaggcacggacaaaatcgatcagatcctgacggattcaactttccgtaatcaaccgattcgaaattgtttatttgctacgctcatacagaatgttcaatgataattca

SEQ ID NO: 80470 - DNA, 711 bp, Heterodera glycines
  misc_feature (586)..(586): n is a, c, g, or t
  misc_feature (641)..(641): n is a, c, g, or t
  misc_feature (654)..(654): n is a, c, g, or t
  misc_feature (662)..(662): n is a, c, g, or t
  Genomic contig location: Contig_ID=SeqID_16112; Location=1520..2230; Strand=+
  SCN-specific regions: Sequence locations=1-711
atgggcggctcaatgaatcgacttagtgagaatctttgggccacggaaaatcctgaaaagttgacatatgcctggactggcgaaaaatgcgagacaacagtaaatgactttttggaagaaggaaaagggggaattttggactttttcctggtcacttcttttgggcataatttaaacccgtataaaaactgggaagaactgccaagaaagacattcatttgggaaatccctgagccaaatgagaaatattgggctacacatttttcggttggcgaattcaaggccgaaataacagaaaatgcagtggtaattgaaagtgagcaaagtgtattttatttcgaaaaggaggcgactgacgaaagggagggcataatcggtgttcccgaaaatgcctataaaatgtcaaacgatgcttttattgtcttaagcaaaacggaaatacgggaaaaacgagaaacacctaaaattgagccaaaaagaaaggaaaggccggtaaaacaggaagttcaactgaaaagtgaaattggtaaaaaggaaaacgttttgaaaacaaaggaacaaaatgctacagtatatgttttaccanagagtactgtaaagctggtcaaggacagtcaacaaaaaatgccaaatccaattanaatcttacctcanagtactcnaagtacagtaaccacaacttctaaacctcaagtcaaaatctccacaaca

SEQ ID NO: 80471 - DNA, 1551 bp, Heterodera glycines
  Genomic contig location: Contig_ID=SeqID_16113; Location=609..2159; Strand=-
  SCN-specific regions: Sequence locations=1-53,95-284,313-491,523 -632,654-1151,1174-1352,1374-1551
atggaaattgaaaatgtaggtgaaaagtactctttcaacttaaataagtatcgtatttaaataaaatggtaattttattaaatatttatttattgtgcagaaaattggtcttgtaaaagttcggcaacacttcgaattgtgtcacaaaagaatggcacggaggatttaattggaagaattggtgatcgcatttttaataaggaattaaataatcctggatttccttatttcattagttttgcggtgagtgggattcaaataaatttaataaacttcctattttgaaattaaaatttttaaaattttaaaaaagaaagtgacaaaaaaatgaatagaaatttttgaaattttttggttataactctttgtaaattttttctagattttaaaaaattaaataagataggatttgataggatatgtaatgcatcgtttaataccaattttattaattgaactaaatttaagctaagttatggtttcttattagcaataaaattaaaactattaataaatttaaatgtttctatcattgacacttttgtaactttggctcaccatgattttatattacataattgatttaaaattaaagttataatcggaaacattgctgattttcatgcatctccaaataaaatcatcaaaattaaggaattgttggatccgggcaaaggattttacgacaaagatgaggacaaagtcacattggccattgatgtcattgtggatgagccaaaaactgagaaaattatttccgatccaaacaaatccaacggcacactttcgatggaaattgaaaagctatcggaatttgcacgagaaatcgaagaaagtgaccgtataagtgaaactgctgtgtacataaagggaatgccatggaaaatattggcatatatcaaaatgaaaaatgaaagcactgagaaatggttgggcttttatctttggtgcgatgcttgtaaaaaaggtttgcttatcaaattatataagagaaaatgttcggcaacacttcgaattgtctctcaaaagagcggtgtggaggattttaagagagaatacaatgaaaaagtttttaacaatgcaacgctgctgagtttgggttggcactatttcatttcttttgcggtgagtggaaattaattagttaatttacattttaatattgtaatggtaaattaaggaattaatggacccaagcaaagggttgtacaacaaagacgaggacaaagtcaccttggcaattgattttacgtgtgaatagcgtaaacatttcgtgaagaattgaaaagggaaaggaaggaaatcagcaggatgagaagagagtcttggagggcacaaaattttcttggtgcttaaattttatatttttttatgttttgtaagtattttggtttcataaagcaacatattccaatgatagggatggatttttatgtgctaaaaatcgagaaatatatatacctaaagagttgataaaaaggcagaaaaatttgctaaaatgcagaaaaatgccaaaatagttgccaaaaaattggaaaaaatgtcaataaa

SEQ ID NO: 80472 - DNA, 1341 bp, Heterodera glycines
  Genomic contig location: Contig_ID=SeqID_16114; Location=242..1582; Strand=+
  SCN-specific regions: Sequence locations=1-233,258-921,963-1341
atggacggctccaccagtaccaccaagggcacccaaacggaaaatgccacaagaagaccaagcgccggaattaaatcaaaaatcccaaaagctcagaggaatgaggcaggcgagaggcagggaacaagaaggattgacacttccgtttccaacgaggggagtcaagcggaagtcgacggctctgtcagcagtagaaacggaaattccaaccaaaagccaacgtctccgaccaaagaaatggacaaatcaatagaaaaggtgttagaacggctctacaatgacccaaaatcccctgctgcgtttgccggtgtcgaccgattgtggttggaagccaaaaaggaacttggaaataaaattcgtaaaaatgatgtaaaacattatctggagggacatcgcacctacacattgatgcgtccaagacgcatcaattttccgcgcgctagaacaacggctgccggttttatgaccgactgtcaggtcgatttggctgactttcaaaccctttctcgacacaacaggggaaatcggtatttaatggtggtaattgatgttctttcaaagcggatttttgtgacacctcttcgtaccaagaaggctgatgacatggtagacggctttaaagaagtgttttcaacgatgccaatgaaaccacacagaattttctccgacaagggtacagaattcagaaatcagcagctgaaaaaacttttcgatgaagaggaagttgagaaatatgagagcacacattctgagaagaaagcagcattagccgagcgcgcaatacgacaaatcaaaaatcgggtgtatcgctactttgcccaaacaaaaaccctaaattgggtggatgtaattgatcaaattgttaatggtattaataaatcaccgagccgggtgcatggaatgcgacctattgacgtgaactttaaaaattcacaacaaatatgggaaaaaatgtttggagatgatcagcatatggctctttttggaaagcccagaaaacgagccagatttgtccctggtcagacggtaagaatgagcatagcaaaaggtcaattcgagaaaggttatatacccaattacggcgacgaaattctcgaagttgatgccgtcaaacgccacatgaaaccaatgagatataagctacgtgattcaaagggggagaaatttaaaggatttttctacccggaagaattggcacccgtacgtaaggatgccgagacgacgtacagaattgagagagtttttcggaaacggaaaatgcctgacggaacgacagaagtactagtaaaatttattggataccctgaaagggaatggattcatgagacccaacttgtataa

SEQ ID NO: 80473 - DNA, 1187 bp, Heterodera glycines
  Genomic contig location: Contig_ID=SeqID_16115; Location=1076..2262; Strand=+
  SCN-specific regions: Sequence locations=1-271,293-880,902-931,970 -1187
atggtcattgttttatttggttagttggagatgcgcaagttcggatgatcagaacaaccaatgcaaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaactttatcatacctaatactaacaccaaaatttcttattaatttttaaaaattctcaatagtgtcgaatttactcattgtcgaaatggtccagtgtcgaaaatgctggaaaacagtgaaagtttttgaaatagttcagtgtcgaaatttctctatgtcgaaaacgtagtgtcgaaattacatagcgccggtcccaacgctaaatagcggaattggcgtaattttttgcgcgttaattcaaaatttacactggtaaatgcctttttgaatttttttaattttggtctgccataactcgcttcattctgaactaaacttgacaaatttagtatctaaaaaaagttttgaaatgaagaatcttttcttagcgaatgctaagcaatttcacatctcacaaaaagttgtgagcctttcaagaaataaactggatataatattcatgaacatgttttagttctttattttgatgtttagaattctttaaacgaggagaaacgcaaacagcgtggttcacgtgtgatctctgttcctatttcaagtggaattcgctctgcttctgtgctattggctcccgttttggcatggatcgtcattctctcgaccaagtttattctgcaatcatccaaaaagctttggaccttcgggttgagagtctttcgatgcctctgcttggtacagttttattgtcatactttttatattctttaaatttaggaactttattttcctcgcttgataccgcatcaaattatttgtgggcttgccttcagcagttttcttcatttggtcgtttaaaggtaaatggaaattattttcatttagccaactccacattttagaaaattcaaatcgtggacaccaatgatttccatatgcgatctcttcacaaattcatcattgccaaattgcgtgctcagtcacaactccaaaatggttcatctgcttcaa

SEQ ID NO: 80474 - DNA, 1306 bp, Heterodera glycines
  Genomic contig location: Contig_ID=SeqID_16117; Location=12..1317; Strand=-
  SCN-specific regions: Sequence locations=1-13,35-380,402-1282,1304 -1306
atgaacagacggtaagcaatttcttttgaaaaattacaatttcgttttacccaattttttttcatgtttcagttggatttgtgcggatgtttggatggacattctgccatcttttgaccgtgctcaactcggactcaaaatggcattgctttccgaccgtttcgatgttttggttgacacgcattttgatggaaaaagcgaattgacaatttggaaagcaatcgaaattcgcaaggacaaaggacgaaatgcgaaactgtctgaatggatcgatggcaaaagggtggattttccgatgccggaccattcgctgcccatcaaaattcgctttaaggagcttcggataaagcaattttatacttttgtatatattaaagcaatttttatatttcttcagttacatcgaccattccgtcattgaatttctccgttccaacaagcaaatttgggacagaagtggcaccaaattggaagtgtatattgaatattgtgaccagcgaatttgggatgttttggaccgtcaaatttggccactttttgcgacaaacattcgccatttgagctttaccagtggcgatgctttggacaatttgcgtcgtctgatttcaccaacgattctcactgatcttgatcaattgaattcaatcgattctgttggtcttttacccgatggaatttctgacgatggaccaaatgcaactgctggccaagcgttgaccaaatggcttcacactccgagcaaaaatggccaaccgaagcgattgtatcgctataatttgttgggtccaccaaatttcgaatgggtcaacagcttcaaagaggtgtgtctcgccatattttcgtcaatttgttttcgttttaccaatttttgtgtttaggcattccgtcgtgccaccacttctgtcagttacacaattcaactgttttttcatgtggaaccaacgtcaattgaacaatttgaattggtgaatgaacggacgaaagaaaagctgacattgaaacatagcgaagaattaggctataattgcctgtataatttgctgttgcaacgctacccaattggagagacggcgacggcgccagttaagtgggaaaaccgcgaaaattcgggtgccaattctaactatatcagatttgctctacggcatgccaattattcgggtgccaatttgaataatatccgatttgagttgtggggtggaaatagttgcattgggtgagcagcaaaagcaatttttgattgtcgaaaaaacataaataattttaggccattgtcgctgccagcggaagaagaagaagcggatga

SEQ ID NO: 80475 - DNA, 1678 bp, Heterodera glycines
  Genomic contig location: Contig_ID=SeqID_16118; Location=204..1881; Strand=-
  SCN-specific regions: Sequence locations=1-84,106-161,199-260,339 -538,572-613,658-678,708-865,887-912,935-949,1056-1070,1092-1152,1177- 1198,1220-1262,1285-1343,1365-1465,1513-1678
atggttaatggatttagcagaaaaaagcatttttattcaccaaatcagggttactccgtctccttgttccaagaaatctctttatttacaactatttaaactttatttctccacaaacaacagcatagatgaaagaaaattcgaaaaaacataaaaaacagtttattaataaaaaaactttattcttttaaattttatcattaccgacatggcggcactaataccctttttaacaagataatatttattgaaactcaaccaaaattattataaataataaatatataactatttacaataaaaaaatatcatttttaaattctaaattttttaaaattgctcttatttaaaagattagtagttacccttgtagatttcaccggattacggtagccccccataggtgtgggaggggtgcatggccaactgagcgccagccatttgagcgccgccaagtgagcgcgggccatttgagcgccagacttttcagtactgaagccaaaacctattgcgcgacttttttttgcaaacccaaacctattgcgcgactttttcttggaaacccaaacctattgcaggggtgcgcgacttttttgactgcgcgactttatgcaaattattttaattaaattaatttaattttaaattaattttaaacgtcttaaaggtcaaagccgttgaatttaaattcatttaaaattcatcaaaaattccccgcaccaagcggatccgaaccccaggggggcggccagactgacgcactaaccactcggccacattggcaatggataataaacattaatttgctctcataaagggaaaatttgacgtcaccagtggcgggaggggggcgagagcaggcggcgagaagggggagggggtcaaataaacaaatcaattattgaattcacaattttctcttttaaaagcaaaaagaaatgggggaccgtataataaaatataatttagaaattaaaataattaaaaggttaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaattttttttattgtcccaatttttaccattttgtgttttttcaacaaaataaatatttgttcaaatttaaagaattaatttttaaaattttagacacaaaaacaaatcatgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtggttttgttttga

SEQ ID NO: 80476 - DNA, 1735 bp, Heterodera glycines
  Genomic contig location: Contig_ID=SeqID_16119; Location=422..2156; Strand=+
  SCN-specific regions: Sequence locations=1-134,188-449,486-534,563 -576,619-621,644-728,752-864,886-1186,1209-1232,1254-1277,1302 -1589,1611-1681,1703-1735
atatggtctttgcgaggagcatcttttcatttatattttaccaatgcttacggttacatttggatacagtttctatgtgcttggcgaagctgcacaatgggcactttttgtctaccccgactggtaaattaagctaattttttaatttaaaaatatattcgttttttcaatttttaatttaattttaggccagttttgtgcacaaattctgacatgttcagttttggaatgtccacaatgctgctgagaaacggtctggtgatcaatgggctgtcattgatctgttatttatttgttggtttgtcactgttttgggcttggcagaaaagttagttggactaaaattcaattattttatataacttgcatcttaaaaattaaatttgcattcatattttgcaattaaattagcatttagtaattgaattaataatggaaaaacattgaccatttttatttaattatttttacttaattgtttttttcacataagtgaatttattcattagacgaaattttcgttgctttttgtatatttgattaaaattaatttccattctttccgcacttgctttcatttatttttataataatttatttaaaaaatttataaatattcactttttcttaaaatttttaccgttaaattgacgcgatttttacgggacacaaaaaaaaattttgtagcaaatcagctaggtgtaaaaaatttggtattcatttttctgatttaaaaattttttaaaaattacgtttgccattcatcatatttttaccactgatcctttatgcaaaaaaagaataatataaaacaatagtaccaaattggaacgtagtcttttaaagaatccttaaatatttgtcaatataaatattttttgctaatttttccatttaagacccgagttcagtgataaaacatcgcatcttcaaatccctggcttcgataatgactttggtggttggcacttattttgccatttgcttcatccgattgctgctcgcttccgtcagggacccaattttcattttgcacatttcgccttccattagcgcactgcttacggtcacagcggcgagcagtaatgcgcccgttctgtttgcatttaggtgaaatttgataagttaaaatccaaaccaaaatttccattgtctgtctcttttttcaaataattgatcgattgggattaatattttaatttttaataggttaacaaaaattgcccatagatacaaaaagaaatttctaatttgtgctgggtgttttgcatataaaacgtatttcctcgattataagccccctctcgattagaagcgcctccctcgaatatagccccctttgaagggggtttcaacaatagagcccgggggcttatatcgagaaaatacggtatctatttgttttctcagtaattagttgaaaaacacccatagcaattttttcttatacaaattcttttgtttttcatcaaatattcaatcgaatttctaactttttagcactgaatatcgacaagcgttccgcaaacatctcagaaaattgccattggccggcatttgtttaatgcgaattggacaacagcagcaacaattgccaaatgctgtctccatggttgccgttttcaacaatgcaattcctcaaccgagcagtgttggtcgagttcggcacatcacaacaattgggggcggtggcggcaccgcggtgccaaaaacaatggcacccattgactcataa

SEQ ID NO: 80477 - DNA, 1694 bp, Heterodera glycines
  Genomic contig location: Contig_ID=SeqID_23; Location=361..2054; Strand=+
  SCN-specific regions: Sequence locations=1-273,295-1021,1051 -1075,1097-1353,1385-1405,1515-1694
atgtctaattttaatcaaaatgattttgccattacttcggtgcaccaaatgcgcaaccgacctcggaatacaattggtgaaatagcggaagtgcgctttgctccacttgaagaagtggaacggcccgatcgtgtgctcgagcgtcttgtacagcggctgtttgacagagtgcttgatggacgtccagcaccgatgttaattggtcttcaactgcatccacctacctttgagaacccatttaccattcctcttcgtccacccgagcaaaacaatccggctgctatcgctgatctgatccaaagactcaatgatcaatctgctgccggaattgatctgactggcgggacaacagtcacaaaagtgcttgcagtttggccaatgcaatcggaccacagtgaatcagggagagcaggttgaactttatttttattttcttttcatattttcttttgctgtataggcgcatgcagccttgaggaagagcaccgattggtgaacactgttcgctcgttgatccgcattaagaatccgaatgatcgactctgtttggccagagctgtgttgctaggtcttcacgattggcgttcacggtcaccaggcggaggcggaccgacagcattcaaaagtttcgcaaatcgccagcacacccacgggcctgaggcacgtaacttattgagacgtgccgcaattccccgcaacaaacacatgtacacaattgatgacgtccaaaaagtacaagattggattgatcaacgatacgggccaggagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaacaacagcaatcccgagcagatgggtcaactggcaatcgtctttgccgttattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaaccaatgaggaggagaaggagaagaagagggcaacaacaacaacaacaaaataataataacgatgacgaagacgatgatgatggtaatgatggtaacgaggagggagacgacgatcacggtcatgatgctgataatgaggaagaagaagaagttggaacaaatcggtcggtcagactttgctttttcgacgctgaaacgtcccaagatttgccacttcaactgcgtacaaaggttgtacagaaacatgttccgatgctcattattgccgaaattatctgcgaagcgtgtataaatgaaggaatttcggttcattctggtgttggacaatacgcaaatgg

SEQ ID NO: 80478 - DNA, 2313 bp, Heterodera glycines
  Genomic contig location: Contig_ID=SeqID_24; Location=33..2345; Strand=+
  SCN-specific regions: Sequence locations=1-528,558-1263,1285 -1910,1934-2313
atgactcatccgggggtacatgttcggtctgcccaatggtcaattggtgaggctaacgtcgaagacactggctaccgccttgatggattagtcacacgtgaaccccctcaacgcaaccttgccattgaatatatgggttgcttttatcatggtaaaaaaaaaaggtcgcccttttcaaccgaacaaaaaaaaatgcttaaaggttgccccaagtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacggggtggacgcactgaaccgtttattcttcattacacatgcagtccagacgaagagataattctcattgacattgtaaaaaaaaagttaggagaaacaaaaaatattttttcattgttaaaggtgagcttatatccatatgtgatgaaggcattctcgtttccggttggtaacccacgcgttctcacgcgagagacacttctatgtgcaccgacatcaccgcttccctggtgttctgtcgacgcgaacacattcaaagggctgttgtttgttcgtgttctgcccccagatccagctgtacacccgctaaaagttcctttgcttccctatcgaactaccgacgggcgcctaacttttccgctttgtgcacgctgtgctgacaaccgacaacaacgggcatgcaaacacattgatgcatcaagggcatgggtttccgcgtaattttgtgaaattaatccatgtcaatttactttttttgtcccggtgtttagatacacccatgttgaattgaacaaagcactggagcttggctataaagttattgatttatttgaggtaaaaataacgtatcgtttattgcacataaacttcaaaaaaataaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaaatacagaattacaattttttaaacttaaaaaaaaaaaacacacacagaaaattcttgcaaactccctctggggaaaacttgcgcaacgagtcggtggaacggaagttcgttatacccgaactccagctgagtttcatgcactgctcgagaatcgcaacatcgacattattgactttcatcacgtctctcaccatatggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctttattgcggtgagccaaaaaaaaaattttttttcacctttattgacctattattcaagataccgattcaatttattacgtgacaaacaacgggagacagcaggtgcctgaaggtgaagcgctgggaaagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggaacattacaacattgatggacaaatgttaacacatttttctctcacataataatccagaaaaaatacactaaaattctattccacagagatgatgtgctggacatggaaggtgttcatgttgtcccgggaagcaacgcgtcgataagaatcgaatttccacaaattggccgaactccatgttcggatctgtacacctacgacgctcacaaagactaccaacctcattatgtgaaggggcgcattcgccccagcatggaaactgtaccattcggatttcgtgaagcacaaacggatcaagaacaagctgaacatcaccaacgacagctgaatgattttgataacaacttattaattgttaaccttcccggatgctcaaattggaatcaataa

SEQ ID NO: 80479 - DNA, 721 bp, Heterodera glycines
  Genomic contig location: Contig_ID=SeqID_24; Location=2982..3702; Strand=-
  SCN-specific regions: Sequence locations=1-20,43-62,84-97,119-721
atgagttggcttaaaatcatcgaggaggaggaggagcgggcgagggaattgcaaaatgatcaaatggaactggaacaagtgaaaggtttatttagttatttttagacattaaaaacagttttttaaatttagacaacattgagttgccaaagcacccgcaaccacaaaccaagtgcagttgcaatgaaaagcagaagagtgtgccgttgattgattttctctgcaaacactacaaatgttcaatgaatgagcttcacgttctgctgcagacgctgagcaaacgtagagaaatttcggaaatgttgcgttccaatcttcatttacgcaccaatcatctgcgccctgcctggaaaaacattcgcgtccattgcaacgaactaacaattcatccagctcaaactgcatatgctatgcgcggttatcttggcattacggtttgtctttgatttatttaaatttaaccaatctatgtgtacaatacactttaggtgcgcgtctactactatgtaaagcatggtataaagctggcttacccccaactgccatgtgttcttcaatttggtggtggtgatcatagctctctgttcccgcttgagtgtcttagtgttgttgttgttaaagaaccatgatttagtgatgatgatgatgatgcatgatgaacgggtgttttttttttaattcaaatattgtcgttttttaatgtcagattaaaaaaaataaa

SEQ ID NO: 80480 - DNA, 1138 bp, Heterodera glycines
  Genomic contig location: Contig_ID=SeqID_24; Location=3984..5121; Strand=+
  SCN-specific regions: Sequence locations=1-195,217-395,418-1010,1035 -1138
atggcagacaattttcaaaaatttgatgaaaaacacttacaactcagacacccgtttacgctgacaatctcagggagcacggggagtggaaaatcggaatgggtgttacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcaggcgcgctccaagtgcggacgctcgcctctcagctatttccaacgaaaagcaactatttcacggaagcataccgggatgcaactgaaaagcaatttggctacctactaatcgacatgcaccccgagagtccggaattgttgcgcctgaaaacgaatatatatggagagcagggtggtcttcccccattggtttatgttgcaaaatgaagcatgtcaaaagaagaaaaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttgggtgcattgaagcaccagttgaggcgcttagcacgcgcacgttgcgcaaaaaccgcgcgcagagtactattattgaatcgtcaagaccaacaacaacaacaacaacaccaaaccggtgctggctttccggtggtagccagtatgctgacaagcattctcttaccagtgttaatggacaaattactgccaaaaactaattgataaatagataaaaa

SEQ ID NO: 80481 - DNA, 1018 bp, Heterodera glycines
  Genomic contig location: Contig_ID=SeqID_24; Location=11757..12774; Strand=-
  SCN-specific regions: Sequence locations=1-178,205-337,360-397,432 -1018
atgacgtcatcatgcaaagtaaaaagactccgccccttttcttgttggtcacacccattgatttttgttttgctttactaagaagttgactccgccttttttgcttttagtttcttttgtcccgccccattttttttctatttaatcacagtttttctaaataaaaatcattcgtgttccattttttaaaaaattccatcctccttcgttttttccgatcttcctgcaatgaattctcttaaacgctttcaactcccggagcaagggacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaaattaattaattaaattattaattttttctagtttaggcatgcccatttcgttccaaggggctcatttgccgccgaaaattgtccgatgataacatgtgtgaggcttgcggccaaaaagcgattgctcccatccacacggtgtttgtccgtcttctgctgcaggatgttgaacaagcagacattgctcaacgtgtcaccatgttttcgagtgttgccgaagagtttttgggaatgaaagctgctgaattgctcgccaaggagaaggagccggaaagccttgcgaaacacttggacgatttgattgctgtgaagctgatcgcaaaagttaacattaaggtttttttttgttgctatttattatgtatttgacaaaccacgccctaggcgaacaatcagacgtacactggatttgattggattgtcaaccttttcaagaagtgcccagggaatgatgacagtgatgtgccaaaagaaaaaaatgatgttgatgagattgcaaccaagaaggccaagaaaaattgatagagagagagagagagaaaaatgattcatttgttgtgagctttaaaaaaaagattgagcatgtcctttactttttttttaaatccattaaa

SEQ ID NO: 80482 - DNA, 600 bp, Heterodera glycines
  Genomic contig location: Contig_ID=SeqID_24; Location=13174..13773; Strand=+
  SCN-specific regions: Sequence locations=1-40,62-141,168-323,346 -379,435-455,477-600
atggcgatgctattaatttggacaattatggacaattatttgatggaaaaaacagtgaacaatcgatcactgatcagcaacagtttaaggtggactaaagaacagaaacaattgggagaagtatttgaatttataggagacaaaactgattttttaatttaaatttaggaattccatgaaaagtttgccagaatggaaatcgaattaaaaatggccaaattggaactcgaaaatgtgagatttaccttaaaaaataacgattaaaaatttgtctaaaaatttagaaggaacaaaagttaaagctccacgaactgattggagaacagaaggcattaaaggaaaaattggccaaattggaacagaaaaagggaaaaaatggtaaaaaaaaaagtaattaaatgaaaaaagttacaaattaattttattttattaatccacagattgttgtcaaaattaatttattttcagcaatttttccaaatctgagcacatcggaggaaatgattgttctgattgccagaattgctgagctgaatcgagctaacacagcggaaccatcaatcgcaagttctgctgatttgtttggacaagacggaaacg

SEQ ID NO: 80483 - DNA, 2700 bp, Heterodera glycines
  Genomic contig location: Contig_ID=SeqID_2573; Location=984..3683; Strand=-
  SCN-specific regions: Sequence locations=1-1288,1310-1510,1533 -2344,2368-2602,2626-2700
atgtctacatcagggggctgttcaagtgagcccgcctctggtacatcccaagcctgcgggcaggaaacaaaaatgtttttgagtggaaaggacgatgcgtcctcaatcacggctattgatagaaaactttggcaaggaaaggtcactgtaaaaatttctgacttagaaaaagttcaaaatgacatggggaaattggaagatggagtgaatagagcttttcgccacttgaaccgttccttaaaccaaaaagtcacttgggtgaatgatgttgtggctaatacaaatgccaattttgaaacgctgaaggtacaattcgagaccctaaccgaaagagtcgatattttggaacgtgacaatgatggggcgaattcaggtggaacttttagtcttattaatcaaaacagagcatcgctcgcgccgtttgtgatgccaatgggcaatgcacagcccaaccaactcatgccgaatcaagtgccaatccagcaactgtcaagcgaagacgaagatgacgggccgactctttttggcctgaacatgctaatgagtggaccggcagtagggtcaggtttggaaatgttcagagaagagtcagtttttgcatttgacgattgggctgaacgttttaaggactacctttctgtgtcaggcaaggcttacactgagcgcgaaaaagtcaccagactcaaattggctctgaaggacacgccactggcattgtttaaagaattattaccagcacaaacggacactctcgacacagcactgagtgaacttcgacggaaattggactcccctcaacgtcgggaaattacaaagcgaacattatcattgtgcaagcaaagggaagatgagacagtggcacaatttctgaggcgtttaactccgttggtggatgcgacaaattcgtcattgaccggtaattcgcgaaaagaaaaaatttgcgaagaatttttggatagattgaaaccaaatataagctttctcattcgtctggtgggattgtcacgagctaaagatttggacttggtaagagcacaagctgaggagttggaggctttactgatgatgagcaagagtgacgaggcagtgcgcctctctgacgtagtcaacgcgctaaacaatcagtcatcacagtcccgttggtttacagaagcgaacctgaacaatgactttgctggacagtgggcatcaggtaacaatgtcagaggattcagttctttttcaggatcggatgaacaaacccagcaacaagggggaggagaaggacaaaatcgatctcgcaactggggagaaagccatcaagaacaatttagtcaaagaaattggtcaagaaatcccagatgcgattattgtgaccgcgttggacatgtggcttacaactgctatcaacgccgtgccaatttcagtcaaggaagatggtccaaccaacagccacaccaatcgcaaggacaatggcaaaataggcagagttccgttaacatgatggatgccccaagttcctcgaatgcttcagctgaattttttcaaaacttggctcaggctttgctagatcttaaaattcaggagcgtcgcaattacaaagacgaagagccgagatccggagcaatgaatgcacttacacacattaaacccgaaacggaagtaaaaaagtgtcaagttggtgaagaactgtcaaaaaaatcccaagcctgtgggccggaaacaaaagcaaaccgtcttaaaacagcaaactgggaacggccaaatgtgcgttcgaaagtcgcctccttaatgcaatttcattaatgcttattggaatgactttgccactcactgctgctgttaggcctaatctgccgatgtctccttgtctataaagcccaaaacgtagcaaaagtctggcaatttactggtgctctaacccgtcaattgatcactaaaaagcacctgtggtttaaaccgaatttaattgaaaattcggcgaacacttgactgctcattaatgactcttggactcattcattaccgatttgtaggtaataagttattcaatccatgcccttcgctttaagaaatatgttcatgtgaatttgaacattgcttgatttagaattcattatttaattttttttttgtgaatgattccgaattcaaactggggcccaggattacaatgtaattgttggttctgatgtcaaagagaaattgcccaaataaaatttaaagagactattagtgattagcaatgtctcacctgcgggtcagaaacaaatcaaagtggcggtagtgaacctttttagagatttatcttagtaattttgctatggtttttgtattcaattcctttgcacattcattttgaattttgtaaaatataattgtaaaaaagaggtaataacacttctaattttcaatgtccactttattccaagctggtgggccaaaataacaaaagcgcttttgtaaaagcacacaaaacattaaaaggacaggagtgttaaatttataattgactaatttaaaagttcaaaatttaattgacataaatatttcattctgccagaaagtattgcctttttgcagaaccatccttaagtaatctatattttttcgtttcagtatcatggttcttgctgaagatggccaccaagctcagccatggtccaaatgtgagcacactccgaattctctcgaacactaatggaaatgaatatttaacat

SEQ ID NO: 80484 - DNA, 1091 bp, Heterodera glycines
  Genomic contig location: Contig_ID=SeqID_2574; Location=426..1516; Strand=-
  SCN-specific regions: Sequence locations=1-168,190-598,620-781,819 -838,862-1091
atgaaaaaacaattgcacaaattaagaaatgaacaagagtcaaaaattatttcccaggggcaaaattcagttaacaaatttattcgaaataaattatcaaaagttaatgaaattcctacgttaattgatagtgctggaaatatgttttccagtaatgagcaaaaatgcgaaatattagcagaaatatttcaaaaatcttttttagaaaattcaattgttaatggttcactgactcaatcagcacagaataagactaaacttttggatattgaattgaataatggaacaatttggaatatattaagaagacttccccggcgtaattcaacttcaccagataatgttccttacattttgttaaaaaattgtgcagagccaattaccaaaatattagcggatttatttagattaattttggattccggtcaaattccggaaatatggcgaacatcattagttgtaccaattttcaaaaaaggcgaaaaaatccgatgaattatagaccgatttcattaacaagcactatttgcagttttcgaaagaattttgagtagcaaaattttggaattttgaacagtatagaattttttgataaagaacaatttggctttttaaaaaatagatcgactacaacccaaatattaaaaacgatggacgatatatataattatctacaaaagaatcaacaaattgacattatttatattgattttgtcaaggcgtttgattctgttcccgttgatttattacttaaaaaaatcaaaaagataggaattgaaggaaaaatttataattttttaaataattttttaaaaaatcgaagttttaaagttaaaatcggagaagaattgtcagaaaatttcaaaatattttcgggagtgccccagggaagtgtcttagggccattactctttttaatttttataaatgatctgccgtcctttattgcaaatgaaaaggcatcagttggcataaaaatgtatgccgacgatgttaaattatattatgcccatgaaaatgatggccattcaaatcagttggataaagcaattgaggctaattgaggctttggaaaaatggtcaaaaataaa

SEQ ID NO: 80485 - DNA, 2470 bp, Heterodera glycines
  Genomic contig location: Contig_ID=SeqID_2574; Location=2532..5001; Strand=-
  SCN-specific regions: Sequence locations=1-16,38-224,246-291,314 -322,345-414,443-558,719-724,746-746,768-818,912-946,991-1023,1055 -1125,1147-1212,1234-1386,1411-1518,1540-1867,1890-2131,2153 -2169,2192-2369,2393-2470
atgtcaaatgaatataaacaaaaaggaaaatattcaaccaaagaatggtaccaaaattatgccgaaatttgtaagaaaattggagtaagccatttcataattaaaaaatggatgaaacaatttggaattgccagtaaaagaatgacggagaaagaaaaaatgcaaaaaataaaaaagtattgggaaattaaaaaagaaaatacaaaatgagtaataatgaaattgcaaaaattttaaacacttctcaacagaatatttataattggaagcgtgccaggaaatttcgacacacacatatatcaattttcattaagcatagtgattttttaaataaaaatgactttttgggtcagtttgaccctgaggcagtttgcttcgggcaaaccgtggattccggcttgttcatgtgaatacataataataataaaataataatttaattctctgtcgaaatcagccactgtcgaaatgttacagcaccaatttagacagattaaatttttgattaagtactaattgcttaattcatttataaattttcattcgattttcccccaattttttcgctatttttacttctattttactccagtattttttgtgaatattttctccctttttgctttattttttcttttattttataaaattttccaattatttctctttttttgagttcatttcgtttttcttcttctttttcttcccatttttctccaaatatttcatcaaatgatttttgttccaattttttcttttctgtttcaatttgattaatttgggtgatcaaaaaaataattaaaatgaataataagtggagtttcattttcttcattttctcaaaaataatttgatattatttttctcaaattttaatttatacaattttattttttataaataataaaaatctaaatcccactgatttcttacaaataagaagtgctatttaattgaaaataaaaaataattaaagattttattaaaattcattctactgaacaaattattggcaagaataagtaaaataatgattaatttttatttattttttccattaattcacattttattataggttcctggaaaaattaaaatcctaaatcaatattttactacagatttaagcattttttattttaaaatctattaagagctccaaaataccctttattttttaaattgactcaaaaaccgcgaaaaaataacgaatttttgttttgtgcgtttttgaaatgattaatattgtaccaaattgaatcaaaataaaaaaagcaaaaaatagttaagaatagagttaaaagaattttttaaacaatttttaagcgaatggaaaattttttgaaaaaagtctcgggttttttgggtctcggtctttttgtttccatataaaaattaattttgtacacatatttattcatttattgcatgaaagaaaattactcctaaaattaaaaatttttgatttgaacagaaaactttcttttgtgatattttatcaatttttattttgatgcttttaataataaaatcaaaacagttactaattgattgattgtaaaattaataatttcaagaaaaaagcctgcgcattccgcaaatataataataacacattattgccattatttgaacagaattagaattattttattcagcaacatattttatctatttcattttttcatagcaattgtaattttttccaattcactgaagtgatcgtagacattctcgcccgtcttgaccggcttgaaaagttgttagaaggttcagggaatcccacactgaacccaatcatcgaacggctcgaaaagttggaaaggttggtggagcggctcgtggagggcgagaatcgatatggacatcgatttggtgacccccagcacacctcctccacttcggctcccacccccacaaacggcaattttcaatggggtcaaccgccgccttttgctggcaccggcgcagtgtcgcggatgataaccgacgccatcatcaactcagagcagctgaaggagaaggcaaatcgtgcggtcattgagaaattgccggaggcaatcgatgaacgggcactggtggatcaaattgccgaagaatgcggtgtcaaggacaaactttcgccagacattcatcgccacccaagaacgcggcctgatggaggggtaaaaaaggacagaattctgaagttccatttttggacaaattttcgcgagacaaatttatctataatttccgcaatgctctgaaaaaattgactaatttgccccaacatatcaaagtccgcagggacatgacccaaaacgaactcaaaattttatattcccttcggcaacaagcctatcaggccaatattgctgctggtgaatataaatattttgtggttgatttggaaatcaggtccctgaaaaacccccacccgctcagaactcgctagggacacgcgagcaaaccaaccgaaaaaaataaa

SEQ ID NO: 80486 - DNA, 818 bp, Heterodera glycines
  misc_feature (424)..(424): n is a, c, g, or t
  misc_feature (490)..(490): n is a, c, g, or t
  misc_feature (508)..(508): n is a, c, g, or t
  Genomic contig location: Contig_ID=SeqID_16123; Location=481..1298; Strand=-
  SCN-specific regions: Sequence locations=1-145,167-818
atggccagcgatgggcgccaattgcgcgtatttaagcgccgaaaatcgcagaagaaaaccattcgaaacactcacatccaacaagctcaacagaacaactcggcatcaaatggcttctttctgctgctccccttctgcttgtcgtcttctctttctgtctttgctccttgccactgtctttttggcactttcaaatgcctcgggtttgccttcccccattttttggtttttacttctttcgtgaacgctcagagcatggcacaccgtattggcacggaagtgagcacggaggatggcatggcgaccacgggcaccacgaccacgacaacaacccacgggaaatacggacacaaacgggactggggccacgacaaccacaagaaagacggatgggaccacgggtacaaacatggagacaccatgntaagaaatgggacgaagcgaacattggcaacggcggactatgccacagatgatggacacgccgcgngctatgccaaaggcgacnagtcggactggagcagttaccaatacggaggacagggaaacaaagcccagggcgactcgtacgccaaggggtacaacagcgcatggaaagacggacatgacgacggacacgactacgccactggccatggggacggacacgacaagtaacaagccgaggaggggggggggggggtggagttggacaaaatgtaacaaatgctttagtggttggggaagccatggatcacaccacggagacggggactacggtaaccatggaggacagcacggatacggtggatatggtggaggagagcacggccatcacg

SEQ ID NO: 80487 - DNA, 2341 bp, Heterodera glycines; identical to SEQ ID NO: 16123
  misc_feature (791)..(791): n is a, c, g, or t
  misc_feature (809)..(809): n is a, c, g, or t
  misc_feature (875)..(875): n is a, c, g, or t
  Genomic contig location: Contig_ID=SeqID_16123; Location=1..2341; Strand=+
  SCN-specific regions: Sequence locations=1-1132,1154-1597,1643-2341
  Gene Ontology: Mol. function=calcium ion transporter activity; Cellular component=integral to plasma membrane; Biological process =calcium ion transport

SEQ ID NO: 80488 - DNA, 547 bp, Heterodera glycines
  Genomic contig location: Contig_ID=SeqID_16124; Location=1..547; Strand=+
  SCN-specific regions: Sequence locations=1-385,409-547
  Gene Ontology: Mol. function=calcium ion transporter activity; Cellular component=integral to plasma membrane; Biological process =calcium ion transport
aggcattcctttggcttttagacactttcgccagcaaagtgtcagctgttcaagacaaatacgccgacaattccattggcaacgtggtaaaaaggagcggctaattgttgtaaaatgactttgttgtccaaaagactgggtccaacgcggtcaacgttttcctcggcattggcatcgcgtggacattggccgccgtttaccattggttccagggctccgtgttccgcgtcgacccggggtgccttcgtccgactgtacctgtctttgcctaattacccccccccccccctcattaggaccctcgccttttcggtgaccattttttgcatcgaggccgtcatttgcataattgtgattgtggctcggagacataagtctgtttagctttttgtttcattttgaatttgtcccattttaaagggccattggcggcgaattgggcggtccgcgcaacttccaaatggccaccagtgcgttcttcgcctgtctgtgggccttttacattggcatctccgccctcgagtcgtactgtgtcatcgccggcttt

SEQ ID NO: 80489 - DNA, 1589 bp, Heterodera glycines
  Genomic contig location: Contig_ID=SeqID_16126; Location=439..2027; Strand=-
  SCN-specific regions: Sequence locations=1-161,183-216,238-238,262 -796,828-1043,1065-1408,1433-1502,1540-1589
  Gene Ontology: Mol. function=intracellular transporter activity; Cellular component=intracellular; Biological process=Golgi to endosome transport
atgtcatcggatgacacttttaccgagaaattaatagcacaaattatcaaaaatctccaagtgcatattaaacgggtccatattcgttacgaggacaaattctcgaaccgcgaacgcccatttgccacgggaattactttggactcgttgaattttcaggtgggggaaacaatggaagaattattttcctaatttattacatcgctttttagactacggatgagaatttcaaactgatagtgcaaaaagaaactgtcaaaatcttttacaagtgagtgcatcgttttactatcatcattatgtgttgtttgttcattaattttgttttagattggtgtccatgagcagtttaagcatttattcaaacgccaactccaaattcatctccgacctcaaaagcaaagagaagataatcagcgctttgcaacggacaatcgcagtccacgggaggaagcccgccgggtacaaatacggtgggtactgaattggcaattccaaaaacaagaaattgttgcccttttttccacagtgttggaaccgttgaccattgctgcacagcttaagctgaaccagaagccggagagtgacggctcaaattggaccactcccaaaattgatttgtcaatgcaattggacaaattgggactgtccatcggcaagtaccagtaccaggacatgcttctgtttctggaggcccaagagcgcttcactttggccgagaaattcctcaaatatcggcccaatctgacacactatcgtcagcactacacagaatggtaagcatttctgtcatgtgtatttaaattttaaactaaatttattattttgccaatttccggtggcattttgcatacaattgcattctcaatgagcaagtcttgcggcgccgaaacaattggtcgtgggacagaatgaaaaagcatcggcaaatggtgagggactaccgagaggcgtggattcacttcagaactcacaaaacgcccagaaaagcggtgatggacacaattgaggtagagagagtgcagctgatttctcttcaaattgttcaattaaaatttaaatttaatcgcatattattattgcctttttactctgaaaagcacttactctgttcacaggaggctgaggatgcgctggacgtgttcaacttgaacatcgcgcgacaacaagccgagttcgaaatcgacaaacagactgacctcgtccgtgtcgaggaccaaccgcaggagggatgggttggttgggccaaaaattggtggttcggcggttcgccaaagggaaaagaagcggtggaagacgcacaaattttcgaaaaattcgagaaggaatcgaccccaatggaaaaaagtcgcctttataaatccattgactaccaagtgagaatgaaaaaggaaattcaaatgtttacaataacaaaaattgggcaggaaaatgtgccaccgatgaactacccaaaacattttgtggacaacgtcttcaaagtgcacctgaaaacgctaaagctgaagttggacaatgtgatggaactgcgtttttctcaactgtccgctaaattggagcagagatcggctgcgagtgcaatgcggtaa

SEQ ID NO: 80490 - DNA, 2342 bp, Heterodera glycines
  Genomic contig location: Contig_ID=SeqID_16127; Location=9..2350; Strand=-
  SCN-specific regions: Sequence locations=1-17,42-259,281-290,312 -1716,1738-2342
atgccttctaaacaacaaaatttgaaaaagaagaagcaagatgtgtatcggcgacaggcagagcgatctgtcagtcgggataactcacccgtctcagacgggagtgcagatgggaatggagaggcatcggcatctctccggggcaccaccaccccaagcttaagtgctttgcaaataagcacgccggcgtcttctattggaagtaaaaaaagaggcaggccctcgaaagccggagcgaagccaaacttggctacgcaagaaagtgtgtctctcattgacatacatcgaactgtggtcactcaaaatgaccaggattcgccgtgcaaaaaaagggaaaaggtcgccgagtgtgaccaacccatgtttgccaatgaagctattgctttaacacctgtttcgactcaaagtcgtggagggcgacctgccaaaaaaattggaggcccaggccgaggcagactcagtgattccatgagcaaaagctctgaaatggataacaatcttgaaaatgccccaattccggcaacctcgcacattgtgtctgaaaaaattgacttcagcactgtgccaattaatttcgccacatcgcgaaattttgcctgtaaaatttggagatgggcagcaattggcctttatgagcgtgatggcgaaacagcacttggcccacgctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggacatagtgccaattgaagtggatgattcagcagtacttccttcctcggaagaaactgctgttcttgcgcaagcaccagtgatcggcgaaaatcaagctgacacccacggtgttgttgcggacacaattgtccagcaagaaccaatcgcgcaggctgatgatgtaatcttcgtcagacctaagacgccaccaaggcgatcactgcgcgtgcaaaaaaggctttcagcttctgttagccgttcgccttcaccggcgccaaaacgacccccgccagcaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcccaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggacccccactg

SEQ ID NO: 80491 - DNA, 1235 bp, Heterodera glycines
  Genomic contig location: Contig_ID=SeqID_16128; Location=97..1331; Strand=-
  SCN-specific regions: Sequence locations=1-92,136-293,353-377,433 -788,811-949,1028-1192,1228-1235
atgggcaattcatgcttaatttctgattcaacaagaggacaaacaatttcgccgccgtccaatgattttgtcgcaattttgcgtcggccgagtaataaaaataaaataaagaattaattaaaatgaattaattatcttttagttaatacaacgatcctcatcaaacgacaattaaagaacaaacgaacgctgacaaaaatgctcagtaaaccaaggacagaaactgcaattgttttgcctgaacgagggtggacactaattttttgtcgccaaaagaccgagaattgtacgtcaatttattagtttaacaaataataagaaaaatatatttgattatttattattaattaatcatggcattgaagaatttttggctcattaatttttagaaaaaaatatttacatcaatataatattgtttttattttttttcagaatttatttgtgttggcacaataacattgtgacaagtcgaagcgatctgttccacaaggcaatgcattattgcattcatgcgagcccaaagatgaacgaaattatcgcgtgcggccactattgctatagagacctgacaaaatggccaaaacttaacagaatttggttaataaaaatcaattttaaaaaaatgtttcttttgatgtggtgaaagaaaaaatttgagtgtgggagaaagtcggataaaggacatgggaggaccccttaaaggagttgcccgtagcgcagtcggatagagcattccacggtatggaagggcgccgtgggttcgagtcccatcggagcgagtaaactttattttctatattttttcttgcctttttcgatatatatgaccttatacaaaattgttgcgttctaaacatatacaatttaataagttatacccaaatttcataccatattttcttaatgagttaaatttatttattatgaaaatcaaattgaaaatgccaaaaattctaaaatattttaaatgataataatttaaaaatataaaagtttattataaattatatatttatttaattttcagtcaggcaatttttaagtttttcgataaactgatcaatgaatacaaaatggatgaggataaaatgtacgatgcatgtgtacatcttggcgaaatgcatgcaaattatgcccagtatgggcttaagcaacattttatggacctttttcaacaacaattattaggtgggagaattttaaatataaaatatgggtttaaaatgaattag

SEQ ID NO: 80492 - DNA, 549 bp, Heterodera glycines
  Genomic contig location: Contig_ID=SeqID_16128; Location=2124..2672; Strand=+
  SCN-specific regions: Sequence locations=1-90,113-129,160-215,237 -414,539-549
atgacaattctatttgataaatgcaggttaacatcagaaccaaaggtagatgaccaaatcaaattattaattattcttgaaagattgtgtaaataacctaaatttacatcaattatgtatagatgagagaattattgtttaaaaaaaataaataaaattgttaaacggaatttttaactcaattgcactgaatcaaaaaagttaacgctaaattcatttattaaaattaatttttagctaaatttgggtttttggaagagggtttgttgaatcaaaaaaggatttgaaaaagttagcccttttttttgctccgggttcggaattgtccaaattaaaccaaatattcatgataatgtattatggtactccggggaacgtgtatttgtgaaatattatgtttaattgtcatattactttatttaatttaaagataaaattaaaatcaaatatttaatagtcataatatttatttaaaattaattatagattagagtttttttaatttaaaaagaaaaatatttttataaaatattaaattccattataaaa

SEQ ID NO: 80493 - DNA, 1422 bp, Heterodera glycines
  Genomic contig location: Contig_ID=SeqID_16129; Location=185..1606; Strand=+
  SCN-specific regions: Sequence locations=1-287,316-358,381-703,725 -798,820-1246,1268-1422
  Gene Ontology: Mol. function=voltage-gated potassium channel activity; Cellular component=integral to membrane; Biological process=cation transport
atggtcgttgcgcgtcggggattggttgcaccgcagaacacttttttggaggcggtcgtgcgacgctgcaacaacaccggtgaagcacattaatgataatgagatcattttcaaaattgtattaactgacgaattgtttgatctgctcagattcaagcttcattttggccaacgctcaaattatcgattttccaattgtttactgtaacgaaggcttctccaaaatgatcggttattcgagggccgaaattatgcaaaaaaatgcctcgtagggaaatacaaaaagcaaaaaaatgaattattaaattaatttttcagattgtcttttatgtacggagaacacaccgaccaagtgaaacggaagtaaaatgaaaaattggaaaaaaaaacattttaagatggccatccaaaagattcaaaatgccatggagacagaaaagacggagcaagtcgaaatcgaactgtgcaagaaaaacagtcggaagcactcactcccccaattgcttatctttaaaataattgtgctaattgtcagagtccgtcctgtggctgctgatgaacatttcgccaatcaaaaacgatgccaaccgcgtggttttgtatttgtgccaattcaaagacatcactccgctcaaagagccctttgagggggaaaacaacaaaagtgggcgggggagggggggggatgagataaaaaatgagaaacgaaatcttgaaactgtgccggctcacgccgggacttaaaagcattgcacagcggaattaaaagctaaaataattttcgcatatttttcacaatttatttcaaaaagccaaaaaggccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattaaattttgaaacgaaatagtgcacaaaagggagggatggttagacgaaaagaggaatttttagaaaagagcgcaccccatctgatattcccatttttccgttccacaactggccaaaggcgactgtgctaattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtgcgaaaccaattttaaaaactataatagtgcacataaggcgaggcgtcgcacgacggagcttaaaagcatcgtacagcataattaaaactgaatataattttcgaatatttttcacaatctatttcaaaagacaaaaaaaatgattcaatttt

SEQ ID NO: 80494 - DNA, 107 bp, Heterodera glycines
  Genomic contig location: Contig_ID=SeqID_16130; Location=373..479; Strand=-
  SCN-specific regions: Sequence locations=1-107
atggcccctaattacttcgtcgtcctgtttaaacatatagaaaatgtcataaggcaggcaggaaaggaggtcgatgaggaaccaagacttgaagtaatcttgggaaa

SEQ ID NO: 80495 - DNA, 1677 bp, Heterodera glycines; identical to SEQ ID NO: 16130
  misc_feature (1650)..(1650): n is a, c, g, or t
  misc_feature (1669)..(1670): n is a, c, g, or t
  Genomic contig location: Contig_ID=SeqID_16130; Location=1..1677; Strand=+
  SCN-specific regions: Sequence locations=1-89,127-486,529-1423,1454 -1465,1488-1677
  Gene Ontology: Mol. function=voltage-gated potassium channel activity; Cellular component=integral to membrane; Biological process=courtship behavior

SEQ ID NO: 80496 - DNA, 2852 bp, Heterodera glycines
  Genomic contig location: Contig_ID=SeqID_16131; Location=1..2852; Strand=+
  SCN-specific regions: Sequence locations=1-565,587-864,887-1590,1612 -1719,1741-2332,2359-2515,2551-2852
  Gene Ontology: Mol. function=propionyl-CoA carboxylase activity; Cellular component=mitochondrion; Biological process=isoleucine catabolism
cttacaaagtgtacggccaagagaaagtgccagcgggcggcgttgtcgccggcattggcccaatctgtggccgattgtgtgtcattgtggcaaacgacgcgaccgtaaaagtgagaaaaaaacgtacgaatttcgatgtttttttaataaaattccgtttccccggtttagggtggcacttattatccgattacggtgaagaagcatttgcgggcccaggaaattgcccttgaaaattggtcggtttttgttcccattttttggggtttccgtttttaatttccatcgttttgcccttttaattgcattaattattaattttctgctcagtttgccctgcgtttacctcgtcgactcgggcggtgccaatctgtcgcgccaagcggagattttcgcggacaaagacaaattcggccgaatctttttcaaccaggcacaaatgtccgccaaaggcattccgcagattgccgttgtgatggggtgggctaacaatgggaggggtattaattttcatggcatttttacgatttttcttgtattaattaacacattttcaacaaaattgtatcaaaaactctctctcattttagttcgtgtacggctggcggtgcctatggtgcgttttcgttttactttaaatttttgttgggattttggagaacctttttttgaaatggtcaaaaatggggccttcctaaccttcgctcaacaaaagtgaagtgcccgcaatggctgaccaggcagtgattgtccacggcaccggcaccgttttcctcggcggccctccgttggtcaaagcggcgacgggcgaagaagtacagccacaataagttttaaatttgttcgtccgacaatttggcaaagtccaaaaaaggggggaatttaacgaaccaaaaatcgatttgaaattgaaaagtgatcagattggccactgattgtgaactgttcaggtgagtgccgaagatttgggtggtgccacgcttcactgcggccgcagcggagtctccgattatttcgcctccgacgaccgccacgcgttggccatcgctcgtcgcatcgtcgccggccttcccgcccaacggtcttttcccccttcggtgcgttttgattgcctctaattgatttgtttgtctctctcattagtctaattgattggtgtatttctctcattggcatgccatttggttttgatgagttttaaaattgtttacttcaattggtcagcaaaacgatccttttccgtcttcggcatttgtggaggagcccatttaccctgctgaacaactctacggcatcgtcggcggcccgaaacagcgaaaggcgtacgacgtcagagaagtgatcgcccgcgtggtggacgggtcgcgctttgacgagttcaaaagggtgcgccttaattagcatttaattgccttgcttatactatttactgctaattgtaagcaattgatcggtgtgtccatttggttgataattttccctcttttttcagatgtacggcgaaactttggtcaccggatttgcccatatttttggccaaattgttggcattgtcggcgagtgcttttcaattcaaataaaaaaaacaaatttttccacccctccctctttcattataggaaataatggcattttgttcagcgaatcggccatgaaaggtgcgcatttcattgagttgtgctgtcagcgccaaattccgctcattttccttcaggtggacaatcattttgctaaaattgtcaaaataataaattactttaatttgttgccaattttatccatccgttgcgatttcaaaaatatttcttcccttttaatcatttgttttttttcaaatatttctctgatttctgttcaattaattcgcctttttgtcttgaattgttttgtttcgtaaatttttgcctttttcttgtgcagaatatcaccggttttatggtgggtcccgacgcggaggcgggcggaattgcgaagcacggggccaaattggtgaccgccgtttcgtgtgcagcggtgcccaaactgacggtgctcatcggcgggtcgtacggggcggggaactacggaatgtgcggaagagcgtactcaccgcggtcagaaaaaggcgattaaataaaatggaaaagcaatatttttggccaaaagtaataaaatcagggaccaaagttcggtttcaagtggaggaaagtgtggcaaatttctcattcgtcaggtttctgttcatgtggccaaatgcgcgtgtttctgtgatgggcggtgggcaggcggccaatgttttggcccaagtgcagcgcgaacggcgcttgcgcgagggcggccaatggtcggaggaggacgagcagcagctgaagcagcacattgaacaacgcttcgagcgcgaggcgtcgccccttttcgcatcggcgcgcctttgggacgacggtgggcaaaagggcgacgcatttttgaaaaagcgtggacatgcatttaatcatgatgcccgaccgatccaactggatcgacattttcgggacaaaacccccaagaaaattattttgtatggttttccagattttaaaaaccgccgaaaaagacccaggcttggatccatcggtccagcagaatcttcacgttggacatttgtgatggaaataggaaaatgccccgggggaaacagtcgacgaaactccgtttttaaaacggcggaaaagaggagaaattaagcatttttcacggagtaaccccctcatttgtcaggtgtgattgatcccgtggacactcgccgtgtgcttggcctcgcccttcaggcgacactttccgcacaaaaaagggaaggaaaggcggcggaaacgaaattcggcgttttccgaatg

SEQ ID NO: 80497 - DNA, 997 bp, Heterodera glycines
  misc_feature (73)..(73): n is a, c, g, or t
  Genomic contig location: Contig_ID=SeqID_16133; Location=335..1331; Strand=-
  SCN-specific regions: Sequence locations=1-158,191-679,701-703,725 -768,793-872,897-974
atgatcagccgcagcttcgtccattgttcgtttcctgcggctcccgtccttctcatcctccttcaacccgacnccattggagcagtacctgcgccaccgccggcgctggacaatggctcttatgctgttgcttccggtgatgctctactgcttcaacatcatcattttcctcctcctccaccaccaccgttttgttatgcttcttcacctacagaaaaggctttgaacaatggtggtgttcaaaatgggggactctccgtcaatttggccagcaataataatgatgatggtcaaacggccatcaatggcggcttagcaaccgcgggaccacccagctacgcggagtatttggctttggcagcaacggctgctcatcatcgtcctggcccaccgcggacggaggaatgtgcagcggcgaaccgcagcggtggcgctgctcattgtcagcagcgcgaaagcaaaagcagcaacagcacttcaaatcggcgacggatgaggatgaagcggggcagcaatgcggggcgggggagggggaagccgttgaaaaagggtgaagcaatgattacgttgatgaggaaaagcattggcgaggagagagcggaggaggaggaggaaaagcggcgatgtggaggacggctaatagccgtcaaagcggtgaaaggggaggagaatgttggacgagcatgggcagcagcagcagattgtgatgatggggatgatgaagtggcggctaatagtgcggatgatcgaccgtcgcgaggacaaaaacactcatcatcatcatcctcattggcgcaccaattcgactcatcctcagcagattcggcttctcctcctccaccgcctccgtttgcacttctcctccgggacccgcagcagcggcggccgcggcggggactgaaaaacaacaaccatcttccccatcccaatcccaatcatccccatcatcaaaagcttagccgttgttatcggaccaatagcagcagtagcagcagca

SEQ ID NO: 80498 - DNA, 3883 bp, Heterodera glycines
  misc_feature (704)..(704): n is a, c, g, or t
  Genomic contig location: Contig_ID=SeqID_2575; Location=1..3883; Strand=+
  SCN-specific regions: Sequence locations=1-206,229-1368,1390 -1492,1533-1733,1771-2072,2094-3662,3684-3883
caacgaaattcgtgattttttgaaaagtcagtcgaagagtatgttgattgacgaattttcatcatttgaggaattgatctgtaatttcggagaaattttcgcaatttctgaaaacgaattgacacaaacaaatttggtcgaacacaaaattgatacggttgatacaaaaccgatcaaagcaaaacataggcctgttccatacgcctaccgagaaaaggtggctgaaatgatcaatgattatcttaggagaggtctgatcagaccatctttttcaccgtgggcatcgccaatagtgattgttccaaagcgcgacggaaccctccgtttctgtgttgattacagaggcctaaattcagttacagtaaaagacgcatttcctttaccaaacattgacaatactcttttggcacttgggggacgaaaatttttctctgttattgattttatgtcaggttactggcaaataaaaatggaacccgaatcagtcgaaaagacagcttttgttacggaatttggattgtatgaatttacagttttacctttcggtctttgtaatgcagtagcgactttccaacgcttcatgacgcgacttttcgatggaatggtaaacgattcagtgttcattacattgatgatattctgattgcttccgagacctggagcgatcatttaagagaccttggaacagtttttgaacgcattanagcagcgggactgaaactcaaaatcacaaaatgccactttgccgcaaaggaaatccctttccttggccatattctgacccgtaagggcataaagatggacattgacaaagtcaagccaattatcaaccttccaactcctaaaacgaaaaaagaattacattcactcctcggatttttcacttattacagaaaatacattttcggttttggagcattggccaaaccactttttcgcctacttaaaaaggacgtgaaattcgaaatgggagaaattgaatttggagcgattaaaacactgaaaaagagtattttggatcaagtagttctgtatttgggtcagcttaggccaatttatttcgcgtcaagacaatgtaataatcacgagtcacgctattgtccaacagagcttgaagcgttggcaattcgtttcggaacaaagaaatacgctcaagaatttaggcctctgtaatcaacacagaaattatgttttgttaattggtttttctcaattcattttgggttttttctgagttcttcggattgatattttttttttgctgtgaatgacttttttgcttctcaatttctctctcctccgatctttgaatattttttggaaataaatctctctcatctggtgaagtcgtttggattgtcgtgttcgtcttttgtttaattttgtttggacagggttttaattgttggaatttgccgtggtgtaattgttggtcaacgagcgaaaatttgtgcctgtttcagtcgaaaattggagagtatttgactggccgtataattaaaataaaataaaaatataaaaaattaatatttgtgctgttaaccagggcggttgctttaaagctccgtttatcctggcagcaatttgccttttagggcctgaggtcgttttaattacacacacaaatttcccgagccgtttaggtgccctgtcgtcttgtgcttcatgggtggcggtgtgctgctcctcaggccatagttggttttctaatacatgtcaaaattggggggccgtataattaaataaataataaattaatattttttttttgctgttaaccagggcggttgctttaaagatccgtttatcttggcagcaatttgccttttagggcctgaggtcgttctatcgttctaatttctgtcaccaatttcccgagccgtttaggtgcactgtcgtcttgtgcttcatgggtggcggtgtgctgctcctcaggccatagttggttttatggccaaatgatttactttgaactcttttcaatgcttattccctatcatccccttcacccctcccttccatttatttaccgccatataaattcattcatttcatgcaattcgccattttgaaaattaaaaaattcatctattctcaccttcctatgctgggcattgtccaacagggaaaaggagctgagacaacatcgaccaaaaaactaccggctgaatacgtggaaaagatggactgcatcatggagcacgttgccaaatttcatttcaccaaagtgaagtcgagatttgtcataaaagatgtgcctgcagaccccgaaggactgctagcggccattttccaacactgcattgatgaagcaaagaaggacagtcgcgaaaagggaagcgaaccgacacaccttggctgtgtcatcagcagcccactgctggatggtggcgacataccaattccgctacgtcaaattaccgacaacacaatcaacaccatcctaaatcagttcatcaaggtggcacaaagcaaaaagcagcaaaacatgactttgtggggcgagccgttcatcatcgccataacatcggttgatcgcagtggacttccgatgaagcggcacatcaaagggggcgccagacgtcgcttggcacaagttcagcaccaagtgcatgagaagtgcttgattaaggtgaagcgccatctttgtttattgtatgacacctactcatatatttaagatcaacaaccaaaacggggacaacactgacaattattgcttgttttacgccctacaagcaacaatggtggccaagacgcgcagatggccaaagtggaagttttacgattatgtgcatagtcgccgtggtcagcgaggacagttccagcaagacacattgaaagtgatgcggcaaatcagagcaccactcgatttggacgcatacgacgccgacacttatgctccattggtcatcaatcactggaacaacgcgcagcagcagcaccggtttgctgttttcatctttggaacgaccggccactacaagccgctttacaaatacggcaacgacgactacgatacgccattggcgctttatttcaacaacagtcattttgatggcgtgcagtttctgagtggtctctttgacggcaaaaagtactgcctggcgtgtgaaggaccatactcgagaccatcaatgcataatcaatcatgcaaagcgcactgcctcatgtgttcccgtgttggccctgagtttccgtgtccctcggaagctgacttcttccgacaatgcaaagcgtgccacaaaaacttccacaacgcgggctgttacaatcaccacattcagtccaactattgtgcgcgttcaaagaagtgcaaagactgcggtgtcattttggacgtcaataacaattctcaaaaagggcggaaggtaccaaactcaaaaaaaaatttttttaaccataaacactttaagggacacgtgtgcggagaaaaattctgtcagctctgcaacaacttccacagcaccgagcgtggctgtttcattgcaccacttgagcctaaggaggagatggagtcctatcggttcgtggcctttgatctggagacaatgcagcatctccctgttgaccctcgtctacctgagagcgcaaccacgagccaaacttcattgcagcgaaagtgatttgtccaatgtgcattgaaaatgggagctggaaacaaggaactgccgggtgttgggtgtgcggcccacaccgaaccgttgccttctgccaacgaccatttaacggcacttctgttgacaaacaagtggtcaccgacaatccaatgcaagcgtttgtgggatggctgatcaatgacctaccgaagaaaaccaacacgtacgcatactcccattttggcggacgctttgatatggtcatcacattcagtgaactattt

SEQ ID NO: 80499 - DNA, 1650 bp, Heterodera glycines
  Genomic contig location: Contig_ID=SeqID_2576; Location=1263..2912; Strand=-
  SCN-specific regions: Sequence locations=1-57,79-296,319-547,570 -771,793-1156,1179-1596,1618-1650
  Gene Ontology: Mol. function=calcium-dependent phospholipid binding; Cellular component=secretory vesicle; Biological process=cell proliferation
tctacaccagctactccgacaaagcagcctacaccacctcaacctgctaagcagcctataccaccaccaccacctgctaaagagcagccatttacggcaccaacaccggcaactccaaaattgcaaaagcctactccaccccctgcaataactccagcgcaacctattagtaagcctacgtcaatccccccagtcaatccttcgccagcccaaatacctcccaaaccaaagtccattacaccgattactcccgctaaagtgactccgagctctccagcttttaagccgtccgctcctgtttctacaacacagccttttttaagcaaaccaaacatcgtctcaacccctcccgctccttctaaaccatcagcatcaattgacgcaataaaacatccagttacaactgttaaacccacacctccttttgctaaatctgcttcatctcctactcagactacaaaaatagcttcaccgactgcttctgcaaaacctaaagataacaaagcagcggataaagacgttaagcgatcagtcgaagccccaaacaaaaacgaaaaggaatcgaagagaattttagatgtggatgataggttttttggcggtttacctgccggagacgaatttcctgacgacgatgacaaagagtccgagtggccatatgagcctttcaaaaacattgttgatgatgtagaaatacaatatcttgatgactttgagcgattcaaggtggtgctcaaaagtccaatcataagccacttgtcattctcacctcagctaggctatgtgcttggctttgaaaacccccaacacgttggagatcaagaaatggcaaaatacggttgtgacttacggggtggcttctcaagttttgctgtctattccaaaggattgactgagaatatgattgtgggtaattcgctgagttcgctgcttcgcgttgtgtcagttagcggtgccacacccggtgactacaatgagaagatttatgattcgccaatatacgctcgagtgttgcagcgggagatcaacgaaattgagattgagttgcgcacgatggacaagggtcgactggtcccatttgcctacggcacgaccatggtggtattaatatttaagaaagtgataaatttttaaactcactcatttgtgtttttaaagcatttttacgtaaataaaatggttcatattgtgtttgatccaagcataatcggatatgatgagtacatgcaatacggaagtggcatagagagcgaggattacttccgagggtccagccccttccagcgagggtatggacaacgaggcgcaggggtgggtgatgtttttcgtggactttggcgttttttccttcccatccttcgtcgtgttggcactacagtaggatcggaggcgttgagcacggggcaacgagtacttgagcgagttggaaacgaaggagtaccgtttaaggaggcatttgtgagcgagggaaagaaaggaattgacacggtgttggagaagggcggcctgccaaaacagtttggcagtggtcgaagaatgggtataaaaagaaagagagctcatgcaccaagccatcagacaataattggacgggcaatcagcaaagcaggaaataagcgtattcgttcggacgcttttggactttattaa

SEQ ID NO: 80500 - DNA, 65 bp, Heterodera glycines
  Genomic contig location: Contig_ID=SeqID_16136; Location=134..198; Strand=+
  SCN-specific regions: Sequence locations=1-65
atggcgaagaatcgttcggcgtcggctcaaacgtgcaaaccattctctataatgcgcaaggagaa

SEQ ID NO: 80501 - DNA, 1001 bp, Heterodera glycines
  Genomic contig location: Contig_ID=SeqID_16139; Location=261..1261; Strand=+
  SCN-specific regions: Sequence locations=1-194,238-494,565-976,998 -1001
atgattattgatgcaattttattctctaaaaaacgacaaaaaaggtaggttttatgtctaaaaaaccaaaaatagtcactaaaaatggaaaataggcactaaaaaaatgcgtaaaattttacccataaagcaacaaaatgaagccaaatcagaattgggacacatattttttaaactttaaactccttgtcaagaaaaataaatagattaatttttgagaaaatttttaatttattaggtgtgtgttttttgaaatttttgggtcgattttttagaggcgtatctttcttttttattgtatttttgctaataaattttccaaaaaatgttaaaataagttttttcaaaattactttttgacaaaattaattttttttaacctattttgacgcaaaatcttttacaaattgcacttaaatcttcaaaattttcctctacggcgtctatacgcaccttcggtcacgccaaatctttttaatatgcttttaaattgcttataaaattattgaatttttaaaataaaaatttgaaaattattttaaaaaaataaaattttgaaaattacggattacgggttacggattacggaaaattacggggttttttgacccccgtcatgatggattacggaattccgtaattgagaaaatcgccgtaattacggatttccgtcaatccagttacgcccagccctgttatcgtctccacttttcaaaatgttgatgaattcgatgagatttttgaaacattttatagagtgaaaatagttaggacatgagaaactcaaaaaccaagtttttttaacatttttggtcataactttttgaaacataataatattttttgaaatttttgcaggataatagaaaacactttggctatcgaatgctatcaagaattaaaaatttggttcctacttattttagcggtttttaaagcctaaaattggagctctagttgtaacgtgggctcacttaaaatgccatttttccccactttta

SEQ ID NO: 80502 - DNA, 161 bp, Heterodera glycines
  Genomic contig location: Contig_ID=SeqID_16139; Location=1..161; Strand=+
  SCN-specific regions: Sequence locations=1-12,37-161
aatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatctctgct

SEQ ID NO: 80503 - DNA, 938 bp, Heterodera glycines
  Genomic contig location: Contig_ID=SeqID_16139; Location=1725..2662; Strand=-
  SCN-specific regions: Sequence locations=1-147,189-341,413-522,545 -548,570-938
atgctgctcaaattggccgactacttccaggtgggtgcccttacagatggaatattagacattacattaaattttattccgtgagcacttgattttcaaaaaaatgatacttaaatttgaatatcctttatcaaagagagtttacccataattttcaataaaaaattaatttttactatttttaaattcattagggtaattattagggacactaattgctctgttttcaggtggccgtgttgaagtcgcgctgcgaaacgcatctgatcaattgtgttgaaattccactgatcgaccgtttccttctgattgaacgcttcggactcgacaatttgaaagtgatttaattttcaaatatttaattttttaatattttaaaatagtttttaaatgatttattacattttattttcccatttttagaattattttttgcatttgaatgttgacaaattgcgtttccggcgcgcctgccgcctgggcgacgcgggcgccgcctactcaaaaaagtcggtcgatggaaaattggtcgacgatgggcggcgtcagcggcagcggctgcagcaccgctcagcgcttgccgtccgccgccggcggcttctatcgccagtcgccaacgcccggcgcagcgaccgctacggcgacaacggcgcgccagcagaggccgctggcgctgccgtcgctgtcaatgcgccggtcgccacgccaaaagccggcgcggctccaaccccaaaatgagcagacggcgggaggtcataaagtcagtaaaatgtttcaaaaatctcattttcattaaaagttgttttttttacaattctctcatttttaatgcttgatgagtgactggcgatacaaagcttattgccgtggtcaattagtggggtcaattagtcacgcgtttttccattatgaaatcaattagtgatggtatgaataaa

SEQ ID NO: 80504 - DNA, 1352 bp, Heterodera glycines
  Genomic contig location: Contig_ID=SeqID_16140; Location=163..1514; Strand=-
  SCN-specific regions: Sequence locations=1-177,202-226,269-479,502 -832,854-1106,1129-1129,1158-1178,1230-1352
  Gene Ontology: Cellular component=integral to membrane; Biological process=axonogenesis
atgaaagcgtcgcgcggtctgatcgttcgtgattggaaacccgacgtggtttatttggtccaattcccacgcacccataatgtgctcagtccatccccatttgcactcaaattggagacatggcttcgcatcaatgggcttaaataccgcgtaatttacactcataatattaaatgcattaaataaaaataataattaattgaaaaaggaatgttaaaaattaggcaaaattttatatttagtcttaaaaaatacaataaattaaattggcattttgactgtttaaatgggagcaactcgtacaaaaggcaactcgtacactgttgtacaaaggcaaatcgggcaactttttacgttaggcctaggcttaggcttaggcctaagctttaggccaggcctaggcttaggcataagctttattttgtaaaatccgagtttatttttttgccattgactcgtttaaatgaaaaatattgttcaaaactgttagtgttcttttcagaatgtgaacaacgaattcacaaaggcgtcggccaaaggtcaaattccgttcattgagctgaacgggcgccaatttgccgactccaatctgatcattgatcatttgcgcaaccatttcaaagtttccatcgattcgcgcctcagcacgcacgaacgcgcgttgggtcgcgcattcactattctgatcgaagaatcgctttttcggtacgccaattgcccaaactgataaacgaaagtgccgaaattggaattaccaaagcgaagggaccaaaaaaaaaaatgcatggcactctcgacgatctcgagccgatcaaattccccccttttttgcgaggagggcacgaaggggaggggaggaccttttgttgttttacgaggcccaattcagtcctgagtcattgacaaatgccaatcgctgaacactaatgaggatgaactgctaaataattttttaggtgccttcagtacgaccatagcattgactttgggtggttggccaccgaaaatggttgggccgttcacatgagcggattccaaaagtttctgtttcagaagatcaaactcaaaaagttccaaggatttgtgagtgttttaattaaataatttctttttcaaagcaaagcaaagcaaataaatttaatttatttttaaattatgttttccttatttaggtgtcctttatttttattgaattatttgtaaaaaagaaaacaaattttaaaaaatatgatgcaatatgcgttttagtacaaaagcgttttgatggcacaaggctatggacgccattccgagacggaggtggaagaaatcgcgaaaaaggacctgatagcactatcaacgtgatcaaataa

SEQ ID NO: 80505 - DNA, 661 bp, Heterodera glycines
  Genomic contig location: Contig_ID=SeqID_16141; Location=1751..2411; Strand=+
  SCN-specific regions: Sequence locations=1-661
atggccgatacggtgctgaacattttgcagaagtacgacggagttcgggtaccgaactatgaaagtgtgtgcgagggactgacaggggacgattatttgctggcaattgttaaggtataatggtgaaacatttaaaactgtttctgtttctccatttatcatattcgttcagttcctcgccagacgtgacaaaatttacaatcggatttacaacgaaatcttcgaaagtgtgagtgaatcgctcaaagttttcactattttcgattcagaaaatggcccttaaagacaaattggcatttgctgccattcacatggacgacgattttctcggcactgccctcgaaaggctcgtcgaacggctcactttggaatttccactgaccactttatttgtcaatggcctcgacgaccaaacggaaagtcatcaattgttacaccggtcagcaaaaacaatcatttgcaaattgaatgcccaatgggttctcctcatttggcattttaagttacctcgacctcaccggtgacctccaaacggtgtctcttcttctcgtcattggcaattgttttcgcggctgcgctgtgtttcgggaagaaacgcccaattcgcccgttggcggcgttaaggcggcggaacttttggagtgcgcaatgtaagcggaga

SEQ ID NO: 80506 - DNA, 2249 bp, Heterodera glycines
  Genomic contig location: Contig_ID=SeqID_16144; Location=100..2348; Strand=+
  SCN-specific regions: Sequence locations=1-671,700-747,891-1027,1049 -1314,1399-1554,1632-1632,1679-1948,1971-2028,2052-2249
  Gene Ontology: Mol. function=receptor signaling protein activity; Cellular component=inaD signaling complex; Biological process=signal transduction
atggaccaaaatgatcacaatattgttggtgatgaacaacaacacatttgggttggccgttacaacgaaaaagtgagggcaaaagcgaatttggaaaatgtccttttttgatgccggaaaaattccgtgaatttttaaataaatttagaccggatggttcccagcgaaatgcgtgcgaaaattgactgctacaagcggtggaacaacggatggtaacaacatgctcaattatggcacaattgagctaagcgggacaacgtttaaacaggtgcaagcaaacaatggcattttcaaacttggaatttggcgcaaaattttgttatttcaaacaactgttttttaaattgcattgatcgaatccttctcgatctgttgatcagtcgattatggctcccgtacaacatttatggaattgtttccgggatatctaaagataattggaacggagaaatgcaaatgccggaatttaggaggaaggcaaatgagaaatcgggatcctttttgggccgcctttcccgatcacttgtcttcacatattcttgcccgataacttttccactagtcttttccgatcacttatcccatattctattccgatcaccaatttatccccccccccattgggacagtgctcctccgattcctcggccgatcaccccgccgaggacgaccattcgcgccgcggtcgtcgtccgttcgccttccgcgtcactttggccccgtcccattgggacgtgtgcgactacgttttggcggcgaacagtcgcgaggagatggacgaatgggtgaacgcgtgccaacaagtggcggccgaggcgagcaacaaaatgcgacagttgcgcagtcgcgagaaacagtcgcgcatcgccagcgaactgtccagcctcgtggtagggcaatgacaattttaattttgatcaatcacatatattgaaaacaaaaaatgaccaacattggcagggcaatttcgcataaatgcggactgatcagatagagtttgagctgtgattgtcattttcaagattatcttctgattaagaataaaaagccaccttgacgtgtgacaaagtctctgaacaataaaaaattgatcaataagtcagtttgccattctctgattaaatttaaagctgatcagtcgatcagaagatttagtctgaatttcatcaaaaatggatctttgggtaatcaggcgtgatcggattcgatttttctgatattgagaattttcagctttggtgatcagaatttgttagatgcaaacatttgcttttcggacttcaataagctggtcaaattttgtcctttttaacagatttattgccaagcagttccgttccatgccgatttcgagttgcaagacccgcgcagctcattctacgaaatgtgttcctttaggtgcgtgccatttccgaccaatcttatcaaattttggttaattcaaatgcaaaaattgcatttttggcttttgtctgatctgcaatgatttaaaattagcccttttcgatcatttatccaattgtttagcctaaatttcggccattcgtccatttcagtgagtccaaacatgacaaattggtcgagcgtgggcttcagctgttcaacaagcgtcagctgtcgcgcgtgtacccgcaggcgagtcggttcacctccaccaatttcaacccggtgccaatgtggaacagcgggtgccatatggtggcgctgaacttccaaactggcgacaaatccatgcagctgaacacgggacggttcatggccaacggacggtgggacaacgggcacaaattggaaattagcactatctaatcgggccttaaaaattacaaagaattgaaaaaatcgtctaaaaattttaacagaattaggccgagagtaattttagttacaaaactcgagaatgattttaattagttcgagactgaactcgaacaatctcttatttgtagctgtggctatgtgctgaagccgctttatctgatggacgaaactttttccatcaatgctcgtgatcaccataaccacagccaacaacagcagcaccaccaccagcatcagttgcagcgtccggcgttgtcgagcagcacttttgagaatgtgccgtcgtcgccgtccaacgatggcacggcatttgacaaattgacggaggatcgggacgacgtgccgacgaagctcatcggggacgatggacagaaacaacggcaaaaaatgagcaccggcaatggcactttttccgcagcggcaatgcc

SEQ ID NO: 80507 - DNA, 712 bp, Heterodera glycines
  Genomic contig location: Contig_ID=SeqID_16147; Location=700..1411; Strand=-
  SCN-specific regions: Sequence locations=1-82,117-191,262-668,690-712
atggggccctgcctggtcgtaggagggggaagggaattgagacagctgttaggcaataggcaacaaattcacagaatggcgagatgggaaaacaagggagggagggatgggactggtgatgcgggcatacggtagcgacagtaggcaaacgacagaccaaatttccttctgccggccaaaagtaaattgtggaaaggaaaagagaaaaaaaagaaaagagagagagagagagagaaaaaaaggaaaaaaaataaaataaaattttaagttaatcgcatatggtgttaatgcgcaaaacattattattcagcattggatcgtctggaattctggaggatcccctgcgcgggatacaactgcacttaaatgtgctttgggattaacgaatgggcgagccctgtaatttgctctgttggcccaacttcctgtgtcgactcatcacgctgggacccttttgtcaccccattaatcgtttcggcaatggccgtgctccttttccttgtcggcattcagtctgtgactttggctgcgcttctcctgcgtcgtcgtcgtcagatgggcacaagcggtttgggcttttgcagtcaatgccgccgattctccgccaattgaaatcagtgaactgttacggcgggggttattggtgttaatgacactctcaggatttgttaaatttttttttttttttacatttgatttttaactgaataaa

SEQ ID NO: 80508 - DNA, 846 bp, Heterodera glycines
  misc_feature (632)..(632): n is a, c, g, or t
  misc_feature (687)..(687): n is a, c, g, or t
  misc_feature (702)..(702): n is a, c, g, or t
  Genomic contig location: Contig_ID=SeqID_16148; Location=27..872; Strand=-
  SCN-specific regions: Sequence locations=1-445,470-846
atgctttttcatttcatgattcttaacacgccttatctcctaatacgtttaattgccggcgacgactacgacgaaggctgcgaacagcgcaactgttgcaactgtgtggcggtaaaaaagtcggtcaatttcccatgcatgtgaattgcctatttcagcaagcaaaaggcgaccagatgtacttgttcgaaatcacggagagcgcgtggctaccccactgcaacggtagcaaagcatactttcgactaaacaattcggctacttacacaacttgttttagcgtgcaaaaagtccatttcgggcagaatggccgcggaattggagtgttccaagttcaactttcatgggaaaacgttccacgtcgaatgctcaaaactcgcgaatgacaaagtgtgattgtcaagatctctattgtgttatttccgtcataataatgtttatgtgcctctctctctctctctctctctctgctgtgttttctttaatacccaagtgctaattattggtccgaaattcttcaatttgtatgcgtttcgtgccaactgtttaattttaacgctgcgtttttgatttaaatttttggcattagtttcaatttttcacttaggtatggttgggtcagtcattaattnaggtaaaccgatcgaaaatttggacaatctaccgtaggtataatggtccaattanaattcacatggaaantagattttttttcgtgcatccattcagcatataaatttttaccatttgaaaagtgcggcccaaaagcaccaaaaagcgctgattaaaagaacattttgtgggtttcactaacaggcaaaaaccattcactaaaatcaaaataaa

SEQ ID NO: 80509 - DNA, 967 bp, Heterodera glycines
  Genomic contig location: Contig_ID=SeqID_16148; Location=1296..2262; Strand=+
  SCN-specific regions: Sequence locations=1-248,276-281,304-846,917-967
atgcatgggggcatcagcaacaaaatgcgaagtttaagcggccttcgttttaatcagaaattaatgtttccccatttgcagttcatcccatccggatttgagccaatgttcaaccaacgactcatcaccgttttctctgcacccgcctacacaggccaaacaaacacgggcgcggtactggaagtgaagacgtcgagccactttaccactcactttttcccgccccaatcccagtgattgattgtactttgttgtattgttgttgttgttgttgtgtttataataaatgctcttttgtgcttcaattgagatggttttgtagggaagagggtggcgagggcggtaaaattttgcgtctgtttggtcggagggttagctctcgaagaactcggtctgcttaattctagtaaattcatgtcaaaattatgatggattttcacttttttaccgttgttcacccactaaaaaaactcatctaatatactgttttgtttataccttttatgtatgtacttgaatatgcataaaattaattgacaacataaaatttgtcgaaaatgttttcatgtgaaagttggatttttgacttgtgtcattcatctcgaacaactattccagctacatacatattgatggaatttatttttgtgaatgaataacagtaaaagtgaaaatccatcaaaaaatttttttgacgttatcacttgatgaaaaatcatagattagatgatttatatgataatctgatgtcagattcgtgatcagcgccatcgataacccccgagcacttcttagaatcgaaaaaacgaccttttttatgggaccaatgatgtgaacgattatgtcaataaaaatatttaaattgaattattttaaagctattttttaattgaatattaataataattttaaaattcgaggttcaacttttcttcaatgttttttaaatgctagcttcgtaccatta

SEQ ID NO: 80510 - DNA, 1373 bp, Heterodera glycines
  misc_feature (9)..(9): n is a, c, g, or t
  Genomic contig location: Contig_ID=SeqID_2577; Location=2817..4189; Strand=+
  SCN-specific regions: Sequence locations=1-329,352-903,925-1373
  Gene Ontology: Mol. function=general RNA polymerase II transcription factor activity; Cellular component=chromatin; Biological process =establishment and/or maintenance of chromatin architecture
atgcgttcncaatgtcaaacggacgggccaattagggtttcctccgtttcttctgatggtattgccaatgtgacggaacctatggattcacagcgacataagttgctatttttatggacgactgtcgtctatataagtttttttaagacgccgactttacgaacttttcgcactgattgagaaggaaatggatgcgcttttaatggaaaactgcgcacttcgcgcacaattgggagtacaatcggaggaaaagcctgcctttgaccctccggaaacccctaccagcaagaatgttgcctccgttcaaactgtggaatttgaatcggaacagaagccaagcgggactagcagcatcaaaaaaaattgtaacaatcggtacccaattgtactcaacaatcaatcatttcagcatctcaaagcaaacagcagcgttggaagtcagcattcaaaaacccttcaagcaaattgacgcttaaagtcggcgccaatttcccggaatcaaagcacaaagtggtccaatccttcaaaggccattccgacggagtttggcacataagcacagcccaagttggaaattcaactcatgttattgccagtgcaagtgccggtaaagaatagaattgtgcagcagcttttgagcatgttcataactaattcagaccaaacttccaaaatttggtttgccgaccatggctcccacccattggttagctattctggccacaaaggttccataaattcggtggctattcgtcctgaaacaagccgagtgttttcttccatctatggcaagcatttgacgttgctcacttgtggaggggacagatcggcacacatttggaacgttaacttggatgaacttatggagcggcgaaaagagaaggaaaatggtaaaatttaaggagcattactttatttcctccaaagacgagagggcttaattttttcggctaattgggcgaaagtaaaaaagcatttacaattcagaagaaccgacacagcaaatttctcatcccattacgctgttggatggccattctgacgtcataatggctggggaatggctgatcggcggagatcagatcataacggcatcgtgggatcgaactgctaatttatttgacgcagaaagtgggaaaatcatcaaatgtttatcaggtgaatattatatttaaaaaacaagacgtaaagtacttggttttattttaatgtgaaaattaatgttttctttaaggtcatgatcgagaactgacctcatgttctgctcatccatcacaaaaattggttgcaacggccagcaaagactttactttccgtttgtgggacttccgagacccaatccattcagttgcagtttttcagggccacaatga

SEQ ID NO: 80511 - DNA, 708 bp, Heterodera glycines
  Genomic contig location: Contig_ID=SeqID_2578; Location=27..734; Strand=-
  SCN-specific regions: Sequence locations=1-367,389-511,533-543,567-708
atgttcaattacaattgggaggaagtgcctgaacgggttttatggaaacaaatgggcactgaactaattccactcgtaccattgccaaaggccgttttgagaggggcgagaatggcaaagtgagagagaattaaaattaactgccaacagagaccaattccaataaaaaaaatgcaagttttcaagagtaaagacactcccacgtccccaccccaacatcatcaaaatgtacaccgcctttgtcgatcgtatgccaattcttcccgaagcggagaaactttaccccgaggcgttgccaaacgcagccgaaaaccctttgacttatgagttgaaaacgcttcatttggtgatgaaacggtgaaattcgtcattttcagaacaaaataataatacacttttttaagctatcgaatgactttgcatgactatttggaactgaagaacgattacgagaaaagagacccaatggtgggccgacttttgttcggacaattgttggaagctgttgtctttttacacaaaaacaaaatttgtcatcgggtaaagagagagagggataaattagaaggaaattgaaaaaaatatttaggatatgaaatcggacaacatccttttggattttgacagtgaaggtgctttcttgcttgtatttttctccatcaaaagtttcccttttcagctgaagtgccacacctcgtcctcagcgat

SEQ ID NO: 80512 - DNA, 462 bp, Heterodera glycines
  Genomic contig location: Contig_ID=SeqID_2579; Location=2578..3039; Strand=-
  SCN-specific regions: Sequence locations=1-181,203-462
atgggaatggacaagcatttgcttttccgattgatgtgctgctgcttcacctgtgccggttggaatgccgaaaccgcaacaaatgtgataaaagccgtcctcgccccgttctcccacattttcgtacatatgcgggttgcggcgccgatggagccaacacccgttgcagagcaagcagcagaagaaggagaggaggatggacaaaaaaatggagaggatgaggccgatgatgaacagggaccagtcgaccctttaggggcgaattggacgaaacttttaccatgccgaaaaacgaactgaaaaccgccgccgggggcgtacacggcagcgaaacgttcctcccttttgtgttggccaaagtcggtgatttggccggacgattccacaacattcacattgtcaggttcacagcagaaataaccctgtggtaaagccaatttccggtggattgaccccaataaa

SEQ ID NO: 80513 - DNA, 711 bp, Heterodera glycines
  Genomic contig location: Contig_ID=SeqID_2579; Location=2498..3208; Strand=+
  SCN-specific regions: Sequence locations=1-66,88-340,362-596,619-711
gctccgatgcgcaagggcatgctgccgaagccttgagggggaaaatcaggtaattaagaggcattcttgtcattttctgttttattggggtcaatccaccggaaattggctttaccacagggttatttctgctgtgaacctgacaatgtgaatgttgtggaatcgtccggccaaatcaccgactttggccaacacaaaagggaggaacgtttcgctgccgtgtacgcccccggcggcggttttcagttcgtttttcggcatggtaaaagtttcgtccaattcgcccctaaagggtcgactggtccctgttcatcatcggcctcatcctctccatttttttgtccatcctcctctccttcttctgctgcttgctctgcaacgggtgttggctccatcggcgccgcaacccgcatatgtacgaaaatgtgggagaacggggcgaggacggcttttatcacatttgttgcggtttcggcattccaaccggcacaggtgaagcagcagcacatcaatcggaaaagcaaatgcttgtccattcccataatttcagtggtgttcagcacccatcccccgcagttctccgacggcgtttatgccccgccttcgtctctgagttcggcctcgcgaagccgagtccgtttcaacgaaggcgccgcgccgaagggagtgctgaaaaacggagactttcagcagcagcagtacccaacgcca

SEQ ID NO: 80514 - DNA, 852 bp, Heterodera glycines
  Genomic contig location: Contig_ID=SeqID_16149; Location=128..979; Strand=+
  SCN-specific regions: Sequence locations=1-326,348-368,390-655,677-852
atggcacctccgctggacactgcggctgatcagttgcgcaaactattcatttcgacgcgcactcgcgcagtcagtcaaatcaacgaacagttggccgactttcgtcggcggggccaaccctttggtaagcgattggcagggctttacactattgaatcataaagctgaaattatatacatattttgccattcttttagagttttaatgggttcaatggataaacactccaacatcaaagagttttgacattcatttttttgaatttgcattagtaaatttggcggttctgccaaaactgttcccaatgctttacttttgctgattattttttattttgctttcatttggggtttggcttctcccttctactcccaaatcccttctctttcccagacccggcggatggcgttgacgcggctctgctcgactcgctgacttcgcgcgcggaccgcggtgccgaattgcgcttggccagtcgactgttgttcaaggccctacaaagcttgaccaaatcagcgactaccattggtgaggcattatccataaaatatattgaattgcttttcaaattttcagctggcggaatccccgactttgagaacatcgaccgccgcacactttcactaatcacttccatcgcgacactaattaaggcattttaacactttttgataattaacaaatctttttgattgtcttccacaggtcgttttctgtttgcgcactaccaattcagccctggaggcaagtcacttttttatgagctgatggttatttgggcaattaatttgtgtgtgatcgtggataattaccgttgttaatttcctatccatggcttaatgctcccataa

SEQ ID NO: 80515 - DNA, 914 bp, Heterodera glycines
  Genomic contig location: Contig_ID=SeqID_16150; Location=726..1639; Strand=+
  SCN-specific regions: Sequence locations=1-39,127-158,181-369,397 -420,442-570,592-678,759-914
atggactcgggcatttgtacccaggcaagcagccatagtgccgcaactgcggcggctatggcagcaacgccacccgctgcagcggtggcatcgccggcggcgtcggcgacgacggcaccgccgacgcggtcgcaaagcataaaaaaagtggtcgaatttcttggattttaattcatttttcaatccaatttgaattgttcccaaaaagactgaacatggcagttcgttgaagcggggccccggcggaagtttgggcgcggcggacagcagcggggcaatttcgcaactcgccattccgacggtgggggcgctgaaggccagctcagccggagacatcgcgcaacagcaggtggccattttgaattttgaaatttaatttcaaaaataaaatgaatcgacaaatggcattttgatttgtcttttccaattcacttcttcctttttgctcagtctccccactcttgcttggctggaaccagctcgacctcatgtgttgagctgaacgcggaggcggaggagcgacgcctggtcgagctggtggagaagttcgacatggactggggcagcgatttggaggtgaacagggaaaagcgacgggcgcggggcgtacaatccattaatagaccgggagaactgagctttctttcgtcgtttctccaaactttttactgccaattcaaaaaattattttaatttagattttttaaaattatatttagtccattttaaatttatttattctcttaaatttaatttttcttttccatgcgaaggttgacactgaaattccgagtctcgagtcgctggtcagttgggaaattctcaagcatctgaagccaaaagagaagaagcgccaggaagtggtcaacgaactgtaccaaaccggtaaagagcttcgtattactggcaaatga

SEQ ID NO: 80516 - DNA, 475 bp, Heterodera glycines
  Genomic contig location: Contig_ID=SeqID_16152; Location=52..526; Strand=+
  SCN-specific regions: Sequence locations=1-26,209-386,410-475
atgggaattgacccaaatgatcaacaaaaaagagaaataattaaaaaatttgatgcaattaaagaaaaaattagagaaaagggaaaacttgaaataaaaaataaaaataaaatcgaatgtaaaattggaaaattattaggcacaagtcgccataaaatatacaaatggaaaaaagaattaaatttaaataaaaataaaatgatgaaaaagagtttttatgaacagaaaaagaaagaattcattgaacgaattgatgaatttaagagtttatatagccaaggcaaacagaaagaatttgtgaatgaattgggaattgatgaaaagacatttataaaatggaaaaaggaattaatgccaaaatactataaaaagtatgagaattgatgtatttaaattttaaatattttatgcattaagtaattattccaatgaggacaaattaaaaatgatgaagcaatattccgaaattaaagaa

SEQ ID NO: 80517 - DNA, 49 bp, Heterodera glycines; identical to SEQ ID NO: 51181
  Genomic contig location: Contig_ID=SeqID_16153; Location=31..79; Strand=-
  SCN-specific regions: Sequence locations=1-49

SEQ ID NO: 80518 - DNA, 1422 bp, Heterodera glycines
  Genomic contig location: Contig_ID=SeqID_16154; Location=328..1749; Strand=-
  SCN-specific regions: Sequence locations=1-145,169-395,417-479,508 -514,558-1422
atggacacgacaaacgcgccgactttcacccgtccaacgacgtcaaaagacaaattagtacagtactttgaacggagtttggacaattttctcgacggtcgctaccgtgcaatggagcgaataccgtacctaacggagaaggagaagcaaatgcaacagcagcagaacacaaaaacggatggcatcggaatggcacaagcagcacacaataaaacggtccaattttattgaattcaaagaagcatccgctagctatacaactcaccaaattagctgctgtttcaggaggaggagcacgacgagttcatggaaggctctggcgaggaattagtcgaacttgaagagaattcagtgccgtctttctcctcgtccattagcggcattccaaagcaaattccattcatcccaaaagtccccatggatttcatcgtaccgcaggaagaccaaccaacagaaatagtgtcaaaactgcttgaactgaatgctaaaaaggtggaaaagaaaatcgacggaatgacaaaatccgtgaaaagctttggaaatcgcccaaaagcaaagggcgccgttttgcatgggaaatcattggcggagggcgacggacggatggccaagccgacgaagcagtacttccaagtgggggatgcaagttaagttggaaataatgaagcataaacagtatggagacaagtcaagctatcagcaaggggtggtcagcagtttgttgcagtttatgggcatcaacaacccaaaggcaagctccgaattggatcaggtgcttaccgaatggatcatggaccattcttcacgacatgtcacaaaggtgactttggaaagcctaaataccagcggaagggtcgaatgtccatggatggaagcagtgccattctaaaattatcccctcgctaacggttaagcaagagaagaaatcctacggcgaagagagcacttacacgcgcatacaaaagttcctcaactcgccattggctccgctttgttctgttggggaaacgatggacaacttcgaattggactctctgatgggtcaatggtttgaagtgggccaaagaaatgtcacaccaaattaatcgggcaaaagtgccgttaaggtgatgcacagtccgttgatgtcctcttccatgtgtacaatgttctcctacgaaatgctcagccgttcttcctccaccgaaggcgtcggttccgtctttcaaaccctccaatttacgagtccaaaaggaaatcggacaacgccacgcgacggatttgccaattggcacgaaagcattggcacaatgccaatgccaatgcagcaacagcctctgctgagttcgggctatgcccttatgccacggcccggacaaattgtgttcagacgttcaaacacgccggaggaagtcaatggttgggaaagaagtgcagaataaa

SEQ ID NO: 80519 - DNA, 1252 bp, Heterodera glycines
  Genomic contig location: Contig_ID=SeqID_16157; Location=189..1440; Strand=-
  SCN-specific regions: Sequence locations=1-695,717-788,811-1190,1213 -1231
atgttgcggttggccaacaaaaatgccgagacggagacgacagagaattatgccaagcaaaacgatgacggtggcggcgatggatttgccaacaatgccaaagaaaacggtgccggacaaatggcggcgccaacaatggacaaacaacggcacggacagcagcaacagcggggggctgccgtggacgcgacggcaacgacggatggtggggaggcggaggtgaaggaataatcactcatggaattttaaaatctaaattctccttttaaattttcaaaattggcctactttggttatttgtggggaaaacgaaaaaaaaaaatttttcatccaaaaatatctaaaaaaaggattttccacatcactcgaatatgaatttttaaattctgaataggactcccatgtccacgttttttttcgggcttaatgaaccataatttatctcatttaataattgacatttttccctcaatttttagttgaccaaatgcttcctcaattggctgcgcagtgccgagaacagcaaactgtacaacgaactgttgtcactgaaccctgtgctaattgtgcgttttttcaattttggagtttgcttttttgaggatttctcacccccatttgacttattttcccctattttgtcccttttttaaattaaaattgacctatttttttttttaatttttgaaaagtaccagactgggcagtccccagaaaaatgacatgcttccattttggcttttgaaatcgcatcccatgatcggatttcgaaaatgctacgctctctcattacattacattttacatttgaaaatttattcaacgaattttgcattttgaaaacgttctgactgacccacactttggcattcattactgacaaattcctaatcactggcccctcgaattttagtgtccaataattttgaactttttcgagaccgggctctttcaattgaatctatgtttgttcgggtttcgggattcaaatagccgtgtgtgtgtgtttttctggaatcaactcgatccatgtgtttggccccttttccaggaccgtttgttcgccgaatttggcaccgaaatgaagcgtctgaaggcgtccagggagcgcatggcacaaatgctcgactcgctgggcataacttattgccttcggactgtgcccggcaacaattacgaaacatgacgacgaagggggaggaaaagaagaagcccacacccacccatttttaaatgtattccaacaaataaa

SEQ ID NO: 80520 - DNA, 1236 bp, Heterodera glycines
  Genomic contig location: Contig_ID=SeqID_16158; Location=277..1512; Strand=-
  SCN-specific regions: Sequence locations=1-554,576-1236
  Gene Ontology: Mol. function=adenine transporter activity; Cellular component=integral to plasma membrane; Biological process =embryogenesis and morphogenesis
gtcattggcactcagctaagcgatttcaatcagcatgccctgaagggaatggccgctggcgcatttgcggctgccatttccaaaacaacagtggcaccgatggacagagtcaaattgtgccttcaggcaagaaaaaattgagcaaaaaccgattggaaatgggccgctaaatgcatagcgcaattgcctccgttctttccaattttgatataattaccctaatgaagtcaccatcctcagttaccttaccccatgtcattatccctaattaccccccccccccctcgtctgcttttgcttactctttcgcccattcagttgcaaaatgccgctgttcccaccccccatatgcccgttgttcgcctcccctccgcccattcgctcccttaccgcggcatcgtcgattgtttgcggcgtttgtgcgccgacgaaggcatccgttcgctgtggcgaggaaattcagcagtgttattcgctgctttccgcacaatgcgctcaatttggccttccgcgattggttccgtgtcgcctttttggatggcatcgaatgtcgcaaaaggcccattcgctttgtggcaggcattcatttatttgccttttgtcggcagtcattgactctgccctcaggcaatgtcgctgcgggcggtgcgggtgccgctttgaccctcgtcttctgttacccgttggacctcgcgcgcacccgacttgccgttgacggaggtgtgcaccgcggcttgtttcactgcttttcggtgatacgctcccgcgaaggcactgctgggctttaccgcggctttctcgcttctcttaacttcacctttctctcccgtgccgtttttttcggcattttcgactccattcggctgaccttagcggaggaacggcgacaagcgctgtctttcgcggcaatttggtcattagctcaggtgagacggccttttgggtttgcttttgtggcaccatttgcccattttaattgcccccccccccctccctccacagttttccataattgtgtccagtttggtttgctatccgctggatactgtccgccgtcggttaatgttggaagcgggcagtgaattcaagcagtacagtactcaatggcaatgcttttctaccgtatgccgtactgaaggcgtactgtcactgtacaaaggcgcgctgagcaattcgctgaggtgcacttcaggggcactgattctggccatttattacgaagtgctcaaatacatt

SEQ ID NO: 80521 - DNA, 136 bp, Heterodera glycines
  Genomic contig location: Contig_ID=SeqID_16159; Location=109..244; Strand=-
  SCN-specific regions: Sequence locations=1-136
atgagtacagtcccttccacctcatcggtcattggcactcagctaagcgatttcaatcagcatgccctgaagggaatggccgctggcgcatttgcggctgccattttccaaacaacagtggcacccgatggacgga

SEQ ID NO: 80522 - DNA, 710 bp, Heterodera glycines
  Genomic contig location: Contig_ID=SeqID_16160; Location=103..812; Strand=+
  SCN-specific regions: Sequence locations=1-82,118-236,265-289,311 -551,580-604,626-710
aaagtgctctgaaacacacaaaattttatttacaggttagtttaggcactcagatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaagggagatga

SEQ ID NO: 80523 - DNA, 721 bp, Heterodera glycines
  Genomic contig location: Contig_ID=SeqID_16160; Location=65..785; Strand=-
  SCN-specific regions: Sequence locations=1-58,80-104,133-373,395 -419,448-566,602-688,710-721
cagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaaataaaattttgtgtgtttcagagcactttctgaaaaaatatttatgaattaattttgcaaaaaacaa

SEQ ID NO: 80524 - DNA, 1564 bp, Heterodera glycines
  Genomic contig location: Contig_ID=SeqID_16161; Location=1..1564; Strand=-
  SCN-specific regions: Sequence locations=1-106,128-260,323-372,396 -547,570-722,815-965,1012-1362,1461-1564
  Gene Ontology: Mol. function=alpha,alpha-trehalase activity; Cellular component=extrinsic to plasma membrane, GPI-anchored; Biological process=trehalose catabolism
gtaatttgttgtgcaggcagtgaatgattggggcgaacgaatgcttttcttgcgcgactccaaacattttgttgaccgtccaatgaaaaatgatgccaagaatttggttgaacaattcaaaacagtgttcaatgtggcggaatggaagcaatttatggtgtcgaaaatgaacgaaacccaagtggacaatttgtccaaatttatacggcaaaattttgggacggccgacagcgcattaacggagtgaattttgaattggcaatttaaatttaaaaatattttaataatatttattaaatattgggaatataattttaaaaatgcctcgaatattttttgtaccgaaaaaacccaatttaagagtaaaccgataaataaatgttacaaaattaaggcatttgccggaagattgggtcgaaaatccccaaaatctaaagaacatcaaagacaagaatttgaagcaatgggccattgaattgaacaaaatgtggaaggaattgagcaaaaaaatgccaaacgatgtaaaaaatccaattaattaatgcgcataataaattaaaaatttaaaagatgaacaacaaggacaatcaaaggcattcactgatttatctatccgatccttttttcgtgcccggagggcgatttcgcgagtttcgctattgggattccttttggattgcgcgggggctgctcgcatcaggtggaaagtgatcagaaaaatgaaaatttatttaaaaatctaaattataaattaaacttttttgtaaaatttttatttatatttttgactatttaaaaaattaattttaaattacatattaggaatggaaaaatccgttaaaaatatgtgcaaaaactttgcggaattggtcaaccgttttggttatgtgcccgccggtggacgcatttattacagcaaacgatcgcagccgccattcctcacttagtgtgtctatttttggaccatttatttattacatttttacttaattaaaatttttatttttattagtttggtttacgattatttcggtgccactggggacattgagtttctgaaggaaattatgccaacacttgaaaaggtaagtgtagagcaggggtgggacaactctcgcctctcgtctctcgcctctcgttttttgggacgagaggcgagagttgaaaatacacccctaaagattgaacttttgagcagccagaaaaattttcaaatttacgcgaaaaaaaatcttaaatctctttctttccttccttaatgttttctctatttttggatagctctaattcaaatatggtctgctggctaaaccttctgcctttcattatttttctcttcggttcaattccccaacggtacagaattttttaaataatttctttaaataatttttcaattgaaattttaattaataaaaaatatttcaatttaaaaattattattttttcttttttttaaacagcctaaaactgcaaatttaaccaaaactttgatcattgggggacaagttctgttaatatattacactcaaaattcttggggggggcggcggcgcctatcggc

SEQ ID NO: 80525 - DNA, 743 bp, Heterodera glycines
  Genomic contig location: Contig_ID=SeqID_16164; Location=494..1236; Strand=-
  SCN-specific regions: Sequence locations=1-479,501-691,713-722
atggcgatgcgttactgtgagcagttgctgaacggaaatgaccattttaagcgaaaagcaacggacgaactgttggacagccaattgatccggataaagttaactattaaagaactgccggcagaacttggcacattacgtgtgcagttggaggctaaagacctgttggcaatgccgcaaagtttggtatcgctcaagaaacactgtgccaacattgaacatttgttagtgaacgcagcatactgtagcattgaccgtttccaaactgcaagagaccgtctcctttcgtttgctgaacagcttgaaaaggatggactggaaaaaaaggatgagggaatttcaatgattggagaggccacggagaaatttgttgttgagcttaaattggccatttttgaagcagaatttcggcacaaaatagccgcttttgctgacccgtgcatttacggcgaagcatttgtcaaactttcggagcaaattgccaatgaatttgaagacatttgctatatgtgcaaaaaatggaaaaatgcaacaacaaaaatgaatatccaagaacagttgtcgaattttgtcagtttggcacgggatcaatcggtgccgctaaaacaaaaatttgaacaaaaatttgatgaaatttttgagaaaactaaatttgacttagagcaattaaaacgccgatataacacaaaccaaatagcagaaaaaacagaaatggaatcaggtttataaattttaaaattaaa

SEQ ID NO: 80526 - DNA, 1129 bp, Heterodera glycines
  Genomic contig location: Contig_ID=SeqID_16165; Location=128..1256; Strand=-
  SCN-specific regions: Sequence locations=1-9,32-104,129-217,243 -286,323-344,381-561,590-629,652-1129
atgcctcaagttttcaaaaattggctatttttgggcataatctggcaatctattgtattcaaatattcaatttttttccctgcggcgcctatcggcaccgccggcctccctccttttccctggaccccaaaaagtttttttttcaaaaagtacggagcaaaaaattgttaaaattaataaaggattcggaaataaaaagtttaaacttttttgttcgaataaattgatttaaaaaattatttgaagcaattttgaaaatttatttctgattttcgaccctaaaatctattttttttatttaagttttttttctttaataaaaggattgtccttcaaatttgtgcattaaaaatatttttgtgattatttaattaaattttcgaattactcccgctcccgcccggcactcccgttaaaaatggacgggatttgtacgggagcgggagttttacgggattcccgctcccggaaattattttttaccgggctctaattatgactattttaataagtctcaatctctatcttgaccatataattcgagttagtctttttttacccgtttaaaaatttttcaaaaaacaattcctttttttgaccagaaaataaagttacttaagacagggcaagagaatatgttattttttaatttcgagctctatttaatatcttccaattaattagttaaagaccgggcagaagtaccaacgcaacaaacatttgttgaattggcggaaaatttggcaaatttgaaggaattggcagagaattggcaatctgaaatgagcaacggcgactcaatggtgggctcccggacaattcgacagtgggcactaattagacagtgaatgacaaaatttattattagaaatcgatagacctaagtgtattctaatttgaaacatagcaaaattttttgaaattttgcaggctagtaaagatttctaagggctgtcgaatgatatcaagaatttaaaaatttgctttgctttggggcaaagttatgagcaaatttttgttgaaaatttttcatttgatggttttttataacgctctttttggtggcttttataaatgtctcagcacctttatacacaccgtttcaaaaaacgagagatgaaccaataaa

SEQ ID NO: 80527 - DNA, 797 bp, Heterodera glycines
  Genomic contig location: Contig_ID=SeqID_16165; Location=1512..2308; Strand=+
  SCN-specific regions: Sequence locations=1-43,158-262,284-435,525 -585,613-727,761-797
atggcacggtttttttactgttcggtttttaattctaagctccttttattatttcaagaattaatttatattttaatttttctttttttttaagaaaatgctatgaaatttatcttttttataatctttacatttatttttcaatgttttttatttagaaaattgtgtttcattttgctatcttctcgcgaacatgattatttttataactattttttacctttctttctttaaaatattttgattcaattctctcttgtcaagagcttttaatttttcattcatccagttttattttatgacgaatatactcgatttcggcactcagctggttggacgcattcagcttcgattcacgagccaacatgaacaagattcgggcctcgatttcgttcatctttgccttcagctataaaaatatttctatttgtttcgttttaaataaatgtgtttttttaaaattaaataataatatttttcattatagtattttgaaaactgaattaatttttttttttaaaattgtcttttagttctttgaaattgcaccggagatatcaccccttgcaattgttcaatgcaatataccaaaatgaaaattggcaaaaacaagtacttgccttatatcctgcagaatacacccaataccaataaaatttagtgaatttgttatcccttcactttatctgtataaccactataattaataattttagaaggttacctcatttttttttacttttatttttaatttattttagaattatcgtgttttatccaatgtcattttttatcaa

SEQ ID NO: 80528 - DNA, 1318 bp, Heterodera glycines
  Genomic contig location: Contig_ID=SeqID_2580; Location=1594..2911; Strand=+
  SCN-specific regions: Sequence locations=1-353,375-588,610-691,717 -894,917-1280,1308-1318
  Gene Ontology: Biological process=regulation of transcription, DNA -dependent
atgatttgcgagttttccactcatctcctcactgagcatcaaatctttatcgatgggatggatataatcgtggacttgaaacgttacattgagtattggcgccagcaattcaccaagcgaaacattgcagagattttcccaaaaatttgtcctaagcccgaagatgatgtattcggtaaagtgggtttctactttttgatggacgaaagtgtgaaagaaggtggcgagtggggacttcacagttaaatggtcattgcctttcacagattacggattacgccaacgtttggccatgcgtcgtctcgaggaggctttggcatgccaacagcgcgagagagaagactccgtcttctcaattcaatgcattttctgtcgctacatggcgcgaggaaatcgttctaagatcatccaccatctttataccatccatcatctcaaccttggctcaccggacagtacgttttttccctattctttaactaatttcctacaactttttttttttttttgctcttaagagggtaaaaacccaattcatactaggccaactcgtaccatacatggaaacgggggggggggggtcgccggcgaagggaaaaagagggaaatttctgaaaaattcgcctattttcttaacaaaattgtttaaaattctgaaaatttttccccggcggcgcctacaggcaccgccggcccccttttcttgaaaaaacctcgccgaatctttttgaaatatataaaaatctttcttgaattatgcatgtagaaagagtacctaaagggctatcgaatatactaacgatttacattattttttttgtttagctttaccataatatggtaattctagtaaaaacctttccttgtaaaaagccaactttattcgagaatcataatcaattaaaaaatccccttttgtaccttttccgatataaatcgccactagtgatacttattgttacttttatgaggtttcttgttaagacctcgtcttcgtcactgaatacatcgaacatttgagagagaaacttttgcgaaatgagtgtatttactgcgagaaaacttttgccgaccgaaacgtattaatggaacacatgcgaaagaagaatcaccgagaagtgaacccgaagaataattattacgacaaggcaacattcttttcactttatatggaagacaattgggccttttagttctacatcatcaactacttggaattgggcaagcgttggctggacgttttggctgaggactttgaggacacaatgccaacatttgtcgactctgacgatgaggaggaggaagattcgtggcacga

SEQ ID NO: 80529 - DNA, 1992 bp, Heterodera glycines
  Genomic contig location: Contig_ID=SeqID_2581; Location=1..1992; Strand=+
  SCN-specific regions: Sequence locations=1-190,212-324,346-437,485 -560,586-768,791-1154,1182-1608,1631-1907,1929-1992
  Gene Ontology: Biological process=regulation of transcription, DNA -dependent
atgatgtattcggtaaagtgggtttctactttttgatggacgaaagtgtgaaagaaggtggcgagtggggacttcacagttaaatggtcattgcctttcacagattacggattacgccaacgtttggccatgcgtcgtctcgaggaggctttggcatgccaacagcgcgagagagaagactccgtcttctcaattcaatgcattttctgtcgctacatggcgcgaggaaatcgttctaagatcatccaccatctttataccatccatcatctcaaccttggctcaccggacagtacgttttttcgcctattctttaggtcgtagcgaagggaaaaagagggaaatttctgaaaaatttgcctattttcttaacaaaattcatttaaaattctgaaaatttttccccggcggcgcctatcggcaccgccggcccccacaaaaatattatttttttaaaaattaccccaaaatctcaaaatttggtcattttttagataaaatctgctaacaatagcattaaaattacaaaaaattccccggcggcgcctacaggcaccgccggcccccttttcttgaaaaaacctcgccgcaaaaatctttttgaaatatataaaaatctttcttgaattatgcatgtagaaagagtacctaaagggctatcgaatatactaacgatttacattatttttttttgtttagctttaccataatatggtaattcgagtaaaaacctttccttgtaaaaagccaactttattcgagaatcataatcaattaaaaaatccccttttggaccttttccgatataaatcgccgctagtgatacttattattacttttatgaggtttcttgttaagacctcgtcttcgtcactgaatacatcgaacatttgagagagaaacttttgcgaaatgagtgtatttactgcgagaaaacttttgccgaccgaaacgtattaatggaacacatgcgaaagaagaatcaccgagaagtgaacccgaagaataattattacgacaaggcaacattcttttcactttatatggaagacaattgggccttttagttctacatcatcaactacttggaattgggcaagcgttggctggacgttttggctgaggactttgaggacacaatgccaacatttgtcgactctgacgatgaggaggaggaggattcgtggcacgagtggcaggcattttccgggcgttggcatcatgtttcgcaaatgctcaattcaggaggacaatgcggacgagggggacctttttgcggtgtgtcttttctgccctcacgcacgggagaaactcgaggaaactatcaaacacatgaatgagactcacaaattcgaccttatcggttacatccacgacaattccatggacacatacgaccggatgaaattcgtcaacttcatccgaaaacgagtaactgaatacttaattcagctcgtgttctctcctcgtcacaattttatatgatttagactttcaacactcggactaaagaccaacagacaatggaatccaaatgcgttgaaattcccgacaaagagcaatgggacaatgaggagaatttggtgccgctgtttgggaatgtcggttttggttttctttgggtctctctccttcacatttgttaacttttcataggaccatttgctttggatgttggagagttggcatttggagcaggaaatggagcaaatcggaaaacaaaaggcgactgaatgtgatgaaccgatagagaaggctgtcactgaaagtgttgtcgattcaccaaaaattaacatgggcacattggtcgaggagtcgaagcaaaacgccgtggaaggggtgcaacaaattatactaacaataaaatcctgactttgtttgggtttgattaaccggatttgcgcccttttacatttctttgcttttcaggtgattgccgaagatttgccggatctgacgggcagtgtcttggccaatgccgagctccaacaa

SEQ ID NO: 80530 - DNA, 1836 bp, Heterodera glycines
  Genomic contig location: Contig_ID=SeqID_2582; Location=1233..3068; Strand=+
  SCN-specific regions: Sequence locations=1-370,403-825,847-1195,1217 -1296,1318-1836
atgacgacgactcgcgagagttcgacagagatcgctgatcggtaccctttcggctactccaccgaactctcttccaaccacgaatcgtccatttgtacggcaaaacggcttcgacaacgtctgcagaggcaacagtcgggccaatcgggtcattcttttcttttttgggatgaccaaataaagcggattttatgtgaaggacggcgttacaccggcgaaagcagcgaaggatcatctcttgtggtgggaaatggggggggaaggccgagcgaatagcaaagcgacgttttgagggcactccgacggagtcgggccgatgtttcactttcaccgccgcccaacgcattcaccgaaacggagccacaaacagcaccaccacaaccaacaacaacaacagcaccagcatggacgaccagcggaagccgtcgatgaatcaaaatttgtcggaaatgttattggacgtgagtgatcggaaggggccgtaggattgacgtcagccttctcacaattagcgatcctttcgtgtcaattggcccatttaaggccattcacatggaagacgccaatttggtcgaccgtttgctgctgtcccattgcagcaacaaagtgaccaaacactgctcccctcctcaatttctctgatgcctttcaaaggtcctttcctcgtccccctccatcggcagcacaaacactttcaccgatttggcccaacgacggcacggcgccaccggcggaatgggttcgatgcagcaccgacgctccaatgcctcgagcacattgtccacacattcggggggacgctcaaactgtgctgcaatgagcacattgtaagaaagtgaattgtaacggatggaacgaaaaaagcaaaaaaagggacggatttgaattttaagaaattcaaaatgaatgcattttcttcaggcatatggcagtggcacacaaacaacgcgaaattgccgagctgttgctgaagagcggctacgacccgaatttggtggcgttgtgccattgccggggcgcgtgcattaccagcggcaacattcctttgtcatccgttttgccaccaaggcatgccattcactaccaaacgaactttcgcatattaatcttttccctctttaacttcagtcgctcccattcggcggccattaccagcgacatttgctcagtctgttcacatcttcgagtcgtttcaattctcgatcagacccctctggcgattgccgtccgaactcagagtgccgaaatgatgtaccatttgcctaagggctatttaatgagtttgatacttaattgcagaaatttgctggtctcatacggtgcggatgtcaactcagtggacgaggacggcaattcccctttgatgttggctgtccgcgactcgcctttgagttggcactgtcttcacatgttaatcctattcggagcaaagtaataaaatgccgaggaaatagaaaaaagggaccaaattaaggatacaacagaaaaactcacgagggatctgtcctttggatttggctccggaactgcgcaaaatccaagagacgtgtgtggaggccctcttccaaatggcctgctcccggccaaacaatgcctcccaaaacgcatcccccgcggcattacacggcacagaaagtacccagggtcatcaccagcagggctcctcggccacaggtggcaatggcactaacggagcagcagagcgtacggaagaacgcgacgcaaatgggacgaaacaaacggcgggggccgcagcgagtacgcaggagagactgatgcgcaccgcggcgatgatctcagccacgaagcaatcacgaaaagcgcatttggacgcag

SEQ ID NO: 80531 - DNA, 398 bp, Heterodera glycines
  Genomic contig location: Contig_ID=SeqID_16166; Location=714..1111; Strand=-
  SCN-specific regions: Sequence locations=1-81,118-137,159-193,215 -270,292-398
atgggtattttttcaaggttactgtattttactcaaagactgagcatcaattttgccaggtgccgaaggcaccgccgggtcccaatcaaaatggctaaaattacccgtttttcccaaggcgccaaaattttggtaattacttttttccctcttcaaaaatgaccaactttattttggcttcataaatgatactaacttcacatattcaaaacaattaactctacaggttcgagctttttacgtttaaaaaagcattttacttgtaattggtctatgaaatccaaaataccaagatttagagcattatttttggcatattgcgaaaatgacagccggggaatttgccaaattgaggtcatgctgaatttctaagtcattgggaaaatatttataataaa

SEQ ID NO: 80532 - DNA, 943 bp, Heterodera glycines
  Genomic contig location: Contig_ID=SeqID_16166; Location=1704..2646; Strand=-
  SCN-specific regions: Sequence locations=1-149,180-373,395-705,734 -769,793-840,862-877,899-943
atgctttttgtctcgccaaaggttggttattttgtgctgtccgaaatccatccatggtattttttgccgtttttaatagcattttttgccgtttttaatagcaactcgaagttttagagacggaattcctctgggaaattttggtgtgcaaataccaaatttatttatttttaatgccatgaaaaattgaattttttctattgaaacacattgggttcttttctggcggtgaccaattttatgctgacagtgattttcaacttaaaaattgcctattgaaattcaaggctttctctaaaaaaattttttttttcttggcattcaaaactattttttttgtttccttttcatggttcatcgtttattaaggagtcaacaacaacatcaaaaaccggcacttttggcaatttgttacttggacaaattttccacccaaacattggcgatttggaggcggaaaagggttgcattttggatggagaagagaatgctgatgccgatgccaccaacactgatgaagacaaatgccgtctccgattggccaccgtccgcgcactgttcgccacaattggccaatacgcgcgcaaatacggcaccaccaccaccgacgaaagtgtcgccgcctcaggggaccaaccgacaaacgactacggcacactgtgtaccgcattcaatgcctgttttgggtccgtattcctatcgttgattttttgaaatttattaatttttttttgtgaaaatccctgcttccctaatgcctccaatccgtagaattttgaggaaaatggacaatttgtttttggaaattatgtcccatttttttagactttagaatgcttgaccattgtaaaaaattttccagcaaaactttccataatttgtgtcttttttaaaaaatcattggaaccaccgtttttgtgatagccataccccattaaataaa

SEQ ID NO: 80533 - DNA, 797 bp, Heterodera glycines
  misc_feature (761)..(761): n is a, c, g, or t
  Genomic contig location: Contig_ID=SeqID_16168; Location=1..797; Strand=-
  SCN-specific regions: Sequence locations=1-215,237-388,410-797
  Gene Ontology: Mol. function=UTP-glucose-1-phosphate uridylyltransferase activity; Biological process=UDP-glucose metabolism
tcaatccttccgaggttttcttcaaaaagcttagcaattgttgaattgatctaaattaatcagtgccaaagtgagaaggatttggcattgtttcggcaacttttccgccaatttttggaggatccgcacaaagtgaattggcaggaaatacaaccaatggcaaaggaaaagcaaatgccatacgaacatttgccgaaggtggagggatcggaggagagaagggcaattttggaacgaattgcggtgataaaactgaacggaggattgggtaagcgaagggggacaaaaggagaagcgaatgatcggatgaaaagcaaagggcggggaggggggagaatgatcagcagaatgagtaaatggacagagaaaagtgggaaaagtgatcgaaaaagggaaaatcaaaggatgacaaggaagtgttcggacattgatggctttggcaggcactacaatgggctgttccgggcccaaatcgctggtccaactgcgtgacggactcacctttttggacttcgccctgcagcagcaccgcattctgttgaactgcgccgacttgcgctcccccgttccgcttctgttgatgaactctttcaacaccgatgcgcaaaccaaagccttcctctgggcacaaaatgccaattctgtcgctgctgtcaaatgcttttgccagtcgaagtgtccccgaatatttgccgattctcttcgtccggtgcccaactcgtgggatgaccgtgccgaagaggggtcggtcgctctgctcngtgcttttctttgttttgacgatttttggtttttct

SEQ ID NO: 80534 - DNA, 896 bp, Heterodera glycines
  Genomic contig location: Contig_ID=SeqID_16168; Location=2984..3879; Strand=+
  SCN-specific regions: Sequence locations=1-554,576-730,752-816,839-896
atggcaaaattaattgctgttaactgtgcaaaaggaaagttttgtgacgggtattgttatcacaaacacaaaaagacaaaaaataaaatttggtggaagtgtgaactttatcaacacggatgcaaaggttggggttatgagagtaacggtgagtttttcggcactcgaatgcataaccatcctccatgaccaaattctacttcaaattgagggagaacaatagatttgaatatgttaaacatataaatcagattttacattggaatttcaaaaatatcacgtgaaattatttttcctctcagcgtgcgtgattttgggtaactcaaaacttgaaaaaaaagtttgatatttccctactctgagcttttgaatgagcttaatttttgttcataccggttcaatttcagggattgaataaatgacaattaaaaattgcggctaacaggtgcttacctacactttaggtcgttcccaattgatggtccaccagaaagttggcaccgggtgtttggaaatcaggaagtttgggcatcagaaatttaatcaattagtacagctaattagacatagggtaggttaagcgtctacttttttccgccttagaccatggaaacgctggagactgcttggctttcaaatcacaatgccgtcggtcggacatcgtcgtcttccccagccgtcggtgtcagctcaaaaagttgagccattctcgtcaccacatgctaatcactaattttatttctactaattagaaaatttttcacccacaaatggttgacaaatagactgaactgcgttttattttgcagtagtaaggcctaattttgaaaaataacagaaattttttggcagagtaaaaaaatagattaaatgaattgccatttaattgaacaaaa

SEQ ID NO: 80535 - DNA, 1550 bp, Heterodera glycines
  Genomic contig location: Contig_ID=SeqID_16171; Location=382..1931; Strand=-
  SCN-specific regions: Sequence locations=1-192,231-669,705-834,856 -1203,1226-1354,1376-1525
atggacttcgaatgggcggaaaaacgcgagactgactttgtcaattttgtcgagcagtgcgttgctgaagttggccgaaaatttgatcaaatttgtcgctggtacatggactcttatttacccgcctttgattatatcgccgacacactgaaaaaggtacaaaaattttttgttttattccttgttttctcgaaatttaaatttgtaatgtataaattttttattattatccctcctcactctccttctgcaaacttcgatcaaataagaatgttttagagttttcaggctaatgaatttggctttttgttcttcgacttcaatttttcaaaagtgacactcgacgacttgctcataagggctggcaacaatttgcgattgcctcgtctgctcattcgccccaccctcaacaaattccgtatcgattgcgtccgaatggtcaaaccgatgtgagcggaaaaagctcaactcatttgcgcatttaccataatattttgctgattctttaagtttgtattttccacgcgaatgggttggacgaagtgatcacgtgacagaaaccctggacattgagcacatcgattacatcagcagtgatcggacatatgccattgcacagacactgaaagcagctgaacaattggcatttcatctgttggcctatgcgtaagttttcagatttattttaaaaatagtttttgttaattaagagaaaagaacagcaacatcgtgacctcgcaagaatgttggctgacctccactaatgagggcaaaaaagtgattcattcggcgcgttcattgccaggcactcggaaaaactcgacttcacgcaatttgctaaatgttgtcacagataatgaacaatccgaagatgaagaagaacgcagcaaaagggaaaaggcggcgatggaattgaaggcattggcggggatagaaacaacaaataatgacaaagaagcaaaaatggaggagcaaagggacgacgaacaaatgcagagaaaggaaacgccatgcaaaggaacggaaaacgaaggcaaaagaccaccgaattgcagtgaggacaaggagaacaacagtccggtgcttttgcttgattttgacgatcgcagcagtgcgccgggggggtcatcttccgaagaacggcggacggaggaaaacgcactgaaaatgaacgccgcaaacggagagaagcaaaaggtgggcacagacttcgtccaaatgtttcttctccttttgttctcccatctcttctctccaccgttcgtcggtctttggggtgtttttgtgcttcgaaaattcctttttgtggcgatggattcaaatgcctttgacattagttttagttagatgtttaagatgacgatgactgactgagctgaataatcgattgttcatcccttttataaatgtgtgaatgtgctttattatagtacccaacaacagttggattgacacgacggattattattattcttctgacacttctgcatttgctaaaaatttatttcttatctttagaaagaactatttttttaaattaaattaataaa

SEQ ID NO: 80536 - DNA, 609 bp, Heterodera glycines
  Genomic contig location: Contig_ID=SeqID_16172; Location=377..985; Strand=-
  SCN-specific regions: Sequence locations=1-177,200-406,429-548,575-609
atgaatttcgaattcaatgcatcgaaaggtaaaataaaaataaatgaaatgaaaaaccaataaataattatttaagatatccatgagagattggaagattttttgatttattggaccaaaattttttctaatgagataaatgataaagaatttggaatggaaatggaaatgtacaggataaatgaatttttaaagaaaatatttggggaattatttccccaaatagaggcattaaaagtgagcctaaaaggagaattggatttaaaaggattggtcaaaaaatgtgaaaaactaaaatttgcattggaaaaagcggaagaaaagcaaaaacaaaatgaaattggaaaaatggagatggaaacgaaacaacaaatagaaaaagcaaaggaaatggtcaacaatattttggaaatgttagaggaaaagaaaaattcatttgctgaggaaatggcgaaagaggcgccaaattctgaatgaaatggcatttatttgcggaaagaattgccattggtatcagccggttccgtaccgcgccagttccatccatatcagaaaaatttttccccaaaataagtttaagtatttgccgaaaacaatgcaaaaattaaa

SEQ ID NO: 80537 - DNA, 913 bp, Heterodera glycines
  Genomic contig location: Contig_ID=SeqID_16173; Location=5..917; Strand=-
  SCN-specific regions: Sequence locations=1-68,90-127,153-209,232 -490,512-551,578-602,639-858,881-913
atggccgatattgtggaaataattatggataatcctgaagatagacctttttttacctttaaaattgtaaatgattttcttgaaaaattatttaatttttcaacaaaagaaattttaatggtcgacgaaaacccacaaaaacaaaaacaatttaaatgccgggcaaagaaagtgttattgaaaaatgtcaatttcgaaaaggcaattagtgtaatattaagcagagaaaaagccggccaaataaagcaactaattaactcaattaataatgagcaaaattatgtcaaattagcagcaattaaaaataaagaaatgcacaaaacaatcgaacaaaaaatgaaatgggaaattgacacacttttgttcaatttgcttttttcatttgctgttcgacttgaggcacttgttcatggcaaaaacgaagaaggaataattattgtagaagaattcggggaaaattcaaaggacaaaattcgtgcattttttgctgttttaaaatgctttccaatggccgagtgggaaaacgaattaatgtaaattcaaaaaaattctttgaattaaatttgattttttatgatagagaaaaattttgaaaaaattccaaaaatatttattagtaataatactataattttaaagcatttgtgagcataaaatttttatataaacagccaactacatctcactcatctacgaaaatccgaatccttaggtgtgtaatttcacccccgcacccccgcgggggcggagttcgcagggggcgggggttgcggacagagctggccgtgattgcatttccaatcacggtaatccgtgagccgtgttcacggggcttccaaaaaaatccgcgtcccgttgattttttatttaattttattaacaaaaaactgaatttaatcgctggaaaaataaa

SEQ ID NO: 80538 - DNA, 762 bp, Heterodera glycines
  Genomic contig location: Contig_ID=SeqID_16176; Location=1332..2093; Strand=+
  SCN-specific regions: Sequence locations=1-1,24-126,152-182,214 -276,298-342,364-382,404-631,656-736,760-762
atggaatctttgaaaaaacaactgctcttgcagagagagctgagccggggtgaccaattctatatgaatccgattgacggaaaattggtgtgtcggcacgattatgaggccggaggaaagggtgagtattataatattaaaaaaaaattttggcaatttttccgtaatttttgaaaaatcggataaatttttcaattttttaaattttaataagttactttgtattttgacttttgtgagagcttattcaattcactttcttgtttattcattttgatttatatttgtcagtttccatttggtgccgccaaatttatcaaaaattcctgtgaaagtgccataatttttcaaatttatcaaaaattcctgtgaaagtgccataatttttcaaatttatcaaaaatttgtgcgaaaatactacatttttcaaaattgtcgtaaatttaagcgaaaaggccacagtttttcaaaatgtaccgaaaatttaagcgaaaatgccacaatttttcaaattttcgaaaattcatgcgaaaatgccacaatttttcaaattttcgaaaattcatgcgaaaatgccataattttttttctcgcgtaaatctgtgccaaattttgtgaaatttcgctgcaaatttatctcaaaattttttgtttcatatcataattttacgaaactttgctgcttgttttttcgaaaaattcttggcataattttttgcaaaaaaattggtgccgcttaaaatttaattttttttttttgaa

SEQ ID NO: 80539 - DNA, 2250 bp, Heterodera glycines
  Genomic contig location: Contig_ID=SeqID_16179; Location=137..2386; Strand=+
  SCN-specific regions: Sequence locations=1-238,261-410,433-491,513 -926,948-1702,1724-1747,1807-1829,1875-1998,2050-2250
  Gene Ontology: Mol. function=zinc porter activity; Cellular component= integral to membrane; Biological process=transport
gttttttctcaatttaatttttgaatttattttcttttccctaagcgtccaattccgtcccaacatttttccgtccattcgaatggttacggcgccatcgccgccgatgcgacgcggccatcggtcagcggttcgtccaattcgtcgtccgatggctttcattgtcacgcggacggcgaccgacggccaacggacgcgcaaaacggcgcaagtgatcagaggagggcacggacagtgctgtggatgtccgtgggggtgtgctttgtgtttatgatttgcgaagtgatcggcggagtgttggccaattctttggcggtcggttggattcattagtcaaaggttcaattagtgaatacttcagattataacggacgccgcacatttggtaattggcaattagcagtggccatacggaaaatgaaacatttatttgaaagtttttgaaaccatttaaatgctatatttaaatattttaacaaattattctgcttcgtccgataaataaaaacaacacagctgaccgacttggccagcatgctcatttcgctgttttcgctttacattgcctctcggcccgcttcccagcgcatgagtttcgggtggcatcgcgcgggtgcgttaaaagcccccgcccccgctaattaatgctaatgctaatatttcctgcatttcatttaataatgatgcaattccatttcccttttagaggttgtcggcgcttttatttccgttgtgatgatttgggtgctgactggaattttaagtgctttcaattgacaatttggcctttccacgactttccggtcgctttagtgtatttggcgttggagcgaatgatcacttccgactacgacatccaagcggggattatggcgatcactgcagcgatcggagtcggcgcaacttgatgtgtgttttttgggtcgaaatgagaaaaatactcgacacgaatgtttcctatttgagcatgggcctcttactgtaccttggcggacattcgcacagccattcccaccatgggcatggcacacattcgcaacggcaaaccgaccgtacgaactttgcagagcacgagtggggtacggtagacggacggccgggccaaaacggtggcaatcgccagacgcacggcacgcggagacagacgaacatcaacgtcagggcagcatttgtccatgtgctcggtatttgttgagaaaggcaaataaacaaacttcgaattttgaggtgatctgatccaaagtgtcggggttttgttcgccggattgctaatttattggaaagtaatttcgaattttatttggggcaattaactaattaatggtcagccgaattggcacattctcgacccaatttgcacgttgcttttctccgcaattgttctcagcaccaccatttatatcatccgcgatgcgctcgttgtccttttggaaggtccgctttttatatcttcttttatttatttcaacttttttaggtcgtccgtcgaccatcgattttcgccatgtttttggtaatccaaattttttgcttacaattaacacttttaatgagtttcagacgcacttgagcacattgaaggggtaagttactaattgttccttcccctttgacagcaaaattaagcattcgatttttcctaagatttccgcttactcgtggacaaaaaaataataaaataatccacaaaggaagcaaatggataataaataacacaaataaagagaagaacaattaatagaatctcaaaatataaatattatatctatatttttaaaaaaaatgcaattttaagaaatatataaacttcgaatatgcaccaaatatccaataaaaaatttttggaaattataataattaattaacaaataattggttttcgcacttttttcggtcagaatagaccgatcctttcattaatcgttcaggtcaaaaaagtgcatgaccttcgaatttgggctctcactatggacaaaggttgtttttttgtgaaaaaagaaatttttaaattttaattaaattatttttcttatttttacataaataaatgtgaaaatgacttgaatcgtttctttggcagttgcaatttcggtccatttggaggtcgaatcggctgcggactcccaacaaattctgagggccaccactttgatgcttcgacgcgacttcaacgtgcacgagtcgaccattcaaattgagggctatcagcccgaaacggccaattgtggccaatgtgtggtgccgacaaag

SEQ ID NO: 80540 - DNA, 481 bp, Heterodera glycines
  Genomic contig location: Contig_ID=SeqID_2584; Location=798..1278; Strand=-
  SCN-specific regions: Sequence locations=1-28,54-181,256-481
atgtcatctatattgacgctgttgttatcattgtctttgttgttgtttttgctagttttagctctatcatttgggcttttcgttcttgaaaatcggctgaacgacggcgatgaatccgttttttctattgttttagcggaattttgccgatttgattgttttttgttttttggtccgtctaatgatgatggtgatgaagaagatgatgatgataatgatggtgatgaagatgatgatgatgatggtggtaatgataaagcttttttggcaatttttgatacaaaattgggttttcccatattatcgaagtaaatggtcgggtcatttattggcatatcatttggcggcaaaggtcggtgagacttaaaatgcaaaatgtggaaagtgatagtgaacatcagatttatttaatataggcaactacaattttatcaaaattttaagcaaagtgtctatcctatattaattttacaaaaataaa

SEQ ID NO: 80541 - DNA, 1271 bp, Heterodera glycines
  Genomic contig location: Contig_ID=SeqID_2584; Location=1280..2550; Strand=+
  SCN-specific regions: Sequence locations=1-234,256-588,611-922,944 -956,983-1271
atgaaagaaatcacagaaaaatataaaactgtccaattatcgggcaatgaaactgataataatgatgtttggctaaacgaagacgagttggccaaatattcagaagtatggtaatgagaaaggaggaaacattgagcaaaaagaaaaagaacggaattgaaaatggaaagaaaaagaaagttgcaaaaaaaaaaccgtatttactgaattcgaacccccgggggttcatttttcaacccccctaaaaggggggttataattcagggggaagagggtttcaaattcagtaaatacggtatttaaaattgcattcccatttattataaacagagcaaataatgcctaatcaatcagaggtggagcgcgactaagacccgcgaccgcggcatttttcccaaaccagcgatttgcaatcgcgacaatttaaagtcgcgatccgtgaccgcggtattttgaatccgcgagcgcggcacttttgtccgcgctccaccccggtgtctgcaattcatcacggcggggctgggcggaaatccactgttttacctacatattcactgaaacggacagaaggaaaaaatggcaaaatttaacagaaaacggcggagttccgcgcagccatctgatcagtgatcacattgttattctgtacctcttttctcaaacattttgtgataagtgattgtgtgggattgtgagattttttgaaaattttgaaaaattcgcacttaaataaaaattctccaaaaaatataaccaattttatcggacatttttgctaaaaataagataaaaaggagaaaagtaagaatagaattccaaaaatttatttctgagataaattttttaattttttacccaattaatttttcgtcgcgtgtctctttttgaaatcgtttgagtggagggcggaggaccgccgaaaaatatttaaaattgtctaaatcagcaaaagaaagttaacaaatttttgaaattttagatgggaatagcgatgaacacttatgactatcgaatgatatcaaggattaatttttttgttttgatggttttttaaataaacccattatgattagggatgcaatttatagtttttcactatttttttcctgagctccccgaggcctgaaatgcacgaaaaacgtgtttttttcgactgttgttaagctacttttcgagttattagcaactattttctagttttttttatttttagcaactaaaaaactataaaatttttgaaaaaaactattttcaactatttttgcttgtga

SEQ ID NO: 80542 - DNA, 982 bp, Heterodera glycines
  Genomic contig location: Contig_ID=SeqID_2585; Location=423..1404; Strand=+
  SCN-specific regions: Sequence locations=1-155,178-242,266-378,400 -947,981-982
atgttttgcttgctccatttcactcttttcactgcgctttatgtcggtgcattaggaggaatgtgttcatcaaaaaaggaaaaggtgcatgaccccttaccaagatacatgcaaccaacgtactcgtttagccaaagtaattaggggaacatttgataaataaatttaaaataaataccaataaattacctgaaatccgcatgtgaactgggattgcaagtgttttcattagaattgtcatgaatttttaattttttttaattttgagggtttggtaatttagggtatttttttttttgaaaatttgaacgtattaattgggattaagggataataggtgtcgataattgtgtgaaaatccccaaaaaaggcaaattaagcaattttcaaattttctgagagctttatcattattcagaatccaatgccgccaaaagttatcagagtacgcctgagcatgggtacaaaacgcctaatcaccccagggaaaatttggcaaaattacgacggacggttgcgcgaaataacacaattccaatgagtggtgcaaaacgcggcccattagcggcatcatcaagcgctgggagctatgcaaattcaccgctaattacccatcaatcgcaacaaaaaaacaaatatttacaacagcgagcatctgatgcatcaccggctgatcgaatttatttgtaggcaaaaaaccaagggcatagcttagccagacacttggcttcgggaggggaggctaatccccgcccgagattgttctttggccttatattttttagactcgattttttaaaaattttttttgtatggtaggatacagtagatctagatccgaaatgcgcctgcctggaaaattttggaattttgccgattttttaactgattttcaccaaaattgcgttttttatgttaagttttaaattataatgaaaactcgcaacaaaactttgtatttttcaaaaattatttattttca

SEQ ID NO: 80543 - DNA, 2378 bp, Heterodera glycines
  Genomic contig location: Contig_ID=SeqID_2585; Location=1478..3855; Strand=+
  SCN-specific regions: Sequence locations=1-112,136-344,366-508,566 -761,795-916,938-1345,1367-1380,1427-1461,1491-1647,1669-1669,1697 -1812,1847-1957,1980-2378
atgggaaaaaggccgcttcaacaacgccggcagcacgaaatgaaccggtccaaaagcaccagaggcatgttacagttggaaccgacatcaccgcggtaccaacagctgctaacaccccaacagacaccacaacaccgtgccatgattaaggtcggttggatgggtgtggagaaggaatggaaaattatagtgatgctcgaaagtctcatttctcgagaaaagtctcgggttttttagtctctgactcgagtctcggcttttcgtctcggtcttcgagactatacgagacttgagaatgagaattttttattcccctaatgattggctttcttgatgctgacagggattgattttaataaatgaagcttgatcaccagggatgggagttatatatgctaaattaaaaaatcctcaaaatgtgtgctaaaaccccaaaaagagccaaaataaatgggacgaaacaaaaatgctttaattggctttaatatttttatgcttataattcgtcaaaattttttttaattagaaaaaatatttaaaggtataaattaatttatatttaaaaccatacaaataccaatccttactgatcattaaatatggtggcgggtgttttaagctaaaacagtcggtttaattttcaggttttcgattgagtaagtttctttggttcctggcttttcgttgaatatattaatggaaaattattttgtcctgtaaattgagcattattaataatgcttcctagacgcatttcgatgaattaaaaaataataatttataataattaattacccttttaatttggtctatctaattaatgtcatagaaacgatttgaaactccgccaccccaattgccatcgccggaagttgtgttcaaacaacggaacaatcagctgaggattgaaggaggacaacaccagcagcagccgcagtcgaaaaggacgctcacacgagtgaattccatgggcagaacgcaatcgtatgccaacgaagtaagggaaaagccgccgaaaaactaagccttcaaggcagaaggaatctcgacgaaccattaaatggtcgagagtcagtctgagcctgtggtataatgtaaataggcttgaattagttctaaattttctatgtaagcttgcaaaatttaaaaaatttgcatctacttaaatcaatttttagagatttgactggtcacaggttgtttgatctgctagatgaaatttgaaattttataggcgaataaagaaaacagagctaaaaaaacttattttttgctcaaaattttgttgggttaagttttgaattgaaaatgcacaaccactaaagacgaaagaattttttaaaaagacttggtttgaatctttcatgttggtcagatagctaaaattatttttatattaattttcttatctaataaatcattttaagatttccaaaaatatgcggagtattgaaaaattcttgtaaatttaaaaacttttataaacaaaatttagctgattacctatttttacttatggaaagtgcctggattttatttgctaaaaacccaaatatatactacatatatatatatatgtgccaaaaacaccaaaaatatttgctaaaatcctaaaaaggccaaatatttgccaaaaattgaaataaaactgctcaagaaataaatgaaattatttaaaaaatatcattgttatccatttcactagcacaatgctaatcaaaatcatttcaatgcttttaggcgataattcatgaaattttaaatccaatgacgatcaaagcagaattaaattgggtctttaggcatctctcatctctgtaagaataaaaattaaaaaccaaatttgactcaattgtacatttatttttttaactgggccctgtttatggaataacctgaaattaaaactaaatgaaccataaaaaagtagcccgagggttgcttgtagtaataatttttaaaattttcctgataaaaattttcattatggaatttctatttttatgggacgaatgccgcaaagaactgggacggaactggcgtgatggaactgaccctttttcatttatcagatgaaggtgaaacatcgccaacgtgctttgcccttgccttcgtcactgtcggttgttggtgcccaaattggggaccgaatgaaacagcaacaacaaaagcttcaacaaaatcgccaaattgcgcaactccaaattgactcaccgcgcggaatgtttgatgacaaacgcattttggacgagaaaacgaccgaagaaaaggaggaactaatggactcactttgggaggagtttaatgacgaaaaactcattagccaaatggacaaccgcccaaaagctggcaacatgaagaagtcgggctcatggtga

SEQ ID NO: 80544 - DNA, 575 bp, Heterodera glycines
  Genomic contig location: Contig_ID=SeqID_2585; Location=2758..3332; Strand=-
  SCN-specific regions: Sequence locations=1-9,44-252,274-365,395 -429,476-489,511-575
caattgagtcaaatttggtttttaatttttattcttacagagatgagagatgcctaaagacccaatttaattctgctttgatcgtcattggatttaaaatttcatgaattatcgcctaaaagcattgaaatgattttgattagcattgtgctagtgaaatggataacaatgatattttttaaataatttcatttatttcttgagcagttttatttcaatttttggcaaatatttggcctttttaggattttagcaaatatttttggtgtttttggcacatatatatatatatgtagtatatatttgggtttttagcaaataaaatccaggcactttccataagtaaaaataggtaatcagctaaattttgtttataaaagtttttaaatttacaagaatttttcaatactccgcatatttttggaaatcttaaaatgatttattagataagaaaattaatataaaaataattttagctatctgaccaacatgaaagattcaaaccaagtctttttaaaaaattctttcgtctttagtggttgtgcattttcaattcaaaacttaacccaacaaaa

SEQ ID NO: 80545 - DNA, 136 bp, Heterodera glycines
  Genomic contig location: Contig_ID=SeqID_16182; Location=494..629; Strand=-
  SCN-specific regions: Sequence locations=1-136
gaccaattgctgtcggagacggatgtccacctggacactctgttggcaccgccgctggagcgtggcctcttttacatgtcaaaatttacgttggcgcgaaagcgatggaaacaatcgccggcggagaatgaaaaag

SEQ ID NO: 80546 - DNA, 1706 bp, Heterodera glycines; identical to SEQ ID NO: 16183
  misc_feature (1560)..(1560): n is a, c, g, or t
  Genomic contig location: Contig_ID=SeqID_16183; Location=1..1706; Strand=+
  SCN-specific regions: Sequence locations=1-60,96-400,422-471,493-1706
  Gene Ontology: Mol. function=signal transducer activity; Cellular component=extracellular; Biological process=cell organization and biogenesis

SEQ ID NO: 80547 - DNA, 861 bp, Heterodera glycines
  Genomic contig location: Contig_ID=SeqID_16186; Location=1198..2058; Strand=+
  SCN-specific regions: Sequence locations=1-861
cacgtggttccgtgccagttgcttcatccgctttattcctggatggcctttgtggagcattcgtaggactttcgctcgaaattttggcgggatgacgactcgttctccgtacatcagacattcttttgtgatggagaggtcatcttttcgacgaaagaacaattttatttcttccgtttccgaagcaattgctttatcattgggtcatccatctttgacaaatttcttaacctttttgatggtttcgtcttcgttccctgctgaaattatgtccttcgatgagagtgacattgtttccaaagtgttgatgaagaaattttcggcttccttctcaaattccatggacgcgatgactcggtcttcttcaggactggtgctttttgcaatcagccttgagagcgcatccgcttgtccaaattctgtggtgttcacatactcaatctcgaagtcatacgccaacagcataagtgaccatcgtaaaagacggttagcactcatttggcggattccctttttgttgccgaaaatggcgaggagtggcttgtgatcagtttgaagaacaaattttcttccgtagatcattttgtgaaattttcgcactgcgaaaatcaaagccaatccctctttttcaatttgggaataatttctttcagcgggtgtcaaagatgatgaggcgtgttcgatggccttaattgctccgtttggaaatcggtgggaaatgactgcgccaattccatgttctgaggcgtcagcggccacgatgatttccaattttgggtcatagtgcgtcaggagcaaatccgaggacaaaatttccttgattttaatgaatgctccttggcattctttgccccagtccca

SEQ ID NO: 80548 - DNA, 2819 bp, Heterodera glycines
  misc_feature (2733)..(2733): n is a, c, g, or t
  misc_feature (2753)..(2753): n is a, c, g, or t
  misc_feature (2757)..(2757): n is a, c, g, or t
  misc_feature (2760)..(2761): n is a, c, g, or t
  Genomic contig location: Contig_ID=SeqID_16186; Location=1..2819; Strand=-
  SCN-specific regions: Sequence locations=1-282,304-354,376-2536,2558 -2638,2670-2704,2726-2819
cctcacactcacggtaagttgtcgagaaagagctcgtttggggggagagcctaggaatcatcacaaaaggtgagcacttggattgggcggcaccgattctaatcgtgaagaatgccgacggaacagcccgtatgtgcatcgactactcgacgggcctcaacaacgctctattggaccatcagcacccacttccgttgccaaatgacatttttgcgacgttgaatggtggaaaagtcttctctcaggtggacttaaaagatgcctacctgcaaattgagctgactgctgaagcgaaaaagctatgcacggtcgcaacccaccgtggctactacaaattcaacagattgccattcggtgtgaagacggcaccaggaatttttcaatccgttatggataagctcctggccggactcgagtttgcgacggcgtaccttgatgacatcataattgtcagcaaatcgaaagaagagcactttcaaaatctggaaagtgttcgaacgaatccaaagctggggatttcgggtcaaaatggacaaatgttcgtttttccaagaacaaatcaagtatcttggccaaatcatcgactaagatggaagacgacccgaccaaggcaaaatcgcggcaataacgaatatgccagcaccaaaagacgtcccgtcacttcgcacgttccttggaatggtaaaccattaccaacaatttgtgaagaaatgcgattcatccgataaccaatggatgaactactgaagaaggacaaagactgggactggggcaaagaatgccaaggagcattcattaaaatcaaggaaattttgtcctcggatttgctcctgacgcactatgacccaaaattggaaatcatcgtggccgctgacgcctcagaacatggaattggcgcagtcatttcccaccgatttccaaacggagcaattaaggccatcgaacacgcctcatcatctttgacacccgctgaaagaaattattcccaaattgaaaaagagggattggctttgattttcgcagtgcgaaaatttcacaaaatgatctacggaagaaaatttgttcttcaaactgatcacaagccactcctcgccattttcggcaacaaaaagggaatccgccaaatgagtgctaaccgtcttttacgatggtcacttatgctgttggcgtatgacttcgagattgagtatgtgaacaccacagaatttggacaagcggatgcgctctcaaggctgattgcaaaaagcaccagtcctgaagaagaccgagtcatcgcgtccatggaatttgagaaggaagccgaaaatttcttcatcaacactttggaaacaatgtcactctcatcgaaggacataatttcagcagggaacgaagacgaaaccatcaaaaaggttaagaaatttgtcaaagatggatgacccaatgataaagcaattgcttcggaaacggaagaaataaaattgttctttcgtcgaaaagatgacctctccatcacaaaagaatgtctgatgtacggagaacgagtcgtcatcccgccaaaatttcgagcgaaagtcctacgaatgctccacaaaggccatccaggaataaagcggatgaagcaactggcacggaaccacgtgtattggccaaaactggacgcggaaatcgaggatttcgtcagaaattgtgagccttgccagctcgcggccaaatcgtccatcaaagcggagctgcattcatggccgaaggcgagcaaaccatggcaacggattcacatattagatttgttgcgcccgccgcagtttcagccaatggagcgtgatgaactgatggagcggcgtttcaacaaaagatttggcgccaaaccaagagagtttggccaaggcgacaaaatcttcgcccgtcaccgaatttcgcagaattggcgtccaggaaacgtcgtcaaaaagaccggcgtaatttacgacgttaaattcatggatggcacgaccaatcggtttcacgccaatcaaatacgcccacggcaaattgaggacaaaacgatggaccaattgaacattttcaatgatgtcttcggccttccaccgcaggtaagagccgaaccggaagatgtacagcctcaagacgaagccgttcgaagtgaagccgatgaggatgaaatcggccgggcagtcgaagaacagaatgatggacggatcgaacaggaggaacagccgaatgaggaaaggccgatcactccccgagtataccctcgacggaatcgacgaccaccggaccgctacagccctcattaagcggaagcggcacttcttaaaaggggaggtgttaggggcagcgcccttcggctttcgagtgtggtcaacataacgccacacgcaatgccctttgacccaatcgatattcccttcccctctgttcgtttgttatttaaattcaccctttccctcattcatgttcactcttccctattcagttcactttttgtgcaattgacattattgttcttccccaatttctcttcatttattttcttctaaataaattgtattgtctgcacccaaaataaatatttatatttgttggacactaaacattggcttagcacccattgtgtggaccgaacagtgtaaaaacttttcaatcggagaagtttgggtaaatataaatttagaaattttttaatttttcgttttacgagtgtgacgtgaaagaggaactgaagaaaaataaggagatgaaaaagttttttgncacgtgagccgggcccgggnccgntcnntccgagggatgctccctagaaagggagaacgatgcctttttgtttgtacgcaaaggct

SEQ ID NO: 80549 - DNA, 236 bp, Heterodera glycines
  Genomic contig location: Contig_ID=SeqID_16187; Location=240..475; Strand=+
  SCN-specific regions: Sequence locations=1-15,38-236
atgttaaaatttggaaaagtacagtggaaaagaaattttggggtaaagatcaaaaaaatacttcggattctcctctgattttttcagcttaagcgattttttctcgccatacacgtcctcgtatttcatcattctccatgaattctgtatgatcagtagaaattgagtttgatctgacccctgagttagcaaatttagttaaaattttcattgtaaaatattaatatcaacgtaaa

SEQ ID NO: 80550 - DNA, 1141 bp, Heterodera glycines
  Genomic contig location: Contig_ID=SeqID_16188; Location=182..1322; Strand=+
  SCN-specific regions: Sequence locations=1-479,502-709,739-744,766 -905,953-1141
atgaactgcacatcactctgtcacggctgccgagaggtgggcgtcgactacccctgcgaagcccaacaaggatacttcaaaaaatgtttgcattgtaacaacaccttctacaacaaagactgctatgaacgccacctacacaaggatttatgcactaaatttcaacgatgcgaagagtgtggggtagtttacaacataaaagttcatgggagtgttgggcataaatgcggagaaaaattttgtcgtctgtgtaaacagtttcacatcaaagaaaacgaccaaatgaatgcttgcatgagctgtttcattcaacctatgaagcaacaacgaattaagccgtatagaatcatagcatacgactttgaggcgacacaggacaagaaggtggagaaccgtttcgaacacgaggtaaactttgcagcggctaccatcatctgcaccgactgcattatcaacggcgactggaacaaatcacttcagggaaaaaactgccaaatttgcggtcctcaccgctcaattaccttttcaccatttgactacacggagacaacagttgaccaaaaaatcgtcacgcaagaaccgctacgcaaattcgttgaatggctcctttttgaccacaacaaaaagtttccaacagttgcctttgcacactttggtggccgttatgacataacgttatttatcatggaaattattaaccaaggtaatgaattcaattttaaacatttttaaatatttcttaaggaatacacacaccacaaataatcaaacaaggaaatcgtatctatgagctcaaaatcaacgacaatggacactgccccctcacaatcctacgcgacagctacaatctaatgcccatcaaattatcaggactcatcaaatcgtttgggcttaaaattcaagtgaaaaaataatactaatagtaaatacaatttaatttaaaataatttttctgttttccaaaaaaatttttttgactattcttgttttttattgtcgatttttctgggagtaatctacaattttatgtgatcttattagtttttttaaaagatttattaattcttaggactaaaaaaaacatataagaattagagaaaacatgtaatttgtgagagaaaaaattaacactatttctaaa

SEQ ID NO: 80551 - DNA, 1035 bp, Heterodera glycines
  Genomic contig location: Contig_ID=SeqID_16189; Location=71..1105; Strand=+
  SCN-specific regions: Sequence locations=1-367,389-436,474-526,548 -1035
atgaccatagccagcgcctgtgtcaaaaattatgcactcaaccatttgaaaccgaactctcttgccatcgtcccggaaaaaggttacactcctcaacaaaaccaaagtgcactgtccatcaaatttcttgactggtactcgcacatcaataacgtcaacattcaaactgcacactcccgttacggtgaatatgtgtttaagcgtgaagggcaggtataccaagtggacggctacatcaaaggcacaaatgggaagcgggacaaaataatagaagtgaatgggtgtctgtggcacggctgcgaggagtgtttttgtaatattgacgaagaaacaaaaatgccaaacggaaagacgctgcgggagattagggaaagggaagagaagaaacatgaaatattaagcaggtacgtcgacttggaggttgtttgggagcacgagatcaaccagaagctgaagaagaacaagcagatgagggagttttttgataactggagggaccgctcgccaatcaaaatcagagacgcatttcatggaggacggactggaccgatgaagctactccacacagctaagcctggccaaaaaatcagctacaaggacttcacaagtctctacccgtggaccaactttacgacggactacccacttggtcacccaaaaatcatcagtgttccaccaaatgagcagacggttaactggcgcaccccaacagacaacccctacaaaggtctactcaaagtgctgcttctacctccaaacaacaacatcagcgtcaatgttatgcctgtaaaaataaatgatcgccttctttttccaacttgtgaaaaatgcgccaaatattttactaaaaaacaccctaacggcctcaaagacaacgactattcctgtccccacttcaaccctaacgaccgcgccttcgtgtccacttgcacccatcttgagttaaacgcagcattggaggccggctacacagtccgcaaagtcttccacgtcctccaatacgaccaatggagcgacaacgttttcaagtcgtac

SEQ ID NO: 80552 - DNA, 506 bp, Heterodera glycines
  Genomic contig location: Contig_ID=SeqID_16190; Location=538..1043; Strand=+
  SCN-specific regions: Sequence locations=1-157,181-506
atgccttggaaaggaagaaggagttagtgggatttcaatgttgatgaagctttttcttctctgctggtccaccactgtgtttgtgcttctatccgaatgcaaataattcctcacaaaaaaatcttttattttcagcttgggtccctgaaaagttaaattttaaacaaattattttaaactcggattttggcattccattcattttttgcattttaaatttcaattaatcatttttactgattcaccaaagtccggcgattgtccgcagcagcgggtgccctttggccccaactttgtgccaattgcatatggtaaatttgcgcattgttcgacactaccaaattttgtcctaatgcgtttctgatttgtattccgtggcgctcatttgctaccgtaatgttcgggtgtactgtggccactgaactcggagagccgaaaacaaatttcctgcagaacaaaattgatacagtaaaatagccaaaaaagtctgtttcaattcagacaaa

SEQ ID NO: 80553 - DNA, 600 bp, Heterodera glycines
  Genomic contig location: Contig_ID=SeqID_16190; Location=1618..2217; Strand=-
  SCN-specific regions: Sequence locations=1-86,109-255,277-280,302 -455,499-600
atggtaagtaattatatattatttaaaacgatttacaaaatgttccacaggcattattgaaacagtgccccaatttgctgtgctggaagtgattaacattatcagttggatggtaatttttatcccaaattttagagcaatttttaatcaagaaaaaatgtttttttccctttaaatagacagagtaaaaaattatatcacttgaaaaaattttcgaggaaaggagtgtctttccgaatatgaaattttgtttagaaaaaggcataatttaaaattgtaattattggattgtatactgtataataaatatgttttatatttaaggtattcttgcgactgtacttttacaatcgcaaaaaatacaaaacgatgcgtgcgatcagtttggatgaaagatatcaagtaaaattggaaaattaaagccaaatatatcaaaataatagcaaattttgagcatttttaaatatttcatattatataaagaaataattaaaataaggaaaagatgaaaagcaattcaagaacatttatagcaaaatgaacgaatgggcaaaataattgtatgaattaaaaaaatgaaaatgttcgaaagccaataaa

SEQ ID NO: 80554 - DNA, 412 bp, Heterodera glycines
  Genomic contig location: Contig_ID=SeqID_16190; Location=2432..2843; Strand=-
  SCN-specific regions: Sequence locations=1-240,262-412
atgggcaacataatccaaccgatggaacacacggccaaaaattgcagcgacgcgtacgaaatggactcgactcggctcggcctttgcatattcgaaatgttcgtcaacgtttgcgtgatcggcgcctcggcaccgtttgccaaaatggtctccgccatcacttcgttcaccggcactatgaaagtgcttttcctcaacatgcttttcgccgcctttggcatcgccgccacgcggtcggacatttgaatttgaatttaaattaagttttgaaatatttaggcttttcgtgctcatcccccagtacatttccatcaattcgctttacagcgccgcttttgtggcgcccgtccaaattttccacgatgtcagcataaacgtgtgcgtgaaagcattgcttaattgtgtaatttaa

SEQ ID NO: 80555 - DNA, 102 bp, Heterodera glycines
  Genomic contig location: Contig_ID=SeqID_16192; Location=1035..1136; Strand=+
  SCN-specific regions: Sequence locations=1-25,51-102
atgatttgtatattgacaaagctaaaaatatttttacaaagtaaagaaaatgccattatccaatggattggctattttaaatgtgcgcaagcaatgccaatg

SEQ ID NO: 80556 - DNA, 102 bp, Heterodera glycines
  Genomic contig location: Contig_ID=SeqID_16193; Location=514..615; Strand=-
  SCN-specific regions: Sequence locations=1-102
atggtctcacacgcagtaaatggtaaaaaaaggcaaatgaaaattgagtcaaaatgttcgtccaccctcggaaacactggcgaatcacagagccaacacaac

SEQ ID NO: 80557 - DNA, 137 bp, Heterodera glycines
  Genomic contig location: Contig_ID=SeqID_16193; Location=391..527; Strand=+
  SCN-specific regions: Sequence locations=1-137
atgtgggatgagcatgacgcgtccaacaaaggtcgaccatcattatgccatcacatttggaaggcgggaaagaatggtcaacaaatggcaccgtttcggcctgtctattggtcgtcaacttacgttgtgttggctct

SEQ ID NO: 80558 - DNA, 84 bp, Heterodera glycines
  Genomic contig location: Contig_ID=SeqID_16194; Location=936..1019; Strand=+
  SCN-specific regions: Sequence locations=1-84
atggcaatgattggactaatccctcgccaatgtaaagaaatgaatacggagccaacgagctcaattgttccggtgtatctgaag

SEQ ID NO: 80559 - DNA, 1586 bp, Heterodera glycines
  Genomic contig location: Contig_ID=SeqID_16195; Location=417..2002; Strand=-
  SCN-specific regions: Sequence locations=1-289,372-386,410-466,493 -565,588-696,720-1118,1140-1179,1203-1332,1358-1477,1500-1586
atggttcataaattcattattgttttggcagttctatttttctactggtctacagcatcagccactgaatatcatcgtgctgtattcgaagggtgccattatggtaatgacagccttgccaagtttcgccatgtgaatgcacgaaactcacccgtaagtagaccatcagcagctgccgctttaagcgccttgtcgaaaaaggaaaggcatacaaatacgctttagtttattagctatttcaaattaaaaacaattgagaataattttaagcaaaattttaaaagaacgcattttttgattttttttatattttaaaaagatttttatatttacattaaaaaataattaaaattaatttttgaaatatttttgcctacttttcgctattttctttccgaattgaaaatttcggccaggtcccggcatttctggtccatgacaatttcggtccataaatttcacaaaaacaagaattaaaaattttatttggaagaataagagtaatcgcatgctgttgtttgaatgcttgagaataaaaagggttctactttaacgagggctaggatttttatttttaattacaaaaaacgccaattatgcatttaaatgtgcgaaaaaccccccaaaatatatcctataaaccattaaaaaaatgtcacaaaatctgaaaaagtaatgaattagtttctttcttaattttcagtttattaaaaaatccacatggttggtaagtgcatcgggccctacaaatctttggcgtggtacacaaataaaatttcctgaaaaataaatacaataaattgtatgaggtagaaaatgctaacaagatgtcgtgatcaggacccccaaaaaccgccgtgtgttgcaaaatcgctcaaaagcagttaaaaattttgcaaaaattttccaaaaagagcatttcgaatttgaaaaacagagttgaaaataaagtccatctatgttaggtcaataccactaaattaagctcttcttttgggtgtgggagttgaaaaaataaaagcgatactaatacttaactcacttgccgaagctggtcttgccaatctggcaaaactatggaaaatcacaaccataaactcccagctgtaaaaaattgcttaaaaaaatttattattaaaccaaaaaatacgatagttgacaagttttccctctacccagttaattttattaaatattttaaagttcgtgtcagcaatgatgcaatggaactccattgctgtggaagaacaacggcctagtttccatgagactggccatgctgtcgcgtgttggttagatcgtcattgtaccaaaattgtcattgtaagaaaatttaatttttaaattgtttttgtttaactcagatgaccatcgaaccagccgagggttcgcaaggtgaaacgcggatcaattatcgcaagctgtacaccaaaaatgaattaacggcttacatgaaatattttcttggtaattttaaatcaatctttttgtttttgtatagaaacctttaagggtcaacaatcgccgaaactctcatcttcaacaacctgaatcggaacggagcattctctgacttagtcgctgcg

SEQ ID NO: 80560 - DNA, 253 bp, Heterodera glycines
  Genomic contig location: Contig_ID=SeqID_16195; Location=2665..2917; Strand=+
  SCN-specific regions: Sequence locations=1-253
tcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaactttttaatagttaaaatcataaagcaaaaatcattatttaaaattttattccaaatttaaaaatcaataaaacgcttttttgaggcgcgctttttc

SEQ ID NO: 80561 - DNA, 522 bp, Heterodera glycines
  Genomic contig location: Contig_ID=SeqID_16195; Location=909..1430; Strand=+
  SCN-specific regions: Sequence locations=1-375,399-522
atggttgtgattttccatagttttgccagattggcaagaccagcttcggcaagtgagttaagtattagtatcgcttttattttttcaactcccacacccaaaagaagagcttaatttagtggtattgacctaacatagatggactttattttcaactctgtttttcaaattcgaaatgctctttttggaaaatttttgcaaaatttttaactgcttttgagcgattttgcaacacacggcggtttttgggggtcctgatcacgacatcttgttagcattttctacctcatacaatttattgtatttatttttcaggaaattttatttgtgtaccacgccaaagatttgtagggcccgatgcacttaccaaccatgtggattttttaataaactgaaaattaagaaagaaactaattcattactttttcagattttgtgacatttttttaatggtttataggatatattttggggggtttttcgcacatttaaatgcataattggcgttttttgtaattaaaa

SEQ ID NO: 80562 - DNA, 691 bp, Heterodera glycines
  Genomic contig location: Contig_ID=SeqID_16196; Location=126..816; Strand=+
  SCN-specific regions: Sequence locations=1-140,162-184,210-215,261 -566,588-691
aaaccccaaaaaaggaaaagcaccgtttttatgcccgattatataataaatttttgttacaaaataatcccattggaaaatggaggacaaaaattacattggacaaatatttgtacagcgaatgggcagaaaattattttaacaatgaactcaaaaaatcagatgaagctggtaagaaaaaccgaaaaaaaatttattatttttaaaatggcgaaaaataataaataaataaaaatatatttaaaaaagaaaataaataatttgtcacgaaataattaaagaccaaacaaacaaagtgagaaaaaggcaaattattgatgagctgaattcgatttggaaatgctttgaaaaatacttttggcttaatgaacgaaaaattcgtgaaaattttgaccaatttatgcgaaaaaatcgaggaaaattttccaaaatgaaagagccaattcaaatttgtatagaattcagtgaaatagagtcggtaagaatgcttaaaccattaaaaaatttcaacaaaatgccagaaatgtaaattattttatagtcacaaaaacataatcctgtctttagatttattaaaagcagggcggtcaagtttttattttcaaaataaggacagatgaggctaaaactaagattcggaccccaaaaataagattttttctaaaactgatagtagcgcgaaggaaacgca

SEQ ID NO: 80563 - DNA, 971 bp, Heterodera glycines
  Genomic contig location: Contig_ID=SeqID_16196; Location=851..1821; Strand=-
  SCN-specific regions: Sequence locations=1-190,212-399,421-971
atgaacagcgtgttgggcaaaattattcggatggaatctgtcttaatcgcctacttttcaaaacctgacaaatgtccggcacttctttacgacttttttttcgttttttctgaacaatcatttgcgatcattcattttttacaccacgtgctaggcctatttaacaagacaattgacttttttcaggttgttttactaattttaaatgaaaattctgttcataaatttagaaagaaaaagccattttgcccgaacttttgctggaaatggacaaatttagagcgaaaattgagcgacgaaaacaagaacggttttatggtgccgatttggcaatggaaaaagtcggggagtgcacacgcgaagcgttggaggaacaatttcaagtaaaaattaatcggttttttattaaatttccaatttttccagtctttttacacctcggttttggcatatttggacaaatggcatcgcattgaccgatttccggaaaagttgcaatgggttgcgctggcatcccgcaaaattccccacgacgatgcattggctctggctcgacaaattgcgcccgagttaacaaatgatttgtttgacgatgttagcgaagccaaccaaatactgaattcttttccaaatgatgaatttcaaaaattaacccccgaacagaagtggaataagctatttgaagcaaatttgccgcatctgctcaagctggtcagcattgttctttccattccggtctctaatgcatttgtcgagagagtgttttctctttgtggctcacaatggactgacacgcggaatttgttgcaagtcgaaacagtcaaggcgttggtccaaacgaaagccaattttgatctttcttgcccacaaatgtaccaaatgctaatttccaatcacaaattgttggagaaaatcggcggatgggaaaaatacttttgataatcactttcaattgtttttgcgctaataaa

SEQ ID NO: 80564 - DNA, 4980 bp, Heterodera glycines
  Genomic contig location: Contig_ID=SeqID_2586; Location=831..5810; Strand=+
  SCN-specific regions: Sequence locations=1-629,651-747,769-1343,1374 -2004,2026-2392,2439-3020,3042-3945,3969-4448,4470-4661,4692-4980
atgaaggcaaagcccatgatatgtctcccggatgctcccaccagtatttggtcattgcctgtcgaccctatctgccctaattgggttccaacgcaggtccccgttccttttgcattaaatatatatcgaccaaacactgtacaatacaaaaccgaagctacagcctgcagctgcattttaacgcgcatttcaaggaggagaggattttttggtggaacatatgaagaaataagtgcctttcattcggtagtgcctacggcaatttgcaggaaaatggcagttgataaggactctccagcaggcgaattatacgttaatgacgaaacgttaatggcaacaaataattccctagaaattgggtggggaaaatggccatcaaatttgttttggagaacggaagaaatcgataattgttatgtgtataagacaattgtttttacacgtcatggaatggaggggttgaatacaccaatcggagagtgctctaattgcttttataaatcaggcgaatgtcaatgcataaaaattagtctgatttggacccccgacaagacccaactttgcccttttgtttggttgtcaaaatggtctggtgaatatgcaagtctaatatggacgacggaaagtggtgattttgcattgagttttgaaaatacctcgtctcatagtcagcccgggtgctatgccgagtcgggcgaactaattgtgtcggaccaagcgtttgccgtacctgtttcggacttccaagaaatggtcgagaaagccaaaggaagcggcaccaggaaaacgagagaaacaaccgaaattggtcctgtttatagttctcagcttgctgcacagcttacagccttaagcacaaaaatggccataacgactcagcggctatttacggagacaattcgtaaaatttgcacgagcatgcaaataatggcagaccaagctttaaccttgtctataacaaacccatcgttattagcgaggtttttcctgggaaatccttttttatcggctcgattgatcacggaaaaactaatggaggtaaaaacgtgttttcctatttatgagggcgaagtacattttgactggcaaaatggtcactgttttgagtttcttccggtaacattttatttataccgtcagcaaaagcacggttttatcgacccaaacacgttaattatccatacaaaatctaaagaggtggattgcggtaatggaagattcatttttatggagatttttggcatgataatacgatacgatcaaaaaacaggaaatgtcagccaaatttcaacagaaggaataagggaaatcagccgatatggaaaaatagacatcccagaaataaacctcccttttttcaaaaataaagttttggccaattttacggaactttactcgcgtgaaaatttcaaagaaacagtggaaggagccaaaataattcaggagatttcccgcttatcgcgagttgattcgtggaatagtccctcggaacacaaaaaccgtatttcgggtggaatagtgagcagcggactgttttcatttttacgtggcggtattctgagtctaaaccaactttgggtttttggatgctgctgttatgttacgctaacaattataatccaaattttgttaccgtcgacaatcgctcaggccttacagtacctcaatcttggaggaattttcttcagattctttcgatttgcatggcatattttctttagggggaagagaagaggtaaaaaaccccgagatgaaattgaggagggagcctatcccgtggaaaagaaaaccatacaaaagaaagactcaaaaaatcggaaaaggctaactcgtacgcactcagttccgctaacggaaagatggccatctccggaacaaaaaccgaccataccagtaaaaaagggcttaaaagtgagcgtgttggcaatcattgaatggaacacaaggtgcgatgaaacttttaaaattgaaggattcgtttacgggaaaataactcggtttcaattggacactggcgcacatgtgtcaatctgcagcctacgcactgcagaaaaacttggaataaaattgcttagtcctgaggtggctggtgttatcggaattagtggtgaatttgcaccagttattggcagtggaaaaattgaattggaactggccggagtgaaaatcataacagaagtggcggtgattgataaggaaattggtaaaggaggtgcatatgacatgctaattgggcgcaacacatttaaaaagacacccttctacctcgatttacaaaatggttacctgatcaaaaaaggcagcaacgaaataatggagtgtggcacctcacagagaaaaattgaaaatttggagcagcatgtcggaaaatcggggaaccgagaagcagaacggaacgaaacggaagacaggcaattgaaaagttgcttagaacaaaataaaaatgccttctctaagcacgaatatgacttaggaacttgtaaaattatggcaccaaagattttaactacaacagaattgccagaaagggttaaaccgtaccccgtgccggaaaaatacgaaagcgaattgaaaaagcaaatcgataaaatgttgagagctggcgtaataaaggaaagccatacgccttgggtgcataatatggtgcttgtaaaaaaggcaaatgggcagttaagaccatgtgtggattttaggccattgaacaaagtcactattcccgacccttaccctttaccgagaatggaaaaggtcatttttcgggtcgcagggaaaaagttttattcgagtcttgatctcgcctcgggcttttggcagatcccattggatcccgagagttcatataaatgcggaataattaccccatggggtgtttatcaaatgctaaaattgccttttggcctgtgcaacgcaccaagcatttttcaaagaacgatggacaaagttttggatgacataaaaaatgtaaatgtttacattgatgacatattgatacattcgaacacattagaagagcatttggaaagtttggatttagtttttaatcgcctacaaaagtacggtctaaaattaaagggagataaatgcaattttcttcaaaataaatgccattacctggggcatattttgtcggaagcaggctatcaaccgtcgttgggcaataaagaagttattgataagttcccggaacctacaaatgtgaaagaggttaaacgatttttgggaatggcatcgttttttcgaaaatttattccgggttttgcctcaatcgctcaccccctcaataaattgacaagaggaaatggcacggaattcgtatggggaggagcagaaaaagccgcgatggatgaattaaaacagcatttgttgaaagcaccttgcctacgcccgccaaactacgacttggccttttacttattcaccgacgcatcagcaatcgcttatggcggggctttaatgcagactaaggataataatgagatgcatgctgttagcttttggtcccgtacactcactccaacagagagtaaattaccacccactcatggggaattagcggcaattgttcatgcgatacagaattttcgagcaattctgtatggggcagaattaatcgtactcactgatcatcgaccattaacattcctcttccaaaaagccagtacaaatccaaaattaaaccggtggctcatggctctgcaggaatttgagccgaaagtaatatacattgagggtaaagcaaataaagtggcggatgctttatcacgagtccctatcccatgggaaaatgtggaaacaaaattaaaagaggatgtcccttatgtgttggcaatagaaagtagtttgaatagacaaacatttgtaaaagaaacaaaagatgatcaaattatgtcaaaagtaattgccaaaataaatgaaaactgggcagagccaatagagaaggaactggaaatatattttaaaaaccgagataaattgtatgtcgaaggcggaataattcgaaaacatccccagggccaatttgtggtaccaaagaaactaaaagttgccattttggaacaaattcacaaggctcattttggaatcgtacggggaaagtcaaaggccagaaggtatgtatggtggccaggaatgtcggaggacatcgaaaattttgtgaaagaatgtgaggtgtgtcaaagaaatggcccaagcccgccccgattggatccggaacaccgttggcccgcagcaaaataccccttcgagaggctccatgccgatttggcaggcccggtttggggaacgaattttttaataatggttgactcgtattcacgctatccatttgtctttcagacaaattcaaccagtagcgcaactttgatcgcatttttccgggacatttttgccttatttgggtccccaaaaaccttaattaccgataacggcccacagtttatttcggtagaattcgaaaattttttgtgtgaggaaggggttacccatttaacctcgccaacatatcatcccgccagcaacggagaggcggagcggttcgtgcgaacctttaaagaaggaattaaaaaattgttggatgaggggagaaatctccgtattgcacaattcatccttttacaggaataccgatcctcaccatgcccaattttgaaaggaaatagtccggcacaaatgtttttgaaaagagaaatgcgcacgagtttggataaaataagaatttcccaagtggaaagagacaaaggcactcctacgggcgaccccgtgagagataaaggggctcaaaatcagcaaaggcagttgccgaaatatgagccaggagattcggtatggatgcgcgaccaacaggacaaaaagtggacgccggccatactgcttgagccaataggagagaggatgtggcgtttggagatggaagggggcggagaaagaactgcgcatgtggagcaaataaaagcgcgtcgaatggtcgccggacgagcctag

SEQ ID NO: 80565 - DNA, 193 bp, Heterodera glycines
  Genomic contig location: Contig_ID=SeqID_2586; Location=7252..7444; Strand=-
  SCN-specific regions: Sequence locations=1-110,133-193
agaattcgcatttgtccggcgccaagtctttgttggatttgctattgggcaaaggcaaagagcaaccgccgcgggaacattcggtggctaatggcggcggcgctggtcgaaaaaatccaagaaaggcagcagcaccctttcagaaaagaagagagcggaaaaccaatcaagcttgagccgtttgttgttattg

SEQ ID NO: 80566 - DNA, 884 bp, Heterodera glycines
  Genomic contig location: Contig_ID=SeqID_2587; Location=193..1076; Strand=-
  SCN-specific regions: Sequence locations=1-311,339-365,387-492,514 -826,848-884
atgccaattaaaaagttaagcgagcgaagtgtcgcgcaaaacagctcgacggaacacctgaagacggaactgaacgaggcaaacgacgaaatcgcactgctgagacggaccaacggagagcagaaggggcgaaacgccaaattggaggcggaattgatcaaagtggaaaagggtaagggaaatcagtggaagataattaggggtaattaaaactaattaggctaggggaattcataaaaaaattaggggtgattaaaaatgggcttccatttgatattgtctttcagcttacaacagagaaagagaattgcgtattaaaactgaagaaaatttgaagaggaaagagttagaagcacaagcaactgaagaaagaagagtgagtaaaacattaaaagtgaatcaatataattaatacaactaatggttaacatactaaacagcggattaattaacaaatattaatcgtggctagtttactaaacgtccaattaacaaataattaatgatcatttacttattgttagctgtccgaacagcgaatgtcccaattgacttatgaacgtttgagccgaatgggacaaagccgaaattggcatgaagaagcgggggatgacaattttaattgtaagcatgaaaagcaaatccacgcaagcattgacaaatggggcggaaaagtcggcataaaaacaatgccaaaaagaacagacgcaattgagacactgaatgaactgctgaacgaattatgggacaaatgcgaacggtgggagaagcgcaaagaaaaagcagaagaaggcaagcgaaagagtgggaaaagggagagaaagggatggatgagtgatcagagaaaagagggactgatcaggggggaagggatggatgagtga

SEQ ID NO: 80567 - DNA, 943 bp, Heterodera glycines
  Genomic contig location: Contig_ID=SeqID_16198; Location=122..1064; Strand=-
  SCN-specific regions: Sequence locations=1-50,72-97,120-789,824-943
atgtcctgcagttatcactattggtgggttgggtctgacaaatgagagaattttaaacagagcacaaatacatatcccatttacgtaataaaataccaataaatcggaattctctttaataactttgtttctcctaaattatttccgtccattttagtcagtttttggtaaagcccggccagatccatctcggaaatccgagtcctggttcgggtccgggttttttgacaggctcaagtctatgtttactatttgacgattaaccgtattccaataacgtattcccccgccaggtaccattatccatatttcaaacgatggtatctcggaggcctcggtggagtttcgcaattccacaaacaatgaaagtgaaaatggatgtatagcacagaaacacaatgacgcgtaccgtaccctttaccgtagttcgcttttctttgacgaaacgaatccctgcaattattgtgacatatttaagcagttttattactttcacagtttagtgtttaaaatcatttttcacaagaaaaaaagaagggcaaatgcgcgcgcattcattcgcccgcccttcgcctttcaatgcgtttagaagcaaaagccaacaaaaaagcaatttgggaaaagcaaaaagccaacattgcatttggggtgtgtttctggcacggcacaatgaatggccacggtcccctccccatgtcgttcttcaaaaaccataatgcttataaaaggtttttgatgagtaaggaggacccagcacccgcctatcggcacctccgcatttattacaccataaatatttttaatttaaaatttagtaatttttcaatcagaatttggcctcctatttttcgcaggtatcgcgtatttcttattttgttcgtccataataattaatttaccacaacccatcaatcgtataattcaataagagagaaaaaataaa

SEQ ID NO: 80568 - DNA, 135 bp, Heterodera glycines
  Genomic contig location: Contig_ID=SeqID_16198; Location=2669..2803; Strand=-
  SCN-specific regions: Sequence locations=1-135
gctaatagagcatccgaagggctctcgaatgatatcaagaaagttggattagcgtatttggcgtaaatttttgcgcgttaattcaaaagaaacgctgatcactgccttttttggagaccaattaacattaataaa

SEQ ID NO: 80569 - DNA, 188 bp, Heterodera glycines
  Genomic contig location: Contig_ID=SeqID_16198; Location=2469..2656; Strand=+
  SCN-specific regions: Sequence locations=1-188
gacactgctaaatgcacttcatgatcgaggcgtcgacaacaaccaagagaatacaagcgattacccaaatttttgatcaaatttcattttttcaaacattttcaccatttcacattttccatatctgaatatttaagtgaacacattttttcggtttcaaatagcatttttaaataaagattttagtc

SEQ ID NO: 80570 - DNA, 752 bp, Heterodera glycines
  Genomic contig location: Contig_ID=SeqID_16199; Location=136..887; Strand=+
  SCN-specific regions: Sequence locations=1-166,200-396,419-593,627 -700,723-752
  Gene Ontology: Mol. function=transcription factor activity; Cellular component=nucleus; Biological process=regulation of protein activity, epigenetic
cacaacaaacggcgccagttcaacatccccaacaacatgttggagcagtacgaggaagccaaacgctgccaaggatagcacagccggcacgacaaggacaaaatggaactgttcaatcgtcacaacttcagcgtggagctgttccattgccaagagtcccaactccacaaccgcagcaacaacaccaacaacaacaacagcgccaagttgtccgaacgccacaattgcagcaacaagttggagctgtgcaagggcaagtgccaagacaggcaccccagcaacagcacgaaaaacttgttggagctgttcagttaccaagaatgacatcgcaacaacaaccatctactgggacagtccaaggaagtcaaaccttgccgagaatggcaccgaaaaatcaacaacagccacaactacaacttggggccgtcccattgccaagaatggcatctccgcagttacaacaaaatcaacgggaacaacaacacgttggagctgtacaacaaccaaaaatggcaatggcggcacaacaacacatgccgcaacaagttggagctgttcaaggaaaccaacaggtgccaagaatgatggcaccacaacaacagcaacagtggcagcagcagcaagaaattggcgaattgggagcggaaaatggcacgaatcgttgggaagaatggcaagaatgctgcgtccagttgcccgcaggcaattcagtcctgggcaaatgcatggcgaaaatgataatctgggtttaa

SEQ ID NO: 80571 - DNA, 2007 bp, Heterodera glycines
  Genomic contig location: Contig_ID=SeqID_16201; Location=118..2124; Strand=+
  SCN-specific regions: Sequence locations=1-143,165-242,265-1307,1336 -1386,1408-1490,1512-1536,1558-1598,1620-1733,1755-2007
atgggcgaaccgcaggcgatgttcatgcaaagtcgcaaggacgcgtgcgcaaaattgggcgcgccaaatgaatcgtatttgtgcagcaaatcgcaggtgagcgccaaatgagtgggagccacggccgaatgggcaaagtcggagtggaaaagtgccaaaattagtggcggatgccaaaaaattccatgccatttatatgccaaggcacttcccattaacaccttaatttaaatgggcagaatttgctctttttctgctgaagttgaccttcaccaacaaataccctttctacgtgaatatgccaacttcgtccaaacaaagcagaaaagtgtcacttctggcaaatgcaattcgcacagaaaattcattcattgccgcacttcgcaaggagcaaagttcaaaagaggacggaatattgtcattaattagctaattgcttttcctttgattagtgtccgaatggaaaaagaaaaaagaggagggaaaaacgacgcggggaaatgcgacgagcgaaacgaacggcgaaactccgaaaagggcggaggtgcgaacaaagagatgtgccttttggcatttcccaactgaaataaatttctcataggaaaagcctccttcgatggtgccgaattcggtttcttcgccttcgatttcgccaccgtatgccaatgtcacaccaacagacgatctccaatgtaccgtaccaatgccaattgcgagtactgtaccaacaaaatgtgaagaacaacaaacggcctcagaaacaatgacaactccagctgaacaaagtgctgaagaagcatccatagtggagaatgtcaaaccaactcttcctaccgtaatggtcagagcgaaaccgttgacaactacggtaggatggacggggcgacaaccgccacaaaaaacggccatttcgccattggcacccgtggaaacgacgacagtgccagtttgagacgaggacacagccttggcgatttgaatggccaacccatgggccataaacagtaactcatgacatcctatcgtatcgcattcatactgtattttctatgattttagtagagcaaataaatttctttatttatgaccttcttttttcaattgcgcgttttgctttcaatcatattttgacgtaataacaccagtttaaatcggaaatttcgaaaaaaaatcctatgggtaggcaaatttaaatttggcgttgcgatcttagaaagacttttcggcttttacttctttttgtcttcgtttccctttttttcttcctccgtcttggtatcgccaaattttttgaacttatctttatgtatttactttttatttgtttttcaaaggggctatcatgtttaagtttattcatatccccctttttgtcatttttttggcattcaaaagttgtgaacacatgtttccggcgggggttttccgggatttaaattagggaccacaattctttaccattgcccaaattcgaaacaaaagtcgtagttctatttttctattttatgttcgcgttcgggttaaaaatggtcttggttttaaaaaagtggacccaaacttaacctagtgccttaactattcagttgttttcgttcgttataaattcacaaataaatctccaaaatgctcctttcttccaactttgttggcgttggccgtgtcgcgtctcgtgccgttcaccgtttcttcctgtcgacttccgctgtgcgccttcagcaacaatacaaagtggcggtttcattttttatttatgaaatacgaaataatcgaaacaaagtttagcattgcaaacattttttttaggaagaagaaaatatggacattgaaaatctcttctcggaacagcaaaatctgccgcaatcgcagagcgaagaccaaccgcaggtgttcgatgcaccgaagcgtcgcttcaacaaagggtttgtcgaaacgatcaaaagcagcccatccccgggggaggggggaatagaggcactgcccatcaagcacaaattatattggtattga

SEQ ID NO: 80572 - DNA, 235 bp, Heterodera glycines
  Genomic contig location: Contig_ID=SeqID_16203; Location=31..265; Strand=+
  SCN-specific regions: Sequence locations=1-30,69-235
atgcaatctgttccttatatggtgagattgataataatattatttacaaaaaaaatatttgattatttcaggatgaactttggcaatgcattttaaataaacaacacgattgggtactgattaatagggatgcaatttttaggttttagcctatttttagtgcctattttctatgtttttattttcagagcctaaaacctaaaaaaaatgtgaaaaacctattttggcaaatgca

SEQ ID NO: 80573 - DNA, 1777 bp, Heterodera glycines
  Genomic contig location: Contig_ID=SeqID_16206; Location=576..2352; Strand=-
  SCN-specific regions: Sequence locations=1-61,84-422,445-709,731 -819,841-978,1000-1217,1247-1777
  Gene Ontology: Mol. function=acid phosphatase activity; Cellular component=integral to membrane; Biological process=regulation of cell cycle
ttatggcgtcatggagatcgttccccaaccggaacgttcagaaccgacccgaaccaggaagaagtgtggcctcagggctggggacaattgtctccggttggcattcatttgtcattcgttttagaattaatttcaataaatgttacagaaaggaatggcccaacacgtcattcttggcaggaagctgaaggcacgatacattgaccagctgcattttgtcagtgaacgctatttaaacaaggaaatttacattcgaagcaccgatataaacagaacgctgacaagtgccatttcaaacatggtcggattttacagcaaagggatgccggggacggattatccgagtgaacgcgagtcgcaatggtggcctcatgggtcagcaatttaaacatacttctaggggtcagtgatgaaacgcgaactttatttgtttgtctttttgctttttcatcctacaatttgaatttgattgtgtcatattgtaatttattttttagtttcaccccagtggctgttcacacgatcgcttcctacgaggatcacattatccccgacattccagacgtcccatgtccaagacaaagcaaaattcatgaaattatgcagaacacaccggaatatcgtcagttgatggacgataataaagtaatttttctagcctagctctgatttttttacgaaaaattagttattggtggtttctgaatccaattttgtgcttaaaacaactgggttttccgcttttaacgagaaccttttcagcaacttttctccgatttgtcaacttttaccggtgagaaaattgacatttttaactttgggctggtcgctgacacacttttcattgaggttttgttcattcgcttataaaattatgtccgtttgttgaacaatttgattattgaggatcaataccgcgacaaattgcctcatccgatgccggaatggactcaaaaccgaacactgagggaaatgatcacaaagatggattttttgttggaagaatggattaacgggagaggcatgtcaagataaccactgtttttgtgctcttttttgaattgctttgcttctattaaggcttgtccgctttcgacggtgtgcactttgacatcgaattgccacggataaggggcgggccaatcctttggattttaattggaaatatgcaaaacaaattgaaatgtctgtccgagaatgtgacggagtctttttcgggttggttttggttctctcctacattgattatgtctatgtgtcttaattctaattgtaaggtctgaaatcgccaattgggtcgccactttgcgattggattcgtaccaggaaatatttcgcatattccgcggtgcttttagacggttctaattaatagcataattaatagtccgtcatttagcatgacacaacaattgccgcactgttctcagccctgggcttcaacaaaacgaattttgacgttgacgggtcggatcctcgttcctctaataaattatggttttaccaattattatttagttatccccattattccgcctgtgtgacgtttgagctgtggcaaaacgctactaatctcgagcactatataaaggtgctttcaaaatctgtttgttgtccgatattcacaatcattttcaggcgttttattggcctcccaattcgcccagcttcgaggaaatgacgagaaacatcaccggttgtgagacaaactcaactttgaatcgctttgtcgagcgttcggaaatctttaagcctgtgccctcgccagatgagtact

SEQ ID NO: 80574 - DNA, 175 bp, Heterodera glycines
  Genomic contig location: Contig_ID=SeqID_16207; Location=641..815; Strand=+
  SCN-specific regions: Sequence locations=1-175
atgaaaatcagtgtaattataattggactgacaatttttgaaactttgtttggcacaatatttgctgggtttttcgattgcttttttggtcgtgacagtgatgagcgcaaaccatcgacgactaattacagaaagccggccccaattacgacatcaagccgatgggatatggacg

SEQ ID NO: 80575 - DNA, 928 bp, Heterodera glycines
  Genomic contig location: Contig_ID=SeqID_16208; Location=167..1094; Strand=+
  SCN-specific regions: Sequence locations=1-119,165-331,354-550,672 -806,854-876,898-928
gtttgatcaaccaaggtaggggagctcagcatgcttttgatcaatcattgaaaagctccacaagaaaaagccccgagtaccaatcaattctagatgagtggaacaaaccaaagagcaacaacaatcataataataatgatattgcaaggcaaaaaacaaatgtatacaatcgtagaatttcaagaatagaccatggaaagagttcaaagcaattgggccaagtttatgctgaacagcgaacagcaacaagccgaaatcgtggcaaaaatgttcagggccaacgttcaaagccactgggccaaaattacactggaacaccaagacgaaatccgggaaaaaatgttcaaagtccaggtttattaacaaggctatttagtcgaatgtccaattagcttataagcaaaagttcaggcagcagccgtttaaaccgaagcaagtcgggccattatgccaaagagttagggcaagtgccaaaaccaaagacgcaaaaagtgattcgcattgatgcacatgaatatacaaaaaagcacatctatgggcaaaataagagtaaaattattgtttcaaatttaataacttaaattaattaatagttttattaattccaaaataaaggatgaatgaaataatattaatattaatttttatgtatgcattaataaaatattttagaagtcaaacctcaaaaggatgaatataatttgccatcgcatgcattggctggcaatggtaaatcatcacgtggaaaaagcaagaaacatagtcaaaaacaaaaaatcaaagaagagctttatgaattgagtgactattattaattgatattttttttaaattgttttattttcaaattttagtgaaatttcggaccgtctatgtcattttctttaaatttttggggaacgttttgtaaagttattatttattctaa

SEQ ID NO: 80576 - DNA, 618 bp, Heterodera glycines
  Genomic contig location: Contig_ID=SeqID_16210; Location=328..945; Strand=-
  SCN-specific regions: Sequence locations=1-595,617-618
atgagcgaaatcaattctctgtacgaaatttacaaattttgtggccccggagggaattgcgcagcaaaaaagacccaattttaccatcacattcacaacattgtgcaaatttggcgcgaatttgaacaagtccttttgccggacgaagaatatgaacgaatggcacgtgaaaaggcgcatttggtgaccaagacggaatggccgcaacaaatggacggtgagggaatgggaaacagggacaattgggcaagggaaggatttgctaatgggacaaacggtcattgggacaaacagtcaatgggaaattggtcagcagtagactattggccaatgggataatgagctaattggccaattagacaattgatcaatgagacaatttgctaatggaactgtgccaattagataatcggcagtctttcattcatttactttacaattcttcaatcggataggtcttactgatcaggactgatcaattctttggggatatctctaagttcatccgaaaatgggacccaattgctcgattatgtcgagaatgaccactcccgccttaaaattgtataatttgaggagaattataattaaaatatttcttttttgaaatgcaataaa

SEQ ID NO: 80577 - DNA, 1034 bp, Heterodera glycines
  Genomic contig location: Contig_ID=SeqID_16210; Location=1955..2988; Strand=-
  SCN-specific regions: Sequence locations=1-189,235-665,707-756,793 -845,870-940,1023-1034
atggcactgatcgcaatgtgcttcaaactgatgcaggacgacgttgtgcagaaggcgcgatggttgggacaacgcattggcataatcggtggtggacaaattgaaattgaattggaaaaatagtcactaattctaatttgcctgtaaatttgaaaacctagggtaaatttcgaaaatgccatgaaatttaatttatattatctttattcataactttaaacataagggatttttaatattttgtttgcttcagtgcacgacgaagttggaagcgaagagtccgactttgaggaggaaggcattgcgatggatggggaggatgactttggcattttcggaggtgtcgaagacggcgacgaattggtgggggcggacgacgacttgctgagcgtcaaaacggagcaggtaaggcacaattaatgaatgccattattcattttggtgttctgcaggagaagcgcactctctcctcaacttcgtccaccaataaagcgctgcaggaggaatttctgctcgccgccactcgccagcgaacgccgcgagggcgacgcgtcgccggggggcgcgccaatggcaaacggacgcggcacacgcgcgcggaagagacgggcgacggcgggggatgagcggggcggaaaaccggcccgcacgcgcgcgagcggagtgattgatctatcgatcgaccggataatcaatcgattgattggcataaaacgattttcaacaatatgtatcaatctgctggacagaaaacccaaaataaaataaaataagattaaaaattaattaattcatttagcgatgggacgtgtaaatatttgctaatcgattttcatttttattggaattaattatttatttattttttagcagaatttttcattctctagacagaagaattaagtttcagattaggaaatataattgcttaaaaaattgttttttatttttttaaatttaataatttacaatttttctttttaattattatttttatattttgttttattttacaatttttaaaaccaaataaa

SEQ ID NO: 80578 - DNA, 1015 bp, Heterodera glycines
  misc_feature (41)..(42): n is a, c, g, or t
  misc_feature (47)..(47): n is a, c, g, or t
  misc_feature (110)..(110): n is a, c, g, or t
  Genomic contig location: Contig_ID=SeqID_16212; Location=1..1015; Strand=-
  SCN-specific regions: Sequence locations=1-876,898-1015
agtgaattcattttccgtttgactgtcgtcgaatgctcacnngttcncaaggagtacacggacgtgtttgtcagtttcaagtaggccaaatgcgaatgccaatggcatcncattcttcgttttataattatttccctccagttttctccatcggcacgacgaagcattttcaacagagcccagtcaaagggattgcgaagggcgaacatcgcacgttaccgtataattatgtgcaggtggcataattagcaaacgccattgccctatcaatggaccatttgcaatgattgcctaattgttccaattgcccttttgaggagttcaaagcggtggtcaactcggcatttatccattacctgcagcactttcccatcattttcgaagtgttcggccatttgactaaagtagacgagcagagcatgttcagtgggacgacggcgaacaatcagtcggaaaagtaacgaaggatggcataaatggtggcactttctggttttgacaggtgcaaaatgtcgaagaatctgagcaacttgcagccgtcgttggtcatttcaactccgctgaagagcaaattggtggtcagcggcaacggctgcccgaggcaaagcctaattaattaattaatcgacgataaagagaaattccagggcaaattcggtcaaatcaaagtatgacttgctgatttggttcgaaatttgcgaattcaccagcaacggagaataccatccagcggttcgattttgcaaagaaaaccaatcgttgttattcccccaaaataaatgcaggtggttgaccatgccaatggactgccaacccatggcattttccttctccaccagggcatccaacggcgcattaaaatcacaatttgccacgaaaaaggttttgttttttgggcaaaaagcattataaaaaagacataatataattaattgcaggagacattcgctggagagactgtcaagaggtaaaaagggacacttttaattaccccctcctctttcccccccccccc

SEQ ID NO: 80579 - DNA, 358 bp, Heterodera glycines
  Genomic contig location: Contig_ID=SeqID_16213; Location=110..467; Strand=-
  SCN-specific regions: Sequence locations=1-284,317-358
atgacgcaggttcagtttacgtcaaatgtcaatgccattggcgctgcttctgtcggttgcactacggtaagtgccgttcgtggccgtgccaaattccgtcgtttgttttgtcgtgccgtcaccttcccggtcagtttcactcagctacgcttttcatttttgatctaagttttgctaccgtataccctccctatctccttttattacagtacttccaacgatttttttaggtgaacgttgtcaccaattggccagaaaaatgtgtttagtaagtgcgcattggccaacaaaggcaaaaacaacaaagaatgaatggtcaagaatgggcaaacggaagaggaatttgatgacaattaaa

SEQ ID NO: 80580 - DNA, 210 bp, Heterodera glycines
  Genomic contig location: Contig_ID=SeqID_16214; Location=100..309; Strand=-
  SCN-specific regions: Sequence locations=1-169,205-210
atgctcaaaatgatgccttcttcagcgctaacagcagcagatggacacaaaaaaaagagtgagtaaatgcgaaatgcgcagatggaaaatggaggagcccaaaggtcacacaccccaagggcaatcaatggaagaaaaagtaatgagcgtattaggtgcaatatggaacaatataaaaattaattattatttaaataatttttagattaa

SEQ ID NO: 80581 - DNA, 491 bp, Heterodera glycines
  Genomic contig location: Contig_ID=SeqID_2588; Location=1..491; Strand=-
  SCN-specific regions: Sequence locations=1-491
  Gene Ontology: Mol. function=ATP dependent DNA helicase activity; Cellular component=nucleus; Biological process=DNA ligation
gcattgttgtgatcggcttcaaaccgttgcatttgctgaaggattcgcatcggatgggcgccgccgtttttgtctatcccatcgaatcggtcggtgtgcttttcgcttttgttttcactcaacatttccccttcgtcgtcggttggtttaggtaatctccggcagttccgccctttaccgtgcccttctgaagcgctgtatggacaaacaattgtttgtcctcgtccgttatacgcataaaacgaacactgtttgtttttcatgtccattagtcgataaaacccttaattattcgcttcgtttagcctccaaagctttgtgcgctcgtcccccaatcggccgaccgaattccgagtggttgtgtgagcagttccatccgaatggatggtcactctcatcagatgcattttttagacactcgcgcgcgaatatttctacgacggctttcatttggttgaaattcccttcgcggaaaagtcgcgatcgatgga

SEQ ID NO: 80582 - DNA, 400 bp, Heterodera glycines
  Genomic contig location: Contig_ID=SeqID_2589; Location=2182..2581; Strand=+
  SCN-specific regions: Sequence locations=1-379
atggaagacggagcagcaccacctgtaggtgaacacgatgttgaagaggaaggaaaagccgacggagccgaggtaacagaaggaagtgagcaaacgccaaaactgaacggagggacgaatttggcgagaagtacaaaacgaatggaccacctgccattcgcgaatgatcaaatgccaattgaagtagagatgaaacggggtgaccagctccaaatggaccgccaaagtggtcacctgaaaaagcaaattggcaattaattggctactgccctttttcgattggctttcaccacacaggcggtcacataggcacgagtcacctgaaaaaatggactaattatggtaatgaaaccaacgaatgagccaaaaaaacaaaacacggaaattaaagggaccggga

SEQ ID NO: 80583 - DNA, 190 bp, Heterodera glycines
  Genomic contig location: Contig_ID=SeqID_2589; Location=3153..3342; Strand=+
  SCN-specific regions: Sequence locations=1-17,39-190
tgttccatctgagaacattgggaaaaaaccttatgggagaaagaacgcaacctctttgatttccgtaattcgaagcatatgacgagcagcgcccatatcagcagaaatggtgatctgtcaagtcaattaaaatttattacaataatttttacgtcagcaacatccaaattttcactattttatgcatagg

SEQ ID NO: 80584 - DNA, 1263 bp, Heterodera glycines
  Genomic contig location: Contig_ID=SeqID_2589; Location=1411..2673; Strand=-
  SCN-specific regions: Sequence locations=1-90,114-581,603-721,745 -890,915-1263
atgcaatcagtgatccaagcatatgctgagatgccgccggtagcttttcgtcttatttcttgttaattgctttagtctttgattggttttattcccggtccctttaatttccgtgttttgtttttttggctcattcgttggtttcattaccataattagtccattttttcaggtgactcgtgcctatgtgaccgcctgtgtggtgaaagccaatcgaaaaagggcagtagccaattaattgccaatttgctttttcaggtgaccactttggcggtccatttggagctggtcaccccgtttcatctctacttcaattggcatttgatcattcgcgaatggcaggtggtccattcgttttgtacttctcgccaaattcgtccctccgttcagttttggcgtttgctcacttccttctgttacctcggctccgtcggcttttccttcctcttcaacatcgtgttcacctacaggtggtgctgctccgtcttccattatttgtttttcgtccttttattccttctccccccccctcttttaggcattgttccatgttggaagagggctctttccgtggtcgaacggctgactttgtctttatgttcatttttggcgcagttttcatggtcctttcttccatttgttcatcatccgtgccattttcagattatttgtgcctgttttgtccatctcattttccttggccatgcatttaccattatggtaatatatttttatttttttttacattgttcagttttcagttggtttacgtttggtcgagaagaaaccctttcattggtccgttttcgccatttccttttttgcatttatttatttaaagggatgaattttttcggcattttctccttttctgccccttatttggtttgtcccccctttcctccattttccctcatttttcgctctctcccccatttagccttgggtgctgatgttcttctcacttttgctcggacaaactgttattgtggacattttcggtgagttatccgtgtgtttatttcccattttcatggaatgtttgttaattccccccccccccctcaagggattgcctgtggccatttgtactactttctcgaggacgtgttccccaatcagcccggaggctttcgcgtgttggaaacgccgcgtgtgctcaaatggctgtttgaccccgccccgttgccgcgggtggaccccgaccaaagaccgggcggatacgaatggggcggtcagggagacgaagaccgactgcaaacc

SEQ ID NO: 80585 - DNA, 2750 bp, Heterodera glycines
  Genomic contig location: Contig_ID=SeqID_2589; Location=2855..5604; Strand=-
  SCN-specific regions: Sequence locations=1-132,154-460,482-617,639 -1026,1048-1177,1199-1545,1567-1625,1647-2414,2436-2652,2674-2750
  Gene Ontology: Mol. function=tumor necrosis factor receptor binding; Cellular component=extracellular space
atgagcagggacgagctcgtcaatttgctcggcacaattgccaagtctgggtccaaggcgtttcgagcggacgagaaaaacgccgcggctgccgaggcaatcatcggttggtctgatcattgccattttccttcattttttaaaacatttttaggtcaattcggggtcggcttttattcggctttcgttgtcaggtcttttcttgtatatttttgcaatttattcgttttggtaaacgcgttttagtgagaaagtttccgttaccacccgaaaacttggcgaagaaatggggcacatttggagttggaatggcgggacacattttacggttgaagaaaaagcagatgccgacattgggacgaaggtcgaattgcacttgaaggcgggagaagcggagaaattcgctgtgccgcagaaagtggtcgatgtcattaacaagtgagtgggcaatgccaacatcagcaaatgcttaagactgattgattgcgtttaaaggtattcctattttgtgaccgctccaatatttgtgaatggcgagcgaataaatgtgacccgcgcgttgtggacaatggcaccgagcgaaacgacgcccgaaatgcacgagacatttttcaagtggctacaacccacccatttacgcttttaattcaaaactgttacagacaattggccaagacgcaccacccccacttggcagacgaccgtccccagtacaccatccaatatcagaccgattctccgatcaacatccgtgcactgttttatggtccgttcgtcatcccatcttttttgttgaacattttccttcattttagtgcccacaaagcgcgtctcccacttggaatttgcagcagattcacagcgggacatcgccatttcgctgtacaatcaacgcgttttgattaagccaaatgccaaagagttggtgccgcactatttacgcttcctaattggggtcctttgcactttgccatagcaaaattaatcattcattccccttttaggtcgtcgattctgaaggtattaattggccaatgtttttgttttgcgatttaacgccataagtgtcgctcgctttaacattatctcgtatcttttcagatgtgccgttgaatttaagccgagaaatgctacagactgacctaattctcgagtatattacccccctctttatatgctttattacattatttttcagaaaaatcagaaaaacccttaccgaacgatgtgtgcgcttctttctctcacaattgtccaaagaccgagtcaaatacaacgacttttacatgggctattcaatgttcttcaaggaaggcgttgtcacggaacagtccaacaccaccaaggtgttttccattgccatttatcccatttttcttcatcaaaactttgttcaggaagaaattgctcagcttctgttgttcgaatcgtccagttttcggtctggcactttgaccactctgtcggaatatgtcgaacgaatgcaatcggaccaaaagaacatttattacatttacgcaccaaggtatgacacgaagacatatacatttttgtcacttttatttagccgtcaactcgccgaaacgtcgccttactttgaactgttcaaagacaaatacgaagtgttgtttttgtcgggtttgtcactccccccccccaccctttttccatttattttttccattttttcagacccagcggatgaactcgtctttttgtcaatgccccaatttcgcatgaaatctttgcagtcgctggagaaatggacgaaggaggagggactgagcattgactctgacaaagaatcatcggctgaattgatgagggacagctccaaaaagggtaattgcttcgtttgttcgttggctattgccactcggattggctctcactttctacatttactgtatcatccttttctcggcattcagaatttcttggctggttgcgcgacagtttgggcactgtacgcgtcagtgacattaagcccagcggaagacaatcggaacatccgtttatggtaggtaaaatgggaacaaattgttcttgtgttataaggtttagggaataaataaaatactaacaataattggcaaaaccagggggaataatgaagatttgattggatatataacagagattaaatgagatagaaatggcacaataacattgggaatgagaagaaaaggatggcttggaatggaatgagacagaaagacaaatttatgggggattaaaccgggagaaaaccagggcaatttacctatgcataaaatagtgaaaatttggatgttgctgacgtaaaaattattgtaataaattttaattgacttgacagatcaccatttctgctgatatgggcgctgctcgtcatatgcttcgaattacggaaatcaaagaggttgcgttctttctcccataaggttttttcccaatgttctcagatggaacacctcgtcatgctccgtcccgttttgcatgtgaacctttcgcaccccgtcgtcgctggactgatgcgtctgaagcgtcaaaatgccgaattggcaactgaaattgctatacaggtgtggcacggcgcatgtgatgggagggcacattccttaatgaacacacaattcaaggtgtatgagaatgcgttgtgcactgccggactgttgaaggacaccagcaaaatggtgggccggctcaacaaaatttttgcggaattgctgcagttgaacgcggagaaatcacaaattttgactccatga

SEQ ID NO: 80586 - DNA, 1812 bp, Heterodera glycines
  Genomic contig location: Contig_ID=SeqID_2590; Location=99..1910; Strand=-
  SCN-specific regions: Sequence locations=1-212,236-440,463-513,535 -554,577-828,850-861,883-1235,1303-1812
atgaagaaggaattgagctttacttatcaaatttctggccatgaaccacgctaccattcgtggaccgtgttcaagtcgttggtcgcgagggattacgacgaattaatggccaaaggcaccgccacgacggaatttcacgaccagccgagcagcagcagtagcattttggagatgactaagacagcatcaacaacttcaacagcaacgcccaatgttttgatcaacaacaacaacagctgttcctcttctccgttgtccgttgagacggttcgtccacagcaaaatcgacgccatccgccagacataagaaatgacgcagaaaatggcattgtggagcaggaaaatgcacagttcatagaacagctgaagacccactgcaacatattgcagccgaaaaggccaaaaagacagataaaattggtccaggacaatcaccgagtaagcaaatgcaacaaaaatagagcaaagcgttggaaggacaaagttttcttcagaagctcatcagagttaccgctcctcctccgcagaggcaacaacatctgaccagtggcgtagtaatgtctcacaatcaacatttgcacgtgccgaacacggcaattggtgggaggacgacgacggtggacatggccataccccaacggcagcagttgtccgacagtgaagtgttgccggtgcatcatcattgtctttatcgaattgaccacccacaaattctttcttcgggcactgcgacagacttttcggtccttcagaatttcccggcggccgaagtgaagcgattcatttccataattaacagaaaacatagctttcagcctcgcaatgccgtcaatttgaacaataacaacatgcaacaatttgtgccaacaacagaatcgttttcgtcgccttcctcgtcgtcggcgccaaacactgccattgagctgacattgatgaacggcgaattgtcgatggactcatccgctaccatttctcagtttcatccaattgtcttggacaattcgcccaccaaaacactccccgaagatgtgcgaaatgcttatgagcagatgctcaaagagaattccgtcgattactgtcgacaatttgaacaattggccaacctgcacaatgacggctctccgattaaaacatttgaagaaatcaggcggtagaataacgaactcactcttaccaattgtcgcattatttccttctataaattcgtctaatatttcttgcaatttctttgctgttttcaatttttcagtttatttttcgtttaatatttgtacttttatttttctttctttccttctttttttggcattttcccaatgcgtttttccatcgccccttctctctgtcgtcgtgtgctttgtagacattgttggcctcgtgttcgttttggtcggcttctgtcttcctccgcttcagttccttggcattgtccccaatcggtgaacgccaccaccagcacgaacagcttcagaacatgccgttattcgtcacaggcggctgctgtagcacccgaaaattatgaatttcaggccgaaattaacagtcttttgggcatcgttgcgaagtcgctttattcggaccaagaagtgagtgaaacggacgaagaattgagcatttcatttgattacgtgttcatttattttgaggtgttcatccgtgaactcatttcgaatgcgtcggacgcactggaaaaacggcggtgttcggaattgcaaggcgacgcagccgaagcaacggcaactctcgagctgagaattgaagtggatgaaaagggcaaaaaactcacattcgtcgacacaggcataaaataaa

SEQ ID NO: 80587 - DNA, 3120 bp, Heterodera glycines
  Genomic contig location: Contig_ID=SeqID_2591; Location=1..3120; Strand=-
  SCN-specific regions: Sequence locations=1-208,261-514,551-578,600 -1007,1038-1106,1142-1490,1514-1798,1829-3120
aaagattgtgaggacgcatcagatgagaaggaatgcacatgcgaaggtgcggaacggagggggataaatcaatgacttatcccttgggtctcctgcatacgatagtcataagctcttttgttactatatatgcgttattaaactttaataaatgcgaacctttcctccatttccctttaattattttcacctgaatcttttgaaaaagttttttattaaaaaactgataaaattaattatttaaaaaaataatattttttcatagaatgcacgcgtttttcttcgcatccaatgtacatgtgtaaggaagcgcgacgttgttacccgctggacaaagtttgcaggcccagcagtttatgccctaaggtctccaaaatggacgaattatactgcgccgtgcggacccagcgtggcatcgaacttctctgagaaaatgaacgaaaaatgacgaattcgatttattgaaaatcttttttgacttaaacccactgacatcccaaattacctccaaattacttccaattttcaaagcttttcatatttttaaagaataatattgtgttaaataaacttattaaagattctttgtgtttctctaatttctaagccaaaatttatacgcttatttaatttcgatattatttttaggatgttgtgctttttaagaaatataatgccaattcaagagataaacaattaggtatttgctttgggaaattcacatatttgatttgttggttaccaatgactgctccttgcattgatgttggcaatcttttactcattgatgttgagacggacgccgaaggtttggccagtagcaactcagaacggattaacgaacttacaagcaaaaatgcccagcttttgttcaatgaaatatggaaattacccagaaaaattgtgcaagatgcgacttgttctcaggtgtacaaaataatttgtccgtttaaattataaaattcagcttcccgaatacacttatggccttcctcgtgaaaaacccgtaaattttttaaatttttaattaaataattccaaattctaagattccaaaaccgaaagaaccaacgaaatgggagaagttcgcgagggctaaagggataacaaagaagaaagacaggaaagtctgggacaaaacgactcaggttaatctgagacattggcgaattgttcaatcgttaatatgttaaggaatggaagccgaaatacggatacagacgagccgagaaccaatcgaaggaatggctcattgaaattcccgaccaaaaaggcgagtcttttttttatttcttccgtttttttttgctcattctctcccttcagacccatacaaagattattttgctgagaaggcggaggaaaagcgggaaaagaataacaagcaggagttgcaacggctgaagaacatttcccgcgcctctaacaaatccaaagttccaactgggaacagaaaggtgttcaaagattgatcaaatcaaatctgtcaattgttttatgtttttgttgttttcataaacaattttaatcgagttgctttcaatgaattttgtttgctcgaacatcctttatggtttattgttagattcccatgaaccttttacaattgttgttgcacttggtgccgatgaattcgccgtcacatgtccatggtatgatgcccgatgactcctcaacagcacttatagtgtcgagaaggaggctggcatttaagtaaaagataaaaaaatgcttgaacacgggatttagctaaaaattcaaatattttgtgctaactcaaattcagataaatttatacttaaatttattttttcctccctttaggcctccaaatctgtccagcaataaaaaagcaataactcctgtttcttcaacttgcgtttcggctgacaaaaatgagcataatgttcctctctccacttctgcgggcctttctttgagcataaaaactacggcttctgattttactgcttcgtcctcaaagtgtacaacaaatgcaaattccgttgaaacggttgacaaaactcggcgaatgtattggacctttgacgaacaagcggtgttctacgaggctttgaaattggtaagattttcggtccaattgataagcctaaaccaaaaatttcagcatgggaaagattttgacgcaatttcaaagttcatgctcaaaaagaagttcaacaaggacaaagaccaagtgcgcaactactatttgaacaccttcaaagtgtggaagtgcaaagcgcaaattgaggacgtcgattgggagaacattccacgcgatgcccgggaattgtttgtgcttctcaatggtttcgagtggcgtaaacggctcaaagggttgtcatttgacgagaaaaagttcaagcaactcgtaatggaaggggtacgttttctgtttgattattaattgactttccttcaccaatttttcatttcagtacgcatcttttcgaccgaaaaggaaaaagtttattgtcaatttgaagacgccttactgtccagctttgctcaaatactttccatgtgagttttcgtaattcaatggcatttgcctatgccattacggattttttacttttggttcagatgacagaagaaactgtgaaatcccacaacatttggttgtcagacttaagccattgaggaaccaggacagagaatttgttgttgccagtgagcaaaatccccttttgatggtccaaattaatgtaaatgacaaaattacatctttgttcgaactgctcaaatgtaaatggttacaaaatggcactcaaaaggtaattttacagcattttctttactttttcttaaatgacggttacagaaaaacgctgctcatgtgtacaataataatgctagccgaactgtggtgggcgaaattcggttatttgttggcgaaagtaaccaaattatccacgatgttttggttggaaatgagggcaattcccctctcttgtcgcttagcaaattgaagaaagacttttgtccgatagaaagcaccgaaatgggaaaacaatccatcggatcaggtaaccaattattttctgtaaataattcctgacattcaaaactcagtgtcagtaatgagacagcaaaatgagatcaaagtgagtgctt

SEQ ID NO: 80588 - DNA, 1597 bp, Heterodera glycines
  Genomic contig location: Contig_ID=SeqID_16216; Location=1..1597; Strand=+
  SCN-specific regions: Sequence locations=1-20,63-172,194-196,315 -328,369-415,468-518,540-607,662-706,728-933,998-1597
aaattatacattttaaatgcaattaaatattttcaattaaattattattttaattaaatttagttgaaccgtgagcctcgtcttgcgcagcccattcagctgttgacccgtctccatgttcatgtgttaaaccccgtggacgcaatgcgctcttttctggacgaaggtgacaaaacaaataaataaacaatttcactaatttattaattgaaaaatgttattaaatttttactaattaatttattaaattcaaaatatgatttttgcttttaatttataaaattattgaatttgaatttttgaattttatttttcacttacctaacgcttttaaattttattctttattatattttcaatattttaaactttctaacaaagttctttcattactatacatttgtatgcatttttctttatttaaaatattaattatgaagtattaaatttaaatttttaaattatttccggcgttttgtgttttccctacggcgctttgttggaccgcgcgttggccatgcttggccgtattgaagacattgtgattagttccgccgaacagatcaattacgacgaggtgagctcacaattagtagtagacaattactttttaaattattatttattttaaaaatttatttttaattatttcatttatttacattttaggccagcgatcagcttgatcaactgcaggatttggcacgccgtgccaatgttcactatcgccaagtggtggagccggaggcggaaaagcgcatgagcgaggtgccatagcaaaatttttaaaaaattccaaatttcgaaaattttaaaaccgtaaatctgtggcttttcagatgtacaggctgtcggcacagcagcgtctgcaacggttggactcatttctggtggagagcagcatgagccgagtggaaagagtagggcacagagaataataaattattattatttttttttaatggcatcaattttaaataattaatttcaaaatattgtccataccacttcaatttgtcttgttggttagcccttttcgcgaatgaattaattatttttgatattttgaaattagaaaaaacggacattcgacaaaaatgccatttacaaaatatgggactgtcgagagaaaaatgaatgccatttgtcgccaagttcctaacttttttggcactcattaaattttaattgctttttgaaagtgctttattatccaattaggagttgaagaaggtacatattttcattggccagggattttcaaatttttggcactcatttaaattttactgcgttttaaaatggcctttttcacccaattaggagtcggagaaggcgcacaatttcattgcttgggatctcggctttttttttgcactcattaaatttttcaatgccctttaaatgccatatttaatcacccaattaggagtcggagaaggcgcgcaatgacatgcgctgggagttggagcagttgaaggaccaaaatgcgcagctgaaaaaggagaaccgggagctgaagcatttgtgcgtccgcttggacggccgcgttgacgttttggagcggaagttcaaaacaatggcacggctgctgcaa

SEQ ID NO: 80589 - DNA, 1487 bp, Heterodera glycines
  Genomic contig location: Contig_ID=SeqID_16217; Location=31..1517; Strand=-
  SCN-specific regions: Sequence locations=1-604,646-871,908-1001,1023 -1073,1096-1109,1132-1456
atgaattcggccgatgaaacaacggcttacggtagcaaagtgggcaaattggaagcgcaaattgccaaattggtcaatgacggcatcaaagtcggcatgcgattggcggagttggaaagaaagtcaaagtcaatcgaacattcaaaatcggacgaattcaacgaaggaaaaagaaatgaaatggcaaattatgacgaagaaatggagggggaggagtacggtagggaacagagcgaggaatacggtaaaagcggcgaacggagggcaaagggcggagaagcggcgagagcaaaagcaatggaagcgggccgattggttgacgttttatcgccacggtttatgagcgtcacggccagcaagtcgaggggaaaggtgccgaattttggcagaattgctcattgatcagctccacgcggatcagagggggcgggacagggacgaaacgcgacaacacgtccccggccaactcagtcccaaacggtttaagacactgtactcagctagttcgggttgatgggactgagttgatctcctgctgcccagcaggaggccccctttcacccaaattcctgaaaaactattggaatgttatattatacctatctatatataattcaaaaatagaaaatttttatttttatttttcttgttttaggctaattttctgtccccatcactgttcagcctgcacacaaaagggcatggccttgaaaggcaaatgagtttgccaaatttgatgaaggagggggtccatttagtggaccgagaccaaaacgaatggcttaatctgatcatggaagcatcgggggtcaacgagcaagtggacacagtgaaggtggatggaagaataatgcaaaaacaattcattgacttaaattttaaaatatttttataaatttattattttgattgctcacagtctcacctcagatcttttatgtccttgaaaaggaagtttttatattcctatagcagcatgtccttccaaaagacgtccttgaaaaaagaacatttcatttccaatgccccagaactatcatttattttgaattccccaactagctcatctcccctagcaaacctttagcttgttttgtaattctatttagctttttattaattacaatttttggatataacttaagtcgtccatttggctgaaacctcctccaattaaaggaaataattttcaccagaattagcaatgatttacaattctcagcatttgttgtcctctgctgatgatgggtacggcactgatgatgagattgccaaaaaagtggagaaacgatacaaacgcgaatttgatggcctttatctgacgaaggaaaatgtgaggagcaaatgggcaaaatggacaattgttcactcgttgatttgaaaggtgcgcgaaatgtatggacagaacgaacaacgaaaatcggacacatgggaaaaattggtgcaaaatttgagcaaagagcaagtaaaatgaaaaacaaaataaa

SEQ ID NO: 80590 - DNA, 742 bp, Heterodera glycines
  Genomic contig location: Contig_ID=SeqID_16217; Location=1744..2485; Strand=-
  SCN-specific regions: Sequence locations=1-75,100-244,267-280,302-742
atggccaaatgcatcgttcggctgttgaacaacgaattcgaaattgagctcaaaaatggcaaaattgttgctggcaccaaaaatttggtgaaaagcgaaaattgggtgggacaaattcgaatcgaaagcgaaagtgccgaagaaaacggacaaacggaacatcagaagaaaaaggcagaaaaaggacacgaaagcaattcagcagtagaaaaagaaactgttaatggtaaataaaatgccgaataatgggaatgaatttccttaaatgaaattttcgcaaatttaataatgtatcattgtataattaggggtatgggattttttgactatataattaacctaaaaagtgccaaaaattgagcgaattctgtgcctgttaattaatcacttccaattgagagctttttcttttttaatttccggcattatttaggtacaagtaaaaccgattattacagcgcaaagccaaaatttgaagttgccaaagtgcggaaaagggaagcagtttttgccagagaccaacggcatttagacaaagactttttggcaagaaaacgcaaaaatattgcaatttcgaaaagtcattcatacaatttgctggaggcaaaacgaacacttggcctcagtcccattggaggattggcacgctttttgatgagcggcatattgggaaggaagaacaaaacacggacaataccgtaaaaggaatactataattcaaattaatatagtaaataataaa

SEQ ID NO: 80591 - DNA, 1204 bp, Heterodera glycines
  Genomic contig location: Contig_ID=SeqID_16219; Location=240..1443; Strand=+
  SCN-specific regions: Sequence locations=1-4,42-72,94-142,169-200,257- 391,430-1204
atggtgctgctgctgctgctgctgctgctgctgctgctactccgaccgatcagatcatcggatcatgggcggatctgggcctgtgggtgtggtggaatgagggtgaaagtggaagaaagagaagcggaagggagaagccggttcatggagagaaaggaagcagcgggagaagcggaggcttttgcatgaaaagcatgcgcgagagaaaggggggggggagagagagaaaggaagaaagagagaaatcagagagagaagatggctggcagagtaatcagagaaagcattggaggggaatctcatggatagggaaaagatagagagtggattgaaagagcgagaggcatgcatacagctagagaaaaatggatgatttaaagaagtcagaaaggagcgaaagagagtgagaaagagagagagagagagagactagcagagaaaaatgtgatcaaacgattggaattcactttcagattcaatcatccaaatttgatgggttttggtgcccctccaaaatgatatctgatcactttaattatgctaaaaattccaatttactaaaaaatttcaaatggcaaatcgatcaatcccccgcccccgcattatccaaacgcaaatctgcgactgactgatttaagtaaatccatccccgctgctcgccctcctactccgtcctccgtattcgtcgtgtgtcctccctccctcaaactgcccctccccttcccccccgtccccgttgtccccgtccccgcgcgcgcgacagccctgacccaatttggggggggggggggaattagtgctctgactgctggttggaagtggtggttgtcgagttggaattggtggtggtgtactgctccgctggtggaagaggtcgtcgtcatccgtccgtcttccaattccccgccgtccccgccaaaagcgcatttccccgcccgctttctccccgaaattgcgcatgtttaatccgccccaataacaccgatcatagctggcgcccccgcccccccggactcggcataacttgcaaaaactggcgactgatcactctgatcatcaggcatgcctgatcggataaaatgccggttccccgctttctttttagtgcccgaaattgcttttttaaaggtcaccgcttctatgaacacattaatcccgcttcggcggttcgtcccaatttgtagcaaaggatcaatgatcacta

SEQ ID NO: 80592 - DNA, 1302 bp, Heterodera glycines
  Genomic contig location: Contig_ID=SeqID_16220; Location=97..1398; Strand=-
  SCN-specific regions: Sequence locations=1-92,114-1170,1192-1302
atgaatgagatagtcaataaaaaggtttttcgagaagtgattgcatggatgtatccggtagagaaccaaggacggggactaccgcacttccatttgcttttgacattggcggagcaagacaaattgattaatggtgaagatgttgaaaagaaaggaattagtgcgagaataccggacaaggaattagaagcagaactgtttgatttggtgaaaaggtttatgatccatggcccatgtggtaatttgaacccaaattgcccatgcatggaagagtttgttgacaaaaatggtatgaaaggaaggaaatgctctaagggataccctaaagtatttcaagaagagacagttgttcttgaaaatggattggctttgtatgcaagaccaaatgatggaagaacagttcaagtatttgcaaatggaagaagacatgaattagacaacagatgggttgtcccgcacaacctgtacctgttgaaaatgttcaagtgccacattaatcttgaaaaggttaatagtgttagttcagtaaagtatttgcataagtatgtgcataagccaccagacagagcaagattggaattagaagagaaaaatgatcatgatgaagttaaagagtttattgatgcgcggtatgtttgcccacaagaagcagtttggagaatttttgaattgcctatgtatgatagaagccattgtattatgtctttgcctgtacacctacaaggtgaacatatttgttattttgacgagaatatggaagaagaagagattcgtgaaagaattgcgaatggttctgagttgatggcatattttgaattgaataagacaaatgttttggcaaaaaatttgttttatcaccagatacctgaaaagttttgttttaagaaaggaaaatggacagagagaaagacatattttaacacaattggccgaatggtgaaggtgtcaccggctgagccggaacgataccacctgaggctgttgttgttaaatgtgaagggagcatgctcctatgatgatttgaaatcagtttttgatactaatggcaatgcaaaagtttgtgaaactttttcagccgcatgtttagaaagaggtttgattagaaatgatgaagagtggaaaagagcattagaagaagcagagagttttgagatgccatggaaattgagagagttttttgcattgattttagtccattgcccggccaaaccggaagagctttggaatatgtttaaagactcattgtctgaagattttagcaggaattttagaaaagaagtagcttatgctaaagctttataa

SEQ ID NO: 80593 - DNA, 452 bp, Heterodera glycines; identical to SEQ ID NO: 65604
  Genomic contig location: Contig_ID=SeqID_16221; Location=98..549; Strand=-
  SCN-specific regions: Sequence locations=1-41,64-131,163-244,266 -387,409-452

SEQ ID NO: 80594 - DNA, 635 bp, Heterodera glycines
  Genomic contig location: Contig_ID=SeqID_16221; Location=979..1613; Strand=-
  SCN-specific regions: Sequence locations=1-118,140-254,311-483,522-635
tttggctggttatccgttgccttttaagcgcccctcgggatgggaggagccctatcggagagataaaatgggggggggggggagaagggtaaaggccatttccggtcccggccttacacctccggccctccaaaagaccgtccctggtcgttaaaatttaaataatttccaaatttgaatgaagtcctcagactttttctttcttttgatttgttttacgatgagaaatttgttttgattttaagccaaaactgaaaataaaataatttaaatatttatttaattactcaaaataaaaatggaaaatgccgaacctctaatgggaatgaacccattcctccaaccaatccacagaagctctgtcattgagctactaaaagaaatccgccctttttaaattaattttcttgaaattctgattcaattggatttgaattaaattggcattgcttttcaaattatgagacaagagaaaatctgatgaaatttaaaacttttaaaattatataaatttaataattgtttcatttaatttccaatcgactaaaatttggatttttgatataatttggtgtgactgtatgactatacctccccttcatatctgaggatcgtccctgatccaagaacttaaa

SEQ ID NO: 80595 - DNA, 463 bp, Heterodera glycines
  Genomic contig location: Contig_ID=SeqID_16221; Location=964..1426; Strand=+
  SCN-specific regions: Sequence locations=1-129,168-340,397-440
atgaatcccgtgggatttaagttcttggatcagggacgatcctcagatatgaaggggaggtatagtcatacagtcacaccaaattatatcaaaaatccaaattttagtcgattggaaattaaatgaaacaattattaaatttatataattttaaaagttttaaatttcatcagattttctcttgtctcataatttgaaaagcaatgccaatttaattcaaatccaattgaatcagaatttcaagaaaattaatttaaaaagggcggatttcttttagtagctcaatgacagagcttctgtggattggttggaggaatgggttcattcccattagaggttcggcattttccatttttattttgagtaattaaataaatatttaaattattttattttcagttttggcttaaaatcaaaacaaatttctcatcgtaaaacaaatcaaaagaaagaaaaagtctga

SEQ ID NO: 80596 - DNA, 500 bp, Heterodera glycines
  Genomic contig location: Contig_ID=SeqID_16221; Location=2543..3042; Strand=+
  SCN-specific regions: Sequence locations=1-327,351-500
atgaccgcccacggggacaaattggccatcgttgagccaaccggcggagtaattgtggactcggaggacgactacgaacatcgggtaaacgaagagttgcctcggaatatgcattcttaatgacaattttcatccctttttattactttgatttcacatttcgaattgctttcttttttaattaatctttttcaggtttcggtctccgtttacactgtcaatgcgttgtccggcgactgttgcgctccgtcgttggattggacttgtccaattccgttgtcgcccttctcccgcctctgttggctgaattttacagccgttggaaagtaaaatataaaatttaaaaatatcaatcttttattccttttcagtttggcaacaatggacgaaggtatcaaacaaaccaaccagtccttgtttttctgttcatgtggtcttaagaatgcactgtccgtctccatttacccggccctaatggtggcgtcggtctttggcttccg

SEQ ID NO: 80597 - DNA, 410 bp, Heterodera glycines
  Genomic contig location: Contig_ID=SeqID_16221; Location=1847..2256; Strand=+
  SCN-specific regions: Sequence locations=1-12,34-249,286-290,312-410
atgaaattgttttataaaaaagttttgagatataatgacgtcaaaaggtgcaagctcatttaatttttgagtaacaacaatttttagttttttaaatatggaacaacgatcacagaccatttgtggaaggataagagccttaagaatgtatacatttggaattgagctaggcattgatgacttagctaactttgttgcgcacacaactcccccagcccaggtagacatcaaagtgttagtatatctcaaattgaaattggcttaatttttaaaattggcaaatttgacctcattcagctccgttcaactttggctttggcatttttcgacccgacgaggcaaaataaaatggccgagtttactttcgcccaaattttggctgtcactcattcgaagtgaattttgtgaaa

SEQ ID NO: 80598 - DNA, 1564 bp, Heterodera glycines
  misc_feature (317)..(317): n is a, c, g, or t
  misc_feature (343)..(343): n is a, c, g, or t
  Genomic contig location: Contig_ID=SeqID_16222; Location=1068..2631; Strand=+
  SCN-specific regions: Sequence locations=1-88,110-350,392-447,470 -592,619-1402,1425-1564
atgtacccaatatgtaagaaaatcccgaaatatgtaaatatgtataaaaacgccgaaaaattaaaagtcaagattcttgttcgcaaacagaaaaataaagcgtttttcctactatttgagcatggagaagccaggaaaatatctatttacataaaattggcagccctaataattaagcatttatgtaatttcagcatcaaaaaattctaaattaaattcgaaaaaagcatgaaatagcaaaacaagcacaaaaattgaaaaaaaggtataaaaatttagtcatttttaggcaaaatttttttatcagttaacattanattcttaattttctttttcccactanagattcaaatattttcttttagcaaaaatggcatttttaaataaaaaatgttgtcaagaaagtggatgaatttttgagagtaaattttgcatttcttaggggatgtattttttgaaaattttaatcgatgttagggttttgtcttagggtagtgctggtagacggtgttttcgtcaatattttacaaaaaatgtcataagcactaaatgctaaaaatcacatgctcagcattaagcacaaaaatacgaatttaaacaaaaataagcatgaaaaagttggacctaaaagcctaaaaccaagttagaaattagttttcatgcttattagcacgccccaagttagcaaaaaatttagtgattgctgcaaagccggtcttattgttcgtcataactagagaccgacttttgaggcatatgccttttttctgctcattagttccggtatattacgcataaaaaatacattttgcttttggtttgaagcttctacattgacttttattatgcctttttttgtctttttcgggattttcatgtatttaatgcctttttggcattttgccgttttggtgtctttttagcgttttttccaaaaaatccattaaaatgcaataaaatcgggaaaatacactcctaagaaatgaaaaattttctcaaaaattgattaccaaattatttttttcttgttaaaaaattttaggtttaattattccttattcgaaaaacattttcaagcctagtatagtgcctttttcacgatttttactgaacctgcccgttgtgcaacaataacccgttgctgtgcatcattcgcaaccacaaaacaccgccccattctcagttgcacaacaatcgcaaccacaaccatttgcccctgttcaggacccaagtattcgtcagcatctggttcagatacttcagcaacaacaaacgcagcaacaccaattccaactgtcgccacctttgcagcgtgtcaacaaccccgggctaagcattaatccagtccgaatgataacatcaggtcaattgatagccaatcgtcaacaaagtcaagcgcagttacaacaacagcaacaagaacatttgttgatggattcgccaccagcggcacgttcgtccagcctacaccaacggattatacaacatatgcagcaacaacagctaccgcagctagccgctagactcccgacaatatcagttgaatagaaaatatttacgaaaa

SEQ ID NO: 80599 - DNA, 434 bp, Heterodera glycines
  Genomic contig location: Contig_ID=SeqID_16224; Location=41..474; Strand=-
  SCN-specific regions: Sequence locations=1-148,177-434
atgcccccaaaacgtaaaaatatctatttggagagctacgaaaaagaattccggcacataaagaaaagtcgaaaaggcgaagaatttgccctttgtgtcgtctgcaacgatgatattaacctactttccattgggaaagctgccatttctcatcatcaaaaaactggaaaacatcagaaagcggcaaaagcagcaaaccgatcaattccattgcaggaatttttgccaaatacttcggccccatcaactgaagaccgtaaagttctggctgccgaaggttaacaggcttattctgatcaaaatttttctaattaataggcactatcgcgtatcacactgcacaacattgccaatcttttcgctcggtggactgtttgtcatctgacggattgttgcgcacaatttttcctgattcaactattgcgaaaaaataa

SEQ ID NO: 80600 - DNA, 799 bp, Heterodera glycines
  Genomic contig location: Contig_ID=SeqID_16226; Location=16..814; Strand=+
  SCN-specific regions: Sequence locations=1-212,234-243,272-799
atggcattccgagacatcaaaaattttcggaagtcggaattcggagggccaaaatgtcgtaagtcggacaaaggaagtcggaaattcttgaaaaaaatataaatactaaattgaaaattcaaaacagaaataaaagtaaaatgatttcaaaaattattttcgctatttacaccactttttcgcggacgatcggcggtgccggtaggcgtcgccggaaaaattttgaaaattttaatgtaagcgttatttttgaaaaaattttaaaaaatttccgatttttatcagattttgtgagtcggaattacgacctgaaaatgtcggaactcggaattccgtgccatctctagtgtatgtattgaaaaagtaaaaaaaataaggcctaagaaactgacgattatatttattggatgcgtaaaaagagtagctaatcttcgatatttcatagagctttaaaaagcaccaagattttgttggattcaaactcaaaaagtcgcatataaccagttacaatttgtaggcgtccaccttttgccggttgcacatgttgcgccacgctttgcatcagtatgatgactagggcagcaacttttagtgaaaaaacttttttttgctcaattgttttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactatttcgacattttttgggaaaatttctcaacaaaaatgca

SEQ ID NO: 80601 - DNA, 200 bp, Heterodera glycines
  Genomic contig location: Contig_ID=SeqID_16226; Location=628..827; Strand=-
  SCN-specific regions: Sequence locations=1-200
tttccgtttttattgcatttttgttgagaaattttcccaaaaaatgtcgaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaattg

SEQ ID NO: 80602 - DNA, 952 bp, Heterodera glycines
  Genomic contig location: Contig_ID=SeqID_16228; Location=1..952; Strand=+
  SCN-specific regions: Sequence locations=1-420,442-489,513-837,862-952
ttgaagaggaatgcacgccgaactttgctacgccgaattgcttgtcattcgtgcacttttgacttttttcatcgacgaaactcttggcggcttcatcaaaggcgcctttcgcattcgaatgtgttaccaatcattcaagtcagcccctccggcagtgccattgccgcaatttaatcattgaataataattgtgatgactaattggcctttctcccccatttcctccagagaatgccatcgggtgctccgttcaattcctccgtgccatctttccgcttgtccctcttcaaatccgtcgctgcgacgtcagttcgaggccggcatccgtgccggcttcgggttgttcaacgtgatgctgtccgcaatgcccacccgtgtgtccgcactgctccaacttgtcggcttctccggcgatcgggcaaagtccaccaattcccaagagttccaatttccctttacaggactttgggatgtccgaactcgtttcggtctgtcctttctttcttcctttcgaatgcccctttctcccacagagtgcctcaatggcggacactctccgcgcgcccctcgcggcaatggttttgatcaggcgagtgcccgggttgcccatccttacttattctgttcctgatcagttaccaactcttcctggcccatctgctggacggatgtccgcccgatttggcgttgtgttcccaacttttggcacctttggtccgccaattccccaatgtccgtctccatttccaaattcgtttgtccattgtcctttttctcatttgtcagggtgccgttgtgcttttccttcgtgcccgtttccatttggtcaacggcgaattgaacagagccattcagttgaacaacagatccattcaatcgcagaacgtctacaaacagttccagcacatttgccattgggaattggtgtcagcaaatagaatatctttttttt

SEQ ID NO: 80603 - DNA, 303 bp, Heterodera glycines
  Genomic contig location: Contig_ID=SeqID_16228; Location=613..915; Strand=-
  SCN-specific regions: Sequence locations=1-54,79-303
atggcaaatgtgctggaactgtttgtagacgttctgcgattgaatggatctgttgttcaactgaatggctctgttcaattcgccgttgaccaaatggaaacgggcacgaaggaaaagcacaacggcaccctgacaaatgagaaaaaggacaatggacaaacgaatttggaaatggagacggacattggggaattggcggaccaaaggtgccaaaagttgggaacacaacgccaaatcgggcggacatccgtccagcagatgggccaggaagagttggtaactgatcaggaacagaataagtaa

SEQ ID NO: 80604 - DNA, 528 bp, Heterodera glycines
  Genomic contig location: Contig_ID=SeqID_2592; Location=841..1368; Strand=-
  SCN-specific regions: Sequence locations=1-314,347-473,496-528
atggcgctgaattggacttttcggaaggagtgcgtcattattttcgtaatgaatttggtcaattatgtttccttgatgatggcaatggtgcactttttgtactcccgtagagcgaaaaaccgaaagagatactgtatagtaagttgagcagatgaaaatttgttcggatagtattgttgatttgttcgatcaggacgggacactttggcgccaaacgttaatgcatttttcaatattcaagaattattaccctgtaaatttaacatcaaaatgtcccgcgccaaagtgattatgatccttaatacatgcctattcttggcttgttgttgttgttgacgataaattctatgtcttttagttacatttttcagtcttaaaatcaaaatcatcaacggatattagaggcgcaacagcgatgccaatattcagagtgaaatattggaatttagttgacttccaacaaaggaaagcacttttctagggtaattttattatttgttaatgaaaacttcaaaagaacaaaataaa

SEQ ID NO: 80605 - DNA, 2924 bp, Heterodera glycines
  Genomic contig location: Contig_ID=SeqID_2592; Location=3754..6677; Strand=+
  SCN-specific regions: Sequence locations=1-448,471-1858,1880 -2216,2242-2924
atgtctgggccaatacaaaaagggatcatcaatgcactcaaagctctggacaatgccaaaagcgccacctcactccttctacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccacagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactctgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatgggcatcactacgtccaaccaaaagcagaagtcgtctcagcagcacctgtacaagcaccgagaacaccaaaccaaaggtcacgaaggcctaaccaaccaatggcactgcgtgatatgacatttatagcctcatcactggacgagggtcacagacatcaagggtatgtaagccaacagcacacacaacaagcaaagaaacactgccaacaaatgcgaaaccaagtacaaagcgtcaaaaagggtccgccatacccctgcattttctgcaacagcaatcattggcatgacgaatgccaaaacgtcgacacactcaaccaacggatcagcatcgtcagagaaaagaagctgtgcttcaaatgcatgaagccaaaccaccgcgcatcaaattgcgctcgaccatctaagtgctatcactgcaaacgtcggcatcccacggcactctgccgagatcagtacaaagccgagaatggcatcaactcgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgaaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcaagctcaagcaaccgtccaacatctctttcgtgctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaatgcctatggcagtgcaacggctaacaccaacaaggaagagttcatcagttgccatgcgaccagcattttcttccagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagacgttaaactaagctaatcaccaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaatgaca

SEQ ID NO: 80606 - DNA, 492 bp, Heterodera glycines
  Genomic contig location: Contig_ID=SeqID_2592; Location=6922..7413; Strand=+
  SCN-specific regions: Sequence locations=1-492
atgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcaccctgcgtcttctgcaatggcactcactggaccacgacgacgactcagcgaacaacccttgcaacgagagcaaggacacgaatccagtacgtcaccaggacgagaacgcagaccacgaaagagccaacgacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagagaatgcccattcgccaagtctgaaatga

SEQ ID NO: 80607 - DNA, 1919 bp, Heterodera glycines
  Genomic contig location: Contig_ID=SeqID_2592; Location=7750..9668; Strand=+
  SCN-specific regions: Sequence locations=1-1129,1151-1171,1194 -1378,1400-1528,1553-1586,1633-1805,1827-1885,1910-1919
atgcgccagaactcatcgcctgcgatggcacgcacacgcatcgtcatgtccgaacagaacttcggaattgccaaggagcaatacgacgacattgtcagcaccacgacacgatggaaaagaggcatccgaccagaacagctcgcatcacagctctcggcatcccaagtggcaacaagcgttgcgttaaatcagctctacacgagggaatgtcagcgaaacacgagggcagccaacccgactctccaggccagacgcttactacggcaaccaaacatccaagctcgttggatcggcgaaacgacaatggaagtgtttccatgtgtcaacatttcgctacaggacatctcatacaggccaatgaatgaatgtcgcctctacattcccgtgactgcgcactttcccgaccgagctatcgcagctttcctggatccggaacttcgcatcatctcgctgacagcacaacaggcaagctgtaatagctaccggttccatcatcttcaactgcgaagcaatcccaacatctggttacggatcgactctcgaaccggcacagcacgacgaatgccaaaagattacgtgcacgaattgtacgaaacaacgatcaaccaaacaaacagcaacttggaacttcatccattgatcttccacgcatggcaactcgacaatgagtctgacgcgacacgcttcccgcacatcaacgaattcatcaactcggagcagttcaaggacaagctggaacagcacattacagcaaggactgaagctttgggcgcgttgaagggcggaatagaaggattcaccatgcgctggctaaaaggcctgatcgacgaagcaatcacgtggtggattcgagtcgcctgcgtttattcaaccttcctcatgctgcgcgacattgttctcccatgcactctggcgtatttgctcaatcccatccgagtgactcttcacagcctcgttggagtacgcccgcacccgacattccgacccaccgtttctaaaccactcgggatcgaagagggaatgccgctgcgtgaaatgccacgaacccccaaaccaccagcgcgcagggcagagcatcgatccatgtcaccaatcaaattggacatgattgccagaacggctcggtaccaacaaccactaacacagagccatctcgacctcacagaagactcgccctttgggaggccgagacgaaaagaattctgacgggccccatcctttttcgcgccggaatgtcggaatttttattcctatcgccgatcaatgatcggcggaattaagagggaggaggcccttcaccaatcccccgcccgccgcgcgacatgttttcgccgttccatccctctgtccccttttccttcaaattgtcaattgtttttgtgtgttcctcccccactccgcgcacaaattaatgaccaatttgtcaaaccgcaactttctgcccccgtccccaaatttggcgaatcgactccaaagaacgatgaacccccaaatttcccgttttccgcccattttgttcatctgttcattttgtcccccgtttttcatttcgtgcccaaattttcggcccattttgttctgctcacatttgccactttttatttaaatttattgttatttaagcggccaaaaatgcccccaatttcacaaccaaaattcattaggcatttttgccgtttctctcccctcccttccatttgcctttaactgtgataaccccattcgtgatcattctttgacccccggttattgatttttgttctgtggccccagtgccctccatttcctgtcccatcccggtgcccaattccatttgtgataattccccggtgatggcatttctgtgatcaatttgtgataattcgttcaccatttcaaaatttttgtttaattacccaagtttgaggtcatttcccgga

SEQ ID NO: 80608 - DNA, 990 bp, Heterodera glycines
  Genomic contig location: Contig_ID=SeqID_16231; Location=354..1343; Strand=-
  SCN-specific regions: Sequence locations=1-146,186-239,261-391,414 -472,495-876,898-990
atggccaagtgagttccgccaactacgtcccagtttagtttaagaagccgtaacttttttttcatgagttggatattttataagtttggcactattaaatgctctattagatcaggagataacgactggaattaaaattgtccttctatttttgaaaaaattacaaaaaattttttttataaattcctgtctttggtctcatttttaattgaaaaaatgtcagcaaaagcgcaaacaacaaaatttaattcactaaaataaaataaatggaaaattttttttatctcgtggctttttgtcgcgttttttttaatttgaaaatgaggccacaaaacaggaaattaccaatttttttaaggaatttcatcgccggacaatacctaaacatttgaatattaataattattatttttcgagcggttccaaaaacatataaaatttgataaattaaaaaaactgattgcttcttaaacttggctgggcctctgttggcgggactgagttcggcggccaccgcttgggcgccggtggtgaacaaacattcgattcttgggtggtggaggacacatataataaaatggttggtcactccttttgcgcccgctttgctgcacacaaccaacaattttgccggcagcggggtccgtcgctgtttttacgacggacggacgacccacggtctcgcggaccatttgccgtccgtcgaatgacccctaggggggggggggggggggtaggcggcgaggggtggcaaacgcataggtcattgagcaagcgggaaaattttgatcgtcctcccttaaagaatttgtataagaaacaatattcagtgaagaatgcccattactgttccagactctcgaagttgtcgatgagcctcgaggatttttggggatctctgtatcaagttttttggcaacgtctcggtactgggatttttctttacttcatttggaccctattccgtaccacgtgtactcctcgctctaa

SEQ ID NO: 80609 - DNA, 483 bp, Heterodera glycines
  Genomic contig location: Contig_ID=SeqID_16231; Location=2167..2649; Strand=+
  SCN-specific regions: Sequence locations=1-117,139-199,221-236,261-462
atgaaaggttagagaacaagaggaaaaagggttttgaaaatttgaatttaaatcaaaaatattgtcgaaatttaaatgggacagcatcaggatgaacatagaaaattgtaagaaatttggctaaataaataaaatttgggtaattaattatctatgatatggcccggagccgaaaatggccagaatatgttttcggaagtttttggggacccataacttttgtcaatttcattttgtcaaaaatttttgaggaaatgattccggaactcagggattagttcccgcaaaaaataaatttaattcgttcaattacggaccaagaaagaatcaatttgtctatatttttttggcagttttagactacggtctaatgatcaatattttcggttaaattttgttagtagacttttcgaaaattgccgatttttgaattttgagtcaatttcttaaagtatttagcggaaaattaaaattaaaaattca

SEQ ID NO: 80610 - DNA, 591 bp, Heterodera glycines
  Genomic contig location: Contig_ID=SeqID_16231; Location=3594..4184; Strand=+
  SCN-specific regions: Sequence locations=39-116,251-591
atgaaattacacataatattttctttacttttatttttgatcgtcttaataaaaattaattatgttgaagcaaaaaaggaaaagttgcaacaaaaatcatttgatgaaatatttggagaaaaatgggaagaaaaagaagaagaaaaacgaaatgaactcaaaaaaagagaaataattgaaaaattttataaaataaaagagaaaataaagcaaaagggaagaaaatactcaagaaaaaaatggaataaaattaatttgaaaatagcgaagaagttgggcacaaattgtaattatatttataaatggattaaagaattagggcttaatcaaaaaatacataaatgtcacaaatcaaaaactgatgaagaaaaacttgaaattgtgcaaaaatttatagcaatgaaaaaagaatacaaacaaataagaaaatattcgccaaaagaatggcgccaaaattatgccgaaatttgtaagaaaattggagtaggccgagacataattaacaaatggaagaaacaatttggcattagcaagaaaagaataacggagagagaaatccaaaaatgtatgacaaggaaattgcaaaaatga

SEQ ID NO: 80611 - DNA, 581 bp, Heterodera glycines
  Genomic contig location: Contig_ID=SeqID_16233; Location=520..1100; Strand=-
  SCN-specific regions: Sequence locations=1-163,198-581
atgaacggtttgctattaaataatttcattccctctgtgattttcggtggaaaagtgttcatatcttcgaagttacatttgacagaagaatcctgcggcctaatttgtttttttttcgcgccattaccttcgaacaatttgactacctgaatttgaaaaagtgaaaaattattttcatattttttatttaatttataggcagggttcaaataatgaaattaatgaactaaaatattttgcttgcagcaatatggactctggcgctcaatgccgttgtgtttttggcactgatggttcataagcgaattttggctgttgaaatgttcctcacccaacacggcattgaaattcccaaaagacctaaatatggactaatgaaaaacgcaaaggcaataggaattcagaataaaaattcattaaattaaaaatatgaactaataatagcaattaaaaataacactgaaaagggagtttagcatttgtcaatcatcagcgagtcgttacttgattttaattgattgtttaaagctttgatttgtatggaaacatgaactaaaatgcgtctgcgctataaaaataaa

SEQ ID NO: 80612 - DNA, 1763 bp, Heterodera glycines
  Genomic contig location: Contig_ID=SeqID_16234; Location=467..2229; Strand=+
  SCN-specific regions: Sequence locations=1-442,470-611,633-727,764 -764,786-967,991-1343,1365-1399,1422-1763
  Gene Ontology: Mol. function=pyruvate kinase activity; Biological process=glycolysis
tcgacgacgccatactgtgcaaagttgaaaatggagggaaattgggcagtcgcaaaggggtgaatttgcccggaacaccggtcgatttgccagccgtttccgagaaggacatcaaggacctgcgttttggtgttgaacaggtgcggttatctgtggcattttattttatttaaaggcacttttcgatattttccttgattttttgtttaatattttgttcctccaaattttcagggcgtcgacattattttcgcctcgttcattcgaaacgccaatggcatccaaaccatcagagaagtgttgggcgaggcgggcaaaaacatcaaaatcatcgcaaagatcgagaaccaggaaggcgtggacaatgtggacgaaatgtgagtttaagctgaaagacgaacaagggagagaattcaaaaacttagaaagttcgttgtataagaaaattcttagaaaaaataatttcaaaaattttcagctattgtagaaatttttgaaaaatcctagtaattcgctgaaaatttttgatattggagtgggaaacggagtgcacccattttttctatttttacagcattgcggcatcggacggcgtgatggtcgctcggggcgacttgggcatcgaaatcccagcccagaaggtgtttctggcccagaagatgatgatcgcaaagtgcaacatggccgggaagccggtgataactgcaacgcaaatgctcgaatcgatggtaaaaaattagggttttaaaaaatgaatgaaagtgtgtgtatttaatttccaaatttgtcattaggtgaacaagccgagaccgactcgtgccgaggtcagtgacgtggccaacgcagtgctggacggctcggactgtgtgatgttgtcgggcgagtcggccaagggcgattatccggtggaatctctcaaaaccatgcacgacgttcgtttccctcgttacatttgataattaaagactgaaaatttaatttttcagatttgtctggaggccgaaaccgcctttttccactcgaggtacttcgaggagttgttgcagaacacgctcagccccaccgggccgggcgaaaccatcgcaagcgctgccgccaacgccgcgaggagatgccgggcaagcgcaatcattgtgctgaccaccaccggaaagtgggcattcatttttttattgtttgaactatttgcaaaattaatttattgtcctaattccaattacaaaaaagaggcataacttttgaacaattgcattctgcagattctctggtcaggagcaggtcgtttccctctcccttttcgccgcccctccccccgaaaatcttgaattttttttattacaagacttagcttttcctttggttttgaattataaaatttaaaaaagacaaatatttaaacctcaaaattttgaactttttccagtgaaatatggactataaactaattaataatcaaaataaaatatctgaaaataacaatttttcaaccgcaacacacccaacacgcactctcaggtcggcccaggagtgttcccgcttccgcatgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtggtgattgtcaccggatggcaagcgg

SEQ ID NO: 80613 - DNA, 1783 bp, Heterodera glycines
  Genomic contig location: Contig_ID=SeqID_16235; Location=67..1849; Strand=+
  SCN-specific regions: Sequence locations=1-285,319-352,374-853,876 -1318,1352-1758,1780-1783
  Gene Ontology: Mol. function=N-acetylglucosamine kinase activity; Cellular component=soluble fraction; Biological process=N -acetylglucosamine metabolism
ttccgattggtcggttgaggaacttttggtggcgcagggaatgcgctgttctctgatcagatgcgtggacactgatcagcactcaatttgtcttgccaagtttgcctgcacttcgccaacactgtcggccagtgccaatttgacatttgccggcgttgaagggtatttccgggtcttgggatgttccaaggtcacaacacactccatttcgtactcatttttactttatgggagcaattcccgaatttcactctgtcgctgtggcctgacatattgctgctctgcgttttctccctttttcatttcgtttgtttattttatgggtgccacccactccactctcgttctgatcacttccactggctcttcttccattcaaattgttggccaatgggacgacggtcccgcgctcaactgtctgttgaacggcgtggaaacgacggccgaccaaatcgccgcatggctgcgatgctccgttagatccatcaaagggcccatttcgttgccaattgcctctttggtaatttacttttttcgccttttgatcccccccccccaagggaatgggcctttcgggcgcggaggacgaaggcaccaacaaacggctgatggcttatatgaaggcgcaacacggagacttgacacacaattttctgcttaccagcgattcaattgccgcagctgcaacttcgttcgacaaaggtcgtaaagcatatgcaactttcactgctttttcgttgttgttactgcttttattttttgtcatttggtagccattcaaattacaaaattttttattttccggtggcattgttttgatcgctggcacgggctcggcctgccgtctcctcaaggcttggacaaatctctgaaatgtaacctttcatttgttgataaatttaggaaaatggcgaagtgtttggaggttttctgttgttttacgcttttttgatatttttttaagttggcggttgggggcatttaatcggcgacggaggcggcggtttttggatcacaatgcggtgggataaaacatgtctttttgatgatttatgaatacacataacaatcattttcactgttccagtgctattaaacgaattttcgatgttgaagatggacttttgtggagctccgataccgataatgaaaaaacttcggcttttgtcgactcagtcaaaaagactttgttggaacacttcgccgtggactcgaaattgggcttgctggacattctgtacagcccaaagttcaacaaatctcgcattgccgctttttgcaaggaattagctgaaggtgaatagtgcaaattccgctacatttcccttattttaagaataaattcagttgccactggtggcgatgcttttgctgtcgaactgtttagcgatgctggcaaggctttagcgcaacatttggtggccatttcacggcattgtgacgacaaaatgttaagggaattgcccgttttgctggtcgggtccgtcttcaagagttggcattttatgagacttggttttgagcgatgtataaaagagtcaaatgacgccgtgacggatttgaatagacggatcaatcgagtgatgcttttccaattggagtgttcagcttcggttgggtgagttgttgctttttctttgttatggtcaactataaacgcatcttctttctaagagctgcgattctaagtgttaagcaaacaaacgatgggaaaatggacctttgtgaccttaaaggaatacaatcgaagaaactttttgatgaacttcaattatacgagtaa

SEQ ID NO: 80614 - DNA, 715 bp, Heterodera glycines
  Genomic contig location: Contig_ID=SeqID_16235; Location=2990..3704; Strand=+
  SCN-specific regions: Sequence locations=1-447,472-715
  Gene Ontology: Mol. function=motor activity; Cellular component =spindle pole body; Biological process=centrosome separation
atgatcacaaattttggttcctgttcctctgttaaacacaaagttggacctacaacgaagcgtaaaaatgtgcaagtggtcgtcagaacacgtcctctcagtgaaatggaacggaacgatcggtgtaaaaatattgtttcatgtgattccgtctccaaagtcgtttcgttgaaaacaaacacatgcgacaaatacagcactggtcagcgccaatttggagtgttcgataaggtcttgataaactcgaattgaatatttatcattaacttataaaaaggcagcttttaggtatatggccacgaatcaacgcagatccaagtctatggtgatgtggttgctccattgatgaaagaagttttgaatggctacaactgtacagtgtttgcgtgagttatttaaataatgttactttttgagggcactttttaccaaaaaaaaaattctcagatatggccagaccggaagtggcaaaacctatacaatggaaggccgccacgacgaaagtggagctttttcttgggattcggacccgacctctggcattattccgagagcactgcatcaaatattcacagagctcagcaacgaagtctgtctaatggagaaaagagtgtaatatttgcgttgcaattatttcctttttttgcaggacatcgatttcaccgttagtgtctctaatattgagctttttagtgatcagattaaagaaagataa

SEQ ID NO: 80615 - DNA, 476 bp, Heterodera glycines
  Genomic contig location: Contig_ID=SeqID_16236; Location=387..862; Strand=-
  SCN-specific regions: Sequence locations=1-95,128-138,161-362,386-476
  Gene Ontology: Mol. function=signal transducer activity; Cellular component=bud; Biological process=signal transduction
atgcgtgattacaaaattgtcgttttgggcagcggaggcgtgggaaagtctgcgctgacagtgcaatttgtacaggtgggcttcgcaaattctggaaaatatttttgaaatataaaaattattttaagggaattttcgttgagaaatacgacccaacaattgaagacagttaccggaaacaggtcattgataggatagacggatgacaaaagcgatcgagaaaatattactaaaattcagttggagttcgacggtcagcagtgtatgctcgaaattttagacaccgccggcaccgaacaggtgttttttggccgttttcaaaattcttaagtgagattcagttcacggcaatgcgcgacctttacatgaaaaacggccagggcttcgtgttggtctactccatcactgcacagtcgaccttcaacgacttgatggatctgcgtgatcagattctacgcgtaaaggacacggacgat

SEQ ID NO: 80616 - DNA, 108 bp, Heterodera glycines
  Genomic contig location: Contig_ID=SeqID_16236; Location=998..1105; Strand=-
  SCN-specific regions: Sequence locations=1-29,58-108
ttcattttcggttattttcgccagtgcgatctctttccctttttgttgtttattttgcgatggatttaattgatttcattccccgtgttgttgaaatagggtttttta

SEQ ID NO: 80617 - DNA, 510 bp, Heterodera glycines
  Genomic contig location: Contig_ID=SeqID_16237; Location=103..612; Strand=-
  SCN-specific regions: Sequence locations=1-328,351-510
atgtatcgccgtgtcttttgttattcttcggctcctttggccggtgcccttggcgcatacgctggtgtgacgatggcaaaccaaaattctccatcgacagaaaaaaacacaagcgaagttcagcagaaagtcgcaaagcaagcagtcgtaaaaagtggaactcacaattctcagcctaaagatgttcaatcgcttggcaccggtgaaataacgcgatgggactataattgggacaagtttgagccgattgaatgtggtcaatatttgtatattttagaagagaccctttttctatggttattggaaagggatacgaagcggcggacgaagaaaagaaaaaggaaattcttgccaaggtcagtaatttcttttattttgactcgtattttttatacaaacatttgttaagtttgttccgaccgcaacacggaacattttcctgatcagacacggacaatacgaattggattcaaagacgaaggagcttaccgctctcggtatctttgagcg

SEQ ID NO: 80618 - DNA, 1515 bp, Heterodera glycines
  Genomic contig location: Contig_ID=SeqID_16239; Location=300..1814; Strand=-
  SCN-specific regions: Sequence locations=1-72,125-245,292-318,340 -413,438-443,541-708,748-755,782-1165,1193-1271,1295-1515
atgccattttttgctccggccggaagatctctgcagactttgctatttgcttttataattgggatactcaacaatttttatgtaaattaaaaattaaatttaaataaaattaaaaaattaatttcagcaagcctattcttcttactattccatttcggctgccaaaagtttgcaaaattttctgaacgtttcgtacgctgcgcgtggcgttgaactttccgaagtaaaacaaattgactttatacattttttatattcaatttacaaataatttatacattttttatatttcaattttcaggggaaattattgtggctttggagtttcaatttgaattcgctttatatcggaaatattctcggaaccgtttttacttcatggctttgcgaacaatttggcaggaaaagtgagctcaaaatgaaatgaacaaaaacaattgcaaaataaattaagaaattttaaataataattaattcattaattaatatttaaaaatatattttaaaaaaatgaatttataaaaattaattgaattaattgtgtgcctttagtgattttgttgctctccaactgtggcattttcggtgccagctttttctccactttggccattgtctttttgctgcccgaactttttctcatttcccgcattttcggtgccattctttcatctttgaacttttgcgcatttgcactttttgttacagtaataatttaaaaataatttctaaatttatttattttttgtgtcattttttcttttccctccaaaggaattcccatcgtcaaaactccgcggattggtcatttttgtcagtggcgtctgttataatgtggtggcaaacattggcatgcttctcggcatggatgtgcttttgggacaaaatttggaaattttaatcggtaaaattaacgaaaggaaaataatagaattttcccaatttaaggatttggcatggtgccaagctttttcggcattttgaccagcattgcgttggaagaaacgccaaaatttctgctgttaaaccgcgaaaacacagaaagggcgctgaaagcattgcaattttaccagggcaagcaaaacaaaaattggaaattgaaagtgcaattaatgaaattttaactaaaaaatggctttggcactgatcattaaaattctctaattagcgcattttaattaaaaatgcctttgccactcattaaaaccattggaatttccttcaggcgattccgtcgatcagaaaatgacactggcggagattgtgaaggaaaagcagcagaacgaagaaaaagagcgaccaatgcttcaaatgttgagagaactgttcacacagcggcatttgaggcattgaaagccgttcttcttttttgggcttaattgcctcattttcttttcggttggccactttgctcggcatttgttccctccaattgaccattggcatttggcccgtcctcacaacactttttgctgatcatttcccactcaatgaagcgcaggcgaacaaaataaa

SEQ ID NO: 80619 - DNA, 1013 bp, Heterodera glycines
  Genomic contig location: Contig_ID=SeqID_16240; Location=5..1017; Strand=+
  SCN-specific regions: Sequence locations=1-428,450-512,576-783,834 -929,951-1013
atgtccaaggagttgtgctatcgctgtggtaaacccgtctatccgacggataaagtgggcccattgaaggacggggccttcttccaccagggatgcttcaagtggtagggagcaaagtgagccaattagcaacatcaaaacgttcagttatttgtgtggcacgcgtctcgccttgaaaacgtactgcaacaacagaaagtggggatagattaaaagattaattaatcttctgatcaataataggcaattaattaacaacacatgtccaattaacttgcaaattgggctttccgcagggcaaacgacgaccgcgaagtgtactgtcgcaaccacgtgccaaacgccacaccgcacgatcccacgctgccgttgccgccttccccgtcaaacggagtcgaacccaacgcgtgtcaccaacaacagcagatgcggcgccatcggcacaacgcggacgcaggactccatgacatgaaaattgcggtaaattttgaaaattggaagacgaatcaatgttttaatctaattaattaattatatttttaattaaatttaatataaactgaatttaaatatatgccatttaaatcatatgaaaatttgaatggttaagcacgcaatgaaagtgacgcaagcagttaaaccgtatccgaagatcaaacacggaggagccaaatacattgtggactacgacacacagacgcggctggaactgctgcatcggcaggacgaggacaaactgtaccaagaatttgatgaacaccgccaaaaggtggtggaatacggaaaacagagggggagaaaaaagaggacaaattggaaatttggaaaattttaaggaaatccaacagtttgaagaggagacgcgcgaagagtgggaaaaggctttggccgaattcgcacgtcgctacgaacaaaggcacgccacggcccgggagaaggaacagctgctgcacgacttgacactgcgcaaagagcggaaactcgaagtcaaacggaagaaccacagactttga

SEQ ID NO: 80620 - DNA, 725 bp, Heterodera glycines
  Genomic contig location: Contig_ID=SeqID_16241; Location=83..807; Strand=+
  SCN-specific regions: Sequence locations=1-725
atggactcgctgatttttcattacaatttgcgttcctttgacaccgaagacgccgaattggacggaggactcagtctgaagaggtgggcaagatgagaagcccttgtggtcatcgtcgtaatttacccaagtgccatgttgaggttcgtgatgcaatcgtcgctggacgactccgtcattttccgcgtccacgtgcccaccacgcggcctcttctgctggacatttttgccaattgcgtgtcgtcggagcattatctgaccggacagccgattaagttcaaaagtgtttgcaagttcaaggtgctgctggtgttgggcaatgcccgtccgttctgtcggctgtacgcgttgcgctgttcagattgagtgcgactctcttcggcatattatggtgcctttgcccgagtgcgccagcggcgagtggggcccctcaaaggctttccgactgtttgggctcgtcccgcgcacgcacgaagagccgatcatcaactgtgaccaatattgcgaaatccgtttcaagttttcggcattttttgcgcaaaaaaacggcgattttcagagtgacaaagccactgactgaaatggtggcaaatcttcatcggaatgggatggaaagtcggcacttgcaaaagtgcgtgcactgttcgctggacgatgaagaagtggtgatcgaattggcatttccggacgaaggccaatacggactggacatttacacgaggtga

SEQ ID NO: 80621 - DNA, 585 bp, Heterodera glycines
  Genomic contig location: Contig_ID=SeqID_16241; Location=1273..1857; Strand=-
  SCN-specific regions: Sequence locations=1-12,34-585
atgaaaatgtacaataaattgaaactgaaattcaaatcggacacaaaaggaatagtcaaaacggtggacccaaagcgcgaagaacaggtcatttaataatgtacaagtaaaaagcaatttaaaaggacgaacattcagacaattgcacttttggggcgcttccaaacgacgttggaaaggacaaccgttaaagacattttattcgacaaaaaagtggacatgagcgatcagaagagccgtgaacagatcattttggcaacttcagaggagcaggggaaaatcgacttggacgcagcggacattcagggggacgaatggtgggacatcggacagagacaaacccttgaagaccatggccatcttttaaaccattcatttggattttatttaaggatggaccatgaattggtggcacccgaggacacatcgggcgtaacaaaggccaaagatgctaatatgaaggatagcaatatggaatggtatccatctgatgacccacggaatctgctgaatgttcgccggaggacccaaggcgggacaatgccggatttgtttaaaagtgccgaaccgatggcattgccataa

SEQ ID NO: 80622 - DNA, 2630 bp, Heterodera glycines
  Genomic contig location: Contig_ID=SeqID_16242; Location=423..3052; Strand=-
  SCN-specific regions: Sequence locations=1-319,342-1729,1751 -2084,2110-2382,2407-2630
gctcaatttgatcgcgtcgtcaaggaaatccgtacaacagaaatgcagatggacagtctacgagacttatccaacgcttggattgaacttctcgcccgcctgaccggagacaacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccaaccaattcaactggataaatttttcggccaaaagcgaaaatggcccgaattctacgaatccttcaaatcggcaatcggcagtcaatcaatcagtaaagcgcagaagctgaacttactccgcaatctgctgggtggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgagatgtgctaaccgaagcagtccggaaagaagtccaaatccaagaagtgatgggagaatatggccatcactacgtccaaccaaaagcagaagtcgtctcagcagcacctgtacaagcactgagaacaccaaaccaaaggtcacgaaggcctaaccaaccaatggcactgcgtgatatgacatttatcgcctcatcactggacgagggtcacaaacatcaagggtatgtaagccaacagcacacacaacaagcaaagaaacactgccaacaaatgcgaaaccaagtacaaagcctcaaaaagggtccgccatacccctgtattttctgcaacagcaatcattggcatgacgaatgccaaaacgtcgacacactcaaccaacggatcagcatcgtcagagaaaagaagctgtgcttcaagtgcatgaagccaaaccaccgcgcatcaaattgcgctcgaccatctaagtgctatcactgcaaacgtcggcatcccacggcactctgccgagatcagtacaaagccaagaatggcatcaacacgcctagcacctcttgcagtgaagagaagccaaatgccaacgatggcaagcgatcaacagtgatcgaacaacaacaaatgtgtaatgccatccaaaggaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcatcggaatggacgtttggcaccagctgaatgttcaaccaattgaacaactgccaagcggatttacgatttgccaatcgaaaatcggcaatatcatcagtggaacagggcgaatcgagctcaagcaaccgtccaacatctctttcgtcctaatggtcaacaacgatgaatcgccacaaagcagtaaagcggctcagcagaaaaacattcaacaaaaagaaaaggacgaactgagacggcatcaacgcaacaaactcttgtccaacattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacgccaacaaggaagagttcatcagttgccaagcgaccagcattttcttccagcaaacaaacaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagac

SEQ ID NO: 80623 - DNA, 86 bp, Heterodera glycines
  Genomic contig location: Contig_ID=SeqID_16243; Location=11..96; Strand=+
  SCN-specific regions: Sequence locations=1-4,47-86
tgaagcgggaccgggccgggaattcccggtcatccgaggtcccggttcccggtcccggattttgaaaaactcaggtcccggtcccg

SEQ ID NO: 80624 - DNA, 421 bp, Heterodera glycines
  Genomic contig location: Contig_ID=SeqID_16244; Location=543..963; Strand=-
  SCN-specific regions: Sequence locations=1-122,144-421
aagcatttccaactctctttttctattcaaatggcattcaaattggcattttttttcatcgcacccgtgctatgcttgtcaattttaatgatcggccaaatgccatgccaaactgatgccgttgctgttcatcccgctgttcgaacagcggtgagacttgccaatacaaaaggcggacagattgcacttggaattgtggcgcctagtgccctcccaggtcagtcgaataaaatgacatgaatgtcttatggtatctcatcaaatgcccgcgacatattagaacaaaaagtcaaaaattcaatttcaaatagaattcgacactgtttgtccaatggccctttggtgttcttttttaaaattgtccaaggcctttatttttgtaccccacaaagggttacggtatttttgataaaaaaataaa

SEQ ID NO: 80625 - DNA, 1388 bp, Heterodera glycines
  Genomic contig location: Contig_ID=SeqID_2594; Location=759..2146; Strand=-
  SCN-specific regions: Sequence locations=1-118,140-398,420-448,473 -934,970-970,1088-1153,1179-1262,1284-1360,1383-1388
atgatcaaaaaagaagaagccgataaaattgccgaagatcctggaaacgtgccaaaagtgatcaaaacggaagaaaaagcggacaaaataactgaaaaaattacggaaagtccgccagaaacactggaagaagatgaagccgactttgatcaagaagatgacaagcggaaagcagcagaaggtgtagataaaatcaaactgatggtgatcaatgaatatgaccgaatgaaaaatgaatacaaaaagaaaaaggggatcaaagatggaaaagaccgttataaaatcgaacaaaaaattgccattgaattgggctcaaatcgacgaaaaatttaccaatggaaaagagaaattaatcggatgatgaaaaaagacgagggcgatgaaagaccaacaaaagcggaagagcagaaggaaaatgagagaagacgagagctgatcaacaaatttgaccaaacaaaaaaggaatgccaattgagaatcggatattggagcgaaaagcggcacaaaatcgaaggtgaaatcagcgacaatgggaggggtcgggaccagcgctgggcgtaactggattttcaattaaggaaactcgtcatccgtaattacggcgaattgatcaattacagattctgtaatccgtcatgacaggggtcaaaaaaggccgcaatttcccgtaatccgttattacgcccagccctgctggtcgggacagagggggacacgcagggatttgagggacgcattccaaaatgcgccaacttttgatatgtattttcataaatttcactcgcacaagagatgtctctcatccttggtaaaaaaaaataaccaatctaattagctaattatatccggctcaaaagtgtaaaaaataatcctaattgatttgaattctttttaatcatttctaggaagaattgccaacgcgttgggcacaacctgtaataatatttacgaatggaaaaaggaattcagcaacaaaaacaacacaagaaaacgacaacagcagaatgaaaatgaaataaaaatgagcatagtgaaaaaatttgaaaaaattacaaataaaaatgaaaatgacaatgacaatgaaaatcgcattaaaatggaatgcgaaattgccaacaaatttggcaccacccgtgaacagatttacgaatggaaaagggaagaaaatctgaagatggatgaagtaagccaaagtgaaaaaatgcgaattgtgaaagcatttgacaaaatgaaaaaaagcaaaaaccaaactgagaatgaaattgccatgaaattggggacaaatcggaggaaaatttacgaatggaaaagggaaatgcgccaaaaagaaacgggtgaaagtggtgaaaatgaattgggaaaattaggtgaacagaaataaaaataaa

SEQ ID NO: 80626 - DNA, 641 bp, Heterodera glycines
  Genomic contig location: Contig_ID=SeqID_2594; Location=3343..3983; Strand=-
  SCN-specific regions: Sequence locations=1-211,242-286,313-322,350-641
atgacaaagataaagcagttcaacattggcattcacgtcacggacaacaccggcaaatataaagtgaaatttgacacggatggcgaagtgacagattgccagtacgaaagtccggaaatgccaacatggactgtccaatatatcacggtgagtgttgaattttcagcgttaattaccatcatttagtaaagttctctaaattatgaagttgtaaaattaaaaaattaaaataattaattaagccaagattaaagttatggaaatgaaacttgtgattaattcgcttgaatttttaaaatgttctttaaatttaaaatgttcgtaataaataatatttttattattttttgatattctttcggcataactaatttttttttttatatgtcatctatgttttttttatttcaggttttacttacaaatgaccctcagcagttaattaagccggaaatcagttgtattccgcaaaagcgctgcatgaaaatgagagatgttgatgacctattagagaagagaacaagtggttgaaaagcagcttcagccattagcataatgtcacattaatactaattaatgcataaatttgactattcaaatgtttattaaaagtactgataactatggaaaccctaaataaa

SEQ ID NO: 80627 - DNA, 2363 bp, Heterodera glycines
  Genomic contig location: Contig_ID=SeqID_2595; Location=156..2518; Strand=-
  SCN-specific regions: Sequence locations=1-518,542-909,936-947,969 -1004,1026-1380,1402-1452,1474-1851,1873-1889,1912-2337
atgggaagtatgataaatgaaacaaaaaaaaaaaatttagtggccttattttttttcttaacagactgtactactttttcacattgcattaagaaaaaagcaaatttgaacattgtcgcatcattggatacggtacttaactacggtgacgaaatttggatggaaatgatcatcagtgaaacaaccaaaaaattctacattcgattgatgcacgaatcagtgaaacccagcacaaaaagtcagttcaattcagggttgattctgttagccagaaaataaagaatattataaaatcggtatttcctttggacttgagtcgatacacaattaacttaataattttttaaacaatttagtcccggactcgctcaattcggccccgcatggttcgggtccagccaagtcttcgatctataacttttttttttgttaacccaatcaacaatcttggtatcattcgaaagctctttacataactctattaaccttacaaaaagcaaaaagatttccaagcctggaaaaaattaaaaaaatttattaagaaaaaacttcaaaaattcgacttttcgaaattttcatgtataactttttttgaaattgtctaatcgcgaagcaatattttagaaaaagcttctaaacatattaagctttcgaatgatacaaaattcgtttgttttggttggcaaagaaaaaagttatagtcaaaaaattggctggggccaaactgaggtaaaccgtttagtccatatttatttatcctctttcggctggcaaaaattttggaagctttaaatgggcattggttaatccatttaatttgtcattttcagttggtgacattttgctgttattggaattcgatctttcaaagcctgatattagctgcaggaattatctgcacgctgtgagataatatttaaataattttttttttacaaattctgtaatatagagttgaaaaattttgtagaaacatctgtaaaatttacagttgtttgttgtccttttttgaaattttacagtaatataggaaattgtaagcgaaaagcttgtcatccaatttgttgtcacaaatgaatttcccacttttacctacaaaaaaccgaattatatgcaaacaatgtcagtttattaatttaatacaatggcaatttcgtatacgaaatgccgacttgttaaataaatacagtaaccaacttgtaacattcacttacaaatgaatacagtaaccagctcgtgccaaatgtcagcttattaataactgaacagagaaacaaaaccgtatcagacatatagcaacaatcaaatgctgagtactgtatcatgtattacagaaccaaaacttttcaattggtaataatggcacgcacaagctgaaccaatatggccaacattttgatttactgatcaatgcgacggccaagcattttgaaatcagaattgatcaagtcggttttcaactggattgcaaatatggaattccgaaagatttctcaaaagatgaacgcttcatatacccaccatgggcagtggataaaattcaagtaaaattggaggtgctatgacgttacgcaaaaaccatcaaaaaatatatatattgctaacaacgtagtgcaaaaagcaactcaatttttaattcttaatatcattcaatggccctaagtgtttctattatcatgcaaaatttcaaaaaatttgttaaatttgaagaaagttatgaccaaaaatgttcaaaaaaaaaacttggttttttgggtttctcaggtcataactttttttaaacttaatgaatttttttgtttgcagcatatttgaaaacacttactatcgaaagataccaaggtttaagaatttggttcattttgggggaagttatgaataattttctgtcaaaaattttcattttgatggttttttgtagcgttgcacgggaccaagactggtactgaaaaaaaggtacacatgagtacccaagtcccggttttgactgggaccgggactagtcccgggttttttccggttttgcgagccaaaaaggcccggtttttcaacccgaaaagtcccggtaccggtttttttttacaattaccgctctactctagttttttgagtaacgacccggcaccatcgattgtttcataaattaattctggcataggttacccgggcgaggaaagttggcaaccatcggaaaatatttattcgcaagaattggtggctgattttattgagtattctacggtaatgtgcgctgtacatgcattgtccggcaaagaatcagtgcccgagcatattgcagaagaactgcgcgaaaatgagaaattcaagaaatgtatgaaaataattaaaaattaaaaaataaa

SEQ ID NO: 80628 - DNA, 1069 bp, Heterodera glycines
  Genomic contig location: Contig_ID=SeqID_2596; Location=255..1323; Strand=-
  SCN-specific regions: Sequence locations=1-25,47-147,206-401,446 -529,551-658,681-1048
atgaaatttacatcctattctgttgaggtaagtaaacaggctattataataaccaggcggcaggtcgtccatattttcaatgtaaaaattttcaaaaaaattaatactctttcttttttgctcaccaatttttaaaacaaatcattcaatttaataattaatttgaagaaaaaataaataaaatttctcaaaaaaaaaaaaatttcggcagcgaatcttttgtaatttccaaaataatagacaatttcgcgaaaattattgaattgcaaaaattttatcagaaacggtaccggtttttacagtacagaatcagtaccggttaaagtgaaaataaccaagtcgtgtgctacaactaaatgaaacaaaattgtgaaaactattttttattacaagtttatgtgatatttattttatttattttttaaaatagtttattttatttttagaaggcagaaccacctgaaactttcaatttatatttaactcgactgacggacattaaaatcattgcgcaggaaggctaccaatttagtgttacttttaatgagaacaaaaaaacatattcattgcctacaattgtgccaatttgggccgtcaattttattcgggtaaatgcaaaaaataaataaatgaaaaaattgaaaaatatgccaattttttacaggtaaagggtgagcacatcaggttgctggaccggccatatttaccaccgaaaacagaaaagcaggtaatttttcaaatttttgccagaaaaaatttgaaaaacccaaatgaaaattcacttttttcaaattttaaagccaattccattacatatgtttaataaaatccacaagtttttttttcatattcattattgcagtctgtaaaggaattataaagcctcaatttttttttcttcatttatcatagtggactttttgatcagcacaaaaagttatgcttacatgaatttttccagatttttatgatgtctttgaaaaaagttttttgtgttttatgaagtagcctgataatttctttacagcaaatttgggcaaaattttggaattaaattcataaaaataaa

SEQ ID NO: 80629 - DNA, 429 bp, Heterodera glycines
  Genomic contig location: Contig_ID=SeqID_16247; Location=96..524; Strand=-
  SCN-specific regions: Sequence locations=1-152
ctgtttcccgaccaaatcaggcccgcaaattgagtacgtgtctgtacaacgaattgttgccgccggggaacaacgcatggcggcacaagcaagcggctttgagcgcgcaatgggcccagcaaataaaccggtggttcaggtgggaaacatcgaaattttagttatttttattttttattttattctgattattaaaaataaaaaattgccataataaaagaaactgtttcgtaactttatttattttttttgtagatatttttattagaaattatgttaataaaattaattgtattttaaagtcttatttttttgaattttgtcagcaattttattattgaaagtaaagaaatttaataaaaagttttttttaatagttaaaatatatttttttaaattattaaattattttaagaataattaaataaa

SEQ ID NO: 80630 - DNA, 658 bp, Heterodera glycines
  Genomic contig location: Contig_ID=SeqID_16248; Location=656..1313; Strand=-
  SCN-specific regions: Sequence locations=1-110,177-309,442-462,493-658
aaatgtgctacaaaaatgttttattatttattgtaactacagtagcaatttttgagacgtcatttggagctgaaaacaatgcaacacaaccacaaaaaaagcaggttgagtttaaattaaaaatcgaaataaataatttttaaaaataattttataaaattaactaaaaaataatacatgactgcgattatatgaaaaaattgcagaaattggttaagattttacattttatacaatgtctccttaactttccaaaaaaaaaagtttacgtcattgactctctccacttatggccgcctaaaaaagctaaattaattggataattaattaattacctttggtcaataattgattcgaatttttaatttaattaataattttttcaatttttaattattattgttttttatttgattattaattggttattattaataaatttacacagaatttcactttttctattttaataattaaataaaaaataattaaggaattgacttttgaaaagacgatggaggaaatgatcatctcggcaaaaacgggcaaatttgtgcggcaatgttcttgcgatgaacaggagccatgtctgaaggacattttgacggattttcaagcctgtttcgagacatgctgggaacagaaaaactcgggaaaa

SEQ ID NO: 80631 - DNA, 110 bp, Heterodera glycines
  Genomic contig location: Contig_ID=SeqID_16249; Location=1054..1163; Strand=+
  SCN-specific regions: Sequence locations=1-110
atgcacttcgatgatccgttagtgggccgactggtccatggattcaattgggagttggcttggccttgtccggtcggatccatgttcttccgtccggtctctgctggccg

SEQ ID NO: 80632 - DNA, 137 bp, Heterodera glycines
  Genomic contig location: Contig_ID=SeqID_16249; Location=1194..1330; Strand=-
  SCN-specific regions: Sequence locations=1-137
gcggcctaacaagctaaaaaacgggcgcgaagcgccgtatgagttcaacgaatttaaaaaacgggcgcgaagcgcccgtccaaggccaacaaaaattgaaaaaccggcgcgaagcgcccgactgaggccgcgaagcg

SEQ ID NO: 80633 - DNA, 2076 bp, Heterodera glycines
  Genomic contig location: Contig_ID=SeqID_16250; Location=253..2328; Strand=+
  SCN-specific regions: Sequence locations=1-641,664-730,752-778,802 -1405,1429-1480,1502-2025,2048-2076
atgctccaattccgcgaccatatcacaatcaatgggaccataaccaaaaatcgtcctcaaattatcattctgttgctcaacgaggcattggaatcgtacaactccggtacggtagtaaaattcgtagagaacggggggggtggtgtactgatgatacgaatagcggcactttcacgaaagaaagtgtctgccgatggcactttcattcgccgttctttttgctttcccccccccccccccctcgagagcggtatttatttgtaactttttaaaatagctatttttctataattttagtagtttactatttatgtgccatctcattttagtggcgcccagcgttatttaccatttgctgaatggcacttcaaatatgggtgagagatacatttttaatttgcttttaactttactcgaccatcaattttagtgggcaccatcgtcgtccgtgccattttcaccaccgatttggacggcaacgtcgctattcatttttcttatgtaaatttgaagggtgccggatcgttacttcaaaaaacatcaaaataagaatttttgaccaaaaattattcaaaactttgcccaaaatgaatcatcaaatataaaaaatttggttgcttttgtgcaaatttagatgaaaaattattttattttgatggtttttgagtaaccttatagcaccatttgaagaacaattcatttcaaccttataaattagtcaattaacaaatttttaaagaatgaagaagtcgaagagcatcatttgaaatcggcgctgaccgaaggacaaaatttccatctgaaaatcataatgcgaagacggcccatgttccatttggagggcttcggcaaattcatgttcggcatcgaaacaatgccaatgtgggcaatccaatacattcgggtggatgaaaatttgaaattttcgaaaaaaattgaaaataatttaagatcgaaggcgatttgaaactgcacgaacagccacgcattgaattcttcgaaaagaaaggacatcacaaatgaacagagagagaatggaatgattgggcatagacggcacttttatatatgcgcaccatttttgattaaactttttcattcgattttttgaaattttcaaggaaatttttagaaataattggcaaaactgcaagatatttgtataaaacagggctcggatcttaccaactcactttccaagtgcataacgggggaaatgtgtgaaatccaagtacatataaaattttatcaacatgcaattaaaaaacaagtccagacatttgcgcctatgtccaaaatcgggttaaaacttacattttttcaatcttatatgtctttaaacagcgttaaatttaagaaaacttattttgttggtttattagggtcaaaaattattttgcttaaaagatttattattttttcaaaatttgctaatgatcaaattattgcacacaatcactttcgatcgcttatttaaagctgtttacatctgggattgaaaaaatgtaagtttaaaccgcttttggacatggcgcaaatgttgggtaaccttaacaacggtgatttttttttacacaaatggtttatattgttccgcggaaagaattttttgcaaaattttttttatttccttcagatagagaaggagaagctcccccgagaggaaggaagattaatggatcaattgaggcgacaattgatcggatatgatcgagcaaattgaaaccgaccaaaatttttacctcaaaagtttccccagctcgtccattttttattttcatatgtaaaaataccggtttccaggtacaatttggaaataagtacagttaacatttcccaaccatgtcgaatccgagataattttctctgctaattatttgaaaaaatgtcaaatatttgtaaaaaaatatgtaagtgtcaaaattaattttaagggctaaaatttaaaaaaagggtttttagggtcaaacatctaaaatagaattccaggggccgaatagagacttgaaaaagaaacattttcgctgctacaataatggttttcctggttttctctttggctaaagaacagggaaa

SEQ ID NO: 80634 - DNA, 622 bp, Heterodera glycines
  Genomic contig location: Contig_ID=SeqID_16255; Location=1111..1732; Strand=+
  SCN-specific regions: Sequence locations=1-85,107-244,266-559,606-622
atggtggcagtttttaagaaacgacccagcacgtatttaaggcatgttcttgacgtcgtcgtccccgccgggcacgggcatcggcattctgttcctgacggcacttctctgccactgctgctgctgcccgtccatgtttgtttggtcgctgtgctaacagtgccgttcggccacctgttggtccgatggcttggcaaaatgcttctgcgcccaaaactatcgtcgcttttgttgctcacaatcagcagcggcagtggcggtggcacaaaacatttgacaaaaaatacgacgccggcgacggccgcgacgaggacaaataagccgaaattgctgggcatcactaagtcaggagcagaggacgataattggggcaaagtgacgcaatcggaccccaaagacaaccgattaaaggtctcaacaattagtgccattctttgctttatattaccggatttgcgggacgaaaaaaatattttcgaaagggtttttttcaaaatttcagaccagcgagaaaaagctggaattgttttctggtttgtgctaaaaaatggcacatattttttgcaccattttggaatttaaaatctttcaaaaccagttttctcgacggaggcgctcaaga

SEQ ID NO: 80635 - DNA, 1750 bp, Heterodera glycines
  Genomic contig location: Contig_ID=SeqID_16257; Location=936..2685; Strand=-
  SCN-specific regions: Sequence locations=1-568,591-947,970-1282,1315 -1506,1529-1688,1710-1750
atgaaatcattggtgaaaatgtcaccattggcctgttttgaatacaatgggcatagttttaccttttttgaagacagcgaatctggtgagactactatcttccgtggtcaccagcataagattgtgcaacgactgtccaaacatggacgggttgtgtttgatcacctatcgggtcgattgtttctgatcgataagtatcagaggcggatcagcgaaatagagcttgaatacctggagcattggtggcttcgaaaaaaccaatcttccgcacatacgatcttgaagagcaactttgtcgcttttcttccaccagataaaagcgactttactttggtggacaaccatgtgtttgtgatcagagaccagcgcatctataaatttcacattggcgagtatgcaaaagggaatcgtgcgctaacttttgtaaccaattcaaatgatgtccgctttaattatctaatttataaacccaaagaccaaaatgttagccgcggtgtttttgcccatctacgcatgtcggacgcctggatgccgatatcgtacctgttcaatctgttcctaattgtactgtgcacatacatacttaaacagctacggcgagtaaaccaaaagagtccgcttaacgtgtccgatagcgccgattattacagcagcccgttcattgacgacgcttattcgtcccaacatcaacaattgctgaacataccgtatgaaactgcaacatcgagtgatcaaagtggtggagcccgtagtcggagtatttaaagaacgattttttgttgtttggattcagttggccatttgtttcctaaattttaagaaaagctattgtcattttacataattgtcacaatatatttacctgcttattgcatgcaaagggcaatccgttatctgatcgacagttacgggctgagcagtgtagacgatctgtacacctgcttgaaagaagaaattaaaagtgggcctgaaggtgggaattgtctctatcccaacccgctttgtgctgtggactgtgtacacgttgcaaacgccgatcatccgaaccaacctgtgcatattgacggctcgcttgaattgattgctgacgttgagctgtactcaacatgttatccgaagaggaagttcgagggaatagtatggtaagttttctaaaaataaaaacattaatatttccatttgcatttttaaggagcgaacctctgtatgtggagctgaaggacctgaagatttgtccgggcgactcgccgctgtgtctttcacgcctttgcgaactagcgcgcagcagcagcaacaacaacaacaacaacaacatggacctgatcgtggacgagttggatttggtcaactattggagcgacgacgaacgcgaaaacgagactgcaacttggtgagagtgctgtgccgattcaataactgtggtccctatcgactgaccaagcaactacagaaacgacgaactgagaaccttgcctatctgagccaattggacattgagactgtccaccttaggagaaatattaaaattatccctgatgccttgtgtcccaacggtgcaaatcaggtgtttgcataccgtggattcctaggaatcacggttcagcaacacctttacactcgccatcgtgtcatgttaaagtacccaagccttccttgtgttgttcagtttggtggtggtcaccaccgcgatatttttcccattgaattattacgtgtcgcaagtgccgaaatccaaagcgaaagaggataa

SEQ ID NO: 80636 - DNA, 906 bp, Heterodera glycines
  Genomic contig location: Contig_ID=SeqID_2597; Location=152..1057; Strand=-
  SCN-specific regions: Sequence locations=1-382,404-428,457-509,531 -752,774-780,802-906
atggttatggtgccagagagtgagtatttggccctcattaatctactgaaaggaaacagcgccgtatctcctcctctaggcgacccgttacagggcgagaaaacgctgcttgatgtacagattcaaaagaatttggttgatccaaaaacgaacgcagaaataaaaatgaagcgtcactcatggttgtacaaacgtagacaccaactaaaagatattattgagaacaaacctcaaaaagtaattgttgagagtggctcagttacagcaccaaacgttgcgccgtatatgggcattcagaaacaacaaacaccgtcgcatgtgagcacaccacaccgcaactcggcttcaattcaatcaattggtgcagtaagtaagagcaacactgatgtagaagaggacacggacttttcaactgcttctgatcagtttgagcctgctgctgatgctgctactacttcgtcaaagaaaacgccgcatcaaaagacgccaacggtttctttaaggaccagcccgaaaaatttcccaaaaatgatgggcattatcgggaaggatcacaaaaaattcggtgtcaacgcaagcagcggagaaattttgactaatttcaataaacccgtttcaggctctcatttcaccgaatcgttaaagcatttgacaggtcagcgcgaagatgtgcccagaggacatcgcttcttcattcaacgcatctcaaaagacccggaaatgatgaaactgcttcaaaaaataccacaaacgggggaaggccggcggcgtagcacagtgaagaaaatgggaaagaaaaaattagtgcttgtcaatatgatgaattcatcgtctataaaaaccgcaggattacaccgaacggaaccaaaacgcaaatttaaacctgaattatgggcaagactatag

SEQ ID NO: 80637 - DNA, 722 bp, Heterodera glycines
  Genomic contig location: Contig_ID=SeqID_2597; Location=1291..2012; Strand=-
  SCN-specific regions: Sequence locations=1-526,548-722
atgctaatcgcaccgcctcctgtaaaaatactctattgttattccgagatgaacgattctgtgatcgggttaatgaaacaaggaattgagacatataatggggtaccgacccaaacgttggttcaaagtatgcccaaacccttacttttaatcctggacgacctgatgttgagtgtaaataacgattttttggatttattgttcacccgaggctcccataactgggatgtaagtgttatttttgtaacacaaagtctctacggacgcaatattcgtaccgcaagagccaacagccattatttggttttaacccggaatccttctggtcaacttcaggtcagaacggtgggctctcaattgtttccgaagaggctaaactattttatggaggcatacaacgatgcaaccagcgaaccattcagctatttggttataaatatgcatcctaatgcgcccgagtctgaacgtttaacaactaaaatcttcccggatgaacagcgtgaggtgtacctaccaattgaataaagaaagggtataaaaggttgagaaaatctgtaattttcactacaaatgtatgaattcagtccatatataagtgaaaacgcagaattttttaaaaaaatcgcctccacgaaatcggaaaaaaagaaaaacatccttctgcgagacgcaacagccgaacaaatattaggacttgttgaaatttgtgcaaacatattaaa

SEQ ID NO: 80638 - DNA, 845 bp, Heterodera glycines
  Genomic contig location: Contig_ID=SeqID_2598; Location=141..985; Strand=+
  SCN-specific regions: Sequence locations=1-46,69-313,335-340,362 -363,385-497,519-610,633-720,743-845
atgatggatggacttttgaaagtaaaagtgatcccaccgaaaattcttttgtaccccctcctccccctgcacatcgatgacatgctcctcttccccaattgttgggcttgtgcaaaaagggccaagaatgagtttgtgatgacaaaagatgtaaagaaatgtaaccatcgtccagcgcagagagcatttttggggacattcacctcaattgagttgcggaaggctttagagctaggatatagaattgtgggattctatcgagcgtatcactttgaacaatttgacagtcaactgtttaaaggatatgtgcgtatgtttttgaagataaaggttgaggcatcggggtggccggcggaggtgaagagtgaggaggaaaagagagcattcctcaagatgtataaggcaaaatatgacattaatttggattacgataaaattggactcaatcccgggttaagaatgattgcgaaattggtgagaaattattttaaaaaatcgaaaaattgtttaatttaagggattaaacagtttgtggggcaaattttcaatgcgcaataccctttcaaatacggaaattgtgggcagcatggaacgctggatggaattgggaagagataatacaattgaatttgggcgcccagtaaaaataagcgaagaaatatcacgggtggtgtaccggaaaaaggaggagttcatcagggagcataaagtttcaaatattgttttgtcattgtggaccactagcgcagcaaggataaaactgtacgagtacatggagcaggtctacagggaggaagggtctaagctgctgtattgcgatacaggtgggcaggaataaaaagaaa

SEQ ID NO: 80639 - DNA, 548 bp, Heterodera glycines
  Genomic contig location: Contig_ID=SeqID_2599; Location=224..771; Strand=+
  SCN-specific regions: Sequence locations=1-65,87-343,366-371,400 -467,520-548
atgactcgagagtatgcggacagcgaaattttggagtttgtgtccgcgggcccgaaacagtacgccttgaaacttagaagaaagaaggatggtgtgatttggcacaaaaccaaaatcagagggatgacattggatagacgaaacgaatttaaatatgaattgttcaaagagatggtgctggactacaaagaaggggtaaagaaagtttttcactacccggagaagatcgggccaacaaacgacttccgggttctctcaaaaaatgtgcaaaaagaatatacgccggtgcagaaaaaaggaattattgacgatcactttaatgttttaccctttggatattattgataattttttggataattttgtccatgtttataacatttaatattttaaattaatcaaatttgtttccttttttagaatgtcaaagaaaaatttccaagaaacttcaaaagaaatccgccgctcgaaaaatacaaaaaattatttcaaaaacagttttaatttagaaaaaagtttcgaagaagtggagagtcacataaaggaaa

SEQ ID NO: 80640 - DNA, 452 bp, Heterodera glycines
  Genomic contig location: Contig_ID=SeqID_2599; Location=1960..2411; Strand=+
  SCN-specific regions: Sequence locations=1-27,49-108,130-182,204 -294,316-452
atgcaaacaatcgctggaattaaaaatttcgagattgttgatggtgtaagagtttttgttgtgagagcgagaattgagaatgtgacggaggcggagtacagggtttgtaataaaaatgaaagaaaatttcagtttgtttaggcatgcactttatgcgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacattaaatttaggatgaggtcaaaagtttggcaggcgccgtgtgcactatgaaagtcggggcgagggtgaaagaattcggagggaagaagggaatttattactctttgattgatattgttagcctttaaatctataa

SEQ ID NO: 80641 - DNA, 687 bp, Heterodera glycines
  Genomic contig location: Contig_ID=SeqID_2600; Location=280..966; Strand=+
  SCN-specific regions: Sequence locations=1-108,130-287,309-324,346 -465,500-538,560-687
atgcaaacaatcgctggaattaaaaatttcgagattgttgatggtggaagagtttttgttgtgagagcgagaattgagaatgtgatgcaggcggagtacagggtttgtaataaaaatgaaagaaaatttcagtttgtttaggcatgcactttatgccgtaaaggggcttgttcttgcggggctgagaaaaagatgacaccttatttgaaggtgtctgtggcagatgatactgggattctggaaaatgtggcattttttggtgtgcgtgggaagcagaacgggatggtaccccaatgttttttaaaaaattcgtatacaatataatttaggatgaggtgaaaagtttgtcgggggctgtgtgcactatgaaaatcggggcgagggtgaaagaattcggagggaagaaggggatttattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagatataattagattagataacgaagcaaaagaattttctttttctgcacataataccatgggtgaagcccaaaatattaaaa

SEQ ID NO: 80642 - DNA, 485 bp, Heterodera glycines
  misc_feature (477)..(477): n is a, c, g, or t
  Genomic contig location: Contig_ID=SeqID_2600; Location=1919..2403; Strand=+
  SCN-specific regions: Sequence locations=1-485
atgaattttcataaatcggaaaaagctaatgccattttattggaggcagctaaaagagagacggagagagcatggaaggatgttgttgcactagaggaagaggttagcgattttgccaaatcttctcgggaaactcttaatcgtgcgataaaatcccgagagaaagccccatacgctaatggtgttcgggagttttacataaaaatatccgactcaatctgggaaattttcacaatcttggacaaaattaatgtagagtcagaaaaggcagaagctgtatggagggaattggaaaaatgcaaagacttcgaactggcaactaaatttgaggaaaaatcaataaacgcattaaccgaagcccataggttgcatttcgaatcccgaagagtgcataataaaataagagcgtatgaaagtagacttcaaaatattgtctgggaatttattggactaaggggggagatataaaaagaaatnttttttta

SEQ ID NO: 80643 - DNA, 542 bp, Heterodera glycines
  Genomic contig location: Contig_ID=SeqID_16260; Location=51..592; Strand=-
  SCN-specific regions: Sequence locations=1-147,169-299,321-542
atgcgcaggtcggaaaaggggagatcggcttttccatgccccagagaaaatggacgaaagtggaagttggccgagaagttcaggtcaaagcggaaacatttctcaaggcaaaccaatgaatggcatttgctaattttagattcagccgttttcgttcacttctgatcaacggattatcacttcaatttcactaattgtcgatttccaaaagaagccgtaaagcccaggggaggcgaattaattagtccaatttgtctttttctttcaggtcaaacccatctgaaccattggacacaaatgcaatggcccagaaatttttaatgcaattcgccaacacgttatttaccgtcaaccaggaatttcccatggaatatgtgcagcagaagcggggcaccggaagaagaaaattgcctccgggaaaagtaaatctgatggacagcataaggatggcgactacgtacacactgaaattggtggtggaacggatggaaggcgccgtcaatctgaacacggcaccggaggaggttctgatattcaattaa

SEQ ID NO: 80644 - DNA, 1104 bp, Heterodera glycines
  Genomic contig location: Contig_ID=SeqID_16260; Location=1631..2734; Strand=-
  SCN-specific regions: Sequence locations=1-111,161-189,228-426,448 -469,501-525,553-592,615-665,698-855,899-915,937-1079,1102-1104
atgacatatttgttgtcgatttgtccacagcaattcatcgagacgcatggaacggccagaaatactgtaagaagcgctacaaacgacacgaaatgcatcttcccctttagcaattatttaaaattaaaattgtaattagagaaaattttatattttttatcaaggcatatccggctaatttatagtgagtgaatttggtgtttttaaaaacaaataaacaacaaaatcgcatccgttgtaatattaattaaatttgaatatgtttctacataaaattaaatgtttagatgttttttacatttatattccctataaaatgcatacagctgaaagaaattggaatcgaaaatataaaatgtcggtgttgcttctattgatgcaaggtcgaatctaaaaataccaatggggcgaacctaaaaaagcagcactaatattaataaatttaaatgtaattgttgtttgatatgtaagcaatttttatggaaaaataaaacattattcggtccacattaaaacgtaatacttaatatttttgaattttttgaagagcaacataatttaaagtttttttatatatttcgatagtccaaaattttatattatctttttaatttgcaaaaaaataggtaggatttaagttcttgaatatcaattttttgtagatcattttgtgaatttttcttaaatataaagaggaccacttgagctaccacttgccactagagctgagcgagaccgggatggtactgaaaaaaacgtacaaatgagtacctaagtcccggttttgcccaaaattcccgatcccgctcagctctacttgccaccaatcttaattattatgatttattatcctacaaatatttaaatatattattatttttattattattgaattttaggtccgtcatgcagatttgaattgattgacaataagataacaatataattgagatattacacataaattttcattcatcccaattcatagcatttattatttctaaagagggacccatttttaggcagatgccttttttgcatatttcgccttttttggtgcctatttttacgactttcagaaaattctttacaaaatacaataaa

SEQ ID NO: 80645 - DNA, 773 bp, Heterodera glycines
  Genomic contig location: Contig_ID=SeqID_16262; Location=1034..1806; Strand=-
  SCN-specific regions: Sequence locations=1-95,117-305,327-674,700-773
atgaaatgcactgcgtcttttagaaaaagcaaagaaaatgagctcaaatctgtcgtgggatattgcgaagaacactgcgattccgaaagtgcattcatttgccctttcaattttatgaaaaatgagacgaagcaaaggccgaccgatggggacgacccatcggtgtttcgaattctgtcaacagtcagcgcaattggaagggtcaaactgtccgaattgcctttgctgtgttcgtcacaggtaatttcatttataacggctagacattacgtcttttttattttctattttatttttttcgcaagtatttatttaaaaaataatttggatcgaaaattccatttataggcacaaaattcgtcaaaaagtgttgccgactatcaaaagcttacccgacaattgattctgtcagggcttctcagaatgtgtcttcagttcaattctttcatgaaatgcaccgctttcgtttcgttgtctttcaaagggtaccaacagatggaagtgacgaaacaaatcgaattggccgaatttgagaaaagagcattggaaatgaatttggcagctcacaatctgtcggacttacaatttcaattaacggaagaaagcgcagcatttgacgaattggaaagtgacgaattgtaaggagaccttagtgggacgaaagcggggtaaacgaaaattttcagcaattattttttgcctcaaaaatttagaatggggtcttggcccccctaggaccgtatccccctccaattagaaaaaaatataataaa

SEQ ID NO: 80646 - DNA, 750 bp, Heterodera glycines
  Genomic contig location: Contig_ID=SeqID_16262; Location=2313..3062; Strand=+
  SCN-specific regions: Sequence locations=1-145,170-336,358-750
atgcccgaaccattcccaatgtccgacaaaaggccatggactgtttgcttgaagttcgacttggacttgggaataacacggtaattgaggtttggcctgtagagatcagatttgaacctaaaggttgttaagaaaaaataagttaatatttactcataatcaaattaagttggcgagaatttataggaatttttagacattttacaaatgtaatgcaatttgctaaccaaccaaagagcactttcacagtccatgcccaaatattggaatgcttttcggcaatcgccttcagaggtggacgcagttaaagccattatcggcactttcttctcggcattttccctgaatttcttcatgaggtcgcccagctgaaggaagtcgggacggaaagaattgccccattgggtgacacaatgcgcttcatcgaccacaaaacgagccaataaattcatgcgatgcaaatacctcagatatttaaggaattgtcgattttttaccgcctaaaattggttacttgatgagttaaatcaaataatgcacatttaattaccctttcgggggtaacataaagcaatttgaaggtgggaattcgattaatgtatacatctcttgccattcgttcggcatcaaaaacagcgcacggaattgttgtctttccattgaaaaagataagtattaaatttcgatcaataaaaatgtcaatattacagtgccattcctcaatttcatcgtttggtcccgaataagtga

SEQ ID NO: 80647 - DNA, 1135 bp, Heterodera glycines
  Genomic contig location: Contig_ID=SeqID_16262; Location=1964..3098; Strand=-
  SCN-specific regions: Sequence locations=1-429,451-617,642-1135
  Gene Ontology: Mol. function=ATP dependent DNA helicase activity; Cellular component=chromatin; Biological process=DNA repair synthesis
gacagaggtgtaactgtggtgatttcgccattaatttcacttattcgggaccaaacgatgaaattgaggaatggcactgtaatattgacatttttattgatcgaaatttaatacttatctttttcaatggaaagacaacaattccgtgcgctgtttttgatgccgaacgaatggcaagagatgtatacattaatcgaattcccaccttcaaattgctttatgttacccccgaaagggtaattaaatgtgcattatttgatttaactcatcaagtaaccaattttaggcggtaaaaaatcgacaattccttaaatatctgaggtatttgcatcgcatgaatttattggctcgttttgtggtcgatgaagcgcattgtgtcacccaatggggcaattctttccgtcccgacttccttcagctgggcgacctcatgaagaaattcagggaaaatgccgagaagaaagtgccgataatggctttaactgcgtccacctctgaaggcgattgccgaaaagcattccaatatttgggcatggactgtgaaagtgctctttggttggttagcaaattgcattacatttgtaaaatgtctaaaaattcctataaattctcgccaacttaatttgattatgagtaaatattaacttattttttcttaacaacctttaggttcaaatctgatctctacaggccaaacctcaattaccgtgttattcccaagtccaagtcgaacttcaagcaaacagtccatggccttttgtcggacattgggaatggttcgggcattgtctattgtcttacggagtgggcttttcctttttgttcataaaaatcacatgtgtttaagaaatgaatgtaaagcgaccgctgctctgctcggaaacattgcgaaaccgtatttttccggtttatccgagagactcaaaagactttaccaagacaagtggatggatgggcgccttcgtgtgctctgtgccacttccggtaaattctacatttttccagagaaattttcgggggacggggggaaattccctcaatattctaattttgtaaatgtttttagcgtttggaatgggcattgacaaaagggacgttcgtttcgtcattcaccgctcaatgccgcgatcattga

SEQ ID NO: 80648 - DNA, 931 bp, Heterodera glycines
  Genomic contig location: Contig_ID=SeqID_16263; Location=617..1547; Strand=+
  SCN-specific regions: Sequence locations=1-245,269-271,294-532,554-931
atgccattgacagtagaggaagaggacgccaaattggcactgacagcggacgatttgcgagtgcaaatgaccgatggaatggttggatgtatcggccgaattagcatggacggaacggagttgccgaagacgggccaaggcttcagaatgttcaacgcagccattggatgtgaagagaggacattgggaccatgcttaaggtggacaaatggccgaaagggaaaaaagacggacaaattccaaaattatgatgaaaaataaacacaattagttaattagctaattaattagtgctccctgccaaaacggtggtcaatgcgttccctctgtttcgtcccccgccatcggtgacttttccccctccaaaaatggttcctcgccgttgttcacttgccattgtcctcaacgcttcaccggttcccgttgtgaaattgatttgaatgcatgtgcgtcaaagccgtgtcccggtggaattccatgtcacaatttgtacggcgatttccattgttcgtgccctcccggactcaccggaaaagttggacattttgaataaccaaattagcagagtataattattaaagacatgccaacttcgtggcgattgggacccttgtgtgacggcgtcgtgcggaccaaacggcaaatgcgtgcggcagccgcaaaggaattctttcgtttgccaatggtacgcctccctttcctcattttgaccattttcaatttcagtgccaatggatttagcgggggtttgtgcacggacattgtgccaacggaattggcatcggaagagagggaagcgggggagggcgacgtatcccccggagggtcggacttcccttgggcggcgatcaccgcgccccaattggcccttttggtggccatttgcctgctgactttgttttgcacggcatttatggtgaattattcgaaa

SEQ ID NO: 80649 - DNA, 872 bp, Heterodera glycines
  Genomic contig location: Contig_ID=SeqID_16263; Location=2015..2886; Strand=+
  SCN-specific regions: Sequence locations=1-225,337-558,586-613,652 -806,855-872
atgccaattggcgagcgaaaaaacaccgcagaggaagacaaaatgaaaggggtcgaattggcaaaggtatttgtacacagcacaagccaaataatgatgccaatttgaccacagactccgccattgccgccgcctcgcgattcgtccgaaagacaaaacggggaacaaaatcagcaaaacggacagaaacaaaatgaaagttatcgacgaaaggtaaatgaatgggagagagggggagggagggggagagagacaacgggagagaggggagagagagagagaaaaggaagaggggagagagagagagaaaaggaagaggggagagagagaaagagaagatttataaagccatttcaattttcagattgatcgcgcatgttcagcagccgcagatacacaaaagcaaaaagcgacttcatcaaagaaagggacagcgaataaaacgacgcgggacgacgggagaagcgacggaaagggaaaggacgagggaaagtcgacggactatttgaccatgaagccggtgcacagggcgaagccgttcagactgatcccaaaagcgagcagaggaggaggaggaggtgatggacacgacgcccccggggcaaagcaccgccccttttttaaaattcaaaaattgttttatttttacagaaaatccgccacctccgccaatgcaccgaacgccgttgctgaacatgcgagggagaagaagcaatggaacaaatatggagcattatgacagcccatcagacgcattggattatgcggacggatatgaggaaaacaatgacggggagcaagacaatggaagaggagaagagagaagaggaggaggggaggaggaggagaaagagaaaacatccaaaagataa

SEQ ID NO: 80650 - DNA, 676 bp, Heterodera glycines
  misc_feature (640)..(640): n is a, c, g, or t
  misc_feature (662)..(662): n is a, c, g, or t
  Genomic contig location: Contig_ID=SeqID_16264; Location=632..1307; Strand=+
  SCN-specific regions: Sequence locations=1-7,29-520,554-676
atgggcttttttaattttctccttgtcattattgttctttcaaatgtttgtatttgtaaaggcaaaaataatgtggaattcatgttattgccctcattggtcggcgacttcaaataccgggtttgtattcagcaaatttgattaattttaattaggaatggagtttaattatgtttgtcctttttcgccatttttgccattattaaataattttttctggatttttcatcactcaaatttaaaatcctaaaaagtaaaaataaatgttaaaattaacgacataaatctacttaaatttacttttattctattcgcattttttttaggtttcagtacaatttgacaatgaaaaatttgtggtgaactatggaaacaaacagccgaaaacgaaatctgaattagtccaactttatttcggaacggaagcgcttaaagctgaaatttacacttttcatatagaaatggttgatacaaaacatattgttgggttttccatctgggtaagagccaaagtttaagtgaaaagaggaaagaggaaaaatcaaatgaattttttaatattttacgaattaaatcgaatttacagccaaataattattcaaaacaattaattgctgacgaaatcaccaagaaaccattncgttatttttgggaattatttncaagtggaaattga

SEQ ID NO: 80651 - DNA, 1903 bp, Heterodera glycines
  Genomic contig location: Contig_ID=SeqID_16265; Location=203..2105; Strand=+
  SCN-specific regions: Sequence locations=1-60,85-111,133-569,609 -785,835-904,926-949,971-1156,1181-1200,1223-1251,1274-1453,1486 -1647,1670-1903
tttggtgggcctggccttctccaagaagggattagtgtcaccaatggcggaacacatcgaatttattttccaaattatttttatttgaatatttcaccaaaaatatcggcaaaaactgacaaattttattgggtggaagtaaattgtcatgacgccagcagagaagcagagaaatacagcacatacacgcagaaaagtgcgttaattgtcttaaattgtgcacaaaattgtgcggaatatgaaattttggtgcggaaattggacaaaaaatgtctgacaaatgccatgaaaaaggtaaaaggtttattaaaccattttgtaatcactcatcaatttagtaaagtgattaggaagttttttgtttaatttgagaaatttggtcattgactttcatttaatttagaaattaaatctgtacaatgaaaaagcgaaaaaaggacaaatcgcagtcaaaattttaaacggcgaagaatatgagttcgtttttcagcaggcttctccgtttttgaagcgagtttctgacaatagtaataatcagaggaacacgaataaacagcaggtgaatgatgaaaataattaacaaaataaaataaaaaataataataattcagaaattggacattaaaatttatgagaaaccgataaataatacggaggaaataaatgaacaacagcaggaggtggggagaacaaagcgattattgacgatttgccaatttacagaaaattgagccaattttgaccattcttccaaatgaatctggggaaaaagacgagaaagtttgaaataattaaatctataattaatttattgaaatttatatttaattaattgtaaatccacatttgaagcgatttgaggagatttccgcaaaagtccacgctgttctaaatgatttttcagaaataaaaaaggaaaatgcaacagtaaaacatttttgatttttaatttattacctatatatgttttagaaatttgtgcaagtgtttacttttatgaaaaatgaaatgtcaaatatgagaaaacaggacgaaaaagtaaaaggggaaggaaaactaagcaaagaaaagaccaggacggattagcaattagcagctgattagtgataactgataagggggaccaattgggcaatccgtcgtggaatttttgatgaaaattttattttattatttttttgtctgccgtttctaaaggtgaaaaaattaaattttaaaattacagaaatttgaagaaattattaagaaaatgaaagaacttcaaaagcaaatagaagaatcgacgacaaataaaaatgaagcggaagtaataattccatttgttttgattgttttttgcgataattattttaaaagaaaaagaaaaaaacattttcagaattcttcgctttcgcaaattaccgctgcgaatgttagcaatgaaacggtggcaattgtcaaattggaatatgagaaagtaaaaagaaaaattgtaattatgaaaatgaataattattttatagaaattcgaactaatgtccgtggaaatgggccaacttaaggaacaaatcacttcgatgaaacaccaaattggccaaaacgagtcaaattttgtaaggacaattgaggaaatcaaaagatttatggaggaacaattcaaagacgaatgaaacaaatggaatgaattgaatgatggattgagtgattagtgaatgattagtgaatggtcggtcatttggggagggattgtttggcctttttggaattttttattgtttttttattaatgcatacgttgttatttttaaaagaacaggataaaattgatacgcgtacaaaaaacaaacaattattatttaggaattttcaaatttgaccccaaaataatcaacaaaaaaactggcaatttttgatgaattattta

SEQ ID NO: 80652 - DNA, 1450 bp, Heterodera glycines
  Genomic contig location: Contig_ID=SeqID_16268; Location=444..1893; Strand=+
  SCN-specific regions: Sequence locations=1-55,86-192,218-600,624 -670,693-788,813-901,924-1036,1058-1250,1277-1302,1324-1450
atgtcatctctagccccgtttaacgagctgaacataataacgggcgatcgtcgtgtaattttgaatttattttaattaataaattcagcaaaatttattaaaggtgcgccaattgattgctaagattgagagagaacgggcaaagaatgaagcggtgagtacgtaatgaaaaaatgcctaataatcattaattttatctcaatttattaatatgccattccccatttcttagaattgtttaaaaaatgcgatcatgttctgcttcataatttgcgcgtttggcattggcttgactttgtttgaaatcgggagtcgagcgtttggcaccgcagcgtcggcattgagcttcgggctttccattggattgtgcattagcgattcgcttttcccacaatccgtgccatccattacggtaaagctttttaagaagggcgttggatttccgatgaaattttagaattttggggttgttctgcaattaatttctcctttgtcccgtcgttagatggaaaatgttatgaatttattccattaaatttttctttagaccataccgaaaaacttttgataggatttttggatccaatgacaatgattgttaaagaaaatagtgaaatccaaacatgcaatgagggacaatttaaaacccttttactgaacaataagctcataaaaataaaccaattaactggcaaatatacttttattggagaaccaactatttataaaatcgatcaaaaaatatggggtgaggaaaatttacctatttttcctttacaaattttcaaacaattaattttaacaaatttaacgaacaaacaaattgacatgctggaaatgcttcatgcattccgtactagccgaattattgacaatagaccaaatgaagaccgaaaaatttggaattcaaaccaatttcaagcatttacctttcaaaatttaattactgaaattgattggtggaaatatgtaattcgatcagtcgttttagtcattataattaattgggtctacaaaatttataaatggaaacaaaaaatcatgatcagaaaagaaattgaaaagaggaatagtcaaaactttcagcaacaaactggtgccattcaaattccactggccgctctgaaacaacgtttcgttgggggagtgtcggcgcccacgaccgacgcagccgagatgccagagaatgccgaaagaattaaatgccaaaaacagaagagacggaggaaataatttttgaacaaatttgcatttaattatttattaatttaaatttcattctccattttattattatcatccatatctttcatcctttgcctttgcgatcactttattcatttatggaaaagtcgttggagacaagaagaaaaagagcgatagggaatttcacagagtttaacaaaaagcggaaaatgtccgtgagcgaaaaaagggggaaagatgaaaa

SEQ ID NO: 80653 - DNA, 271 bp, Heterodera glycines
  Genomic contig location: Contig_ID=SeqID_16269; Location=1971..2241; Strand=-
  SCN-specific regions: Sequence locations=1-124,149-271
atttttttaatgagaaataagagttttggggcgcggcggtgccgataggcgccgccgggggaaaattggaaattttgatcatttataaacaggttttccctgaaaattagccaatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctg

SEQ ID NO: 80654 - DNA, 1077 bp, Heterodera glycines
  Genomic contig location: Contig_ID=SeqID_16270; Location=482..1558; Strand=+
  SCN-specific regions: Sequence locations=1-661,708-894,919-1077
atgaacgtcactccaatgcccttcgaaacggaaagcgacggatttttcatccaagaacatgtttcggtatgaaggaaaagcatcggaaagtggaataatcgagcagagaaatatttagataaaaattttgcatatttccattaaaaaaactattcaagctaaaatatgaaagtcaaaaataagactaatctttggcctagacttcggcttacacataagctgagcttgttagttttagctagccttagtctttgcttagaccgtcctagctaagtcaactgaaggcccaagtaaaggcctctggactttggctaaagcataagctaggcttatgccgttagctcagaccgttttaggtccgttgtttagatctatggccactgatacattaatactaactgatgcgatttgtcaacattttccgctttttaggagtattccttccttggctatctcaacggtatgaaatcgcttacttctgttattttcttgctcttgtcgcttttggtcaatttgtcaacgctaattgcctatagaagaagcaaaaaagtgcaccaacaaaattctcaaaacggaagtgacgtcattgagaagaaattgctaatttacgcccttctcacttttgctggccacgcttttgtctcagtttttttggttaaacatattaaattcaaaatatttttaattttatatttttagattattatgggcaccggagttttctatgactatccatcgattgtctacacccaatatccgtggatcaacgacttgtgcactttggtgttgtccagttggatgttgttgttcaccagcagcattttccgccaccaatttgtcaaggacttttgtccaaaatgcatttggccaatgccaacaaacacttttcagacgccagtgacacatttaacacaacaaaatcaaaatgattgccgtttatttgaaaagccatgagcccaaccaatcgaagctgatggacgtacatcaaatagaaattgaggggaaaacatttccaaaacaaggacaaaacattaggaagcagttcagcaaattcggaattataaaacgaatgatgga

SEQ ID NO: 80655 - DNA, 151 bp, Heterodera glycines
  Genomic contig location: Contig_ID=SeqID_16271; Location=409..559; Strand=-
  SCN-specific regions: Sequence locations=1-151
atgtccaaggtctcgtgccaagacaacaacaactggttggccgccttttcgaagccgctatttacaacgggaagtgacgcgtacatgccgctgaaagacttcggattcaacccgaacagtttggaaacggatttgtgggcaaaacgccaaa

SEQ ID NO: 80656 - DNA, 368 bp, Heterodera glycines
  Genomic contig location: Contig_ID=SeqID_265; Location=1337..1704; Strand=+
  SCN-specific regions: Sequence locations=1-232,254-368
atgcgacgattcgtcaactcagccaaatgtcaacgattcgtcaactcaatgattcgtcaactcgacgattcgtcaacccagccaaaatgtgacgattcgtcaactcagccaaatgtcaacgattcgtcaacccagccaaaatgtgacgattcgtcaactcagccaaatgtcaacgattcgtcaactcagccaaaatgcgacgattcgtcaactcatccaaaaatagttttaaaaagcagtttcaagagcttttaatggcgcttagcacaattatagcattcttttaggctaatttagaaacaagaacacataaaatcacgatccttccgatgaaatattcaatcaaaaacttgcataaacaaatttta

SEQ ID NO: 80657 - DNA, 2188 bp, Heterodera glycines
  misc_feature (220)..(220): n is a, c, g, or t
  Genomic contig location: Contig_ID=SeqID_266; Location=213..2400; Strand=+
  SCN-specific regions: Sequence locations=1-257,280-326,423-638,660 -798,820-978,1000-1280,1309-1496,1518-1843,1866-2065,2087-2146,2168 -2188
atggaagtgccaaccgttggagaggaccacgaggacttggaagaggatgcggtgagatatatcgtattgaaaaaggaagaggggggggggggggagaatttccagatttcgtgatcagaaattagccgcgattcggggtgggatggggaccaaaaacgggatgattttctcgactcggacatcactcgcgatgctcggtctaccctgtttaaagtgccantacataaaatatgccatttcaaaacgaccattattggaaaattttattttttatattttctcgaaattaagactcgaatcagtgccctctacatgggcattgaccacttcctccatccccccccccccgcctcccgccttctctctttcttcctctccctttttcaaattcccttctttctcccatcctcttgctctccctcgattctctaaattaatattcggatttttaaattggatttgtgccgttcggtgactaccaaaggtggcattcccatgacccgaatgagaccgaacaatgtttcattgttcttaatcaacggcacggcagaaaagccgtccactcagaaggacaggtggcgatcactgatcgtcattcactctctcccaaaaaatgaaaatgcttccaaatgaattactttacgaaattgttcacagtcttccgtttgacatccgctgggccacctccgtccgtgtgtcggcttcctttgattattgggtcattaggcgccaatcaatttggctaatcattgagcataagcgtttaatgattttgaaaaaaaaggtctgagacattgactttttgctccatggcttatgcaaaatttgtaaaaaaaactccaataaacaccacgagaaaaaggcacacagattggcatactttttatttggacatttagctaatttatacaaaaattttcaaagtcgtgtgcccggcagtgccgaggcatttgttgttaagaaaatcggtataataattttttcaaattaaggtgggaatgctaattgttgagggccaaaatctgcgcaacctcgtccgccgattgagtccggacaaaatttcttccgttgtgcgtctgttgaccgcccatttcgctgttggacgtgacttcggattgcagttcgtcaacccgaacgcgttcacaccggcgcaactcgccatccgacaaatcaatgcgctcattaacaacattgaccacagtaacggaacagccgtggccaatgcgggtcattgtgagtaaaaacttaaaaattacattttatattaactgtaggatttgaattaaaattattaaataatcaaaatttcatttccattttggaagtttcattttttatattttggttttattccattttaggcctttttatttaaattcatgtttaacattatgtcataatagtatcttttttgatcaaaaattgttggattcgatggaatttgagttttgggaaattttgcatcaaatcttatcttgtttagtctcaaatccggcataaaattaatcaaaacttttttggggcactgtatcattttcatctttttcagtcttacacgagttggtgaatgcatttgagtgaagttcggtcgacggctgctgagcagtgatttggcttttgctttttcctctgttttatgacaggtcactgagtgccgcgagaattgccaatttttcttttcgggaaaaattacatgaattttggaattccattcccaagaattttgacatgacaaaatacctaaattcatttctttgtgcttggaaatattttttctaaaacggctaagccaaaaaacaaagttggcaaaagcacaaaaatttatccgctttttcaaagtcttctttcatcattttttcttctttgtccgattcttcggtcaaaatttgttggatttgttcacttaatcaaatttacatccatttggccgccattccatcactattatttgttgaatttccaaccttttgtcaaacgctgaacatttctaatgccttttccaattttctaatatttttctctgctgatcaaccactcttacagaattttgtcgaatttacaatcattgccaaattttctctcaaattatgccctccttttttcaaatgcttaatacatatgcatttttaaatcatcataaattcccgtttttgttgccattgcttttaattgtaatcctttgtttcaa

SEQ ID NO: 80658 - DNA, 1750 bp, Heterodera glycines
  Genomic contig location: Contig_ID=SeqID_266; Location=2595..4344; Strand=-
  SCN-specific regions: Sequence locations=1-206,228-307,329-619,656 -929,951-1226,1248-1373,1397-1485,1689-1750
atgtgccgagccagacaaaatccgattccgattaaatcgccgattccgattatggccaaaaatccgattaattgcgattccgattacgattatccgattccgattatggcccaaaatccgattaattgcgattccgattacgattccgattcggcacatccctggtatgtatccatcgccagaattttactgatacaataatttgccaaaaataaagaagaaactatcgttaattattttaacgcttcgcctaatagtttcaccttccttcatcaataacaattaactcgaaaaataaaatgaatcaaaaattttttgtgaaataattatagcggccaaaagaatacatttttctacgggcggcgaactggtcgcaacgaaaaaccacgggcgaaccgtccgtgttcccgagatcaaccaagtggttgcccgtgtgttttcatgttcggcagggtgagcaccgcttttcccaaccccccccccccccaattagtgttcctaattgggcaattatagcatagtttacctcaaatttttcttagtttccaaccaatttttaataatttgtctcaatgtgtagcctaactacatggagacgggcattttattgtagtttttgtaaaaaatttgaattttttttatttgaaaatttaaacaaattagtttttggaatgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaaacgtcatattaaataattatttttccacatttttattttattttcagattatttacgccttcaagtcacaagtgggagatgagaattggaacaattttgtcgctcaaattccggaaccgttgaagcaaaggctgggcacacagtaccaattgtgatcattgacgagccccgctgcacgccactcacagacagaaccattctcaaaattcattccaaatttccggggacggacgaaattcggaatttaatcccccgccataccggaaattaaaatccggaaaacatgggcctttcgacctttctcgaaaacggagtcagtcaaaaagcacacaccaattttggtaacggaatgctaatttaaaattgtaattttggaaatgcaaaaccattaatggaataccgcaatttaacggctacaaaatatgagaaagttgacggaaaagtgccgaaactacttttggcaattattctagaaaggtatcccaaattcaaattcgtgcattgttggaatgggtcttggttttttcgtccgtctcccctccccagccacacacataccatcatcacactttgtgttaccgctttttttgttgttgctctgatcagcttggatcattttgcatccgttgtcgctcatcattttttatttcatttgtccattcttttcgttttcatttgtttttcgtctatttattatttttttattttattacatttttttgtttttgtcccttgtcccttgtcctttctcagacttttttttctgttcactcatttcacattttgtactttgtttttgttttatttgttctccgtttcctttttgttttgttgttgttaaatttggcgagcgacaaaattatttatgcaaaaaaaaagaaatcgcattggattcaataaa

SEQ ID NO: 80659 - DNA, 189 bp, Heterodera glycines
  Genomic contig location: Contig_ID=SeqID_266; Location=4868..5056; Strand=+
  SCN-specific regions: Sequence locations=1-189
atgaaaagtaattaaaagtattcaaaaaattgaatgaacaaaaaacataaattattaaacaaatattaaagtttatttatcgagagtctcggacctcgagaaaagtctcgtgttttttcgatttcggtcttcaagactgagacttttttgcatccctaaagattggcttttagtgaaaaaaacaaaaaa

SEQ ID NO: 80660 - DNA, 3100 bp, Heterodera glycines
  Genomic contig location: Contig_ID=SeqID_266; Location=5195..8294; Strand=-
  SCN-specific regions: Sequence locations=1-129,152-1122,1144 -1212,1234-1829,1851-1931,1953-2261,2284-2332,2354-2594,2630 -2679,2708-2765,2824-2906,2949-2950,2972-3100
atgaacaatattatgagacagagggacgcagctattgagcttttacataattgtggaattgatattaacgaatatagctatggtgtggagcaattgccgaatgttcagaaatattgggtgggttaaatgaaaaaatgcaaaattaataaatttttcaggatgagatttaccccggaaagtaccgggttgtggcgtttgaaaaatctgcggatccgcggaaatcgatccgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgattgccgggcgagatgttattattgcaatagagtggggggaatgccatgtgaaaaggagagtggagtgaagattgaatgcccaaagtgtcaccgttacttttacaattgggagtgttataattatcatcagggacatcagacttgcaaattatggaaacgttgtgtgatttgtgacaagacatatttatttaacacgaagaagggacatgaatgcggtgagacttattgccagctttgtagtgtgagccatgaccccaagcgggggtgttatattatgccgatcgaggagaaagaggaaaaagatgtctacagaattgtagtttgggtaagttctacaaataaaatcaacaataataagtctaactccaggattcggagacttcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatgaaaaaaattaatctaaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccatattattacaacaagaaagaaaattatggaatacgattggaacatctgccaccgatggaggactattcgccgggatctatgaacaaggataaatttataaaattcgaaaaatggtaagaaaagaaggacaaaattaacaataaataattttttcaggtacaacgaaaacaaggagacacctttttatttggatgatgaattgaaaaattattgccgaaacgacacggagattttattgctgtcaattattgagtttagaaggatattgattaacgacattacgaaaggatttgacccactaccgaggagttgtacgaatgcgggggttgcgatgaatatttttaaggcaatgtttttattgacggagcagttatcgattgtgccggagaagggatatgagcggtgtgatcgcgccagtgtgatggcaataaagtatttggagtggcggagccagcgggatggaattgagatacggcacgcggggaacggacgagaagttaaaattgggaattacaaattggatggatttattgggaatgaaggagctagggacaagtgcattgaagtgatgggatgttacatacatggatgtttgaattgttatgacccggcggcggaactgattggaggaaggacggcccaggaattgaacgatgagactcaggagagattagtggagctacggaagactttggatgtcgaagaagtttgggtatgtttatttgacatttgaatttataaattctactttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcaaaatcggacgagaagaaaaaaattagcgtttacgatatcgtgagtctgtatccgtctgtgaattacggtacagatttcacgattggtttgtcggagattatcataaagaagatcgatgagatataacgcatagttgattatttcggtttgtaactttcttgaaatattagaattctcttgttttctcgtattattacattatttagactttgtgctttcgaatgataccaaaaagatagggtttgttcgagcatgaacaaagttattgtataaaaaccagggattgtcaattgattggacacataaaactcaattggactcataaagtgcactagagccataatttcttcactttaattttttttgtcccatccgtcgccaaatatttcatcaaaattcggtcggattttgccggagtcaattacaaaaataaataaaaatataataaataaaattaaatgccaccaattcatttttacatataatggaagtatttgtataaaaatattctttaatattgtaattttatttcatcaaatattactaaaaggttttcttattttgttggcattaatatacaaatcgataattcactgatttttaagaaataaaaaatatttaatttttatttataaaatatttttttttttttttgcttattttagccatcgtccattttttcctatttttcaaattacattatagtttcagaatttgccctctttatcgccgaagatctaaattctttattttttaaattcactcaaaagtcacaaacaaattttctcgagttttaaaaaatcaaccaacgctgatcgcccccccccaccccccggttcaccaatgcgaaagggaaaaatccaatttacgaacgaaaaaggcttacaacttttttgttttgtggatttttggattgataaaacataataaa

SEQ ID NO: 80661 - DNA, 74 bp, Heterodera glycines
  Genomic contig location: Contig_ID=SeqID_267; Location=144..217; Strand=-
  SCN-specific regions: Sequence locations=1-74
atgtcttttaaacgcgtgaactccttccaacccaccgtcccattggccaaaaaatgggatttccgatcaatcgg

SEQ ID NO: 80662 - DNA, 698 bp, Heterodera glycines
  Genomic contig location: Contig_ID=SeqID_268; Location=626..1323; Strand=-
  SCN-specific regions: Sequence locations=1-149,171-550,573-698
atgtgtatattacggtatttgaacccccccccccctgaattagaaccctcctttcgagggggttgaaaaatagaacccgggcgggggggggagggggttcaaaatacggtaagtctaattttctaaaaaaaatctctaaaagtaggcgctatttttataattcaaaaattctaaacaaaagtggcagttaagaagagtcgttggggccaacggaaagacaaaatttaataataattaactttaatcacttcactaataatgtttttaactttttctaaaatttcttttccaaaatgtaaaagtgagtattcttattgttttttttttgggtcgccaaaataatttcttatttaagtcatccccgaggtttttgaggcaacggacagtttagtcatgagtctgtaactcgattagggaatgatagccgcataaaaattattagggattcgaacataacataccggagaggtcgaatgactttttattacgccaagaacactgtgaagtgataaaaagtagtatttttatggattggtaaagtaataaaacgataatttttaaaataatattttgacgacagttgaacggtaaaaatatagcttatactcatattccttcagaaactggggcacatttgaggaggaataccttaatggagaaattttcggaagaaaagaaaaacaaacggtttaaataaa

SEQ ID NO: 80663 - DNA, 312 bp, Heterodera glycines
  Genomic contig location: Contig_ID=SeqID_2601; Location=341..652; Strand=-
  SCN-specific regions: Sequence locations=1-170,217-312
atggtgtccctgtccgtgctcgtatccatcccgtttctgatctcggacgaggtgtgcccaggaagggaccgtgatcagctccgagtgcgtctgatcgccgccacttttgtcacctgtggcattggcacaattttgcagacggcgtttgggatgaggtcaaaaaaatttcgaaaatatttttttttaaatattaatttaattttgaaattaaattatcttctttaacttccaataaaaatgctttttttgaggttggctcttctccaaggcgtcgctttcgcttacattccatcggttggcgttaagccctaa

SEQ ID NO: 80664 - DNA, 1110 bp, Heterodera glycines
  Genomic contig location: Contig_ID=SeqID_16272; Location=1061..2170; Strand=-
  SCN-specific regions: Sequence locations=1-61,83-357,379-578,617 -752,774-915,937-1077,1099-1110
  Gene Ontology: Cellular component=membrane; Biological process=signal transduction
actaaaaatgcctcaaatttggcatttttccagataagtttggcatcgtttgctctgtctgtggctttctgttttgccctttatggccacccttttttgaatgccgctttcctttaccatttgtcgcgtgtggacatccgtcacaatttttcgccctattttttaccgctttatttggtgagggacagcccgtcgctcacccaactgatcggactgattgcctttgtgcctcaaattgtttgcatttgcgtttttgctttgtggtgagtaatttagaattgaaaatccttttgtgtcgcaatttggattaacaggccttaataatatgataaaaatcttattgttttgaatgtaagccgaataaattataaaatatttgcttatttccactcttgtttgttttaacttttgtaaaattgggacattaaaaacctatttaaaatcgaacaaatctcagaaattcatttgcttcgctattccaataaaatgattttagatacactggtttttggttgaacttttttttagcctaattaagaaacatttatttgtaaaattttgagtctgatttcttccaatttgttttattttccttgaaatttcttcaggtattctgacgatttgcccttctgttggttcctcacaacgttcgctttcgtctccttcaacaaagtgtccacctcgcaatactttgtgtggtatttgtgctttgtgccgcttctcttcactcgtctaaaggcaggccccgtagaaattaaattgctaattttgtttttattgccacatttctcctaattgagccccccccccccccccgattattggatcaaactctcccatttcctaaacaaattcttaaaacgtgtttctaaaatggcatcattttctcagttttcttggcaaatgtggctcaaactgttcgctctgtggctgtttggccaggcgttttggctgttgcccgcctatctgtatgaattccgtggttgggccaccctcaattgggtttggtttgcttcgctcacttttcttggcatcaacacatttctgatcatccaatttgtgcgcaattattcacccgaagaagagagaatggtggaagttgatcggcaa

SEQ ID NO: 80665 - DNA, 708 bp, Heterodera glycines
  Genomic contig location: Contig_ID=SeqID_16273; Location=129..836; Strand=+
  SCN-specific regions: Sequence locations=1-708
atgaaaaaggcccttcaattttaccgttcggctgataaggggcatcgttcattatcatgtatgaagtcgcattttcgatttatcaaaacagaatcagagctgaaaatgctccgaaggtaaattacaaaatttaattgaaaaaaaattaaaagttaagatttgaaacgaatttgaaaagtaaatagcaataattatggcgaacaaaaaatatattcacgattttttttctcaaaaaaattttgcaaaacaatacggttcccccctttggtttttgataaaactcaaaatttgtcaatttttaactagcgctaaattttcttttaaaatgtttttttcagtttattaaatagtatgcaatacgttctatgttaaaaaaacaaattctgcataaaaaaacaaaaaaaaaaaattgaccaaaaaaaacgtgcaaaaaacaaattcaaaaaggccctctttgcaaatagcgcccaaaattttcccctttacttcatattaaaaagtgaattttttgtttagtttcttggtctccgccaaaacttgttgacatcgttgaatgcgaaccttggccggttgaccacgcttaccgagttggagctgtacgataaccaactgactgaaattgccggcctcgaccagttggtcaaccttgtgatgttggacatgagttacaacagaataaccaaaattcaaggtgactttgcattttaa

SEQ ID NO: 80666 - DNA, 1559 bp, Heterodera glycines
  Genomic contig location: Contig_ID=SeqID_16274; Location=16..1574; Strand=-
  SCN-specific regions: Sequence locations=1-1538
  Gene Ontology: Mol. function=mRNA binding; Cellular component=snRNP U1; Biological process=mRNA splicing
atgggccagcaacgtgcggaggaggagggtcgccgactgcctccctttgaccatcattcggtgtgtcgtgcctatttgcttgggtgttgtcctcgcgatttgttgtccgatacgaggctggaatcgatgatgtcctgtcgaaagttgcatgaaccggctcacaagggcgagttcaaccgtgcacaggagaagaaggaccttttctatgacatcgaggttggtttttgattgacatattgaaaaagaaagacaaccttctcaaatgacacgaactctgaaatatagccaggtctgttccggtgtttccttacaattaactgatattttcgccaaattcgcgactgtcactgctgtaaagtccaaaatcttccggtaaaagacctggcaaattggactgtgttagacttaccttgagaggccttggttagtgacctcttaggtaccgcatactaaagacatttggttttaattggaaagagaaactgccacagaaattttcttaagttatcggactcaaaaaattgtcacccacccactcgaaatatgtatgtttgagcgaaatggtaagtcaaactttagacaagtgtcagacaactaaatgtttttgtagcaattttaattgaattgctaattctgtgctgatgtgaatgagggtatctcagtgggcaattccaatgttttcgtatgtcgattttccagcgaatctttttttagtttttaagtgaacaaagccgctttttaggcttttgaggagttggatgatgccattcgcattgtggacgctgacattcgtcgtcttcaggaaaaagtgaagcgagacgcggagcagaacatggacattagtgagcaacaacgggtacgtgtttgtggtggtgaagcctcttcacatttggaagcatagaattctgtgattcagtggaagcattactcattttcagacccagaaagtcttcgagatgaacgagaaaatcggaacggcgctggtccaagtggaggcactcggcaacgaagggcgcatagccgagtctatcgaactttccaaggaggtggacgagttaaagcgtaagaagcgcgagttggagagcgaaatgcgcaacatgaacccggcaatgatgcagcgtttgcgcgtgtgcgaggcatgcggggcccaactgaacatcatggaccacgagtcgcgactgcaggaccattacgggggcaaaatgcacctgggaatggttgagatcagagaccgttttgctgaaatgaaggctcgtgtcctaagcactcaataatttacatgttaaacttaaagaaagcaatcgatcagcgtcggtcggagaaacgacgcgcggatgacaaggaccgggaggagcgtcgtcgtcggtcgggacgtgaggatgatcgcgatcgtaagcgtgagcgcaggtatgtgagagtcttcaacacattttagagcgagcaaaatgcaattaaggacccctgccaattgtcatgtaaatttgttttttttaagcaatgcaatggaattaactcaggctaaagcagactaaaaggttaattttggacataaaattaaa

SEQ ID NO: 80667 - DNA, 1024 bp, Heterodera glycines
  Genomic contig location: Contig_ID=SeqID_16275; Location=400..1423; Strand=+
  SCN-specific regions: Sequence locations=1-139,318-409,440-452,490 -637,667-836,858-865,887-890,912-1024
atgggcggacgtcacgcaaatttggacacattgagaaaaattgaatgcgtgtgtgcgtttgaaatggtaattaaatacggcaccaatttgaaggggccaaaaacaaaaaaatggcaaaatttatggaaaaaaaatttgctttttttattattagaaaaattaaaaattattttttaattaccaattttaattggaaaatgaattgttgttaaggtagaataaaaaattaattgatttaaattacttttatttgaatgatttaaaaaaagattaattaaaatataattagtgaaaaaataaacaaatttatttatattgtcatgtgaaaattaaatatttttacttctcaatattataattagaaaagtaatttagctgaatggaatattaaattttaatttatgtatttgtcaaagacttttaattcatttttattaaaccgatttaaactcttttaattaataaattaaaaaattttcaaaaaaaattcacagaaaaacattccacggcatggcacaaaatctgcgccatttttggtccccccgtgccaaaatcgatgaattttctgggaaaggatacgcttggagagaggtaataacgaagaattgaataacgccgtgtgctatgaatgagtgcgcaaaaatggccccctcctgccccagggcacgtcgagacccaaatccaattagcggctttttgcctcgggaaaaaggggttattagacaaaagccggcacacacaaattttttggcgggacgtctgacgcgtgccgttaatgaatggactattcaataagttctgtggcataatgtttcaaagggtatggaatgccaatccaaagccgatgatgatgatgggatgccgaaaaacagaaagatagtgaaaatgccaaaatggtgggaatttaaaaatttatagagtgccaatgaaattcttcaaaaaaaaaatcatgggaaattggcagcaaaatgccacagaatgacggatttaaacatttacacaatgccaatggaatgcaaaaata

SEQ ID NO: 80668 - DNA, 672 bp, Heterodera glycines
  Genomic contig location: Contig_ID=SeqID_16276; Location=207..878; Strand=+
  SCN-specific regions: Sequence locations=1-52,75-226,262-292,337 -472,494-496,519-672
atgccatgccattcgttggaaaaacggtgtgtaaatggacaacgactcatgccatgctatgccaagcatgtgccgtccgtcgtagagttgcaagcttgcggcggaatgggaacggcattttggaggtgtgccaaaaattgaaattgcgggggcgttttaaaaatttccgaaaaaattaccaggcctaaaaaataaattgctagggtcacaatgtaaaaaaaggctgttaaattaaattaaattattatttttttatataaagaagcctctcgaaaaatataattgatagatgaaaaaaagattaaataaaaaattaaatgaaaatttacaaaaaatggcatttccaaaagttttttgcgcccaaatgatcgaaatgccaagagctcagaaaaagacataaaaaattattaaaaatgctgggcgttttccaaaaacctccaaaaaacaaaacaaaaaatattataagtttgtttaaatttaaccaaatggttaattctatacctaatattttatatatatttgcctgcaaaatttcaaaaaatttcgttttaattttcataaatgttattgcacacaaaaaaaaacggttttttgaaaagatttttggtcatatttttttagaaatttaacgatttttttttgaaattttgcaggctcaaagaaaacacttaa

SEQ ID NO: 80669 - DNA, 2056 bp, Heterodera glycines
  Genomic contig location: Contig_ID=SeqID_16277; Location=437..2492; Strand=+
  SCN-specific regions: Sequence locations=1-182,367-413,435-473,508 -642,665-1330,1370-1962,1984-2056
atgggaaagaaagagtgcgggatcattttctctactcaggtctcgacttcgccaactcgctccgaagacagcgttgtgacggtcaaaacggtgagttatattttattattgctgagacaaagatttttttttgatatttagcgccaataagcaaacaaacgctgcgttgcatgaggaagatgaaataattttatttaaatttttgaagaaaaaaatcagtaataattttatattaaacagacgatcaaatataatattttatatttcttttaaaaatttttatgattttttttatcattatattatcaataaaatattgggaaaaatatctgtaaattgtaataaatttaggtatgttttttatttggcattggttgaaatagaacagttaaatgatcgtaaattaaaataattgtgttaccaaacatccatcctttgcgttggtcatgtcgtcattctttcaattgttcatctttaaaaaaatatatataattatatgaaataaaagaattcataaaaatcatacctaaataatccaggccaaaattagcaaaatgatgaggataaagcaccaaaccccatatgctgaacgcttgcgttcaaaaagaatgatctgaaatattaaaaaaaagctaaagattgatataaaatattaaaataatatgtacctggccaacgtgaaaatgtcgtacagtaggtttggtgcgtttaaacaaaggaagattcatgggacgtgccatttcgctaaattaaaaaggggcacaaaaaaaaggaaaagggcacaaaaaaagggaaaaggaatatgagaatgacgctagacgttggcgagatatcatcccaagtgttttccgttctcgactgatgacccccttttcgttggtttggtccatcactcgagaacgacaaacatgagggaccatcttctactatgaataaagtaattattgaataaaataaaaacgggcgggtgacagggggggggtgaaggtatataaaagtcgagaaatcggatcattctaattcttgacaatcttaaaaatgagcattaattatagcgccaaaaagcttctcatggacaacattttgcccgccgtagaaatcagccaaacgtccaatggcattacgctgatcagcgagcgaattgcagtgcctcgaacaattccgtatgacatcgttggcaagtgtcgagaatgcaaagccaccgaatgcgagaccgagtggtgcatttcaaaagaaggcgtaacaatttggtgcacccgcttcaaaattaatcctcgtttcgttccgtttgattatgtttatgagttgccaggctatacctttttcaaggttttaaaatattatatgatttttctttaaaaataatattcagattcgtaacaaaggccgagtttttaatgtcgaccacggtttccgctccaatgtttgcacgcggaccgagactcccgtctacaatttaccgcccccaccgcctccgcctcaactaaagccaaagggaaatgagcgaggaacggacgagcaaactacacaaaaattttttgagtctatcacggcagctactacaggattggatgttcctcaaaagaagcatggagaagcaaatgaattttttgatgctcttacggcagcaacaatgggaatggaagtcgacgaaaacaaagagaaaaaagcgcttccacaaccgcagagtaatgcctccgatttcttttctccgatttcggcagctactatgggaattagtggcgaccacctgaagcccaaaccgaaactaagacaacacttgccaagcgcttcggatttcttttctccgatttctgcagctactatgggaattagtggggaccacctcaagcccaaaccaaaaccaagacagcaccagccaaaagcctcggatttcttttcaccgatttctgcagcgacgatgggaatgagtggcgaacagaagaaagacgaaccaaactcaaaccaacaaaagaaagacattccagaatttgcttcggccatttctgccgccaccatggggatgagcaattacgaactacagcagcaacttccg

SEQ ID NO: 80670 - DNA, 224 bp, Heterodera glycines
  Genomic contig location: Contig_ID=SeqID_16277; Location=2129..2352; Strand=-
  SCN-specific regions: Sequence locations=1-224
ctgcagaaatcggtgaaaagaaatccgaggcttttggctggtgctgtcttggttttggtttgggcttgaggtggtccccactaattcccatagtagctgcagaaatcggagaaaagaaatccgaagcgcttggcaagtgttgtcttagtttcggtttgggcttcaggtggtcgccactaattcccatagtagctgccgaaatcggagaaaagaaatcggaggca

SEQ ID NO: 80671 - DNA, 811 bp, Heterodera glycines
  Genomic contig location: Contig_ID=SeqID_16278; Location=520..1330; Strand=-
  SCN-specific regions: Sequence locations=1-158,180-355,378-597,630 -647,672-811
atgacggaccagggcaaagagttcactgccgcccccgtgcagcgctttttcaacgaaaaagaggtgcaacaccattgcatgcacacctcaccccagtggcacgccgggattgcggaacgggcaatccgcagcatcaaggtggtggtatagacaagaaaaaacaattgttatttaatttttctattcttaggagcggctgtatcgatacttcacccaccgtggcacccagtgctggaccggtgtgatacagcacttggtgtcggcgctgaatgcgtctccgcatcgtgccctgtctgggctacggccccgggacgtcaattttgccaacgcggagcaaattcgacgccagcaactggagagtagcaagcatgtgcgtgggcgaaatccgcggcctccacgcttcaacgctggagaccgtgtgcgaattgagaagcacaagcatgtgttcaaaaagggctacttgccacgcttcaccgatgaggtgttcactgtggcagaggtgcgagactcacgtacgcctaccacgtataaattgcgcgacgacaccggggagctgctcaccggctggttctacgcacaagacttgtgccttgtgctcccgcccccagccccaccacagcgcccaacacaacaaggggcagaggcatctgctgctgctgccgcagccgccgtcgttggtcccgtttatgacattgaacgggtgctgaaaaggcgacggcaaggacgcaacggcgtggaacattgccttatcaaatggaagggctactccgcagcgcacaacagctggatccctgccacatcaatcatataa

SEQ ID NO: 80672 - DNA, 879 bp, Heterodera glycines
  Genomic contig location: Contig_ID=SeqID_16279; Location=89..967; Strand=-
  SCN-specific regions: Sequence locations=1-610,637-754,792-879
atgaagcacacaacccgcatgctgttagtaccggaggaactgtaccgctccttgttggccaggagctcggctcctgttgccgacgcatcctctgcgaggggcggcttaccgcagcataccacgccaattgagcacacggcaaagcgcatggcgcgcgctgcacacagcggcggcgtcacccagagcacggatggcgtatctccggcatcgaaacaacaacaccttctgaacgatgacaaacggttgatccactaccaacaggagttcaagaggttcaaaaaattgctggaggatgagcaggagcgtccagcgcctgttcgtctcacccaactgcccaccgacgaagcctcgaaggggctgctgcgcgatgcactttccgaggcggcgcgaacaattcaacaacaacaacaacctcaaccaaaacagccggcgccgcaccaacaacaacagcagtcgtcgcactctgattcgtcaccaatgaggcagcctccacgtcgcagacaacgaccagccaaaaggtcaccccgtacgacatcagtctctacggatggcgccgaagctagccgcttcccgtcatcgtcgtctgccgcctccttgttgacacgcactgataatggaggaagaggaggagctgagacgactgagcgtgaagacagccccaacgacgaccgaccccaaaatatggcggcagttggccccgcaaggaaaggacagcgggaagaagcggacgtgcaactgcatccatcaacatcgacagcaactgcagcaccagcagcagcagtagcagcagccttacgcgacactgagcagaggaaacgacaagccattgactatgcgttacgcaacgcgggcacgctgggcatcggagatggacagcag

SEQ ID NO: 80673 - DNA, 53 bp, Heterodera glycines
  Genomic contig location: Contig_ID=SeqID_16283; Location=260..312; Strand=+
  SCN-specific regions: Sequence locations=1-53
ggcttttttgcttgccgaatgaggcttttgaaaattttcatctgcgagccctg

SEQ ID NO: 80674 - DNA, 330 bp, Heterodera glycines
  Genomic contig location: Contig_ID=SeqID_2605; Location=329..658; Strand=-
  SCN-specific regions: Sequence locations=1-330
ccgggactcaaatgtcccgctcaggccaaaatttttttctatttccgggaaaaaatcgaaatttttccgaaaaaaataccagtcgatagagctcgaaaaactatgttttggaagtggtctccgtttttctgggaaaattcgttaaaaaatcataaaattaaaaaacccgaaaaccgttttttaggcctaactcgaaaaattttgaaaattttcgaaattttaaaatctggaaaaatcgagctttcaaagctctacaataagtccgctggagccacctcgctcagatcaaaccctaatgagttattcgcctggtactgaagtgggaaaaaa

SEQ ID NO: 80675 - DNA, 1015 bp, Heterodera glycines
  Genomic contig location: Contig_ID=SeqID_2606; Location=860..1874; Strand=-
  SCN-specific regions: Sequence locations=1-424,446-458,480-668,690 -1015
atgcaatggaaaccggaagtgcgtacaaaagtgattagaagaggtgcaaaagtgattagaagaggtacaactgtgattaaaggaggtacaacagtgattataagaggtgcaacagtgattagaagaggtgcaacagtgattagaagaggtacaaaagtgattaaaagaggtacaaaaagtgattaaaagaggtacaaaaatgattagaagaggtacaactgtgattaaaggaggtacaaaagtgattaaaagaggtacaaaaatgattagaaggaggtacaaatttgattagaagaggtacaaatttgattagaagaggtacaaatttgattaaaaaaggtataactgtgattaaaagtggtacaaaagtgattcaaagaggtatatcagtgattaaaagacgtacaaaagtgattagaagaggtgcaaaagtgcttagaagaggtacaaaagtgattcaaaaacgtacaaaagtgattcaaagaggtacatcagtgattaaaaaacgtacaaaagtgattaaaggaggtacaaaagtgattaaaagaggtacaaaaatgattaaaagaggtacaaaagtgattcaaagaggtatatcagtgattaaaaaacgtacaaaagtgattagaagaggtgcaaaagtgattagaagaggtacaaaagtgattcaaaaacgtacaaaagtgattcaaagaggtacatcagtgattaaaaaacgtacaaaagtgattaaaggaggtacaaaagtgattaaaagaggtacaaaaataattaaaagaggtacaaaagtgattcaaagaggtatatcagtgattaaaggaggtacaaaagtgattaaaagaggtataaaagtaattaaaagaggtacaacagtgattaggagaggtacaacagtgattaaaagaggtataaaagtaattaaaagaggtacaacagtgattaggagaggtacaccatggttaggagaggtactaccattggggaagaggtacaacatggtttgaaattaaataaa

SEQ ID NO: 80676 - DNA, 597 bp, Heterodera glycines
  Genomic contig location: Contig_ID=SeqID_2608; Location=436..1032; Strand=-
  SCN-specific regions: Sequence locations=1-161,201-350,372-597
aaattttttgaatattatacaatcgtgctttttgctctctatcaatttattataaaaaaattcacttcccttcgaaattgaaggcagaatgctcatttgaagctacgcaaatataaattaatatttgctataagaaccgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaacaaataaatcataaaatt

SEQ ID NO: 80677 - DNA, 316 bp, Heterodera glycines
  Genomic contig location: Contig_ID=SeqID_16288; Location=824..1139; Strand=-
  SCN-specific regions: Sequence locations=1-169,218-316
atgttgaaaacattcgtcttacggttggatcgggtctatcgtagccgcgtgatggatagttatagccactgtatgggctgttattgttactgtacggattcactgggtaagggttgttgttgatattgttgtcatatgggtacggattgttagtattttgtttgtaacctttaaataacttttgtataatattagtttatttaataaaaaatttaatccagaacttttttgatttgtatgggtataaatgcaaatatcgacatattatattaaaagaagagcttaattagacaaaactaaattcgaaattaataaa

SEQ ID NO: 80678 - DNA, 743 bp, Heterodera glycines
  misc_feature (652)..(652): n is a, c, g, or t
  misc_feature (676)..(676): n is a, c, g, or t
  Genomic contig location: Contig_ID=SeqID_16288; Location=1222..1964; Strand=+
  SCN-specific regions: Sequence locations=1-2,40-81,103-743
  Gene Ontology: Mol. function=DNA-directed RNA polymerase activity; Cellular component=DNA-directed RNA polymerase II, core complex; Biological process=transcription from Pol II promoter
atgcacacaaaaaataaattcagtccagtctacagtaatccatcttacccattcaacagcaacaatttatataatggatataacccaagcaacaacaacaacgcgtacaacccttataacaatggatacaatccgtataataatgtaaacaacccaaacaacaacggatataacccgtacagtaacggatttaacccgagcaacaacagatataaccaatataataatggttacaacccatacagtaatggatataatccaatcaacagcggatataatccaatgaacaacggatataatccaagcagtaatggatatagcccaattaacagtggatataatccaataaacaacggatacaacccatacagtaatggatataacagtggatacaatccaatgaacaactataaccagtacagtaatggatacaacccctacagtaatggatataacggtggatacaatccaatgaacaacggatataaccagtacagtaatggatacaacccctacagtaatggatacctgaacaacaacggatacaatcaaaacagcaacggtataaaaataaatgctaatatatttcaattaatatgtttttcaaattgatgacttctcctggttaacaaagcaattaagcttatattgnattttcagattgcttcaccgcgtncatggtacaggaccaaagagcatgcagcgcaatgcaaaggacatgctcaaaccccgtgggtaattaa

SEQ ID NO: 80679 - DNA, 1729 bp, Heterodera glycines
  Genomic contig location: Contig_ID=SeqID_16290; Location=1263..2991; Strand=+
  SCN-specific regions: Sequence locations=1-67,89-144,170-392,425 -529,551-583,611-872,905-909,943-1101,1123-1550,1572-1582,1604-1729
atggcggcggaagcggcacaaaacggcgacgacgcggacaaaacagcaaccggacgaacggacaatccagaaacgacgacaaaaaccatggagggacaagcggaggagcaagaaatggaggacgacacagagcaaaggtgtgggtttttggaaattttgataatttttacatacatgtacaaggggtgtctcagaccaagggccatacgacggacgattgggacagggggggtgtctcgggaccgatttttcatacgaaggtccaaatgttctccggcgacgaccttttttttttttttttgcttttcaaaagcacttattttttgcgacctttgcattgcttttcaaataaaacaatttttatacgccattgcttttattcatgtgaaaattttaaaacacaaaaaatattttattcgtcaaaagcggtgtgcaaagtcaaattggaattggaagaacactccggcgccgtcggtggcaattgcatttgagttgaaggcaaagaaggaagtatttttgtaattaaggcaaattataaaaataattttcacttgagagattgagattaaagggtacctctcgagattttcccgggaatttccggtcctgggtttttttaaatattgctaattttgtcgatttttgtaaaaaaaattttggaaaatttgggtgagggggaggccttggagagggtaccaataaggaaaactgggaaatttcggttaccccacatttgcgccccagccacttgcgcctatgtccaaaattggattctaacttacattttttcaatcccaaatagactaaaccgctttaaaaagcgattgaaagtgattgtatgcaataatttgatcgtcagcaaatttatgaaaaaataataaatttttgaaacaacataattattgttcctaataaaccaaaagaacaagttttcttaaatttaatgctgtttaagacctctaaaattgggaaaatataagtttgagcagcgcgtcatgacgcagaggcttggcaccgcaactttaaaatgtcaaactgttttttcatagacaaatttattgttggtatcatttggtagcccaaagtgttttaataacaaacacaaaatttaaaaagttatattcgcttccaaaaaagatttggtgcacgacgccaaaataacaaaaaaaaagagagtcgattttgccataactttagtaccccaaatgaatttttttcgaattttgcgggttaaagcagtaacaggcaagcgctttaaaagcacacaaccaaattcatttaaattaattgtgccactaaaacattgagaattttaataaatcaaatttttgaaaaaattacaccgaactctcaaaaaaaaaaacttttttttccaattattgtttttttaaatgattcaaaatgcctttcttattttgtttcttttggtttaaggacaacaacaaaaactgtgatgtcgggaggacaacaacgacaacaattggccggccaatcgtcggtggtggcgggggacagcgacgacggcggggaggaggacaatgacaactgcacaacaacaaccaccacccccacttacatcaacacatcatcatgcagcatcattttggatgaccaccagcagcagcagcagcaaagtgatgccgaagaacaggacgaagaagacggagcagaaaacgatggtggaggaaatgccgaggaaaatgcgcaaaatggtgacgggggggaggag

SEQ ID NO: 80680 - DNA, 364 bp, Heterodera glycines
  Genomic contig location: Contig_ID=SeqID_16293; Location=1362..1725; Strand=-
  SCN-specific regions: Sequence locations=1-129,152-329,352-364
atgtgcatcataatcagctatgatgatgatcagcatggtaaaaacccaaataaattgttaccaatttgaagctaaaactgtaggaattcgtatcggcacagttttagtcatccaaaaattgaatttccaaaatgcaaaaatctcaattttcaccatccataccttcatggtgcccaacagggttttgccagctgctgaccgtccagctgaattggcccaatttgtcgtcaaattgtattggaccctcaaaatggatgcgatggtcgccgccaacatcttccacattgtcactggccaacaaaaattgaatgtcacggacagcgaagttcaagttgatcatctgaaagagcaaccaactaattaa

SEQ ID NO: 80681 - DNA, 1139 bp, Heterodera glycines
  Genomic contig location: Contig_ID=SeqID_16293; Location=425..1563; Strand=+
  SCN-specific regions: Sequence locations=1-94,116-193,219-491,516 -643,665-824,917-950,973-1139
atggcattgctagtatcacgtgccactgtgttgtttgcttcatcgtacaccgtgtttgcctaccgtagcacttcgtccttttacaaaatgtgcagtaacaattttgttaggttcattaccgtaatctttacgacaaatgatgcaatgtctgaaaatgaatgctcaaattattttagatttgaatattgtgcgagttttttaattaaaaaatgtttttgtagcgtgtacaactgccaaccatggtctactgtaggcggtgaagagtgcggtaaggtgtacggtatcgccaccgaagaggaccacccaatgagagggccagggcgtgtgtttctgctcaccatgctttcctctggcgctgttcagctgctctcatgcagttctgatctggcacaaccgttccaactgatcgccacgacaaaccatttcccatacaagtgagttggtttgatcaaatgttaatccgatctcaattagaatgtttttttttgatcattattatatgtatatagagatgaacatatttccaaatttgagagatttttagtatctttcgtattttttatgtaattaggaaaccaattggtttcacggattaatgtgttaccatactcaggaatgaattattgtaaaattttgggcatacaaaatctaacatcatcattttctaaaaatgatcgatttgtatgaaaaaaattaattaaagaattcgtcaaatggcatttgcggatgatcgcctgttaattctgacggatgatggattcttcggcaccattgatctgacactccaggtctgtttacactttttaatgatggggacaattgtgttaaaaattttttttattaaaattaacatttttagtttaaatattttcagaaaattagacaatttttttaattaaatttaactaattaattagtaacattaattgcttctaccttaattagttggttgctctttcagatgatcaacttgaacttcgctgtccgtgacattcaatttttgttggccagtgacaatgtggaagatgttggcggcgaccatcgcatccattttgagggtccaatacaatttgacgacaaattgggccaattcagctggacggtcagcagctggcaaaaccctgttgggcaccatgaag

SEQ ID NO: 80682 - DNA, 613 bp, Heterodera glycines
  Genomic contig location: Contig_ID=SeqID_16294; Location=379..991; Strand=+
  SCN-specific regions: Sequence locations=1-300,398-613
atgccggtaaatgccatcattttgtcgaccgataattaattgaaaaaatttatgaactttctcccttttttagcccgtggctgtgttcttccgcggctatctgcgcgacgggaacgcgtgcactgagcatgtcatttacaacatcattttgtggtgagtgatgccctcgggggctgcgggtaccattttgtattttttcaaccaattttttcaaaatttttttttacctttaccaatttttttatttttgaaagggctgaaaatttttcgtaataccaacagattgctttaattgtagggtttttttttaaatttaatattttaaataattgacatttttatttgggcctatacaaatttaattaatttaaatatattcagattttttattttttttctcccttttcagctttttcctgtgggtgcccggcatggtgcacgccttttggtactgcttcagcgacatgttcagcgggccgaagaaggagggcgccgggtacagcaaaaatgcctgagcagaagagcactggcgagcggacgaacgcagaaatgagcattttttgaaaaatgacgtcatcgatcttattaatttttgacacctaattaagcgata

SEQ ID NO: 80683 - DNA, 466 bp, Heterodera glycines
  misc_feature (163)..(163): n is a, c, g, or t
  Genomic contig location: Contig_ID=SeqID_16295; Location=910..1375; Strand=+
  SCN-specific regions: Sequence locations=1-185,208-242,267-355,378-466
atgcaaaataatagagcatcagaagggctctcgaatgataccaacaatgttagatttggtggaaaaagaaaaaagttatagtccaaaaactgggctggcgccgaaacgaggtggaccccttagaaatgcgttttttaaactataaaaagggaaagtgatccangttgtttcaaatgtcacgcaaaactcatgatagctaaaaatgaacgtcatattctgttcagcgcataaaaatgccctagaaaaaattattaaaaaaaattttagggggggtcacaaaagggataagaaccggtaaaaaaaggttcgtttaatcccataactctaggcagataatttgtagttttacccttagaatttttatatttatttattttctcagttcgacattgtatacgaagccaatttgcacgtagatgatctttttaggcataatcaagaattcctaatgtgccatttttactga

SEQ ID NO: 80684 - DNA, 168 bp, Heterodera glycines
  Genomic contig location: Contig_ID=SeqID_16295; Location=1404..1571; Strand=-
  SCN-specific regions: Sequence locations=1-22,46-168
tataaaaacaaaatgagtctaatttaggatttttagggttttcggggtcgctgaatacgaatataccctttatattaccccttgcctaaccttaggcccgtctgaataataaaaaactcaaattcgagacttggacatttcgtgggctggacattttgtgggtcagcg

SEQ ID NO: 80685 - DNA, 654 bp, Heterodera glycines
  Genomic contig location: Contig_ID=SeqID_16296; Location=45..698; Strand=-
  SCN-specific regions: Sequence locations=1-654
atggcaaaccgacggagttttttgacgggaactttcacgttaaaaggggtgaaggcattcaattcggaaaatgactttgttcttcgaggaacagtggcgaacaaagagaatggacagtcggcagctgcggcgcctttgaaggcactttcagagagaaagcgcccgaagagactgccaaaaaatctacaaatgaacaacgacgtcgacgggcgtctgtctgaaaaacaaacggataatttgcaacttttggcgccggaggcaatgcgttcgatgaaggaatttttttggcgattgctcatcgaaggacgctataataaattgatgaaaatgacaagagaaattgtattttagaatctgtttttcgcaaaaatactttgcattttaggcttttatcggttcggatcgccacaactcccaaaataaactcaatgaacaacacttcctcagtttggccacttttgctcttgcttttgcccggcacagtcacatttcgtgccaaaatgtgtacgctaccttttccgtggaattctttcacatggtcacttcctacatgacgaactgcttcgagctgatgaaggccgatcgccactccatccgaaaatatgcattttatgctcggcatgccataagaaatttcaaggagatgatgataat

SEQ ID NO: 80686 - DNA, 1221 bp, Heterodera glycines
  Genomic contig location: Contig_ID=SeqID_16297; Location=1411..2631; Strand=-
  SCN-specific regions: Sequence locations=1-74,96-399,421-1001,1024 -1046,1070-1221
atggaaatgccaactgagaccaaagaaagggagagggaaatgccggaagttgaaattggcggagaatgtttcgggacggcgaggggtgcggcgccagtggcaactaagacgacggagagcccccaaaagttgggcattcaaatgggcgaagaatggcgcaaccacgtgagatgcacccaattgtactggtccattgcttgctccttttgctttattcacccaattcagctatcaacattttttccaacccgagtaccataagaatttgtgtgaatcgcttttcaatgaatattcgcacgctttaacgaatcgaatttggaatacttttggcgactccgaatgccctggtcaacttttaacactcgccaatcatttatgccaaaatcttagcgaggttttataattaaaaaatctttattactaacaccttatatttgcagttctcaattacaacttcaatgccgaattcaatcaaagaactgttttctgcgcgtaataatgaaataattaattcagcaaatgatggcagtgatttatttggggtaaaatatttttttctgtttttctttatcttctcattgttagcattttaccgcaagtgcaaccaaacaacttcgctatttggagactactgaattacggctggaattggtcaaaattcaacccgagttgagtcacagtttcatcgaatctcttattcaacttctacctgacccagaatgtcttgtaaatgttcaaatagtgcatcaaaacaaaatgccaaaagaaatggattttgaatgcacttacgaaactccaaacaatgccaaaaacagtggacagagtctgaaagtgcaggagaagtcgccggcacgtgggaagaagtcgtcatctcttgtcgacaattgctgtaagctgctgcttgatttggtggatgaaagtggagctgttggagtgtcagaagaagaattgaaggtgggcaaatttgattcttttgtacgacggtgctggtaggctatgcgaatttttataaatattaaatatgcacaaattgtaattaattcggcattttattttacaaataactggaattcataggtccatataaacaccaccggaaaattttggttaatttaaatttaggaacgaatgtctgttcataattttgacgtggagatggtacaacaacaattgaataaactggtggagactgctgacgttgtaatttgcggcattgatgaa

SEQ ID NO: 80687 - DNA, 922 bp, Heterodera glycines
  Genomic contig location: Contig_ID=SeqID_16298; Location=116..1037; Strand=+
  SCN-specific regions: Sequence locations=1-578,630-823,845-922
atgggaatttcgtgcagttccgctgcgggtacatcagttcccgtgaccaaagtgactccagtgactgggtcatccaatgggagttcggatggcggtggaggtactacgccgttgcagcgaatccctggaattgcgagtgcattggctgctgcggttgtggctgttcaacagcaacaccataataataataacgttccgccatggccgtccggaactccgcccaacaacgccactcacccatctcttgacactccgccaattcgtcagccattggcacaaagaattttctcgcccgctgtcagcaactcatccagtttgtcaatgagcagcggatcttccaaaagcagcagcggggtttcctcagctacgtccaatgcactgttgcagtcgccgggttccagtggaacaacaatgatgaccggactgaacaacagcgacgttggcaaggagttcagggtaagatctgctgcattaaaaacatacctgtgcaagggggttagtcaaggggggggggtcatgacgtcgaacgtaaggggttaacgggtgtcgaacgtaagaaatcgggggggggggtcaagaggaaaaaaggagagaaaaaagaaaaagaggaaggaaaaaagggagaaaaggcagcgtcgaaatcaaggaaagtgccgtgaattacgttcgactaaccctgaggaatgcgatttgtcgaacgtaaaaaaatggagacttgaaaataaaataatttccacattaaaattttccaattcagctacgttcgacactctttccttacgttcgacgaattctgctgaagaaaattcgtcgaacatgagaggctgaaaaattcctaaaattttgctttcttttttttaagctttcattaaaatttcaatattttttctaaaaaaagtggcttataatcgcaaaaaaccta

SEQ ID NO: 80688 - DNA, 748 bp, Heterodera glycines
  Genomic contig location: Contig_ID=SeqID_16299; Location=40..787; Strand=+
  SCN-specific regions: Sequence locations=1-87,109-233,255-748
ttcattgtctgccgagccatcttctcaacgaaaaaggcattcttccaccggttcgccgatttctgtccaatcgcttgacgagggaatagaaacaaaaacagagagggataaaggcgggaatcaaaagccgcgacagatcaaacaaacacggaaaagcaacgaagtggcacgactattgaacgatctaacggccggaaattgtacggatgagttgaaaaaagaggggacaaacgaaagtaaaaatgggaaaaagagggcccgattggaggaactgaacaatcaaaaagaggggaacgaaacaaaggaaaaagaattcgatcatgaaagtggacctgggcaaaaacattttggaagagacaaatgtgatcaaaaagaacgacacggaacagaaatcgacaatgattattttttggaagaaaaaatggctggcaaatatttaaaaatgaaaagccagaaaacaaatgagcaaactttgtttttggggaagtgggttggacaaaatggtgagtgtgacaaatatttgttgtgtatttagccggcttttaataaatagtagtaatattgcaggttcttggcaatatatggcagagaggagtcaaaaattggcttcccaaggcagcaaacccaatgttcgtggcgatggtactgattcaacaccaacgaaaaaggacggacggacgggcgttgaaaaaggacagaaaaacttgcagtcgcaatttgccaaaatcgaacggaaaaggccgttgag

SEQ ID NO: 80689 - DNA, 1569 bp, Heterodera glycines
  Genomic contig location: Contig_ID=SeqID_16300; Location=14..1582; Strand=-
  SCN-specific regions: Sequence locations=1-21,43-478,502-1064,1086 -1435,1458-1569
gtcagttcgtttggtggcaccgatgagcagcagcaacaacaattccagtgtgacgaagtggaggaggaactgatgcttatgatgaagctcaacgggcacaaaaatggcgtgggtccttcttctgagtccgctacggtttacgagcagattttgaatggaaagaatgggcggagagttgaaaatgaaccagaagtttattcggtgggaatagcactgcaaactgacagaaagcataatggacaaagaattgactcattcagggcaaaacggggttggatttgccgacgatacatttggataaatttgaaacggaagtgaaagcttgtcacacagggcccgacggaggactcacaaaagtaagcgaagacttcgaaaaagcgcggaactcatttgaggtgcaggttcaacccatacgacaaagagccatcgccacaatggctaagttggatgacgaggagttcagtctgtcatcactagtgagaaatatcaaaataaaacaaaggcttttcttcaatctgcacttaaaacattgtaaattcagcaaaattaaggatgaggatgaaaccactgaagcagtacttcctccgagtggtcgctctcgaaaagggaagcggcgagcaaagaattcgctgtcacgaacaccgaatgattcattagacatacttgacagcatcgattcaaaaaagaatcctgaaaagacgaccaccccacgttcctttttgggtcgatacgattggaacaattgggacgaagcgaaggtggaaaaaaagataaatctgtcaaaatgagcaagcaactcaaagtaggccaccaaatgccaattttgacaggcttatggtctgtccacctctctctatgagaagcatccggtcaccggactgtccgctggccatcccatcgccgatgtgttcggcataattgcccgtgaaaacaattgtgcattcgttttaatcttttaaaactcaactgtttggcatattatttagccattctcgcactggctgatggtgtcaattggggcgaaggtgcgcggttggctgcccgatgtgccatccgcggttggcaatatctgtcagaccatccaataattttggatttttttgaggcgctattgagcaattgaacttagctattgagcgggacagtttcaaaacaacgaatgtgagttcattcggccaagtttagcaattctgtgtccttcctctgtttaaggatgtgttccattgtctgctcggttctttccatgctgcccatgcactcattctccaggagggcggtgcgttgaccacactttgtgtggctttggtagcccccgtccgtgcttcttcttccttcgttctttgcgcttgtaatgtcggcgattccctctgttttgtgtttgacgataagaatggagtcagagagtgagtgaaattcaatttataaattatctttttcttcccttcagagttacactcgcctcccacgacattggccaaatgcgcgacatgcgtgacgcgggcggtgctttgggtcccgtcgacgggagaaatccgcagcttcaaaatttgacttgctcaatgaccattt

SEQ ID NO: 80690 - DNA, 399 bp, Heterodera glycines
  Genomic contig location: Contig_ID=SeqID_16302; Location=1129..1527; Strand=-
  SCN-specific regions: Sequence locations=1-7,29-132,154-338,373-399
atggcacggacgacgacgacgacggaaagcattggcacagaggacgaagcgaaccgcgaatttgtgcaatcgttgcgcatcaaagcattgcaacatttgcaaaggtagcgtcggcgcgggggaggggggagaagccaaacaaaaaaggaaaagccgggccatagacagcacaattaggggcaaacatcgttttggcactgccaatcaatggtcatccatgcaaaaacattcagatccctcgagtcgttgagctcgctgactgccaattcgctgatgctaaacgaggcacttcagcccagcgaagagacgccaaatgaggatgaagaagagaaaagttgggaggagaaggaaagggaggaggaggaggaagagacggagcagcaaaatgtgccgaattaa

SEQ ID NO: 80691 - DNA, 854 bp, Heterodera glycines
  Genomic contig location: Contig_ID=SeqID_16303; Location=1..854; Strand=-
  SCN-specific regions: Sequence locations=1-462,484-545,567-601,626-854
  Gene Ontology: Mol. function=guanyl-nucleotide exchange factor activity; Cellular component=mitochondrion; Biological process =exocytosis
acaatcaacgctcgttttgcttcaacagtgacaaccaatggaatagcgccgagtgagcagcaacagctgaacacaacaaaagcgaaggaaagacacaaaggttgatgaggggaagtgtttctttttccgaatgatacaatttttgcagagggacaacccgtctggctgattgggtggtttccaatcattttcgagttgtcctgcatcataaatcgatgcaaattggacgtacggacacgaagtttaacggttggtttgcaacttttgtggtttaaagcctttatcacctttcacttggatatcatcgcaggttttgttcgaacttatcaaaacgtacggtggcacatttggtgcggacgcatggagtgacttattccgagtgattttccgcattttcgattttgggaaaatcagcgaattgggcaacgaagtgagtgaaaagggaaaaaaccattctttgtgaatgtacaaattttacagaaaagcaaatttggaagaaattatgacgaaaataattctaatacagaatacctaaaacaaaaaattggaagtgataacaaaaatgaacgggaaaaggaaggggaaagcggaaagcagaaaaagagcacattcagttcagcagggggaaaggtgccattgaagacaatttcctaaaatattttgcgacaattttttgttccaaaattcagaaaaacgaatggatggtcaccacgtgcaaccacgccctgtacgccattgtggacgtgttctcccaatactacgcctcgttgggcactcttatgttgcccgaggtgtaccggcagttggttttggtgtgtgcagcagggcaacgagctgttggcccgctcggcgat

SEQ ID NO: 80692 - DNA, 814 bp, Heterodera glycines
  Genomic contig location: Contig_ID=SeqID_16304; Location=282..1095; Strand=-
  SCN-specific regions: Sequence locations=1-365,396-515,544-645,669-814
atgaatctccaagcacatgcctcggctccgaacccggtccctgtacgccaagctattgcagatgcacgcggaaacattccaattgaagttcgaatgcaacaggggacttctgcttcagcaatgtcgagaacctaccgaaattacatcgcccgagaaaaagtggaacgcggagatgatcttcttgatctggctgacatttctcaaattgtgatcccagaaagactgcaaaatcagcttcttctcgaccgtattgttgaccaacagcggatgtttgtttttgcttcaccattttcgagaaatcttctcgaacaatacggcaatcatgtcgctgtcgacggtactttcaaggtgattatacataattcaaataaaataaaattattaaaaatttttaagtgtgccccagcacattttacccaaatttacacaatttcggttctaattgacaaagttgctgttccttgtatttatggaatactcaactcaaaatccgaaaacacatatgctaatgtcagttaaataatttgaaatttataatataatcgaaaattagatgtttcaagcggtgtcacagacggttcctggttggcacccacaaacatttatgtctgattttgagtccagtgcgctgaacgcgataactaatgtaaaaataacaaattttacaagaaatcctgaacttaaggtgtttccaaatgccatcagaattggctgtctttttcatttttgtcagtcaatttaccgaaaattgcaacgtctgccgggtcttcatacccaatttttggaaaacgccgaacaacacacaaacattaaa

SEQ ID NO: 80693 - DNA, 2329 bp, Heterodera glycines
  Genomic contig location: Contig_ID=SeqID_2609; Location=2323..4651; Strand=-
  SCN-specific regions: Sequence locations=1-105,128-189,212-506,529 -645,685-857,880-1140,1162-1434,1502-1599,1682-1824,1848-1865,1888 -1945,1967-2329
atggcccagcccacacaataccacggaaagttaatgcattctttggcgtcaattccaaaagcggtggcttggtttctgagcaaatggaatttccgttgcgtttcatctttttgctggtttgttttttgctgcaagtttgtaaatgaacacaaatttcttctgaaagcaaagtttgtgtatgatgaatcattaaaacaacataattttgagtgaatccaactaccaaagaatatagaaaatgtgcaaatgtaaatgcattttttgtattgattcgttttttgtttgtataccgtatttgctctaattatcccccatgggggattatttttcaacctcctcgtagactgggggatacttggagactgggggattaagatagagggattattcttcaaacccctcctagactggaggataactggagaatgggggataattagagcaaatacggtatgtagatgtgtggccctttttgtgtggtcacaaattgaaagaaaaaggtaaacaaataaaaataataaaaaaattctggcgtattgtataaatggttactgaatttgaatttggttgcactgttatggaactagagaaaggcaaatcaacatttttctcttagcgaaaattgttttaataaatatcaacattgacgttgatatttatttaatatcaacataacattatgccatcaacgtaatatcaacgctatttttaaaatttgcgaaaattttttaaaatttaaagcaatttttcaaaaatgacttttggcggaaaataagatggggagagagataacgcaaaagtgagagggtgttatattcagccccagtcatacaaaagcatttttggtaaagaagaataaagaaaaattaattaaaaagagagtgttatgggaagagatttaagacagagagagaatagagaacatagtgaggaatctgcgtctcttaccaaaagaatcagcgaagaagagacatgaactcccttcccattgcgctctctattgaaattgttttctctaccctccttcatcaaaaatgttttgtatgactgggactgagatccagcactctctcatttttgcgttatctctcgcactaaaattataaaccgctcatataaattttaacaaattttcgcaaattttaaaaattacgttgatatttgcgttgatggcataatgttagttgatttaattaaatatcaacatttaaattgataccccgcaaaaactaataaaaaggttgatttgccattctctagtgctgatcaatgttttaaaaccatttttcatcattttttgggttttcaggaatgtttgggcaaattttgatgaaattttgtaaaaaaatccattaaaaccgaaatataagtatatcccgttaggggttgattttttggaatcttccaaaaatatggtccctaaaattcactctgattaaaattaaataatatcaacaaaataatttgttttaaacaaaaatggatatttttaaaaatttttgttcactaatttatgtttattttttcagattatcgtggatttcttctaccaaatcactttgttcactgcaggtcatttttggcattttttatcatcacaaaatttatttaaatgaaaacttttttttatcttttcaaaattatttatttatacattaaactttaatattttaaatattttccccagaaatattgaaaatcaaaaaattttcttattttttaggagagagatgagtaaaaaattgaccaccaaaaacaaactttaaaattttttcctaacctaaaaatttaaaatgaaatttaatcccgtccccatttttaattttaaatgcaattttaaaatatttgcactccaaaaatttgatttttactatttctcatgaaaatctaaaatttattgcctcttaaaaatcgaaatttaaccctccccctaaagctttttccttgaaaacctaaaaattttctatttttttttcaaattttcttggtaaactaaaaattcccacttttgccggcctctagaaaatcaaaattttaccctcccactaaagcatttttcaattgtttttcagtgctcgtcatttgtgcacgtcgggaactgatcagtgcccggaagcgggacaacaacaaaatccatgccacaaatagcaacaatttgtcagaggatgatgttaagccgacgaaaagcggtggatttcggcactcattagaacgcaaattcaacgcatttaaagacatttacatttgcctggtcagtgtgccaaattcaaaacaaaaacaaatggacattccattcacgggattaatccgatcaaaaatcaatccatga

SEQ ID NO: 80694 - DNA, 1372 bp, Heterodera glycines
  Genomic contig location: Contig_ID=SeqID_2609; Location=3577..4948; Strand=+
  SCN-specific regions: Sequence locations=1-196,219-391,431-547,570 -864,887-948,971-1372
atgagagagtgctggatctcagtcccagtcatacaaaacatttttgatgaaggagggtagagaaaacaatttcaatagagagcgcaatgggaagggagttcatgtctcttcttcgctgattcttttggtaagagacgcagattcctcactatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattttcgcaaattttaaaaatagcgttgatattacgttgatggcataatgttatgttgatattaaataaatatcaacgtcaatgttgatatttattaaaacaattttcgctaagagaaaaatgttgatttgcctttctctagttccataacagtgcaaccaaattcaaattcagtaaccatttatacaatacgccagaatttttttattatttttatttgtttacctttttctttcaatttgtgaccacacaaaaagggccacacatctacataccgtatttgctctaattatcccccattctccagttatcctccagtctaggaggggtttgaagaataatccctctatcttaatcccccagtctccaagtatcccccagtctacgaggaggttgaaaaataatcccccatgggggataattagagcaaatacggtatacaaacaaaaaacgaatcaatacaaaaaatgcatttacatttgcacattttctatattctttggtagttggattcactcaaaattatgttgttttaatgattcatcatacacaaactttgctttcagaagaaatttgtgttcatttacaaacttgcagcaaaaaacaaaccagcaaaaagatgaaacgcaacggaaattccatttgctcagaaaccaagccaccgcttttggaattgacgccaaagaatgcattaactttccgtggtattgtgtgggctgggccatttgtgttccgggatgtaacccaccgaaagcaataagtctgaattccgaggtacaaaaaaaaactcggaaatctgtgaactcccaggtctaaaatttctcggaaaacgcaatttggttacgttccctggcatgttcgttaaagaaattgacacatacaaaatttgccaaaaacaggcaaactcggccacgtcggttccgtctctttggacatcaaaaattgtgagatctgctccgtttacttcaaagtcaaatcaaatgccaaccacttctattcggttcgtccaaacaccggtgtga

SEQ ID NO: 80695 - DNA, 120 bp, Heterodera glycines
  Genomic contig location: Contig_ID=SeqID_2610; Location=763..882; Strand=+
  SCN-specific regions: Sequence locations=1-120
aaacgtatgattgttgccgaggcggaacagagagcatttgcgcccattccagagtgctttttcgagctgtccaacctgttgatgctcaaagcgtgggaggatgtcgagcagtatgagcag

SEQ ID NO: 80696 - DNA, 103 bp, Heterodera glycines
  Genomic contig location: Contig_ID=SeqID_2610; Location=1503..1605; Strand=-
  SCN-specific regions: Sequence locations=1-103
gtgctgcatgttggagcgtggaagtcagttgacgtcgaataccacttttaatgagcttaaagagatctctttcaaaattgcctttgttttcacaatcacttaa

SEQ ID NO: 80697 - DNA, 407 bp, Heterodera glycines
  Genomic contig location: Contig_ID=SeqID_16307; Location=21..427; Strand=+
  SCN-specific regions: Sequence locations=1-320,349-356,378-407
atgccgccgcctcatccgttaccgtcgacaccccaacacccccaccgctacggtggccttcacaccatatttgaggacaccgttgagcagaaggcagggcatgagaaagacgtacggcaacaaaaagaacaacgcagtcacacttcatcagctgctactgtcaatacagaggccatggtgcgtgaggctcaccgggtgacctcccaacttgctgccgcaattccggagcctatgcgtagcgctgtgacctcctccgtggccattcccatccttgtgtcggcggcacaaagtggcggtggtcgaaaagaagcaacgcaacacaacagtgaggaagaagaagaaaaggaacgcaattgatatagtgatggaagggcaaactcaaatgtgtttactagtggttcagtgaa

SEQ ID NO: 80698 - DNA, 270 bp, Heterodera glycines
  Genomic contig location: Contig_ID=SeqID_16308; Location=78..347; Strand=+
  SCN-specific regions: Sequence locations=1-212,235-270
gttatagacccaattactctgatcacgtttacacagtagacgaggcccgctcaaccaacccccagcactatttgctcaaagactattatggcacaaagttgaagagaaaattttatttgccagaattaacaaaagtacaagtggatgaaaacacaatgtatcgaattgaaaagaaatacaaagaacgagtgagagatggtaaaagagaaatgttggtgaaattcattggattccggaaaaatattgggtcacaaatgaagaaataaatga

SEQ ID NO: 80699 - DNA, 1572 bp, Heterodera glycines
  Genomic contig location: Contig_ID=SeqID_16308; Location=364..1935; Strand=-
  SCN-specific regions: Sequence locations=1-89,112-164,186-392,415 -728,757-892,916-1087,1109-1572
atgtacccgcgcggcttgatcgaccccgagtacaattgcgatcattttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggttgttccactcgtacctgctgaagttcctcaaaatgaaatttgagggtaaaatttgaaaaacttaataaaaaaaattaaacaaacaaaattttaagcaagcggatatccagcgtcttgtacggaggcgggcatcagcgaggaggagtcggcacggagaaagcaggaacacatcgacaaggccaaagaaaaggcccaagtccctcttgaggcggaccgaatcaaacacaaccccggactccgctacctgtccaagctgtgtttgaattcgctgtggggccggttcgcacttcggtaaaattttggttaagaattatgaaaaaaatacaaatcatacagaaaccggcttaccaaaaccgaaatcgtcgagtgccatgccgagctggccaaactgctcaacgactcgaagattgaggtcagcagcattgatcagctgacggaaaagttctggatggtctgctacaaggccaaagatgagcatgtggtggagcacagcacaagcaatgtaagaaaagttttaaaatatttaaaaaagacaattgaaattttctcaggtggccattgccctatggaccacctctgctgcgcgaatccacttgctggaatcgctgaaaaaggtgtatggccctgcaccaggtgtagagcgcttcgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttttgtttagccggacccaaggcgtacggattgtggctgcgcaacaacgcaacgggggaggacgagtacaagctcaaggtgcgcggcatcacgctcgactcggatgcctgcgagcgcataactttcgagaagatgaaggacatggtgcagaacaagctgggacagccggacaacaacgtccgcttcaactacccaacgaagaactttcggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgtacctgtctgttcaacccagacctcaatgtgaacatgttcacagaagaggagctgaatgaccccgacattatgccataattgtttttattttttaattttcattaaa

SEQ ID NO: 80700 - DNA, 372 bp, Heterodera glycines
  misc_feature (84)..(84): n is a, c, g, or t
  misc_feature (129)..(129): n is a, c, g, or t
  Genomic contig location: Contig_ID=SeqID_16308; Location=2337..2708; Strand=-
  SCN-specific regions: Sequence locations=1-162,184-372
atgatggagcgccttgatgaggacaaaaacttggccatcgagtccaatggtaaaggaaataattcgaaaaatgtgccatttacnccattcaaaaggtgctatggcatgggatgcccaagctgctttccngacgatgcgcaattgtggggcggaggagaaacggccggagccctcagggcccgggacgcaaaacgaacccgggacattgcgcgggaattcgaagtggaagtgatttgggagtgccacttgaacgcaatgctggaggacaacccagccatgaaggcgtatttcgacaactgcccggattctggcccaattgacttccatgatgcattctttggcggtacctttttccatttaatttttaactaa

SEQ ID NO: 80701 - DNA, 599 bp, Heterodera glycines
  Genomic contig location: Contig_ID=SeqID_16310; Location=440..1038; Strand=+
  SCN-specific regions: Sequence locations=1-67,89-148,170-191,213 -348,438-599
  Gene Ontology: Mol. function=ATP binding; Cellular component =dendrite; Biological process=synaptic vesicle transport
atggcctcactccaagttgatggctcaatgttagagacgagttgtggtcagtgtattttattaaacatattttttattgtgccaataattcaaaagcatttccctaaaaaaggatcgcctcactacgcatgtccagaagtgattagggtaatttattattaatatttaacagtgattaatgtttgaatgtaattaactccttaatttcagggagagaaatacgatggacgtaaagccgacgtttggagttgcggggtaattttgcaacaatttgtgccaacaaattgtgcttaattaaggtaattttgtacgctcttctcgttggtgccttgccctttgacgtaagcgaaaaataaaaattatcatcattattattaaatgttttatccagtattatttaaaagaaatgaatttatttttattttaatatttattaacttttaggacgataatttgcgaaatttgctggagaaagtcaaaaagggccttttccatatccctcattttgtgcccgccgattgccaaactcttttgcgctcgatgatcgaagtcgatccggcaaaaagaatctcgttgcaggaagtgttgaagcacccgtg

SEQ ID NO: 80702 - DNA, 1005 bp, Heterodera glycines; identical to SEQ ID NO: 16311
  misc_feature (25)..(25): n is a, c, g, or t
  Genomic contig location: Contig_ID=SeqID_16311; Location=1..1005; Strand=+
  SCN-specific regions: Sequence locations=1-44,80-95,117-245,274 -343,376-1005
  Gene Ontology: Mol. function=ATP binding; Cellular component =dendrite; Biological process=synaptic vesicle transport

SEQ ID NO: 80703 - DNA, 1034 bp, Heterodera glycines
  Genomic contig location: Contig_ID=SeqID_16312; Location=383..1416; Strand=+
  SCN-specific regions: Sequence locations=1-206,237-310,333-368,391 -914,936-1034
atgtccaatgtactgtgtattacggttgttgtatcagccatgattgctggttcttcttcaatttcattgcatggttcgctgttgttgcaaatgcgaataatttgtgcccggtcaaaatcaattagtttcacaagtttttcgtttccattcggattaattggcacaaaaatgagtttatcaatactataatgaagatgagcagcaacttaaaaattttttaaatatttttttaaattcctaaaatgccaagtgcaaaaaataggcattataaaattgatcctagaagactcaaaccaagctagaaactcattttttgtgcttatctcaacgttattatacagggtgacaaataagtcttgcaccactttaaaatttttaatatttcataaaccagaaaaccgattttaatctttttatactcattttgaagcccattaaattctctttaaagtactctgaattataaagaaaaatttctttttctcaatggagtaatagtaccatcaaaaattgtgacccatttttttcaccaaaagtttactatgcgtagacaataaaaaaattcaaacaactaaactaagtgaagcaaaataatgaattcatgtggagaatatgtcataacatagttctttaaaatgagcttgaaatcggtggttattactgtttctaagatcagaaaaaaacatcaaaacgagagtgatcagaaatcgttgatttaaatgaaaacaatagcgcactgagtcaagtcaaaatgaaatgtattaatttagacaaagcgcaaaaattaactagaattattcctttattagatagttaaagccaattttattacaatgtatatggaaaaaagttatgggtctatgaaataggggatacccctcaggcacgcaacttggaaaatattttttcgggcattaattttctaaattaaaattgtttatattaaactaaaatcatataacatacatatgcacacaaataattactcagctgaaattctttggcgtgacataaagccttggtccaagtggtag

SEQ ID NO: 80704 - DNA, 590 bp, Heterodera glycines
  Genomic contig location: Contig_ID=SeqID_16312; Location=1..590; Strand=-
  SCN-specific regions: Sequence locations=1-220,244-279,301-441,476 -488,510-590
aagttgctgctcatcttcattatagtattgataaactcatttttgtgccaattaatccgaatggaaacgaaaaacttgtgaaactaattgattttgaccgggcacaaattattcgcatttgcaacaacagcgaaccatgcaatgaaattgaagaagaaccagcaatcatggctgatacaacaaccgtaatacacagtacattggacatcgggaaatacagtagtcctgaaatatttgttggcaataaacaagttaattaaatgggaacaaataaaagaattcataattaatattaataattaggctgtgggcacaagaaaccacaaacgaaaagtctaaaatgatgtttttaatgtttggaaaaaatttaaaaaattcttgctcaatagtaaaaaattaaataaaaacaaatagaaaaaatggcaaatttttctgttaaagtaaattaatattattattttaaattttttttttacaataagcccatattttaaaagctattttattaataggaaaattaagttgtctgtgaaagcggatatttggtctagagggatttctgtttatgaggcaattctggtggcaaagga

SEQ ID NO: 80705 - DNA, 1153 bp, Heterodera glycines
  Genomic contig location: Contig_ID=SeqID_16313; Location=77..1229; Strand=-
  SCN-specific regions: Sequence locations=1-3,33-205,245-506,529 -547,570-728,750-756,797-1017,1090-1106,1142-1153
atgggttttatgctttccatttttatatttgtgctattaaaaactttaaagttttcatcgccatttattaccaattgtaatggatttgtcactgaaaatatgcttccatttgaagaattcatatcaaccaaaaatgatggacatgagcataacatttggaaaacagttttttcaatcgattcaaaaccctcagcagatggccaagtaatatttttaaactatttaaaaaaattttgaaaattttcaggtttttggtggttatatgaatgaagaaaaagtgtcaagaaatgctcaaaattttgtcgaaaaatgcgtggcaataaaaattgctataaatcgcatacaagaacagcagattatcaacggagttcaagttttggaagagattcaaaaaattgaggaatcaaagagaaaacacattattggactaattgattagtgagttacagggaacttctgaggggggggggggaggcatgaggaacatcttggaaactttttgactgattttttaaataaatttttattcaaaattgccaatttttgcgtcaaatttaaaaacattgagaaatttagggtccggcaacttcgataagcgcctgcgggcaaaatcaatttctttagtttgaattaattttttataaatgttttcccatcttttgctcattttgaacttttttaataaagcaactaatgttaataattgagaaattttaccttatttataaaaaacattgtattttttgaaaggaaatgaaatattaaatttaaattataattattttaaaaaaatttacgatttttatagcggcactttgacgagtcgtcctgctgaaactgaaaatgcatattctgtgctcataatggaacttggtggaataagtttacgtgaacaattaggacgaagattacactttgaaatgccaatggaagaagtcgaattaataaaagaaatcaaaagaatggcacagcctttaaaagaattacaccaaggtaattaagaagaaaaaaacaatcaaaaataattaaactatttaaattattctcaatttatttcttattaatacataataattagaaaatttatatcaccattatcagaacagaatatttttattaaatgaagttaatttatataattgggtaaaataaa

SEQ ID NO: 80706 - DNA, 637 bp, Heterodera glycines
  Genomic contig location: Contig_ID=SeqID_16314; Location=1705..2341; Strand=-
  SCN-specific regions: Sequence locations=1-180,230-249,298-318,348 -607,629-637
atggatgtaagcctttgttactgtattaaacatgataaaaatgaattgttcagggcgaatcttgtctccaatcgtacaaatactttgaaagtcggaggaccgaaattcgtcaaatttttcagtttggaaaaggcatttgtaaaagagttacggcattcaaaaatgaattatttgggttggtataaaaaaataataattaattatttttaaaatgaacaatattttattacgtacggtcattaattacacttttaatacattttaaaaaacgtaaaattaataaaataaaaatatattgaatttactagtttaatattctgtttttcatcttttcagagatgatcattcgcacaaattttgcgtgcacattcgaatgggagactttgtcaatttcggttgggaatcgaaaaaggattttacggagaaaggaattgaatttggatttgaatatttaagggtttgttcgttaatgagcattcattcactgttttaattatgcaattaaattcaagaagaaatttggcaacattttcgtttctgttgttttgctgggagaagaaaagcaatttttgacggatttatcattcaacggccaggcaaagaatgatttaaatatttgcttattaaattaaataaa

SEQ ID NO: 80707 - DNA, 1170 bp, Heterodera glycines
  Genomic contig location: Contig_ID=SeqID_16316; Location=209..1378; Strand=-
  SCN-specific regions: Sequence locations=1-39,105-106,132-153,182 -228,312-329,354-439,468-874,897-986,1008-1170
atggggggggggtggggggggggtgggttcccctcttataaaaaagaaaaaaagaaaaaaaaaaaaaaaaaaattttttttttttttttttttttttttttcttctcccccccccccccccccccccccccgccgccgagaaaaaactgggccggagagaaaagaagagaaaaagagggcgccccggcgggggggaaaaagaggggagaagatttgcgccccccccccttttaaaaaaaaaaaaaaaaaaatatttttttttttttataaataaaaataataaaataaaaaaaaatattttttttttttttcccccaaggaaaaattgctgttttttggggcgaaaaaggggggccaaaactggtgtttttgcccccattttttttttttgaggggggtttagggggccttttccttttggcgaaaaattttgggccccaaaaaaaaaaaaatttttaaatttatttggtgggcaaaaagtcccctttccccaaggggttgattttttttgttttcccccgggcccaattaggcggggggccccatcccattggggggcccttgaaagggggggaattgggggaccggttcgaaccaaaagggaccttttgccccctttggatccctggtcaggggtttccgtttccaatttgttaaaaaggtccttttggaattgaccgtgccgcttcccttcaaaatggaacatttttttccgttttggacttcaaaactgtcacttcccatttctttcccttttttcatttttactttcttccgccctttcagaataatgtcgcccatttggaccgttctctccgttccgcttcgtccgctcgtcagtccgtttgttttgtgttgcctttggaccgccagcagacgctcggcatggaccaattgcaaagggcggcaaaagcgggtgccgaagtgagaaatttgggaggggcgggagcatggtggagaatgggaatagggagaggggtgcgtacctaatattatttgattcaaatgccataaatttgcagaagaatgcccagttgcatggatgggaagaggattggcacttcatgccaaaccccgtgtcggcccctgcccaattgtttcagccggacatttccgagtgccaaggggcgcgatggatagaactgatcagaacgccaaccgatcagaaag

SEQ ID NO: 80708 - DNA, 1636 bp, Heterodera glycines
  Genomic contig location: Contig_ID=SeqID_16318; Location=324..1959; Strand=-
  SCN-specific regions: Sequence locations=1-1015,1037-1058,1080 -1101,1123-1347,1369-1401,1429-1636
atgctgcgatttgccaacgacatggacttggtgatggccatcagcattttggagcagtacaacagacaaagcgaaggagtcgagagacttggaggaagacaacgaacaaacggtgggggaagtgatgccattctggagcagaagttggcacaattccaccaatgtttggagagggcaggccacggcaagggaccaggcagaatacggtatgcactagggggaagggacagatactgtaattcactgctttgaattgcggtaaaaagcaatataaagccattgagaatcggcacgaaaacaattggcatttgggaatgatcgagagagaataaaagaaaagataaaaatgatactcgaaaacgaacttttataatagcttttctctttgtttagcttccgcctgcgacgcgatcacttaatgaatgatgcatttgaaaaggttttgacagtcggcgcggaacagctcaaaaagtgccaaatgatggtaattggggagagggaggggaggaggggattaagcgactgaaaattggtcaataatcattgatcgagattgcttgggattgattaggctttcggtgatgccaaaacggtcaatgattgtttttagcgagtcattgacacgtttggtcaataatttcaattttcttcaggtgacctttgactgtgaggacgggtgagtccgaatgtctcaccgtatgctaagttttgctttgcaaggttggattacggtggcccctcgcgtgaactgtttttcctactctcgcgagaactgttccatccccggcacggcctcttcgaattttccgggcccaatgctcacaccgtccaggtgtcactcacttattggcatatttttgcgttttgtccctccatttttttgcccgttcagatcagtcccatgtccaaattcgtcgaccatcacctcaaatggcacttccattcttttaattggcatttcattcaccgtttgtttccctttaaaaggatggaattgtgcggcagagttctcggcttggcccttgtggtaattttttccaataatttattccaatttcgggaatttttaaaaagttatcagacaaaatgccaatccctgtttccatcccctgccttataaattcaaatttattctcgaatctctccatttgttttgacttatcaatgtctgtgtttgttcagcatcgctgtctgctcgactcctttttcacccgccctttctacaaaatgatggcccaactgttcgtcccattccccccccccccccaactcctcccccattgttggccaaattggcatggcatttttcagtccgctacgtctggacgaccttcgagacttggacccccaactatggcattccctgtgctggttgcgcgaccatccgatcggaggggccgctgaagaggagaaggaggaggagaatgaagtcactgatcagccgacgacattggcattggcattttgcgtgacggaggaggtggctggtgaggtgaatgatgggaagaggcgaaaaaaagcaacaattgaaactattgcgaatcggttggcatttgttcagacccttggcgaaatgccgaaaaaatgcatgggattggattggaacacgtggaatcgcctgatggatgatatttag

SEQ ID NO: 80709 - DNA, 1758 bp, Heterodera glycines
  Genomic contig location: Contig_ID=SeqID_2611; Location=42..1799; Strand=-
  SCN-specific regions: Sequence locations=1-74,108-146,169-202,247 -314,372-496,521-619,641-664,727-862,884-1051,1129-1175,1214 -1410,1446-1539,1586-1688,1711-1758
atgatttggcctgcacaaatggcggttacactaatcccaacaattgcaatcagtgcctttgtcctgcggtgatttattttaatggaaaaaataatttttaagaaaaatgggtaattagtagttttatgatgcctaatatatttgatgaaatttcaaattttatctttggcgacaatttaaattttttcgaaaataataccacaaaatattaaaaattattttttttttgtcaaaattaaaaaaaatcactcatttattgaaaatcgcatttagggctactctggcgctttttgtgacgaaattcctggcaatggtattattattgttattaattatttaaaaaaggttttttaattaaattcttaattttagcaaacccgaactgcttgagcactggcgctctgatggcaggcgaatttgcgggaaacatttccacagtgtcattgacgccaagcacgaattgctactggaaaatattggcatgtttttaattaccataaaaaatttatttaaattaaatgtaattacgcaaatgattaattaagcccgagtccgcggataggcgtgtcatggtcacaattagacgcttggactttccatgcaatcgcgaaacatgctccagctatgtggaagtgaaagcaaaacaggacaaagttgcaaccggtaaaaaattaaaataattaaaaattattattttttattaattaaaaatgatttaaataattaggcgcgcgactttgttgtgcaggagttccagccgctatttatgcggatatcggagcggaagtggtgatcattttgagtgttgatgatgctaatcaacgcaatcacactgggttcgacattgagtacaaatcaagtgaatgttttgtaaattaaaaatttaatacaaaaatttcaattacagtaagcagcttggctcaatttgaagtgccatctgtaaggagttttttttccactaaatatattcccatttatgttgttttcaaatttaagccatctttttcaaatgccaacaacgcaaatcgaggaacaattctggtaaatagcgaaaaaaaattaaatttagttacaaattgtcaaaaaaaaagatttagtatttattttaattatttttttttaattttagcccgctcctaaaattgccaacaacacaattcaatggcctaatatggtaattaataatttaattgaaaatattttaataaattttgccattgtaaattaaaataataattactgacaatattttagccttcttcaacaggcgtaaacagaggaaattggcggcaaattatggtacataatgaaactgataaaaaaaaatcaaaatttatttaaagcctaatttaattaaccccaacaatgcaacacttcgaggaacatttgtggtaattgcagtgaattaagaaattatttatgttaattaaaaaataattaaattacaaatacgcttagaaatgtaattaatttttatgatttagccttattcatctaatgccaataatgcgattcgaagaccaattttggtaaatgaccatttaaaaaatatatatttataatgatattgaaataattaaattaacagagaataatattatcgaattttttttcaaaatgttctttaatttccagcccaacattgcttcatctcctaacaatactgttcaagcaccatctatggtaattgcagaatttagtttaataaaactgaccattttttctaaaagattgctccgacaatttccaacaatttaa

SEQ ID NO: 80710 - DNA, 437 bp, Heterodera glycines
  Genomic contig location: Contig_ID=SeqID_16321; Location=181..617; Strand=+
  SCN-specific regions: Sequence locations=1-233,256-354,376-437
cggcggatcatttggaaaataagctgaaatctgttgataataaaactgattcgatttatcaatggcttgacaatgcgattggcgttatgtgcagttacaaatttgaatttcaaatggatgaaaatgttcaacaaatgcgcacaaatttatgcgaacaaaaaagcattgaaaaagcagcggaaattttgcaaaaaacaactggaaaaagtgaatatgtaattgatctgtccattttcaaaacatttatacaaaaaactcaaaattttacttcgttcatcaaagatcaaaacataaaaaaccttcgcaaatttgttggatatttcggtgcagcaatcaaaaagtgttacgcaggtatttttataaaataaacataaatagcatttttttaagttccaagtgtcgactcgagaaaagtcaaggggcagaccggtttttaa

SEQ ID NO: 80711 - DNA, 242 bp, Heterodera glycines
  Genomic contig location: Contig_ID=SeqID_16323; Location=199..440; Strand=-
  SCN-specific regions: Sequence locations=1-242
atgaccgtcacattcaacaccgaattccgactgatcgaatgggtgccaatgcttgaggaagttgctcgtgaatttggctgtattacgccactaccaaaccttgggtatgtttctttcgttttacaacactaactccaacatacaggagccatcgtgactatcgtgtaagcggatgtctgatgattcgcacactgacatcgttgaaccggctctacatttttgatgctgaggactgtattgag

SEQ ID NO: 80712 - DNA, 1663 bp, Heterodera glycines
  Genomic contig location: Contig_ID=SeqID_16323; Location=2417..4079; Strand=-
  SCN-specific regions: Sequence locations=1-25,47-333,359-368,391 -854,877-943,965-1096,1121-1453,1475-1587,1609-1663
tttactgtaaataattattctcttgattttgatacttctttttcttctccaacaataaacgacgttgaatttaatattatttctgttggtaaagttcttaaaactttacctaacagaaataacacatcaccggacggtattacctttagactgttaaaaaattgttctctttcgtttactccttttgttactgaaattttcagactcacccttgatacaggaaaacttcccactatatggaaacaatcgattattatccctttgcataaacaaggggaaaaaagtaaccctatgaactataggcctattgccttaacttgttctttatgcaaaattatggaaaaatttattttttgggctatttccgattttcttttaaagaacaatttattctccgaacatcaatttggatttataaagggcagatcaaccacaacacaactaatttcaacccttgaaaattggtatgatggtatttataataataagaatatcgattgtgtctatatagattttagggaaagcatttgatgttatcccccataatttacttttatataaggttcatagaatcggtattaggggtaaaatcttaaactggatatctgactttctttcaaaccgtacctttagggttcgggttgataatactctctcttctgaatataaaatgagctctggcgttccccagggttctgttcttgggcctcttttgtttctgatatatattaatgatttacgggaattaattcctaaacaaatttctataaaattatatgcggatgctgtcaaattatattccgtacataaaacaaaaaatgatagaattgctatgcaccatgctttaaatattctctctgattggtctaagaaatggtatattaaaatttctattgataaaacttttatcatttacttcggaaagaataaccccagggaacaatataaaattaatgataatgcaatttgtgaagttaaaactattcgtgacttagggattcttattgacaataaatttactttttccgaacatataagcaaaattacccgtaacgcctactaccgtatgcgtttacttttccgtgttattaaatcaaagaaaattgcaatttggaaaaatatttatgttagttatattcgtccacttctagaatatgcccctgaatcttggaatccgcaactaaaatcacatattattaaaattgaaaaatgtcaaaaatattttactcgaattgctttcagaaaatgttgtcttccatatattccctatgaccaacggctccaattttttaaattagctactcttgaaaaacgaagaaaaatttttgacctcctaactacttacaaaattttacgtggttttacacatttggacccaaattctctgtttaaaagaactaacttaaatactcgaaacaagtcatttttccggttatatgttaaattacaatctaaaaaatcttccaaatcttttgttaacagatcagtcaaggcctggaatgcccttaataaaacgttaatgtctagctcattaaacacctttaaaaattattagaattgactcttgattctgaaagcaccaatgtataaagaaattattaacttttgaggcattttattgactttgacctcgattttattttcatataaatttttcgttatt

SEQ ID NO: 80713 - DNA, 56 bp, Heterodera glycines; identical to SEQ ID NO: 68623
  Genomic contig location: Contig_ID=SeqID_16324; Location=706..761; Strand=-
  SCN-specific regions: Sequence locations=1-21

SEQ ID NO: 80714 - DNA, 1379 bp, Heterodera glycines; identical to SEQ ID NO: 16325
  Genomic contig location: Contig_ID=SeqID_16325; Location=1..1379; Strand=+
  SCN-specific regions: Sequence locations=1-233,255-402,425-539,562 -1379
  Gene Ontology: Mol. function=succinate-CoA ligase (ADP-forming) activity; Cellular component=mitochondrion; Biological process =succinyl-CoA pathway

SEQ ID NO: 80715 - DNA, 1367 bp, Heterodera glycines
  misc_feature (13)..(13): n is a, c, g, or t
  misc_feature (86)..(86): n is a, c, g, or t
  Genomic contig location: Contig_ID=SeqID_16326; Location=413..1779; Strand=-
  SCN-specific regions: Sequence locations=1-550,572-724,757-889,911 -994,1016-1052,1079-1178,1219-1367
atggttttgctgngggaggaccagcagccatcgctgttccttctgctcggccccaacggatgggttcagcaacagcaaatgccatntgacggatcagcggcaccgagaaaccgattcttagcaccactgaacaaaggcacaaggtgggaacatcaaagggacaaaaatcgatagaaaaaggaggggattaatgagtgtgggatcactgatcaatcagtgatagatcaatcggggggagagggcttagaaccgaccgatacaattggccaatcaatggccgacattcagagggaaccgggccgatgagtacagcagcgctggaaaagtggagaagaaatggagccgattcgaaccatcgatacgcttcttttgatctgacgaaccaatcacaaatttagacggatttttgatcgaaaaggcaacgaatcacaacaaactgacggagatcgactgcatttttatcgtccccattaatttttttatttttgtgtaataatgacaatttgccggttaaaaagcgaaacggggccaaatattgacaacttaaaaaatagtttaaatattttgaagttaatgcgagcagaattttgttagcagctggttacagtaagtgttaccgtatgtcgagtcgtcatacagtccctccagcgttacggtgtgcatgtagcggaagttggcggccaatttctgatcggagttgaagccgacttcatccttggggggcaaacaaaatgcaaaaacaattttttggcttttccgaatgattaccttcataaagtccctgaattcgtgcttaatagttttggcaaattttctttcttttctgttttttgaatcttcgtgccaatattcgacgaaagtctcaactaaaatttttgccaataaatttatttaaaagtgaaatatttgccgtcttcaaaagtcaaccagctgatgttcatctcattcattctatcggtcagtgaaaggtgcacctgaacaattaaatgtactcaattatttgccatttgcttaattggccacctgttggggcgtttcccgcgaaaattttccaatttcttaaaataaaacaatgaaaaatggagacaaaacgaatgaataaatgttactaaaagggcatttccgttcgactttctcattttccttgtcatttggtgggtcggcaaattcgaaacggtaaggaaaaagaaagaaaataataaaaaacaaaagaaaaaagcgtttccacttgtaaatagacatttttttaaattttcagttgggcaatatcaaaaaatgtgaaataattttaatggttttggtgccaacattacttccaacgagtgaatcgatggtcggaaagtgggcggaagatggattttaataaa

SEQ ID NO: 80716 - DNA, 159 bp, Heterodera glycines
  Genomic contig location: Contig_ID=SeqID_16329; Location=510..668; Strand=-
  SCN-specific regions: Sequence locations=1-109,131-159
atgattgcacgtaattgccgaaaaaattcgagaccaatttccgaatgttgaccgactaattgcaaaacgaaagccgtctttgtcaaagcgccttaccgagtcaaaaaatttggaaatgtatctcatacatatgcaatttcaaccattaaatttgaagaa

SEQ ID NO: 80717 - DNA, 1275 bp, Heterodera glycines
  Genomic contig location: Contig_ID=SeqID_16332; Location=70..1344; Strand=+
  SCN-specific regions: Sequence locations=1-252,274-342,364-766,789 -861,891-1030,1078-1275
ctgtacataacggacgcggaattaatcttggagcaaccacgggagaaggtgttgaatcgaaacaatatttggagattgatacaaatgtgtggaacggaatgaatgacaatgatcagattgttttccatgttcgcacaccgcatagcgtggtaacaataaaattagaatgatcaaattactttagggggtgtattttctaaaaattttttggtcatttctttggggtacaaatttttttgtttttgcatttttgttaatgatttttctgaaaatccttcaattaggtaacaaaaataatgaaataggtataactaatagagtagaaaaactcccaaataggtaaggataggtattataaaattgggtccatgagctcaaaaccaacgtaaaaatggtttttttcccgcttatctacacgtattaaatgcgcaaacattttggtatttcctaaaaatcccaagccctattcattaaaaaaagacttgaggatttgcaaattggagaaatttagtaatcgaaggttgctcattgatatgaataggactttcaaagataattagagtggaattgcttacacaaaacagctatgaaaatcggaacttagctaaatttaaaaattttgtgaaagaattttatttatggtaattcatcccttttattttaattttatgtatttttactgtattgaccatatcatatttttctaattgtattcatttctttgttttccgctataagtgcaactatgttgccttgcggtttgctcaaataaataaataaataaataatttttttttgccaaaattataatacgaaaacccgttaacaaatagagccaaaatttcctggcgttgattgactccctaaaactcttttttcttaaaaacttcctcaaaaacggaaaattcattccaagtttttctttaaaaattagctcaaaatcgcaaaatttgtacctatttttaatcctgtttaaatcaagttaaatatattaaaatgattttcatttatctcatctcttttttttctcttttttatctaaaaattagaattaataatttatattgaaaaatttttcattaaccgaaacctaaaaccgagggtaccgattaacaatcggtggtgacctaccctttttaatgtctaaaaaatcatcggcttaaatttttgctaatttatctttttcagactaaatgtgacaaagctacagtacgcgaattacgtcaaactgatcaaccgaaagactttgctgatcaaacaatccgaacagtttaa

SEQ ID NO: 80718 - DNA, 659 bp, Heterodera glycines
  misc_feature (71)..(71): n is a, c, g, or t
  Genomic contig location: Contig_ID=SeqID_16333; Location=76..734; Strand=-
  SCN-specific regions: Sequence locations=1-372,399-567,590-659
atgagttcaaacattgtttcggtaaacgaaaatgatgccattggtgacagtttgcctcgtgccacgattcncaccgaattgggcgtcgccgccggtgggattggaatgcgaatcgccgacatcgaccggtaagagaggacggacgaagtgacacgcatttactaaatatttctttgttttgcagacagatagaagtgctgatgcgttgtgagtgtctgacggagcaagaagtgaaagtgttgtgttcgaaggcccgcgaaatcattcttcaggagggaaatgtgcagcgaatcgatgctcccgtgacggtccccttctccttttctggactttcacattaaaatgcaaaccaaacaaacttccgtcttttagatttgtggtgatatccatggccaattccacgacctaaaagaactctttcgagtggctggtcacgtgccggacacaaatttccttttccttggcgactttgtggaccgcggcttcaactccgtggagacatttctgctgctgttggcactcaaaattcgctacccggacaggcaattggaaaattgcgagcagttcagaaatattttcttttgaagaatcgtgctgattagagggaaccacgaatcgcggcaaatcacacaagtttacggttggtgtcaaaaaataaa

SEQ ID NO: 80719 - DNA, 1314 bp, Heterodera glycines
  Genomic contig location: Contig_ID=SeqID_16333; Location=1483..2796; Strand=+
  SCN-specific regions: Sequence locations=1-68,148-180,205-207,294 -294,361-382,418-429,451-451,488-622,645-646,668-728,750-1025,1047 -1132,1158-1234,1258-1314
  Gene Ontology: Mol. function=pre-mRNA splicing factor activity; Cellular component=Cajal body; Biological process=rRNA processing
atgtctgcggaatcgccaacaacatcacaacgccgtgctcgcagtcgcaagacgaagaaacgtgcggtcagcgctggcgagaccaaaccactgcgacgctcggcacggattgcggcacagaaagcggcgaaggaaaaggcagccaaagtgacgttttcggacagcattcctcctccgtcgtcactcattcatttccccttttttcagcagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgatgaagaaggcgccgggcccgagcagtcgcactcctggtcgacgcgtgaagaaaccgccaacgaagaaatcgcctgctcctcgccgtgcaaaaacctccaccaagaagcgcggacgtcctgccaagaaagcggaacaagccgaaccatcggacagcgggacagccgccgacagtgaccgcgacgacagcgaacgtgagttgaaacggggtgtgggaatggcacaattccaatttgtgtccattaattaaactgaattttcagattccgaagagagtgccactgagacgaagaagaagccaacccgcaagactgccggtggacgtgccaacaaacagacgaagtcgcgtgggcgcaaaacaaccaagaagacggaccaggaggaggagcgcgccgactccggatccgaggccgaagctgcaggctctccgcgcgacagtgaacgtgagttgaatgggggtggggaatggcacaattccaattgtataatcctaatgaaattgaattttcagattccgaagagagtgcctcggggacgaagaagaaaccaactcgcaagagcgcggctgctggacgttccacgaaacagaaggcgtcgcgcggaggacgtgcgggaaacaagaaggcgcaggaagaacgctctgaatcgccaactgaatcgggctctgatcgcgaggaggatgaagaatgaatgagccagccggagaagaatgctgcttcacgagaccaccgcgataataacactaacccccatttaaaaaaagagaaattgtatctctatatatgtatgtatatattgtatgtccatatccctgtggcattgtcttgctgaatgtaattctcccacaaatggttgttgttctatttaaatatgccatatatatgtgtattttttataattgtaatatgtttgccctgtttatgcatcttttatggtcatttattctcattgccga

SEQ ID NO: 80720 - DNA, 2791 bp, Heterodera glycines
  Genomic contig location: Contig_ID=SeqID_2613; Location=290..3080; Strand=-
  SCN-specific regions: Sequence locations=1-841,894-1354,1376 -1423,1453-1461,1483-1545,1567-1763,1785-2237,2259-2449,2472 -2530,2557-2574,2628-2708,2774-2791
atggacgacctgactttggtgccgacattctttaatcagcccagcgcaagcggtgaacaaatgaatgtgaaaaatgatcatacagtaacggcggaaggggaagaagttacggtaattgaagcgactgaaccgccgaaatataagaaaaggcaaaaacaaacaaagcaaataaaggcacaaaaacttaagccattaaaacggcaaaaatcgtccaaagaggaccaaaacaagcggaacgcattggaaaatggcaagcgaaacatgccagcagttggccagcaaaatgccattcaaagtgcaattgttccgcagaatatgccacccattggcaatgccattggaatttcgcttcaaagtgtcattgtttcgcagaatgtgccacccattggcaatgccattggaattcggccagccaatgccgttgtgcattcatttttggcggcgccaacagagaaacaattcaatacaactaatcaacgggagcggtaccgcattgagccgatcggaaaagcatcgacagcagaaaaagcagcggagaaaggcacaattgggacggaggagcaaagacaaagtgcactttttgtgactttttcggttatggtaaggctgccccccccccattgtttgaaccaaaaattagtaatttaaaaatttgaattttcgaccatttgttcgagtttgggtctggggttccgaattggtcgaaatggatgctgggtacataatcagcgatcccgaaaagcccagggatatgttttcatgggctacacccaaaaacgttaccgtatccttgccgcagaaacatcgctggacaaaacgtcgccgaacataacatcgccgcaaaaaaaatattaaaatttttcaaaatttcaagaaaatttaaaattattttagcttttttgaaagcctacatttataaaaactaaatttgctgaatttccgaaaaaagaaacttgtaaaaaaaattttcctagaattttgttaataaattttttttttgaaattttctagaattttttttcacaaattcagctacgtaactaaaatttttgatctttcattcctaaaattaaaatttttttagcggcgattatgtcccggcgacgtttcggccggcgacgttttgtcctgctctatttttcatggcttttgaaaattaaaaaaaatttttcggaaaatggggggatcaggcttactttacccttttcttttcgaatttgaatttttagtcgattttgtgcgctatgtttttgatcagagtttatttgcattgtgcttatcgccacaagctttcaataaaccaatggctcagatcaaaaagggtgccaaaatgagcgatcaaatagcaaaaaaacattttaaaaagctatggaaaagtttgaacgtaacggacgcggaaacggcatttgaacgtttgcaattgctgttggcaaaagcaaaacaaaatgaaaattttgccacaaaaatcagtgaaattcaggcgcagaccgagtttttgtttggcaaaacaatcttcagcaggcaattagcgagaattaaaaacgctaattaattaaattaattacattcatttttcaaaatgggcgctaaagcaatgcccaaataagcataaattacctaaaattgctaaaacattgagttttttttcttcttaaattagttaaattaagcgtcaaattttctggttttgaaattttataaattaaaatgtttagaaattcttaaaacccactaaaatggcacacaataaggctgtattttcacaattatttttcaattgtaaaatgggtactaaaagctcgaaacaatggccaaaatatacgaaaaaattagcagaaattagccaaaaattgctaaaacattgcgtttttttctgaaattttggttaaattaagcgtcaattttttttctttctaaatttaatagattaaagtgtttagaaattcttaaaaactcacactataaatggcacacaataatgccgtatattcataattcttttttttgaagtgacaataaaaatgcttccaccgcgactcatttcaaggtttatttggatttgatgaagcatacatttggacaacgaatttctgcatttgaaactcttacaaaattagaaaagcgtgtcgggattttgcagtttttctatttgcgtttgtccgggaaactgatcagtgctttggaggcgcctttccacgaccaatttgatcagaaagtggtattttttatccattgcattagtacaatgctaatcaaaatcatttcaatgctttttagcgtcattctttttttaattctctaagattgatttatttttcgaaattttcttcgataaaatccaaactttgccttaaaaaagcaaaaaaaaaaaatttcgaacattcttggactttttgccaaaaatttagatgccagaaagctatttttgtaaaaaaaatcccccaaaatatttgctaaaaactccaaaaacaccaaaatatttatcagccaaaagtccaaaatctttttttatttgctagaaatgctatagaaaaaataaaataaaaatatataaatccggtctctgcaaataacaaaaattttttaagcatttatataattagttaaatttaaatttatttttatttcaaaggaaaacaatgcgcagagaacggacagagaaacgcttttgttttggataaatattgcgaaaacacaaataattgaagaacagcaacaacaacaacaacaacaacaacaacaacaacaacaacaacaacaacaacaacaacaaaatgagtggcaaaagatg

SEQ ID NO: 80721 - DNA, 280 bp, Heterodera glycines
  Genomic contig location: Contig_ID=SeqID_2613; Location=5003..5282; Strand=+
  SCN-specific regions: Sequence locations=1-11,33-94,117-153,204-280
atgtcactacatattttatcaagaaaatataaggtttgcgcaaaagttggtcatttgttgacaaaaaaactgttaacaaatcgcgataaatgtcgaaattctgatttagaaaaattttcgatccgcaccctggaataaaataaagtaaaacggttaataaaaaataattattaaaatagaaatttgttaataaaaaatttttacagtcgatagcaatctcatagattttttttagttctctactcgcgaagaatataaatcataaaaaatttaaagaata

SEQ ID NO: 80722 - DNA, 884 bp, Heterodera glycines
  Genomic contig location: Contig_ID=SeqID_2614; Location=1184..2067; Strand=-
  SCN-specific regions: Sequence locations=1-48,80-223,249-525,547 -622,644-884
tcaaagatcaaagtgcacaagaagcaaattgaggaggcggtaaagctgaaataaaattaaaatttatttaaatttaattcgatttttacaaaattgtaattgttttaaattgaaatatgctaattaagtgcatccaccctgtcagccgccccttgagttttttttaaatcttagaaagtttttttaagaaagcatcaagtaaaaaattgacaaattttcaactattttttggaaatttattaaaaaatacttaataattcatcataattttgaaaaatggctgaaaaatttttcatttttttttttgaaattttctttggcaaaattccctaagactttttttttaaaatttcttaatttgtaattttcggggggaaggcacgacggatgggaaatggcatcatccgaatttttagagcacggtagcggtgggatttttgatatacgtacacaaaattttgttaaattttttttgtgtgaatttttaagaaaaacctaccacaaccctaattaaccatatttttcaagaatttgtcaacaagaaaatttacattttcacatgtattagagggttatagccttttgcacaaatgaaccattgaatttctgctaataatttggcatttttttttaaatttaattacccccttcatttgcaggaggaagtgtcggcgatgaacacacaaaagtttcgccaaatccaatcccatctgggcgagtcggaggagcgcgcggacgagccggaaaactccctgatgcgtgtccgctccaaaatccgtgtcaacgcggcaccgaacgcgttcggcacaatgcgtgccgcttcgtcatccgcgctgatgcgtgccgccagcggggcaatgattatgaatggacaatcaaaataa

SEQ ID NO: 80723 - DNA, 537 bp, Heterodera glycines
  Genomic contig location: Contig_ID=SeqID_16335; Location=171..707; Strand=-
  SCN-specific regions: Sequence locations=1-277,299-537
  Gene Ontology: Mol. function=nucleotide binding
atggcggctgaacccaattatgaccttgtgaaagaacggatcaaagattttttgcacgaattttacattgaggacgaagaaggctgcaaagtcttcaaataccgagatcagattagtcaaattgctcacagacagcaaattgctctctacattgaacaagatgatgtaacattgtataaatactgctcatcccatttggcctttttaggtgcatcttcatgaccccgaactttccgattggattactttcaatacagtgcgttatcgacaactcttttatgaaattgttcaaaatcttgtccaggaaacaattggcaacaacgaagttttgttttgatattattcacattttaatttacttttctaatccagcctgcggttattgatgcgcttgacgcatttatcttccaacgcctttatatggacaaaatgttgaaaattgccagaggtgaaatgaatgcccgagaagatgacccatctaaggcatatccacctgaactccttcgcagattgtatggtacctttaataaaagataa

SEQ ID NO: 80724 - DNA, 194 bp, Heterodera glycines
  Genomic contig location: Contig_ID=SeqID_16336; Location=1867..2060; Strand=+
  SCN-specific regions: Sequence locations=1-194
atggaggagctgtacaagaaatacgaactgaagctggacgaaattcagcggggcatcgccgaacagctcacttacatgtgcgacggcaccattttcaattcacaaattttgaaatttcatttttttaaaaatgcttcagggaacaggtgtgcgtcggcgccgagcaccagggctcaacttaccattaccatcag

SEQ ID NO: 80725 - DNA, 1581 bp, Heterodera glycines
  misc_feature (11)..(11): n is a, c, g, or t
  Genomic contig location: Contig_ID=SeqID_16337; Location=172..1752; Strand=+
  SCN-specific regions: Sequence locations=1-327,349-936,961-1482,1504 -1581
atgctgctccncagtgggaagactgcggggcaagtgcgcgaacgggattccaagcggatggaatttctgagagagaaggtcaaccgagtggacgtctactgggaatgcgaaatccatcggatgctggagaggagcaaggaaatgcgcaaggcatttgaagactatgtcgatgatggcccgctggtgatccgcgacgcgtttatgggagggctaactggaccgctgaagctgctgcgcaaggctggaccgggagagaaaatctcctattatgacttcacatcgctctacccgtacataaattgagcacagttaaatttgtaacaacttttaacattttttccttcacagttttaccacctgctaccccattggcactcccaaagtgcatgtgttgaaccaggaagtggagtggcgcagtgcagcggacaacccctaccctttggcattgctcaaagtgtgggttgtgcctccccgacgcgtcgacgtcccagttctacctgtgaaagttggagagcggctttgcttccccctgtgcatcacttgcgccaaagagcacccgacaggaggagtggacaacgactaccactgcgagcattccgacagacagcgggggtgggtgagcacgtgcacctccattgagctcaacgaggcgttggacgagggctacctcgtcacaaaggtcttccgtgtcctcgagtatgagcaaagtgacgacaagctcttccgcccgtacattgctgagtttatggcccagaagatccaggccagtggatttgacaacagtatcagaggcaatgcggagaaggaacaacagtttgtccgagagtgcgcagagcagtttgacatcaccatcgacccaaccaaaatggcggtcaacaaagggaagcggtccctggccaagctctgcttgaacaacttatgtgagttttgtcgtccattattattatattaaaaaaaatagggggacgattttcgcttaacaactttggtctcgctcaaacactcatcactgacgacccagcaactttggcggagtacctggacaacaaatccatcaaagtgacatcaatcgacgagttggacgagcagcacatactcatcacctatctgcagaagaaggattgggtggatgagcactcatgctcaaacattggtgagacacacacactcacaataaattgttaaagtacttcagtcatctctctatggaccacctcagcagcgcgcctcgttctgctcaaggcaatgcagaaggtggtcagatcaccgggctcggatctgttgtacactggtaagtcaaactacaaaaaaaaattttgtgcacaaacatttattttagacactgacagcctcatcctcgtccacccggaggagcggtgcccgttgaaaactggcccccacttgggccagttcaccgacgaataccccgaccacgacattgtggaattttgcagtggcggagcaaaacaagtgcattttcagttcatttttgtttacttttcaattttaccacgctttagtatggtctttgtctgcgacgcaagggcgcggaggcgggagcccaattggaacatgtgctaa

SEQ ID NO: 80726 - DNA, 405 bp, Heterodera glycines
  Genomic contig location: Contig_ID=SeqID_16337; Location=2329..2733; Strand=-
  SCN-specific regions: Sequence locations=1-405
atgaccaaaactttcttcgtcactggaatttcggcacaaggcgccgcatttcttcctgcatatgggcaattgcgcaacccgttcaacatcaatgtggcggcacatttttatgcacggcaccgcataaagcttcacttcccgtatgcaccgtgcataattgaacgcttttcggggggaggggaggaccggcactatccaatggaacttcttgagctgattgatgacaacatggacatggacatcaacaacaacgagcattggctgggccgtcttttcactgaaattgacgacaaacaatcgtcgtcaaactcatccgacacaacaatgcgcctagtatttgagggagacatggatgaagacatcggacgcaatgaatgctcacagagtactgtaccgttatattag

SEQ ID NO: 80727 - DNA, 267 bp, Heterodera glycines
  Genomic contig location: Contig_ID=SeqID_16338; Location=1248..1514; Strand=+
  SCN-specific regions: Sequence locations=1-267
atgattgcacagaattgccgaaaaaattcgagaccaatttccgaatgttgaccgactaccgtatatgctctaattatagcccagtctctattaataccgcagtctccaattatccccccccccctttctgaggagtttaaaaaataatcacccagtctccaatacggtaattgccaaaacgaaagccgtctttgtcaaagcgccttaccgagtcaaaaaatttggaaatatatctcatatgcaatttcaaccaataaatttgaagaa

SEQ ID NO: 80728 - DNA, 1097 bp, Heterodera glycines
  Genomic contig location: Contig_ID=SeqID_16341; Location=688..1784; Strand=-
  SCN-specific regions: Sequence locations=1-29,51-259,319-812,834 -846,882-959,981-1097
atggtgagtcatttaagaatccgttttaaaattaagtactatggtttttaatcttttttaaatcactttgagtccaaatttttaggaaaattctgtttccatccggtatactggcactaaaacaaggcttataatcaggaacaaggcattttccggatttgagtctcggttggcccaattcaaaaagcctggctatttaaatattcggggttcaagaacattactagcctagtggctttgttaaactttttttttttggaaaatttaattattaaatgaaaaaatagctaaaatttatttttattttttaaaattaaagcgttgctgccttttctctgtcgctgttgtgctaattgtggcacttttgctgttggatgttgcaatgtgcaaaaaacaccataacaaaaggaataataaaattgcaaataataaacataaaaactcttcatcatcttctgctgattcatcctcgtcctgttcatccgagtcggacgaagatgcttcaaaattggctgaatttttgaccgatgaaggacgacaaaagcgacgatttcgggcaaaaagtcgggtggctaaatgcaatcagcgaagtggaggccattggcaggtcatattatttgggcggagtcggggcgttgtttaaaaaaccataattatgaaaatttttgtcgaataattatttataattttgctctaaagcataaatttttaatttttgatatcattcgatagcactaactgttctctatcagtctgcaaaatttcaaaaaatttcgttaagtttcaaaaaagttatagctcgaggaactcaaaaaaccttggtttttgaacaatttttgccataactttttttaaagttaataaatttttttgaaattttacaggcttctaaagaacacttatttctatcgaatgatttcaaggattaaaatttggttattttagagcaaagttataagcaaaaattttcattttgatggttttttaaataacgcacataatgatggtttttaaataatgacatagcaccatcttattcattgtttttgatttatcgttttcagggttttctgaaaattagtcaaaatatcaataaa

SEQ ID NO: 80729 - DNA, 833 bp, Heterodera glycines
  Genomic contig location: Contig_ID=SeqID_16341; Location=2739..3571; Strand=+
  SCN-specific regions: Sequence locations=1-130,153-327,349-372,408 -452,474-833
atgtttaattttggttctgctgtaatttattttataattcttcaacatttctcattttcaatttcaaatgcaaattctttagtgagtttttgataattaattgctaaatcaattttaattaggcaaacgacaatttgctaattgcatttatgaaaggtcatcagaaaattcaaatcagtgaatattcaaagcaaaaatacgaagctcatcttggcattgtatattatatgagaacgaattggaaatgtgacaaaatttggaagaaatttgacgaatttgaactgaaacaatgccaaaaatatcgaaaatatttgaatattttgtatgaatttttgtacaaaaaatacatcggaattccttcagtgaagccgaaatttgcacttaaaaatgaaaaatttgaatttgatagtccaataattaatgtcattaattgccttgccaaaatttcgcagttttattttaattcaaaatggagtgatcactatgatcatatattaagcaatctgttcttttaccattttgatataatattattgaatgagaagagaatgaattacgaagaaaaatttgaaattgagccaaaaatgccagttaatgaaatgattttgaaattggcaatttacacagcaaatgaatgccaagaaagtgttgacgaaataattcaacaaaattttaaagaaaatatgaataaaatgctgaaaaatgcggaagaaaaggcaaaagaaggcttttcgtcatggagaaacaatgccgtaaattatgacaagcacaaaataattttgcgtttgaaattcgatgactcaaatacttgggttggcattcaattaaaataa

SEQ ID NO: 80730 - DNA, 204 bp, Heterodera glycines
  Genomic contig location: Contig_ID=SeqID_16344; Location=502..705; Strand=+
  SCN-specific regions: Sequence locations=1-204
atggtctcttaccaagaacactgtacagggactgccatgggagacaagtaaagacaagactggttgattacacacttgaaaagtcgtatcatttcagagatgccgtcgaattgcgcacctgcactttgttgaccgactgcaacaattgtctgcttcaaaagggctgcggttggtgcgagagcagtcaggtgaaagatgggaagg

SEQ ID NO: 80731 - DNA, 377 bp, Heterodera glycines
  Genomic contig location: Contig_ID=SeqID_16345; Location=15..391; Strand=+
  SCN-specific regions: Sequence locations=1-171,199-216,239-305,327-377
atgttcgaattcggactcgggattcgaaataggagcgaaatggatgtttggcatatatccgaccaattcagtcctaaacaggcattcacgcgaaaacgtcctgccccgattcttttgaggtgcatttgataatttgtgagtcaaaatttgattatccaaaaaatgggtgagaataattaaattaaattttttaatttagcctattgcccagatcaaaacccacactttgatttaaaactactgagaatcgggaagcaaattagccataaaatttgccgaggcttttgcaaaatcctagctcgggattcaagacagaaccctgagagtatgtgaaaaccacagaacgactaaccaaaaaattaaatgttcattgccaa

SEQ ID NO: 80732 - DNA, 100 bp, Heterodera glycines
  Genomic contig location: Contig_ID=SeqID_16345; Location=1743..1842; Strand=+
  SCN-specific regions: Sequence locations=1-100
atggactcgaacctccttcctttgtccctttactatcttacaaaaaccactgagccacacatgcaaatctttattgttaaaggagctcatttctgggaag

SEQ ID NO: 80733 - DNA, 753 bp, Heterodera glycines
  Genomic contig location: Contig_ID=SeqID_16346; Location=154..906; Strand=+
  SCN-specific regions: Sequence locations=1-93,115-406,428-664,686-731
atgtgcacaacggactcgaacctccttcctttgtccctttactatcttgcaaaaaccactgagccacacatgcaaatctttattgttaaaggagctcatttctgggaaggtgtgtatatcaggggctgacttgtctcagaaaagacgagagcgagagttcggcgagagtcccccaaaagacgagagcgagagttcggcgagagtcccccaaaagacgagagcgagagttcggcgagaggcgagagtccccaaaaacacgagaggtcccaaaaatggtgagagttgtcccacccctggtatatatatacacaccgtttcaaaaaacgagatgtgtaccaataaatagagagtgccagagaaaaacattatctttttttctctaattttttgtctccttttggcgtactatttaatatttttattattaggaaaaacaacatttatttcgtgacgtttaacttttttcctgcacgttaaatccacaccaaattttgtatatcgatagagaaaaaaataatacattcagtaatacagccattttttggcttatacattatttcatgagttattagaaaaacaaattttcgaagcctcatatcttttttcaaactcatcaaatcgcttagcatttgcttagaaaaagcttctcattatcaagagctttcgaaagataccaagattatccaatttggttggcaaaaaccttcaaaaataattcccaaatatcgtgattttttaatattttgtacaaaa

SEQ ID NO: 80734 - DNA, 80 bp, Heterodera glycines
  Genomic contig location: Contig_ID=SeqID_16346; Location=456..535; Strand=-
  SCN-specific regions: Sequence locations=1-80
tagagaaaaaaagataatgtttttctctggcactctctatttattggtacacatctcgttttttgaaacggtgtgtatat

SEQ ID NO: 80735 - DNA, 1470 bp, Heterodera glycines
  Genomic contig location: Contig_ID=SeqID_16347; Location=1426..2895; Strand=+
  SCN-specific regions: Sequence locations=1-17,48-911,933-1162,1201 -1470
atgaacagacggtaagcaatttttaaaaaaattaaaattttaatttacccaaatttttttttcatctttcagttggatttgtggcgacgtttggatggacattctgccatcttttgaccgtccccaactcggactcaaaatggcattgctttccgaccgtttcgatgttttggtggacaaacatttcgatggaaaaagcgaattgacaatttggaggatgatcagagttggcaaggacgaaggaccaaaagcgaaactgtctgtacagatcgatgacaaatttgtggattttcctctgccggaccgtccgctgccccacaaaattcgttttaaggatcttcggataaagcaattttatacttttatatgttttaaagcatattttatattttatcaggtatattgaccattccgtcattgaatttatccgtgtcaacaaacaaatttgggacataagtggcaccaatttggggttgtctattgcgtatattcaacaaatttgggatgtttttgtccgagaaatttggcccgtttttgcaacaaacattcgccatttgggctttcgcagtggcaacgatttggacaatttgtgtcgtctcatttcaccgacaattctcaccgatctcaatcatctgaattcaatcggtttcaattatctgttgcccgacgtaattgctgacgatgggccaaatgcaacttctgctggccaagcattgttcaaatggttgcatgcgccgaccaccgatggacggccgaaggaattgaattgtaatggttatttggtttcacaggatctcgaatggatcaacaatttcaaagaggtggtccttgcccggtgctatgtcattataaaaatccatcaaaaagggaatcgcccattttggtgcagaacgacatatcatttttatttaccaaccaaattaaatattttgcaggccaatagaggaagggtaataataccgatgttagcccctttttcgaagaagaaaatttttgaaatttttttcgagaaaaaattatttttgtggttttagggtcggagaatccgaatctatcattaatttcgacccatgtcgaatcctgaactcgggttcgcgcaaaaattcgaattttttatttttggtctaaaatggctggaaacaaactaaaattggacaattcactaataaaaaatcatttaaactttttgtttagtcatttctccgtgccaccacttcggtcagttacaatgtgcgaattactttttataagacaacaacgccaattgagccatttgaattggtgaatgaacggaccaatgagaaactgacatttatgaagaaagatggcggtggtgaattgcttaatgcttggctgttgaaacggtgcccaattattgttggggagagggcggcggcggttcaaaaagacgacaatttggaccatttgaacggagttcacttcagtctttatggtgattgcattgggtga

SEQ ID NO: 80736 - DNA, 2356 bp, Heterodera glycines
  misc_feature (2320)..(2320): n is a, c, g, or t
  Genomic contig location: Contig_ID=SeqID_2615; Location=442..2797; Strand=+
  SCN-specific regions: Sequence locations=1-84,106-370,398-480,504 -969,1000-1132,1154-1293,1318-1348,1375-1491,1517-1591,1614-1720,1758- 1779,1801-1841,1863-2016,2038-2196,2241-2242,2264-2356
atgttgtcggaacaagccggactaatgggtactgtaacacagtttaacagaaaatcttttttgttacggtagcaagttactaatttctttcctttctttacaggacgtgactacaaagatcacagatgtcagcatgagatgatgacacatcgtcaaatgatggtccaagaattcctcatgtcgccagaaattgtgatgggctgtgcccaacaaattgacaagtactgctcgccacagggcgacatcgaatcgaacggcaaatcggcgcattgtttgatggcacattcgcaggagaaggacgaagaaaaggtggggaccatttatccgatcagatcagcattgattcagattcaattaagaatattgtacattttttcaaaaatgtttttaaattttgctatcactgatttaggatttccattgtttttggtacatctcacaataataattaaactttaacacgaacggtcatgggaagtgttgaattcttaggcacatgatttacaaaataaaaaactacattttggcaaaaatatattactattttaatatgcgcagttgaaattcttcactgcctttgtggaccagcagctgaatgacgcgtgcggccaagaagtagtgaccgtcgacaattggcacaaaagtgccaacaaattgcggggacaggacgacaaagtggcggccgacccaggaccacaggtaaagccgtccatacggcctcaaagctctgactttgccattaaatttacaaattttatagggcgacattgagccggagggcaaaacggtgcacagtttgatggctcatgaacaggaggaggacgtgaaaaaggtggggccgattggctgatcaggacagatttatccataagtctgagcattgttttgacattttgtcggctttcaacttttttgttatcattaccggagtttaacaccccataattttggccaaccatatgaattctgattataaataatataaaattaattatttttgaaaaacctggaatagaagcatgctttcaactggattaaggacaaccttataaatggaaactttttttttggataaatggttaaatttcactaaaaatcctcaaaaaatgtgatataaacgtatttctaaaaaagaattaattcatacctttttataaaattatatcaatagcctgtaaaataaattaggtagaaaaatattgaaattaaaagaaaaaaacgtaaaaataatcggtggaaagtgggttgacaaattatggcgcgcagggaatcgaacacagaccaaaggctgtgacaaaacaaacaaccaacaaaatgcgccatcccaccgctgcactgatcgtcatagaaataaaagaaaagaaataaatttcctcattgatagccgtgttgggacatttcctaaatccgtcatcataaagaagataaataattatagcctaataattaagttctttgtccatgaaacgaattcttcaaaattaatgccgtaaataactttaaacaaagaataatattaaaataaatgaaaaaaagacaaattttttctgttcatttgtcaaatttagtattgcaaagaagaatttcacagaaattttatttttaattaattactttcagggaataaaaattcaatgattgggattttccaaatatccctgtaaacaattattttcatgaaatgaagaggccatttaaaatttataaaaattctgttatgagccattaaataattttccaaaaaattaactatttttgatttaatgaagatggagagaatttggcactttcaacttttttaaaacaacagtaacattgactaaattatcagatgtatgtttaaattttgcttactattttttgggatgatttaaatactgaattaaataatattcaagcccagtaataaatgtttacagcttccagatttcaaattccttgctatcaccaggaaacggatttatatgtttttgaccttttgtccactacaatacttaatgctacaaaattttaataatttatcaaattgacacatttcccggaagccattattatcattaaaagggctgggattttttacacatattttagattgagcacatattttggcattttttggttcttaaaacctgttttgaaagttttttgcacgattttaaccctaattattaataggggaaaaaatgtttaaatgtgtaattttattatttttattttgttagaaaataataaaaaaatttccattttattttttcagtggtgggacaatgagcagaacaaatatgtgcagccgaacctgaagtaccagccgtttgacttncagtgtctgaatgaatccattggcatgcttatgtaa

SEQ ID NO: 80737 - DNA, 1062 bp, Heterodera glycines
  Genomic contig location: Contig_ID=SeqID_2616; Location=1470..2531; Strand=-
  SCN-specific regions: Sequence locations=1-122,144-679,701-1062
atgtaccagaacttgaccctgatcgtggagcacaagttggtggtgtcacatgttgctgctgtaaatgagaaccatacgtggaaagggggtcacttgggaattcgtacaaacgcaattcgtacaataaaaattttttacaaaataaagctaacaataagcataggcccaagcaagcgtctatgccattgtacgaattgcctttgtacaacattgtatgagttgccttttgtacgagttgtcatgacaccggagagggagggaggggggggggagttaagagtttgtgtatggtagcgcagttttacagtaattgtttagtctactgtaatcatatgttttcaaaagaaattgggtaactttttaattttttcatttttcagttgcaaaggcgccaaagctaccaaggaaattcagatccaattgcgcgaccttagccacaagcaattcaaagtgcgttttctgggcaccaaacaaaatgccaatttgcaaaatgccataaagggctcctcatatcattaaaaatttttcatttttttagaatactctttggtctgaatgtatgaaaaaatattttttgtacgctgttgttaagctactttccgagtttttagtgttttccaggtttttcgagcctaaaaactttaagattttgaccttttgcataaaattccttaaatgcgcaataaaaacttaaaactttttagcctattttctaattttactgcctattttggggagtaaggccacaaccattggcagtttttaatgccgaaaaaatatgagccagagacatgacgaagaagtgccaatttggcaataatcatagcatcattaaaggataattgggcggaactgcgtggcctgtacatcaacctgatgaacccgatggacaccagacagtacagctacgtggagttcaaatacatcgatttggccgagaatttggagggcattcaatggtttaacatggtggagacggaggacgacggattctgaagtgcttcttggaagatccgagaaattgggagacggagggaaagcgattattaaaaaaataataaa

SEQ ID NO: 80738 - DNA, 177 bp, Heterodera glycines
  Genomic contig location: Contig_ID=SeqID_2616; Location=2026..2202; Strand=+
  SCN-specific regions: Sequence locations=1-177
gagccctttatggcattttgcaaattggcattttgtttggtgcccagaaaacgcactttgaattgcttgtggctaaggtcgcgcaattggatctgaatttccttggtagctttggcgcctttgcaactgaaaaatgaaaaaattaaaaagttacccaatttcttttgaaaacatatg

SEQ ID NO: 80739 - DNA, 2583 bp, Heterodera glycines
  Genomic contig location: Contig_ID=SeqID_2617; Location=278..2860; Strand=-
  SCN-specific regions: Sequence locations=1-232,254-321,355-477,499 -1168,1190-1468,1490-1593,1619-1659,1681-1735,1806-2420,2496-2583
atgaacagaaaaataatgtacaccgaccggatccgaactccccccccccagaagatgactcagaatccccaatcacacagggattctgaggtcttaacgatgtccaaactaaaatctgatcacgtattcgtgatcagcggcccaaataacccctaaagacatgtttttggatggtttttgatggaaaaatttttccactcaaaaatcctggtcacccccctttggtcccgaatccaaaaatcacttttatttttgtatctttttttaaaaatgcgataaaaatgtgaaataaaatttataaaatagagaaaaaaaatgcggatttttggaatattttatttttccaaaatgacttttcagaaccgagttatgaaattttttctgaaaattcgaaaatttccagaaattctggaataactttttttcttttgaagatagaaatcccaaataaatcacataaaattctccttatttttctctatttttagagcttaaactcacttaaacataccaaacctgaggttagttatgagttttccaaaattagcccaaaatcccaagggccaaaaaattgccaaaaaataaagaatttttaaaaaattccaaaaattctgaaacgtaaaacaaacatcatattcgtgctcagcacctcaaaatagcccagaaaaatatttttgagcccctttttcaacccaaaaaaaatttttgaaaatttctagggggcctagctcgaaaaattttgaaaattttcgaacatgtagtacaccattcgatagcatttaaaaagctctacaattttgccctaaggagttttttcgataaaaccaacccctgacgagttatgggcccgggactcaaatgtcccgctgaggccaaaaattttttctatttccgggaaaaaatcgaaatttttccgaaaaaaataccagtcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgagctttcgaagctctacaatagtgccgctggcacccctgcgctcaggtcaaagcctaatgagttattcaacggggactgaactggacaaatttggtactgaaaagttctagaagcacccagcccagggggttagagatagaggcctggaattttttttaatttttagccaacatttcaacttagggccctcacagcgggaattttttgatccgagttttagaaaaaaagttacgggccctaaactgcaagaaaaagtgagaaatcggtccccgggactcagttgggcgtcgagaatttttttctatagttttcccggattctcctcaaaaagttgtaagacccttccactactttcagacccgtcccattagccgttaagctcaaattagtttttgaaacgaaactccttgtcaatataacgtatatagtaatttacttacgaatttttcaaaaagggcacatttttggaatgcaaatccattttttaaataagtatttgggtattcttataaattgtttttgataaaattgccaaaatctgataccaaataccacaaactttccacattgcaaaaacaataaaagaaattttcattcactttttctcggtcccgcgttttccttcagattctcggtcccattaagaatgtttaaaataataattattatttaaacaataaagataaaaatcgtttaaaaatatatttttgtaaattttagggccccgcttgcggtgacccgttttacgaattcgcgaaacactgtgccatggtcaaattttatgaaaataagagcccgaagaaatggatcgctgagaataatccgggtaaaaaaaaaaatttcaaaattcttcaccaacctgtttaaagactcattgctggtgctgatcgacggctgcgtggtgtgtgatgaggaagggtcgagtggaacgctagcaaatccgaaggatcagcaaattgaggcataaaaacgggggggggggaggggggcgagggattgcaaaaatgataatatcggggcttcgggatggggaagatttctgaatttttctttgtctcaaattagagtttctgaaagaattcgatttcccgaaattttttggggcttaaaattggacttccggaattttttacgccgcggatttgtgactttttgaattttttggcctcggaattccgttttttacctttttgtttaattctatttccaacttctttaggcctctgaattcgctttccgatttaaatgaaattcccagggtatagtattcataacaatattttaacaagtcaaaatttttcaatcatttatttggcttcaaaaaagtctttttgtttttttaatttaaaatttataaacaaaaagaatttttatttgtaaatttgatttattttatgtttatttttttacggtcttgggggtttccatttgatgacatattttcttctttttcagccccttcgaattttaaaaactaattaatagtgttaaaataaa

SEQ ID NO: 80740 - DNA, 742 bp, Heterodera glycines
  Genomic contig location: Contig_ID=SeqID_16348; Location=354..1095; Strand=+
  SCN-specific regions: Sequence locations=1-32,69-130,184-254,283 -344,392-742
atggataaagctgaaagtaaatttgaaagtatttaatagttcattaatattattttttaatagacaaagagattgtgaaaaaattgagtgaattaatggaattgatcaaactgaaaagggtagagaaaggtaataatcttaaatttaataaaaaattttaaataatattgtttttttttaatagtgaaaggactcaaagaaaaatttgttgaattattggaaaaagatgaaggtaattttgaataaaagtcaacaattttttaaagtattatttttataatagtggaaaagctcatggaaaagctactggaattgaaaaaattgcaagtggaaaaagccatgggtaattttaaattattattatttaattaattaattttataaattatttctctaatagtcgaagagctcttaaaagaattgaagaatgtttataaagtataaaaatgtgaagagaaaggaaaacatcaaggccggaagaaaagcagaaaaaaggaacaaaaacaaaaaagaattttctcccattatccaacatttcttttttcactttatctaaaacgatgtaaaaaattttgcacatttatttttgaaccaaattcttcgtattgttattaggctggacacaaattcgacaaattcatctgttttatgtccatgattttcatgcgtatacaaatttatttcagttctttatccatcaaaaaaaacttcggtttccaaaaactttcatttcgcctactaa

SEQ ID NO: 80741 - DNA, 1217 bp, Heterodera glycines
  Genomic contig location: Contig_ID=SeqID_16349; Location=214..1430; Strand=+
  SCN-specific regions: Sequence locations=1-192,215-680,702-1217
atgagagctcagccaacaaatgttgtgcagcaacagcaaaatccgccgccgacaaatcaggcgatggcacaacacaaccctcagcaggaggtgatccggcaaccaacagggctaagtggcattgaatatgctatgatcctggacaggctgcacgacattaaaggaaacgagggaagtgattcgatcctcaactttttcaaaaaattttcacaatatacgagtgaatggccaaacaaaaagctaatcgaatcattagaagccaaattgagtggccgagccgaacgtgcctacaatgctgctttagcgacagagccgttcgcgtacgaaaacatcaaacgaaacattttgcagcagttggaagaaacggattgtagggagatgagtgcttttgacgacctcatgaacggtgtgtacagaaaatcgggggagaacttagacgatttggcaaatcggatttcgaatttggtgcgtagagcgtacccgggattaacccaaaatttgtccgatgattactccataaagcatctgatacggagcttaaacaaccccgagctcgctctaagtttggagttgcatcgccgatccgagatgagcttcgacgagtttgtggctttgacttcacgagccgagacaacacaaagggcagcgaaaagggcaaacacagagcgattcaagccaaataatggaagaattttccaacaaccacaacagagcgggcgtgattttggaagtggttttaagtcaccaattacccaaagccccgtggtttgctataattgcaatgaacctgggcatgtgtcacgtaattgcaataaagcattccacccaaatcgtggcgaatcatcaactcccgcccaacaaaatcaacaatgggcacaaaattctgctgcaaccggtgcaaaccgtgtctttttgaattcaaaaaacggaacatctccagtggttcggtctcaaaattttctgaagcaaaattgcatcagaatggaggaagaagtgagaactgatgctactgttggtggcgtcatgcttgaaaggaaagtaattgatttttttaaaaattaatacagcaaaggccaaacagaaccagagccaacggaggaaaagccgattatggggaaaatggtaacggtggaacttgttattttggagacaccaacaactgcaatgttggacggtggagctcaaatttctttgatcggcggcaaattcttttatga

SEQ ID NO: 80742 - DNA, 213 bp, Heterodera glycines
  Genomic contig location: Contig_ID=SeqID_16349; Location=2044..2256; Strand=+
  SCN-specific regions: Sequence locations=1-213
atgaatgaagttaagtgccaaagcgtggcaattctcgaatgtttgaaaagtcagccaaaagacatgtctgatcgagagtttttacctctcggacaattgataagcgaatttgacaacattttcgcaattcatgaggaggaattgacacagacggatatggtcgaacattccattgacactggaaatgcaaaaccgattaaggcaaagcgatag

SEQ ID NO: 80743 - DNA, 1128 bp, Heterodera glycines
  Genomic contig location: Contig_ID=SeqID_16350; Location=73..1200; Strand=+
  SCN-specific regions: Sequence locations=1-434,467-501,523-828,852 -1128
ggagaagaagttcaaacttggcacgggcaatgtcctcgtggtcggatacgacgccagccatgccccaagggcgaccacggaagaattgtcgatgatgcgcaggaagggcattcaggcgacatcgatggagccggacgtgataggggtcagttacgacaaattaaacaattaaccgggggagtgactgttccggcaatttattttctgtaaaacgcttcccctttcttttctagttttgcgccaattacctgaaggagccgaacaatttctgtggcgattatttctttcagcctgcaaagcaggacatttgccatccggaacatttcaaggcgaaagttctgtggatgctgcgcaagttaaaagccaatcgtgaacgcccgccttcactaatcgtattaaataaaagagggactgattacaaattgcttattaaatttgttttaagttcattattcgcgatggactggacgaaggcaaagtggacaatgtgaggacgggagaaattccccctctttttgtaaatgaaagttgcattttgtattgttttctcacaggcgttgtccagtgagattgggctgtttcgcgaaagctgttctcagatcagccaatcgtggaagccgaaatttgtttattgtttggcggacaaacgacacaacagacgctttttcgaggtcgaggaacggctgccggacgcggcccagccgcgcaatgtgtgcaacccgcaaccgggctccgcggtcgatcgcaagttgacccgttcgggtgttctcaacctctacgttcaagcccatcatcccgtacgcgtaagtgaataaaatggctagaagttgcaaaaaacaatttgtttaggggacagcgaagattcccgagtttattttcccatgtaacgaagtgtgtgctaccaaggaggagttggaggcatttatcaacggactctgtcactcatggcaaattgtgaaggcggcgacgtcactgccggtccccgtttaccaggcccacgaacttgcgaagcgtggaaggtccaattacatggagctgaggaggtattcttcccgaaaaaaccaaattgacccctctcaaaaagaatggcgcccgaacgaattccacggagtgctgacggacaagtga

SEQ ID NO: 80744 - DNA, 1301 bp, Heterodera glycines
  Genomic contig location: Contig_ID=SeqID_16354; Location=1715..3015; Strand=-
  SCN-specific regions: Sequence locations=1-452,474-875,897-940,965 -1120,1142-1301
cggtgcatatcgaacggggcgaccgaacgaattcgtcgctgtcggaggaggacggccagtcgaatcacaacggaaacgacctggccaaacagcagcagcagaacgtacacaatgtgaaattggaaaacgaagtgattcaggtgggcatttcttcgacccatgccaatgccaactttcgcgtggtctttcttttgtgcgttttattcctttctctccttcagaatcggcaattggccgccgcggcgacggagccggcgaaaattgtggcaaatggtcacaattcatccgcgacgatgaacaatgacgacttgtcacccgacttggatgtgcacggcaacaaattggcgtcctccgtggggcggactcagtccgactcgtcgaagagttcgctgaggacggtcaattcttcgctgctgtccaacagagcggagggaattctcgggaaattaatcggaggaaaacacaccaaaaagtgaggacaaaaagactaataccgtatttactgaattagaaccccccgggagctctatttttcaacgcccctcaaaagagggcctttatttcattctaactagtcaaaagtattcgaatttccctgtgcaaattcctcgctaatcgctcccccttcagaaagaaaaggaagtcgctgctttcttcggccggtcgtattcaaatcggtcttaaatacgacggggaccgtttcaaactgatcgtttcagtgattgcggcaaagtgagccgggtaatcaatcacatgccggactttccctcccttttcttccagagatttgagtccaatagaaaaagagggccacgcggacccatacgtaacacttcggctgatgccttccgcaaatggccacccggccacgacaaaagtgcaaaagggcagaaagcacacggaaatggtgcccaattcgttggacccgcaatttaaccaaaagtaaaaagccaaaacaaaacaatcgtctcatgttcaaactctcccattttcagcttcgagtttgacattcactgctccgacttccccaatttcaagctgcacttggctgtgaaagacggcataaagtaggcttttttaatgctttaattgctaaatgccatccatatcgctgctgtgctaactgatgtccctttccccttgcattaattagtttcttggactgattcattactcccttcagttacggtcttttgcacagtacgcccactttcggtgttgctgaagtgccgttgcataacttcgacccgttgaaacccatcgtcagccaatggttggatttgtcgtcgcctcagagatga

SEQ ID NO: 80745 - DNA, 1145 bp, Heterodera glycines
  Genomic contig location: Contig_ID=SeqID_16355; Location=6..1150; Strand=-
  SCN-specific regions: Sequence locations=1-28,50-111,135-483,505 -599,634-842,871-905,927-1124
atggtgcgcatcaacaactcaccgcacttggcctggtatggaatggccattattcttctcgcagccgtggttgttttgcaagtaggaaaatcattttcctttttttttgagatatttatttattcattattttagttggagagcaatagaagaaacaactccacattcaccgtgctgggtccatacaatttgctgcgacgtgtggcgcgcgtgctatgtatggtttatatttttctaagcgcgaagacagatgttttgattagagaccggaaatttcaaatttgcggatcctgttgcaggattggaattcaaaattttttacaggacaggatccggcaggattaatcctgcaaatcctgcatttaaaatctgcaggatcctgcgcaggattgcggattttaggaaatttcaaaaaattatgtattaataaaaaagtctttcaaagtataaaaaagtattcaatatatttttaaacaaaaaaatgatgaagatgaaaaattaataacgtttttttgcttacactccaagcaatcgactgaatcttctttaatgcttttaaaaagaccgatttgccaaattgggtggctcataataatagcttaaattaaagtaaaataatttttatttaaatttctttgcaaaaaaagccataatccattatgtatagggatgggatttttaggcacaaaaaatcgcgaaataggcacttaaaaaggcagaaaaatcctaaaataggcacgaaaatagtgggaaaaaaattttattaacgctttttaggtagcaaaacacataaaaaattcaattgtataaacttttttcgaataaggataagtttttaaacgaaaaatttttattaaaaaaaaaatttttgaaaaaagaaagtttctgaatatttggcattctatttttaaaaattttcaaaaaatcaatgcaggatcctgctgaatcctgcataaaaatcaaatttgcgggtcctgttgcaggattggaattcaaaattttttacaggacaggatccggcaggattaatcctgcaaatcctgtaaatcctgtattttccaaaatatgcaggattgcggactgggatcctgcaaaatcctgcgcaggatcctgtcctgcgccggtctctagtatttaacaataaa

SEQ ID NO: 80746 - DNA, 782 bp, Heterodera glycines
  Genomic contig location: Contig_ID=SeqID_16359; Location=37..818; Strand=-
  SCN-specific regions: Sequence locations=1-134,165-235,258-329,351 -388,428-479,511-584,609-782
atgtcaattattcgattgtacatttcgttcaactggatggatttatcgcaatttattgtgtgtattaacaagaggagttacttattacgaagtggatttaaatatcgttatgaggttggtttatacatatatgtaaatttttcttaaaaatgtttatattaatgttttttgtttctcagttaagtaataaaaaaaagtaaaaattaataatgctgatttattactatgtgaaaagtattttgttttgtattgtaaaagatttgtgacattgtaagagaggaagtatttgtattgaaatgaatttttctacattaattgtgtttaataatatgtaaaagaagttttacaatgaaaaggtcggttcaatcatttgaattttcatttcatcaattaatttcatttaataaatttttatctttatttttttctcatttgttcaatttgcaaatttacctatatgttttaatattgtgttgttaattaactttgttttttaatacagattttaaaaacgccatattatccgagcaatgaatttggaccatgtttttcagataaatcttagtattagagttggaaatgaacagtttttggaaaatggaaatgttttagttattgaagatgaaaccgagatttttgaacatgatatagatgatgttttgtctgaacataattatgctaaacgaacaagatttttgacagatgtgaatgttgctagccaggcatcactgaattcagatattggcgttgcaggaccgtcacgtattagtgatagtcaatag

SEQ ID NO: 80747 - DNA, 1286 bp, Heterodera glycines
  Genomic contig location: Contig_ID=SeqID_16359; Location=1200..2485; Strand=-
  SCN-specific regions: Sequence locations=1-10,32-626,649-832,854-1286
atgatgatgaaagaagaagaggacgaagaagctgaaagagcgagaactgaaaacagagagccagccgagatcaagcttttgtttgagaccgggaagcagttggacagacgtttggggtacaacgtacctcgagcgaatgaagtggcagctgtttatgtacctggggcagatggtgaagtgccaaatgccaagattgtgattcgagaacgtggaaaggaattaaagattttgaatagtactgatatgatggtgactccaatgacttacccactgtttatccgcgtggtacgcttggttgacaccctgaaatgaaacagagaacagtaacagaagagtgacaagactacagtatttgtgttatagtttggcaattagagaaagagaatttaatccgattttatatggaggaaagctctttcaacagtattgtgttgatgaatatgttaagattgaaggagacagaatgagttggataaagaacaatcagaaaaggattttggctgatgcttacaagaatattgacaaattttttaagaaaaaacttctataatttcgacttttcgaatttcatgtataacttttttggtaattgtctaatcgcgaatcaatagcttagaaaaattcgaatgatatcaataatgttggatttggatgacaaagaaaaaagttttagtggaaaaacatgctgacgccgaaacgtgagcgccgaaacgagcgcgccgaaacgtgagcgccgaaacgcagtggatccaaaaaggtgacatgaagtttgggcaccagaaatttcggcaccggaaaatttgggcacctgagggagagatttaaaaagataaaacaaatattaaaatgttatataaatccagggttcccatcatccatgctccgtttccaaggacgggtatgccaatttgcaaggaaatagtggggaaaattcatgaaatcagtcagagaacggcaggtttggtgtaaagagggaagcaattactcaattaggggtcaaacaattatgctaagtcactgctcgcttaggacaaagtcgataattatttagaagaagcttttattaaggcgaacataaattaataatatccaatgcgaatgaatgaatgtcaaaaggaatgtccttatataaaaagtttggtgtctgttgtgtgtgtccagtgtttgaatttgtgtggcgttttgtttaatttttgcgttaaaaatgaatttgaaaagaaatgtttggttttgctttttttcatttttgtttaattagtttttgcaaaaagcacagttaaaataaa

SEQ ID NO: 80748 - DNA, 2800 bp, Heterodera glycines
  Genomic contig location: Contig_ID=SeqID_16361; Location=186..2985; Strand=-
  SCN-specific regions: Sequence locations=1-229,266-318,340-846,880 -909,938-1442,1471-1667,1689-1757,1780-1904,1926-2025,2060-2170,2206 -2211,2233-2406,2435-2666,2702-2800
tgccgaatgtgttgagctgttcctccaatttttgcttgaccatccccggcatcggcaacaaaatgccaaacgcgcgcaccatttgacggaactgttcctccgctgtgtgcacagttcgcacacaatgcgctaccaacttggacatgacgccatcacaacgattttgaaaagtgacgaggtatatatggacgggatttcgattttcggaattttttgtggtcgtctgggctttttttttaaatatttataaaaaaaatttttaaaacagtaataaaagtttctgttttcaagacaactctctctgatgtgcactgtcgttttctctgctgcttcttgaaggtaatcaatcattttgagccaaattccgtagccatgggacaattaattaattcgtcgccaaaaaagtagaaaatatttggccatttattgaaatctgagcctttggcataacaattccgttgttcaccgttgcctttttgttgtcttaaatctttttttgcaaaataagtcgtaaatttttttttctgcttgcaatttggaaacaaaaaatttttttcttttcatccgatttattttctttactgtttcctgttcaaaaaaggatgtccatggtcgggcgtggcttcgcgaaagcggcggattggaccgcattctgtgccgtcttgcgaccgcggaacagtgcgacgaccgcagggatttgctgcgactccaacaattcattgtgaccgatttgaagtcaattttgcacgaccacgcgctgctgctgaccataaatgtgggtgaatattttcgtgttccccccccccccccgtaatgaaaaattaaaattttttccagtaaaatgggaaattattaaatttttttatttcttaaaaaaatggtgcctaatggcaccgccgagtcgcaatcattccattatttatttatttgcaaaatttgattccaaaatggccaaatttgacaaaaattggctaaagatttcctattttcccactgaattgaaattttaaaagaatggacaaaagatctaggggtttctattgagattccacactctccatgcatttttgaataaaaatgtttactttttttttagcacccaaactttttgccgactgccattgcgcaaattaatcgctttttggaagaaaatttggtggagtgtgaaactgttggcgatgctcacaatcagcacgagtcgtcagatgcaaatgttcagcacgaggaacaaatggtggaccagaaaagtgatggcaatcggaaacggcacggcacagacgaggcaaattttggtttttgtgccatggaaaacttgacgaaaatccgttgttttcccattttcagcctctttgcaaggatttttctgcttccacaagtgcctggccttcgcattcgccggccgcttctcctccgtcaactcggttacacggggctcgacttacttttttttgaaatttattattaaattttgagtttttttttatcgaaaagataactaaagcccggaattttggtactgacaatggtcgggatcgggattttaatcttaactcaaaagaaagtttttggaaaaaatatgaaaaataattcaaaaataccgttcccgaacaggcccatgacatgacttgatcattcaccggaacaaaaagcccgtattttccatgtctaaattctggtcccattttcatgataacaaaacccaattcatctatccgtaattaccaaatataactctaaattacgacccgattttcctatgttttattgtatttactgtttagtggaaatgttgcctggtcgccgtcgatgtcgccttccacggacccccaattttcgcttagtccgtccgcctcgcctccgtctgatcatggccaattttgggtaaaaaaaagcgttttttttcgtttcatattttcaaatacattttcaacagttggacgactatttggtcgaaggactcaaaacgaaggccatgtctccgccattgcaagaagacgcggcacccgaagaattggaaacggacggtaaagtttatgagcattttccattgtctttcaaattttttttgttataattgtttaaagtctttgagctactcttcatttttctaaaactaaacatcaaaaaaataaaattttttgcattttttagtaattcgaaacaaaaaaccaaataaatttaatttttttttaataactttttttacatgctagaaaatcattttccctttttgtaaggcaactagagcatgtgaaaggcttttgaatgatatcaagattgtttgatttggttgaaaataaacgaagttatagtccaaaaatttggactgcgccgaaacgtcccatttcatgcattgattggcccctttaaatttgaagatccgtcctcctttttggagcggaagaccatcatggaggaggaggaggacgagtcggacattgaagaatttgctgaccattcaaatgcctctgcttctgttacttctgatgggccatcgtcgtcgtcggccgatggaaaagcgttggccgagcgcaaaaaagtgatgaaaattcgtgccaaaattgtggacgcattgctcacgctgatcaccaccttttcccacttggacgaacgccaaagcattgtgttgatcagcgaaaatgtaagtgagccacttttttaaagtgaaaaaatatttaaaataaataaaaataaaaattttcttttggtactctttttgtgcagcatgccacacttttcggtggatttggattgaaaaaatttgtagagtttgacccggatttggatccaggcatggacc

SEQ ID NO: 80749 - DNA, 582 bp, Heterodera glycines
  misc_feature (552)..(552): n is a, c, g, or t
  Genomic contig location: Contig_ID=SeqID_16362; Location=1..582; Strand=-
  SCN-specific regions: Sequence locations=1-236,275-582
  Gene Ontology: Biological process=aspartate metabolism
gtggttcgcttcgcgaatgaaaggcatcgatttcgaaactgggcaacaaatgtgaattttttaaattatgcattaattcttcgtctattagccttcgtttagcctttgcccttctcaatttgctttggttggctccggctctgatgaacaactcggtgcattcaaataaaatcacttaaatcttttaatgaaaaaagattttttcgctctttttaaatctatttttcgttggaaatttattattattattatttattattatttttgttattataaaggtggctatgctcgacatcaaactgttttcaaaaggtgtttgtcgttcgtccactaaaaatgtgcagatttactgaaaattctttagcaaaggattggacggagttgcggaggaattgtccatggaaatgcatcggatcggagcacgcaattttggcagggacgaccgaattggcacagtgaatggcaaaagccttctgtgagttagccttttatatgccattttccctgctttcataaacgagcatcatcttcattcaaggcaccgtccttgangagccgttggtctgctggctgaacactttg

SEQ ID NO: 80750 - DNA, 236 bp, Heterodera glycines
  Genomic contig location: Contig_ID=SeqID_16363; Location=1472..1707; Strand=-
  SCN-specific regions: Sequence locations=1-236
acggtaattacagtaccaaaaagcttcaaaaatttgaaattgttgctttcagttgtcccacttgctccgaaatgttgtccaaggatcagtcccattttgtggagcgtcatcagtgcattcgcttcttcgcccgcgtgtacggctacaaccctttggtgttctcccaattccgtgccgactccgtgctgttcaaaacgcgagtgccgcacaatcaccaaaagtgctttcgctacgtt

SEQ ID NO: 80751 - DNA, 514 bp, Heterodera glycines
  Genomic contig location: Contig_ID=SeqID_2619; Location=2073..2586; Strand=+
  SCN-specific regions: Sequence locations=1-514
atggccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaattagacataaatgttttaaaaataccggaaaatgtcagacaattgcacccaatgggcaccgaccatttggacggccaagaagacgatgcacaacagcaaatcgatgcctag

SEQ ID NO: 80752 - DNA, 563 bp, Heterodera glycines
  Genomic contig location: Contig_ID=SeqID_2619; Location=605..1167; Strand=+
  SCN-specific regions: Sequence locations=1-563
  Gene Ontology: Mol. function=general RNA polymerase II transcription factor activity; Cellular component=transcription factor TFIID complex; Biological process=negative regulation of FGF receptor signaling pathway
gagcttttatgtgcagaaaatttggacgaacttttgagcagtgagaagcaaaagccgaccaacgaggacgacgacgagtcggccccgccgtggcgcttcgggccggcccaaatgtggtacgaccgttttggggtgccggcgaacccgtcgaatttcgactacggactgaagaggcggggcacggtttgccccccccacgccccattcattggtttgccgttttcattgttaaggcgctgtcgaaacgttcaacggacgacggcactatgccattgccaagcgaaggtaaccgaaccattgccagctcgctgctcaaattccatggcctttttcagatgaccgcaactttttgccagtgcatttcttacattgggaggacgacataatcattgaccctgaacaggcgcgggaaaaggtacagaaaatggggggggggaaggaaatcccacgaacatccgctcaatttgttcagctggtgaaggaactctcttcggttaaactgccgcgttgcggatggattccgacgccgtacacgcgcagttacaaagcatttatcgcggcat

SEQ ID NO: 80753 - DNA, 1301 bp, Heterodera glycines
  Genomic contig location: Contig_ID=SeqID_2621; Location=16..1316; Strand=+
  SCN-specific regions: Sequence locations=1-372,395-1301
atgacgagcacagaatccccgcaccaacaacagttccttcggttgccattgttttgcaacaacaaccgccttcggcaccaatcagcccacaaaagcagcaacaacaacagcacacgagcccaaggccgggaatattgcgtaagtaagacaacgcaatttgtgcaaatgtaatttcaaaaggtggcaatgcgtcggcagtgcgtcgtctcactgtcgatcgcgaccgtcccgcgtcagtttcgggttcgttcataaacaattcggaggaatcccctcggaaacgtcggaagcagcactttgacaacagtcagcttcttggtgacaaagtgacggtaattgcaaattgaaacaatttatggggctcactgaaaatttaatgatttttctaattaaaacatttctcttatgttacattaattgtaagtcgtatataattttaggtcgagatgagacccaatgaccgtcttggacagtcggcttctgctgggcctttgctggcgggctgttggaggaattcgagcagttcagtgacaaccgaaggcggtgttgcaacgcaacagtcagaatatataatttttcaatgcttttccgtgccaactttctgtctttacttaggggaacctttacggccgacccattggcacgtgttggcgcggcaatcagtgggaaaaaagccgtcagcggtgttccaattgagggaaaacagcagccgaagaagcgcggccgaccgaaaacgaattgtcaaacgcaacaattgccgttggtgtcggcaaatgcgacgacaaaaagtgtgcaacagaagcagaaaaacaaccaacgaactgaacaacgagcggtggacatcgccaaaaatcaaccaaaacatcacaaattggcattagggaaccatttgacgttgacaacactcaacgaaagtgcaaaaacgtcaaagtcaaaacagatcatcactgtccaagtcgagcacatcacagaggtatttgaagtgagattggaaaggcacaccaaagcaaaaaaaaaacatttaagacggagcaaaagaagcgcaaataccaaaagaggacaccgaacattgacccattgaccggagcgaggaaagtgcgaaaaaagggcagtggacgaaagtcaaagaaagaattggctgcgaaagcggcaaatggcgggggagtttttggcactgacgggcgatgggtgctgacggaggcacaaccagccaaaagcgatgccaattccatcccaaatcataagatggaggaatttgataacagccatcagccgagccaaaatgaagcacccgaactgat

SEQ ID NO: 80754 - DNA, 774 bp, Heterodera glycines
  Genomic contig location: Contig_ID=SeqID_2622; Location=178..951; Strand=+
  SCN-specific regions: Sequence locations=1-358,392-410,448-602,624-774
atggacagtagtgaaagtgcggttcgtgcacccagaaatcggtcttacaatccgcaacatttgacggtaccgaaacatttggacgaacggtgcgtcgaccgattgagtgccgacattttctgctcgcttttcaacagttacgacgaggtatgctgtcaaaacactattaatgaatttgccatttttccattcgtcgcccattttcagtttaaaaagaccacaaattcgatgcgtttgctgcccgtcgcctgcgcttatttcgacgcctcccaacgccttctctcctctcttcgcacttcacttcgaggcttttcactttatcacgctctgcaaaagtcagatcagccaactatcaaagagaaaaatatggtaaaacacaaacaaatgacaattttatcaaaattatttgcattattatacaatatataattataatatttataaaatcgataaaaatgaccaattacaggatgaaattttggtggaggagagcgaccgttggttctttggagacggtttggtgggcattgaggaggccgaaacggaatgggacgacgacgccgagggcgagagggaagagcggctgagccgtgccttttttgccaaattggacaaagaataccaaaacatcgtcagacgacagtgttgggacgacgatgaacaaaacgaggcgaagggggacaattttcaaccaaaaatggcgcaccaattactcctccaacttgacgttgcccaaacattggatttagtgttgcacaatgttgagaatgacag

SEQ ID NO: 80755 - DNA, 569 bp, Heterodera glycines
  Genomic contig location: Contig_ID=SeqID_16364; Location=1220..1788; Strand=-
  SCN-specific regions: Sequence locations=1-399,442-466,489-539
atgcgacgtgcggacgatggcactgccgatgagcaatgtgatcggcggtatgtaaccatcacaaatgctgggtttcattttccaaaattcacaaaaaataattaaacggtgaaataatattgaataaatattgagtgcaagtgaacagacaataactcatattagggacattctttctgatcagttttctgtaagaggtgaaggaattgaatatgttacaaaaaaatattcagcccaatcctttttttcatcgttcatatttttttggtgataaatgattagattagtagctgaccaattaaacaccgcttttctgatcaattaatataattggattgatttgaaagtgatcggacccattatttatgataattttatttaaggttttctgtcaatttcttttaaataataatagtaaaagatttaaacataaatttttaagtccaaccaaaaatttatgtttgaaaaatgatttcttttgctctttggtaccatcattttaattttgaagattggacttttgagtttcaaaatatcgcttttatttaaagatttaatatttaattaaa

SEQ ID NO: 80756 - DNA, 68 bp, Heterodera glycines
  Genomic contig location: Contig_ID=SeqID_16364; Location=701..768; Strand=-
  SCN-specific regions: Sequence locations=1-68
atgcattggcggcggcgccgcgttcgacgtgctgacgatggcactgccgacgagcaatgtgatcggcg

SEQ ID NO: 80757 - DNA, 104 bp, Heterodera glycines
  Genomic contig location: Contig_ID=SeqID_16365; Location=3153..3256; Strand=-
  SCN-specific regions: Sequence locations=1-104
ctctgggtacgcgccagtgtcagacaaaattgctcttaacgccaaatagcgcatttagcgtaaatttttgcgcgttaattcaaaatttacactggaaaatgcct

SEQ ID NO: 80758 - DNA, 1080 bp, Heterodera glycines
  Genomic contig location: Contig_ID=SeqID_16366; Location=1..1080; Strand=+
  SCN-specific regions: Sequence locations=1-170,192-1029,1052-1080
  Gene Ontology: Mol. function=transporter activity; Cellular component= integral to plasma membrane; Biological process=transport
catcggaatttcggccaacatccaatccttccagtcggcttctgtccatttcggtcctcaatttacctgggggcttggcctcgcttttggtgtttatatttcggcacaaatttcgggttcgctaaattggcattctatagcaatcaattcccttccatatcaggtggtcatttaaacccggccatttctttggttcagttggccaacgggtccatctctctggtccgttttgccctgtatatttttgcccaattgtttgccgcttttctgggcagtgctgtggcatttcttggccatttcggtaaaactaaaattaaattttgcactaattttatttcagagaattgcatgcaaattcaaacacgaaatggcaatcaagaattctgtaatgcgttctcactcatttgtttaatacatttccgatcacttaacagcacaacttttcgccacttttccaagtcctaatttaagcatttggggcagtgttgctgatcaggtcatttccatttccattttcgttttctttctttttttgacaccatctaaagcttgaccactatcttttcctggattaatttaaaattccctctttaagctgatcggtactgcaattttggccttttgtataagtctgatcatggacaaacgcaatcgcgtccccattggactggcgcctctgctggcgggcctttccctgacaatggtctgttccttatttatgcatcaccgatgttccttttttcaatcgaaagatcgcgttgactttcggcacaaatggcggctttgccataaatcccgcaagagatttggggcctcggctttttatgctttgtctgggactcggctgggaagtgttcaggtgggcgctgattagtgaaagtctccgcctacccatcgctgccttttccgttttccatgtgatcgatcatccattcgttcagcaacaacaatttctacttttgggttcccctagccgtgccttttgtcggggctttggtcggtcattggctctacaaaatactgatcggagtccacggcctccaggaactgatcgaaatcagcggagccaaatacccacgg

SEQ ID NO: 80759 - DNA, 860 bp, Heterodera glycines
  Genomic contig location: Contig_ID=SeqID_16366; Location=1972..2831; Strand=+
  SCN-specific regions: Sequence locations=1-301,324-565,587-860
  Gene Ontology: Biological process=reproduction
gacatgaaagacacagtgaaagaggggggacgcgtcaacaaattccctggttaatgctcaagttcccctaattaggcaattaagctaatttagggatgagcgaattggccaaaaaggtttctttgactgtggcgatccaatcaatgcgcgaattgttccccgacgaatatgccttttacccccaaagttgggtacttcccgcccaattggacaaattcaaaaatcactgcacggatcaaagggacgccgacaaaggccaatgttttattgtgaaaccggacgaaggtcaattctgatgtggaaaaagagagatgggggagagaacgaaagctgctttaggtgcccaggggacgggcatttatctgatcaattcgcatgatcagctgaagagcaccacgacacggcaattggtccaggagtacgtcaccgacccctatctgttgccggatgacctcaaatttgaccttcgggtgtatgcggtgattaaaagcatcaacccactttccatttacgtggccagagaaggcgctcactttttattttttgtttatcttgatttataaccttttatctaaaaggataggaatggcacgattttgtacggaaaaatatgtgaggccgtgccctgagaatttcgacaaattttacgctcatttgaccaattactcactgaacaaagagaacaatgcgtacatgcacagcaattccctgagagaacagctgagaggtgaatttggcattttgccaaaaaaaaaataaatgaatcgcaggaagcaagcgactgctgtcgacggtgttccatcagatggagcgaaaaggcgtcagaacacggcgattgtggaaggacgtgaagctgatca

SEQ ID NO: 80760 - DNA, 973 bp, Heterodera glycines
  Genomic contig location: Contig_ID=SeqID_16371; Location=946..1918; Strand=-
  SCN-specific regions: Sequence locations=1-423,445-489,524-551,573 -931,971-973
atgggggtaacctgtaaaatcctgtcaagttggggctggtcatccgggcccgacgaaaatgccatttggaatggtttgtccagtgcgataaggtcatctgaaagtcaaaaaaaaaatcaaataaataaaacgcaaatacaaatcccgaacgttttttaaaaatcatggccattctaggtggtaccccctcccactttttcgaaaaaaatataaattaaactttacaaaagttcataatacattttagggattttcgggctcgatttaatttcacatgaacagttatactcttcgaatttttcggcttatcatttgaatccaattaggggcgcagaattggtcggaattgaatgtgagattcaagattaacgaccccgataatccctaaaatgtgtttcatcaactctttttcaaattttgagattttcgaaaaggtggacacttggccctcaattgccttaaagagcgaaaaattgcagagggagcagaaaatttttctgtcttttatatatacgaaaattatggaacaagtatttgtgccgtttattgtcggattttaaatgttttcctttacccgctcccatcaaattttatttaaaaaatggggctattaccagtctcgtagatgacccgttttgccatgcagtcgaccaattcggcacggtcaaatttccaaattgggtctatcaaagcccacaactgctttatgccgctggtaccgtcagactggtccgcaagctcaaacattgcgaacaaaaacgggaaatgcaaaaaatgtaggaaaaaatgctaaaaagtacaaaaaaatgttaaatcccgaaatatgtacacggcgagtcaattttgggctccaagcgcaaataagttggtttttttgtcttagtggtctgtgagttagtcaacaaaaagggggtctcaggttcaaatcctctttgtgtttgtgtataaatttcaattttttaaagcaaataaa

SEQ ID NO: 80761 - DNA, 107 bp, Heterodera glycines
  misc_feature (99)..(100): n is a, c, g, or t
  Genomic contig location: Contig_ID=SeqID_16371; Location=2536..2642; Strand=+
  SCN-specific regions: Sequence locations=1-107
atgaaggcccaactgcagaacgacgccctccttttccgttaccgagccatttgcaagggcgttccgaagttggccaaggcgcgcatttcaatcccattnngatcaag

SEQ ID NO: 80762 - DNA, 1098 bp, Heterodera glycines
  Genomic contig location: Contig_ID=SeqID_16373; Location=237..1334; Strand=+
  SCN-specific regions: Sequence locations=1-259,286-688,731-904,926 -1098
atgatttccctgtcttcggttaaaggtttcttcacctcgtccactccgctggtggccgccctctcacagccatccatttcctcctcgcccgcctcgacacgttatggggtgaacacgccgaaatcgtcgtcggctgcgtcctcctcgacctacggcacgacgcaaaactatggcggcggcgctgctgccgcactgtgcaacggcggcggtggcggaccgttgccgagtccggcgggaacaccgggcggaggaggttcacggcaacagcagcagcaacaacatcactatgtggtgcagcaacagaccaatgctggaggagcagggtgtgacggaaacggaagataccatccacagcaacaggttgggtggcgatcggaattaattcgttatacacaacggcccaattttgggctctcagtgcaaataggtttattatttatttagtaatcagaacgccaaaactttgcaaaacttaaaatttttttggaattttcccttgtaaaattagaagagccgatctcgagttaaaaactagacagctaaaaaataaactgtgattcgatagagggggacaaaatatgggcctatacaaaatttcaaaaaaagttacccacaggaaaaaattttttcccagggcaaaaatttcaataattttaattcttttttagccaagtccacaatttaaggccaaaccaaataaaatttacaatattctccagaattttcccttcaaaatgagcataaaatggttttatttgctttagtattcaccaagttataagctaaaaaaatttcataaaattgtcgatgttgtacctaaccaacgctttttgaatatgattttttattgccccgaaaacttttattaaagaaaaaataattctcgcctagtcaggcccgtatccagcaggagggaggacccgtgccccccccccccccccaaaaaaaaatttcaagaaaaatgagtaaatttttttcaaaattttcataatggacggcgcctattggcccaactgccgggtcctatttttatgcccctccaagaccttccccacccaaaattttccaaaaactttttttttgaaaaaagtttaagga

SEQ ID NO: 80763 - DNA, 627 bp, Heterodera glycines
  Genomic contig location: Contig_ID=SeqID_16374; Location=398..1024; Strand=-
  SCN-specific regions: Sequence locations=1-16,38-529,557-627
atggtggagccaattgaagggacggacagagaggaagagggggccaacgaccactcggatatgacactgccgtccgaatttgatgaaaatggagggaatggaggagctgtgcgcagtcttcgcagcgacacggagacgaacgaagagagcgcggtagatgaacaatttcggaagcagaagggaatgccaaggggggagacggaggcaccagagaatgccgaagccacagatgtgccggaatcaccgaacagcggcacgacctcggcggcgaaaggagcgcagaagaaacacccaatcttgattctgcttaacaacattgaaggcatgccaaaaccaagcgacccacggaaaagcaaagggattagaaatgcggcacaaaataaccaacagatggatgaagaagggccttctttgactgattgggagattaatgttggaagagcggcgccaactggcgatgttccgctggtgaccctacccaaattcgcaactgaatacaaacaaaacaacgataacacaacgaagggaggagaagagcaggaaaaggaaggggaaaggacggcacaaaaatcaccgaatgacgcgggacagcaacaacaacaaagcggaataggcacgcttttataa

SEQ ID NO: 80764 - DNA, 615 bp, Heterodera glycines
  Genomic contig location: Contig_ID=SeqID_16376; Location=872..1486; Strand=+
  SCN-specific regions: Sequence locations=1-615
atggtgcgccagccgcaaatgcgcatgcttttgccaacgcttctgaccatcgactgttttgagccatcggacgatagaagcatttctgattggttggaacgcttcaactttgccatcgactgtgcggcaccgcagctggcagaccaggcgaaggtcaagctgctcatgacgaagctgagtgaagtggctttcagccagttcagcaaatcatgtctgccgaagaaagtcatcgattttgactacagccaaacagaggagcgcctaaagattgccttcagccggccacaatccatttggattgatcgctatgaatgtatgagggcctcgaaaagcgaagatgaaagctttcgtccttttatcaacagacatatgcgactcttgcgtgattctcagtttgaaaagctcaacgaagagcaattttcttgcctcatgcttttgacggcactgaaatcaccgaaggatgccgagctgagaaaacgaattctttcgaagcttgcagcgaatggtgacctggtcgagtatgatggagtcgtcgaatacctccaaatgtaccagtcaaccatcgctgaagcaaaggtcgtcgaacaacaaccgatgggctcacgaaaaacttga

SEQ ID NO: 80765 - DNA, 760 bp, Heterodera glycines
  Genomic contig location: Contig_ID=SeqID_16376; Location=967..1726; Strand=-
  SCN-specific regions: Sequence locations=1-760
ctccattcttctttaaccatgcctggtgcttggcacacatcctttccaagtggccactcttcttgcactttcgacaaacggttgtttcatgtcgacaattgctcgacgaatgtctcaaaccgcatcgccaacatacgcgttgcgatcgattgctgctgcgcgttcctgtcgaaatgctgctctcattcgacgaatgatccgagttcgttcgtttcttttttgccttcaatttgttcgccatcaagtttttcgtgagcccatcggttgttgttcgacgacctttgcttcagcgatggttgactggtacatttggaggtattcgacgactccatcatactcgaccaggtcaccattcgctgcaagcttcgaaagaattcgttttctcagctcggcatccttcggtgatttcagtgccgtcaaaagcatgaggcaagaaaattgctcttcgttgagcttttcaaactgagaatcacgcaagagtcgcatatgtctgttgataaaaggacgaaagctttcatcttcgcttttcgaggccctcatacattcatagcgatcaatccaaatggattgtggccggctgaaggcaatctttaggcgctcctctgtttggctgtagtcaaaatcgatgactttcttcggcagacatgatttgctgaactggctgaaagccacttcactcagcttcgtcatgagcagcttgaccttcgcctggtctgccagctgcggtgccgcacagtcgatggcaaagttgaagcgttcc

SEQ ID NO: 80766 - DNA, 556 bp, Heterodera glycines
  Genomic contig location: Contig_ID=SeqID_16376; Location=1687..2242; Strand=+
  SCN-specific regions: Sequence locations=1-26,67-556
atgtgtgccaagcaccaggcatggttaaagaagaatggaggaaagaaggaaaaagcggtgaacaacgtccgcgttggaggagttttcctggttaaatctgagaacgagacgaagaaaggaataatcgatgttccgattgatgtgaatggaataaaagtggacttcattgctgatttcggcaccgagagaactgttctttgtgaggacacggtgcgccaaatcggaactttgaaattgagccgttgtcaagaacccgctcagtatggcaagaggtataagaacgccgaccgaggatgcggatgatggacggaggcctggcactttttaagggggggggggggagatgttagggttgggacccaatgactggtacccatttggccttttactttatttgtttctcccattttcccttcgtatgtcacgcccctttttccgcccataaatacccgcgttgttgacccttcctacgtatttcgtttatttcatttatttgttcccttcgttccccaatcaatatctgaccccgttcgccctgtctttcttttctttttga

SEQ ID NO: 80767 - DNA, 286 bp, Heterodera glycines
  Genomic contig location: Contig_ID=SeqID_16377; Location=1328..1613; Strand=+
  SCN-specific regions: Sequence locations=1-24,47-286
atgccaccaataaagcatgccaacaatgatgaagatgacgaggatgccggtggtcatcgacgcgccaatgttcagcttgccaagcatgatcgggtggccaatgtgcagccaatggaagtgcaggccgggcattggggaggtcaaactccagtccatcactttggcatcaacaagcagggcgctaacggtcgaagagccttgctttcctaaacaaaattaattaatgattaaatttacatgaaaaattaaccacaaaaatataattctgcataggttacagaattaa

SEQ ID NO: 80768 - DNA, 846 bp, Heterodera glycines
  Genomic contig location: Contig_ID=SeqID_16377; Location=1809..2654; Strand=-
  SCN-specific regions: Sequence locations=1-140,163-174,196-198,224 -522,565-690,712-846
cttgttattccattttacttgccaatgaaaaagggagtaaaatttgcgttcaaaaaaattttggtgcagcccaaagattggttccgcgcatggatattgaaacttttctcgacagcgaattttgtcttgaatgatggtgatgaaaaaatgaagcaaaaagcgaacgatggtgctaataaatgcaataaaaattattcaaaaccttttaataaattttaattaaccatttttaatgtgttttataataggaaaagtgccaatcactgatttgtcggaaattgagccatcaattaatgtgccgaattttgaggaatcattgaatgaaaatttgggcacaacaattaagaaaatgtcaaatattgtggaaaaaaagaaagcgaacagtaatgaaaaagcgttcaaaaaggtggcacaaatgttgaaggaccttttcattaactttggcctgaaaaaggtacagaacgaaattgaaaagagtgtcggaaatgcccagaacagtgtgggtgttatttttgactaaacatttttaaaataaaataaaaaaatttaaaatgaattattttagagtggagaaaatacaaacacaaaaaagagcaatcggagacgccgaaagcgcggcattgagttgggagctggcataaatgcttacattgaagcgggtaaaatattgaattatgaaaagttttccaaattttcttgaagttttcttaacatttcgtttaaaatcagtcagaccattgtcatcataaaggatgagatttctaggcatgaaaatggcaaatttgcaagtttatacagggataaaagcttatatcccttttttattcatctttttcattaattaaa

SEQ ID NO: 80769 - DNA, 1746 bp, Heterodera glycines
  Genomic contig location: Contig_ID=SeqID_2624; Location=2061..3806; Strand=-
  SCN-specific regions: Sequence locations=1-436,459-476,498-766,789 -962,985-1464,1486-1563,1585-1746
atgccatcacttttatcaaccgttttcgccaacttttcgccaaatgccccattaatttggccatccgaacggcgaatgatcgcatttcggatttcatttttcacaacatttggccaatgttcggaaaaaacattcatggcttgcgattgtccgccagatttttccaccgtttgcgtcaattcgtcccctcaattctcaatgattgtccgtcgcttcgcgttgtcaattcctattctaatgagttcttcaccgaattcccatgcgatgacagtgccgcggcatcggaaggacaagcggtggccaaatggcttttcactcctcgtcctgacgatgtgccaaaggtgttcaaatgctggttgaacttcggtagctggcatttggcgccgaatattgaagcattcaaagcggtgcttactaattgatttaatatttcattgatcattttctttctcaatttttcaatatttcaggcttttgcctcggcttcatctcctgccaatttcatcatttccgtttggtttccttcgtcttttgctgcttctattgtgccatttgtgctgaccaacgaattaactcgagaacaattgacgctgaaaaagattaacaatagccatcgttttctgttcgtccgttgtccaattgtgcgagacgaaagcaaatggacaaaatgggagaaggaagcgattgatttgcgaatttataatcagtgtaaccttcacattgaaattaataaggatgattacatctgcaaagggtcagcgaatgctttttcaaaaattaaatttatttgttcgatttttaggcttctcgacgaaattcccggcccaagtgatcagcagcaaaagtgaatgaatgaattgttgagaagggatcgatcaatttgaaattgcgccgttggataatgaatttgagtcagaaaattgttctttttgttgcggtgatcaatttgatctaattgaattattttgatgctattttgacctatgatcataaaaattgttctcttttttttgttggaatgatcaacataataatctttgttaagccccctaataagggtaatttagtgtttccgacagttcctattcgcaacaaatggcacttttacttatgaaaaacgttgtcttacgctgtttttcggcgctattcagatttttggtattatttgatagcaacattgcctaccaaaaagtttaatatctcgtgtcaaacgaattaagcaaataagtcacgtcatcctgtttcattttccaaatcaaattccccaaaaaagagaatcttcccgttgaaatattttccttcatttcttaaatctgtccctaagccaatgactcactcaatgcttttcctttttgcatactgtacacatcccttttgtagtcaaagtgggacaacacccaactctttttggacaaactcgcttttgttaccctaattcattttttggttcgaaatgcgaaaatcgaggacatttcaaagatttttgagtgtctgatttttagtacaaagtccgttttttaaagacttctcgacacaactcccggcccaagtgatcagcagaagaagtgaaagaatgaatgaattgtggagaaagtgatcgatcaatttgaattatggaattattgacgtgctcataaaaattgctcctttttattggactcgtaaaacttcttttttttttgttttttaatctttagagctttaaaaaatgccaaattcataacaaatttgtttttggaaaataaa

SEQ ID NO: 80770 - DNA, 1115 bp, Heterodera glycines
  Genomic contig location: Contig_ID=SeqID_16378; Location=119..1233; Strand=+
  SCN-specific regions: Sequence locations=1-70,118-220,243-830,853 -1080,1102-1115
atgacacaatggggcagggcgctgctgataggcgcctgtctcggcaatcagtctcgagtcaaccggtatgtttttaaaataaataagcaatatttttttaattttacaaaaatatttgtaaggctaaatgcatttttttctccaaggctacctaatttagaaaaaggcacagtgaaaatttttgaaacgaaaaaatggtctgcatgtaaattctcttgaatttcagttaaggaactgatgattacagtacagccaacccatgcttaccatccgtttcattgatccaccaaagccgaagccgtactgtactcggtccttgtcactgctgatgtgttggatggggaagcgatgggcacatgtgcaccgggccgtctcgcgtgcaatttcctcgtggatacgttccgtctccgtcttgggctcgtaccgacgctaccgagggggggggggggattttgtgttactgtatttacttcatacactgtagcaatttaaatagtaagtaaaatgcgtggaattagagacggatgggaaatgaatatttaaaaaaaagaaaaacacaggctttcagaatatttcctttaaaaggggtaaggcaatggagaacagtatgaaagaattacagtagacataattacagtatgccagacagaatgtagtaatgtacgggtttttaaataagattaccatctttttggggtcgaatcggagtgcgttcatgaattctctggagacgatcaggccatcccccttatcaaactcgtccgccacccgggccatctccagcgcagaggtcggaaattctggaaaaaaacacatggaacagaacagagataaaattgaaaaattaaaaatgatagtaatttcataatactgtacttgaagcgaggattccgtcgatgaacaacttgcgcggcaccatgccggtgcccgacttgtcaatgcgccggaacagatcagacacgcgtgccttgccgtgatcgttccacgccaaataccgttcccgccaatcgtcaaaggtgaagcccttaaggcgttccaattcctggcaataaatcaagcaattagttaattaagaaaatcaaataattcattattcattaaatgatttagatgaa

SEQ ID NO: 80771 - DNA, 1180 bp, Heterodera glycines
  misc_feature (36)..(36): n is a, c, g, or t
  Genomic contig location: Contig_ID=SeqID_16378; Location=428..1607; Strand=-
  SCN-specific regions: Sequence locations=1-227,249-330,356-388,410 -637,660-1180
  Gene Ontology: Mol. function=structural constituent of cytoskeleton; Cellular component=hemidesmosome; Biological process=intermediate filament cytoskeleton organization and biogenesis
ctggtacagtacccttgcgctcttcgcttggtacgnccattgacaagaaacgtacacggcgaaaaagcgacacgctgcacgacaattggaaacggttgtggaccgacttggtacagtatgaacagaagctgaacgagcgcaaagctcatttgcaggtggtcatttcattagggatggttaatacatattcataattttttgattcctttatcttttaaaaaaattaggtgactaaaatgcaaaattaaataggtggcttaaaggcaataatattttgtaaaatctcatcaaattcatcaacgtttctaatttcttaaatttaatgaggtcataataaaaattttaaaaagaaagatattatgctgttcatttatttcatctaaatcatttaatgaataatgaattatttgattttcttaattaactaattgcttgatttattgccaggaattggaacgccttaagggcttcacctttgacgattggcgggaacggtatttggcgtggaacgatcacggcaaggcacgcgtgtctgatctgttccggcgcattgacaagtcgggcaccggcatggtgccgcgcaagttgttcatcgacggaatcctcgcttcaagtacagtattatgaaattactatcatttttaatttttcaattttatctctgttctgttccatgtgtttttttccagaatttccgacctctgcgctggagatggcccgggtggcggacgagtttgataagggggatggcctgatcgtctccagagaattcatgaacgcactccgattcgaccccaaaaagatggtaatcttatttaaaaacccgtacattactacattctgtctggcatactgtaattatgtctactgtaattctttcatactgttctccattgccttaccccttttaaaggaaatattctgaaagcctgtgtttttcttttttttaaatattcatttcccatccgtctctaattccacgcattttacttactatttaaattgctacagtgtatgaagtaaatacagtaacacaaaatccccccccccccctcggtagcgtcggtacgagcccaagacggagacggaacgtatccacgaggaaattgcacgcgagacggcccggtgcacatgtgcccatcgcttccccatccaacacatcagcagtgacaaggaccga

SEQ ID NO: 80772 - DNA, 1777 bp, Heterodera glycines
  Genomic contig location: Contig_ID=SeqID_16379; Location=399..2175; Strand=-
  SCN-specific regions: Sequence locations=1-70,159-472,545-563,597 -696,729-1018,1040-1368,1395-1777
atggagcaggcgaacacgcgcagggaaaatgttgagaaggtgagtgatcaatgatcattaatgatcagagtaattaattaattaaagagtaaattaattaccattaaaatttttttcaaaaaataattatttgtattttttgattatttgtttttaaaggtgcgcgaacgggcacgaaagatcctcgacacaaatgttggagatgcccatgaattggctgaattggaaagaaaattgatcattctgaacgatcaatgggatcggctgaacgacggtaccacgcaaagggtgagtaaatcggcatactgtaatggtgctcaatttcaacagatgcttgggactaaaatttgcctaacattcaaattggcgtgaaaaattttgaagattaattaaagatttaatgggtttttttattggtacctttagttcataaaccatttcccccctccccctcctttcgaattataaactcaatttattttatgttttttttaaattttaaattatttaaaaatttttcttgttttttttattaaaaaattttgctgacttatgaattagacttttttttattaatactttttaaatttattaatgctccagtctcttttttacaatgagaatatcataatattaaggaaacgctgctcaccagctcattgaagaaggctgtagacttgtcagaattaatgttggtatttttacatttaattaaataattttaattagtgccataatgcttaattgccataattaatcattttaattacgaatcgtcatgctgtttaggcacgatttgggcacatcattgcaagacattgaagcgcgactgcgccgtccggcgctgtcttgggacgaaaaatcggtgctagccgaacagacaaagctggaccatttgcgggacgaatttatggccaaattgccagagttcgagaaggtgatggagttggccaaggaattgcagcgcaacgcgcatccgcgcgcggaggctccgatgcgcgagctgatctgtggcatgagcactcgctgggaactgcttgatcagctgatcaatgaccgggcggagaagttgcgacatgtaagtgcactattgcttctgattgatcggaatgagggacgaattttttattgttgattaattgatcagtattgctttaattttttgttgtttagctgatcaggattttaatttttgtttttcagagagtctacgggtgaaattaactcaatagtgaattatcttatagctttttttcagaattctcattaaaaaatccaatcaaaattttttacttttgattttttattcgtttacatttttcttaaatttttgaagaatttgttacaagttttttttgtttactgatcaaaataattttatttttttatttttagcggttggaagaaattcgacaacatgagcaaatgttggacgaattgatgggttttgttgaagaaaagcagggacagttggagctgatgcgcgactgcagtgatgagggacagctgagccgattgagcacgtgagtgatcggaagaaaatgtattactttcattaatgtagccgatttacggaatttatcccaattaatttacggtattattcggatgcaaaaggattttcttttctaaaattgttaatttcaactaaataacgtattttacaaaaggagatccctcccgtccctcgtttggattataaaatatagacccttcccccttttagggatacggtagtttcaaattatcagagaaataacaaaaaaacatcaataaa

SEQ ID NO: 80773 - DNA, 608 bp, Heterodera glycines
  Genomic contig location: Contig_ID=SeqID_16380; Location=1018..1625; Strand=-
  SCN-specific regions: Sequence locations=1-131,174-245,267-443,475-608
atgccattgtatgtgttatgcaacagtttctactcagtccaacaaagttttgacgttctttgtactccagctgatatgccactcatttatgccttcacaaaatcgaattttaaatacaacacaaagtatgcaaaaataaaaaagaaaaataatttaattttactttaataaatgtattggaatttaagtgtcatggaaatggctgacaaattgctttgtaaagccgtgaaaccattcagccgtttaaaactgagcaccgaagaatttgtactcattcgggcaatcattttctctcatatgggtcagctaattaatgaaatgccaaaattacttgattaaaaaagttaattcagtttctccggggcttagtgaccaggcacagaaattgttgttcaccgaagcggagaaatattcttcactgctaatgagtgttttgcaggtgccgttcttttttaaaccattttaaacaaaaaatgagaattcaagaattttcgaacttttattcgaattcggtttgggattagaaattggtcgaaatgaatgtcggattcgtgatcagtgtccccgaaaactctcggaaacatgctttcacgacttttaaaaataaa

SEQ ID NO: 80774 - DNA, 1131 bp, Heterodera glycines
  misc_feature (44)..(44): n is a, c, g, or t
  Genomic contig location: Contig_ID=SeqID_16381; Location=630..1760; Strand=-
  SCN-specific regions: Sequence locations=1-97,121-138,207-383,407 -559,582-767,790-937,959-963,985-1131
atgattgagcctgattctgccgaatctgtcccggtcaaatgttncgtttgtagtgaaaaatgcaaatttcattctggcgtcaaatgttgtgaaggtgtttttataaaaatattaaaaaaagaacaaaggttaaagctctaaaaataatgaaataattaaaataaaataatatttgtatttttaactttaattaaatattaataattcagcttgcaaacatttttttcgtcgctcaatttcgtcgatgaaggaatattattgcaaaagtgccggagagtgcgacgttaaaaaaggcagaaaatgcaattataaatttaaatgatcctttttttgtgatttaaaattacacttatccatcagtctttaaaatggcaaatgaaaagaatttaaaataaatttaaaaaatctaagaattttttctacaaagattcaacgtgtaagcggtgccgtctgaagaaatgctttactgtcggaatgaatcctcgaagagtttgcgtcaacaatgtcaataatgagcaaatattggcatatatacaacgaatcaaacggctaatgacatcaacaaattcagcagcagcaatagcaccaagttcggcagaaattggcatggaattatcgacagaaaccagcgccaccaatggaccattgaaatgtcacataccaaactcggttatcactaatcatggacagataaagacaaaattaagaagattagctctgtaactgattttttaatgccaaacgccttaacaagaaaaatattcttgaggtagagagaaatccaaaactggtttttgaactggttgctaagaaaattggcatgaataacttactctgtttcttcataagcttgtgaatattatttgtaggattttttagcaaattctattaaatgcaaaagctctgattttagcaattggtaaaaaaagattttttgggtttcattgtgctgaaccatttgctggagattgagcagaaagtacgccgaattcgctactcacagacaacgattccagaattattttatgaacaatgcgattcatttgagtcaatttttgggcggaaattaaatttgctcgaattggccgataaattttctgtaagcaaattaaaagaatttaattaaataaa

SEQ ID NO: 80775 - DNA, 75 bp, Heterodera glycines
  Genomic contig location: Contig_ID=SeqID_16382; Location=1408..1482; Strand=+
  SCN-specific regions: Sequence locations=1-75
acatgcacatgtggtgtagtggttaaactttctacctttcataatttttcgcctgggttcaaatccccacttgga

SEQ ID NO: 80776 - DNA, 1966 bp, Heterodera glycines
  Genomic contig location: Contig_ID=SeqID_16383; Location=24..1989; Strand=-
  SCN-specific regions: Sequence locations=1-406,428-879,901-1230,1252 -1966
atggacccgcagcaacttcaacaattgcttaatgcactgcaacaaatggtcacaaatgccgcaccgcaaaacgccgcaccagaaaatttgagcaatgccaatttggcaagctctattgatgctcggctttcagcattccattacaatccggaggtcggcaccacatttgaaagttggttcaaacggtttgggaaattgatcgaggacgacggaagcacactgccggagacctcaaaagtgcgacttctcctcggcaaactcggagaggaggagtacagcaaatatcgtgacacgatcagcccaacccagccggaccaagtgaattggaatgacaccatttcgcacctcaaacagctttttgccgagacacgttcgctgttcgtccgccgctacgaatgcttcaaaattcgacagcaaccaggacaggacgtgtcgtcacttattgcgcagatcaacgcgtcatgtgaaaacgcagatttgagcctgacaaaggaacaactcaagtgtattattttagtcatcgcgctcagcgatgaacatcatgatttgcgacaaaaagcattgaaaatgttggaggacgctcagaaaaatggcaccaacatttcgctcaagaaaattgaggaggaattacgggcaatccaaattgtgaaggaaagcgccctgtcgctggtcaacccgccaattgtcaccaacgccattaacacaaggccgcggcaatggaccgacccagcacaaagacaaagcggcacaaatcaacggcaacataaaaatgccaatacaagtggaaagccaacacgtggtcgtccaacacttccttgtggatcatgtggcaaatccgaccactggcgctccgactgcacattcaaagacgccacttgccttaagtgcaacaaaaaagggcacatttcgacagtctgccgacaaaacaagacaaaggccccaccgaacagccaccggtcattccacacagtcaaagtggacacacattgcctacatgttggcacaactcaaggccgatggtggaaattgatcattttgataaatggaaggcaaacttccatgaatggcgacaccggcgctcaggccacaattatttcattgcaaacatggcgagagttgggagaaccggaactgactccatccgacatcgatgccaaaaactgcaatgaccagccattcgccttgcttggcaaattcatctgcaccgtccaattttccgacaaaacaccgcaaactctgatcgcttatgtgagcggagaagtcggacacaatttattgggattgccgtggatcgaagctttggagatcattccccgccaaattttatttccgtccagcaaatcggctgatcaggcgacaatgattgaaaatttttcggcagtgaagccgccaaacaaaacgatcaatgatgtgtcaacgctaaaagcggcactccaaaaagatttcccggaagtctttgaagaaggactgggacactgctcaaaggcaaaggcgcatctcattttgcggtctgatgcaaagcctgtattttgccgagctcgcccaattccacatggcgccatggaagctgtgaatgccgaattggaccgtcttcttcaaattggcgcaattaagccaatcgatttcagtcattgggccgcaccgatcttggccgtaaaaaagaaaaacggcaagacgagagtctgcatcgacttctcaactggcctcaacaatgcattggaattgaaccggcacccactgccaaggccggacgacatctacgcttcactgaatggcgcgaaatttttctcaaatttggatttgcgcgatgcatatttgcaaatggaaatggatgacaaatccaagcaattgtgcgccatcaacacgcatcgcggactcttccaatgccaacgcctgccattcggagtcaaatcggcaccggcaatatttcaacatctgatggaccaaatatgtgccggtatcccag

SEQ ID NO: 80777 - DNA, 391 bp, Heterodera glycines
  Genomic contig location: Contig_ID=SeqID_16383; Location=2628..3018; Strand=+
  SCN-specific regions: Sequence locations=1-391
atgccgttgtcgctgcattcaccgtctgcgaccggtcgccacaatcgccgtcagtcgtggcgacggcgtcgatcgccgatgtgccattgtcgacgctgtgcgatgacagacgaatcgccgatgccgctgaacagtcaaacagcagcgatcggcgagcggtcgccgatggctgcttttgttgccgctgccgcggagatccgtcgatcagtgccgggaaagcggtgcgcggggagtccaatggcacagccgtgccgacgtacgcttcgtacatggacacaccggcgctgctggggacgtttgctgcaaaagcagggaatgagtggagctgtggaaggagttttaccgtatggctatcgtatcgacattaaaaatgcgttaccgtgtggtaccg

SEQ ID NO: 80778 - DNA, 106 bp, Heterodera glycines
  Genomic contig location: Contig_ID=SeqID_16385; Location=256..361; Strand=-
  SCN-specific regions: Sequence locations=1-106
gtttgtgtcgatgacgcggacggacttttggcagcgattcggggcggtgccgaccgagtcgaactttgttctgcgcttgaggttggcggattgacaccgacgccgg

SEQ ID NO: 80779 - DNA, 2777 bp, Heterodera glycines
  misc_feature (265)..(265): n is a, c, g, or t
  misc_feature (422)..(422): n is a, c, g, or t
  Genomic contig location: Contig_ID=SeqID_16386; Location=495..3271; Strand=+
  SCN-specific regions: Sequence locations=1-123,149-153,176-388,410 -597,626-797,821-1519,1547-1714,1736-1969,1991-2310,2332-2376,2399 -2419,2441-2575,2598-2777
atgagcggtaaaaagggcgccgattggtacgacgaatcggaccgtgacaaaatgaacatgttggacgcatgtgccagtggaatggtggcagaggtggagcggtaccttaatgggggcgtggacatggaggaggaggacgacgacggagtgacgggtgggcggggggaggacggggaacggcacaacacactcggcacacctgctgggggcgaatttcatttaaaaaaaatcaaaaatgaatttagcccttcaaattgctgccgcnaaaggacatcggagcctggtcagtggctttattacatattagtgtcctataattagcaacaattaatatttccaataggttgagttactgctgcggaagggtgcccaagtcgatcgagcaaattatgccggaatggttggcaatgccattcattacnttaataacaacagttaatttgatgttcatgctttgctttcctttatagactccttttctccacgcgtgccgcgaaggtcatcaggacgtgatcactgtgctggccaaccatggggcgaacactaatacgaccacgtattcatttggaaatttgtttatcatgggatgttgcattcaaaatttgttaattattattttttatttcaaatttctgtcactttatctcccagtggtctcggcgtgtcagcgatggcattggcatgcgccggtcggcacattggcgcagtgcggactctccgcggactgaactcgccggtaaattcggtgccttcaaatcggatggctcatcaggtggcgccaagcccatatatggtcgcttttttccaaatggacattgaaatttgcggctttttgaaaaaaaagtactgtggttatcaatttttttaaataattaactgaatttattgaataaaagcgacgcgaatgtttggcaccaaatccgctggatggatggaatggacgtgcacaaaatgggcgaaacgctcaaatttccgccaattttgatgagcctaaactacgcggagaacagcttaaaggcgccaaagagtgcaagtaaaaaaaaattgggttcaaaatgctgaaaaagttttgccaaaatggcagaagactttcgagcggtgatccaagcgggcgacgaggccgaactgtgccaatgggtgcgcgaggggcgagtgccaagcgcaattggagacggagtcactccgctgatgtacgccgcagtccacggccaacagcgcatcgtagggaaagcggaaaactgattcataattagcagcaattaatgaatgattaattgattccaatttcaatgaatcatcgattataatttgcttaggccgaacatttgttgagaaatgttgcgaattcggcgattgatgcccaagaaaacgttctcggactgagtgcgctaatgtttgccattgtcgccggggacaattcgatggtgcaactgatgctgcgccatggggccaacccgcgcctttcctccaccacaaaagagccattcactgcgattgaactgtcccattttgcgggtaattaaataaagcaaataaataaataaacgcatttcacattaaaatttaaaaaaagaaattgtttaggtctcagccatgacacgcttgtcaagctgtacaaacaatttttgatgagtggaaaaggcatggacaatctgaagaaggaattggctaacaaaagggagacgggcgaaattggcggcggaaaagcgccattgggcgagcggaaaagctcagcgggcattgccctggcaaaattagtcctaaacgatagcggaaacggaggcggcggaatgccatcgcccgcgtccgtcgccgggggcggcgtaagttttaccaaatggcaaattttaaaaagaaatgaagcgcaaatggtccaattgaattctcagagtcataagcgacttcgtcgagtgatcgaaagcatcggcagaaatatcatcggacttaccggcgacctaagcggacaaatcggtgccggcgcgtgcggcgcaagtgacgcgttcccaatggcgcatctgtcgcccagcggacgcgcgcgtttcgacgcgcttgtggacacggcacatttgaacggggcggacgcaccgcgatttgtgctggcggaacagattctacgcggcgacgcacgtgcgcccgcaacgacactcgcgcggacgaaaacaatgcaattggacgcacgcattttgttggcccgacagacggcgattgtaagtagagacagagaaacataaacacaagaatgcattgattacagtatcggccaatttgttactgtaatttggtctgacatggatttgggcgtttgcttcacttttttacctttgattttaaagatttttatataaaattagttaatcaattcgattaattagagattggaggggagggaggacgctggacgagtcttacgaggcttcttctggttttaaaatttgttctgtatagagttggatggtccgaggcgacactttgaggccaatgatattcggagacaatgtgccacattcgaaaagtgccgaagagtcagccgaagttaatggcctttacatggcagcccaatggaacgcagaaaaactgtttaaaaatgtataaataaaagtataattcgaattgtcaacaagaaattaaggccccaatgaaaaggcaccgccgcaaaacggacccatcccatgggaatggggcggaggcaattccgaacgtgcgagtgcccttaacaccgcaattaattgtcagaacggctaacagtcgcgggcacgaacaactgcaaaaatgttgaa

SEQ ID NO: 80780 - DNA, 319 bp, Heterodera glycines
  Genomic contig location: Contig_ID=SeqID_16388; Location=805..1123; Strand=-
  SCN-specific regions: Sequence locations=1-319
atggacacaattctagcagagaggaagcgtgccaagcttcaacacaacgggcattcatacatgtttcacaaggtgagtgctgacggtgaagttcgcttttggtcgtgtgaacatcatcacgcaaaagacatccgttgcaaagggcgccttcacactgacctcaacaacaacgctttacgtgaagttggcagccaccaatgtgaaccaagcacgatgtgtcacgtcgctcgcgtttctcccaattggagatttgacccctggaatcattgctctggacatggctcttcccgacgaacttaatcccgtccttgactggtaa

SEQ ID NO: 80781 - DNA, 1716 bp, Heterodera glycines
  Genomic contig location: Contig_ID=SeqID_16389; Location=195..1910; Strand=-
  SCN-specific regions: Sequence locations=1-213,236-393,415-580,602 -769,791-1339,1361-1716
ataagaaaatggacacaattctaacaaaaaggaaccgtgccaagcttcaacacaacgtctattcatacatttttcacatgctgagtgctgacggtgaagttcgcttttggtcgtgtgaacaccatcacacaaaagacatccgttgcaaagggcgccttcacactgacctcaacaacaacgctttacgtgaagttggcagccaccaatgtgaaccaagtgcagctcgaatggaagcacaacgagtgatcactggaatcaaacgccgggcggtacaaaccatggaaccaccagcgacaattcgctctttggcactgcagaatgtggtcacgccagtccttgcgcaactccctaccaaacaggcgacaaaacaagtgataatttttatgtttcctcaaatatttgtatatttagataatcaggcgtgtacgtcgtgaaattgacgcaccgccaccggttccgaacacgctcacagacttaatcatcccagacgcatacaaaatgtattctcgtacggacgaacaaagcgagcaatttttgttagccgattcgggtgtttaccaagaaaacgggagggaacagaggtaatatacatgcccactttttaattatttaaacgcaatttagaatactgatatttggacgtgaatcgaatggtcggtgggcgcatgaaatgaaagagtgcttcgccgacggcaccttcagcatcacaccgatgcctttccaacaagtgtacgcaattttggcgcggtacgaaataaacagttaacaattttgaacttattatttaagtcggaatcgctgggtcatcccagtgtgctattgcatgctgtccaacaaaacgcacactacatacgagcgtatgtttcgtatgctcgttgctgtgtggccagacttcaacccggacagcgtgtcgatggacttcgagacagcggcgattactgcgctgaatgtagtcttcccattcactgaagtgcgcggatgtctgttccacctcgtccaaaattttcacaaaaaaatttctgaatttgggctgaaacaggttgaattcatgacaaaaaaaaaatcgaattttcgaaaattttagcgctatcaaaatgacccgacattcgcagaaatggcacgatgtgtcacgtcgctcgcgtttctcccaattggagatttgacccctggaatcattgctctggacatggctcttcccgacgaacttactcccgtccttgactggtaaattgacaatctcacaaattgtttactatttattgttctttaattatatattaggttcatcatgaactacacgggtcgtcttaagaatgatggaagccgaacacgcccgcgatttgacccaaacacttggagcgtttacactcgaacaatgcaagtcgatgaccggacgaataaccattcggaagccgcgaacagacgcctgcagtgctcatttgcctgttcacatccatcgatttggcatttcattgaccttctgcgaaaggatcaaaagttatcagatgatgacttcgcgaagtgttcaactggacaagacccaccgcaaaaggcaaagaaatatcgcgacgcagaccgccgaattctcacgatggttcaaaattatttgccacttaacaacggagacaccaacattttcctaattcatcagcctttcaatcatcattttatcattacctttttgatcggaatttctcgaaattatgaaatgagacc

SEQ ID NO: 80782 - DNA, 951 bp, Heterodera glycines
  Genomic contig location: Contig_ID=SeqID_16390; Location=397..1347; Strand=-
  SCN-specific regions: Sequence locations=1-166,190-578,661-850,872-951
atgcttaaaaacggtcagaatcgatgtaaaaaggtttgaaatgggttggaaaaaaagaattaggggcgcgcttgccctttttcaggctgagaaagtggcggaaatggagtgccaaactcagctgggactcaagtgaccgcactataaaaagcactcaaaaggcatttgaaataatttttctagggtaatttgtggcgctgttcacgaatatgacttttgtttttcaaattttcctaatcccaaaccctaattcgaacaaaaattcgaaattcataaattaaaaggaaaacatatttttaggagttttcgaggtcgctgaacacggttattgcgcagctgaaaaaggagaactctaacgcaacgatttgttctattctatacaaccatcagcattggactgcactcaaaaatacaacaaatctcctagatttgattctcgaaccgcgtgggaaactcatgctaactaatgccagctttgagtgccaagatgcgaacctttaattaccgcatttattctgatctatttaattagtatttatgaattaacacgttatcacacttttaattattttttccacaatttttactttttaatatttaaaattcagagaattttttattataaattttattaattgtacaaaatttataaaaaaatttcaaactaaagagcgagcatttgtgaaaatcattaattttgcttaaaactcctctctaaagcattgttctaatggaatttatgggaattatttttgcttttgtaaatggatatgtttttttatcccgaggagacaaatgcaatttgatttctcgctttcacaaaaaagaaaaaatttaatttttagggatgaaaaatatgtacaaaaaatggtcaaaatatgtacataaattttaaacaaaataccgaaatatgtataaaaaaaattaaatatgtactaaatatgaaataaa

SEQ ID NO: 80783 - DNA, 495 bp, Heterodera glycines
  Genomic contig location: Contig_ID=SeqID_16390; Location=1588..2082; Strand=-
  SCN-specific regions: Sequence locations=1-346,369-495
atgtatcaagaaaccgacgttttccccaatcttcaacatgaatctcttttctcattgtttttcagggatactttgccaaataccattggtacgtttcggtggccacccaacaggtggacgctccgatcaaagttagtggttgtgatgagttaaaaatgtgtgcagaaacaatggaccacaaattggcatagtttcctctggttgatacccaaaaaggatttatgtcccgaaaaacttaaccaatcgctcgtcaagactctcgagcattgatcggcttcaatttgttcctttttgtccgtattttctgttgcattttcgagtgcttctgtttttttaaattttgtccttacataattgttttcagttggtccaattgcccatcaaagtgttcaatgtcggcatcgatgtcagcgcggccaaaccgaaagccgaaccgatcatcggggagaatccatttctgagcagagacatcgaaaggcacttctcatgggatga

SEQ ID NO: 80784 - DNA, 136 bp, Heterodera glycines
  Genomic contig location: Contig_ID=SeqID_16391; Location=227..362; Strand=+
  SCN-specific regions: Sequence locations=1-136
atgaggagagcaacggctcaggcccgcaagggagcaggcaaaatctcccgcgcggtcacagtggctccgaccgcacccgagagcatcgccatccaaacgcccaccgccaagctttttgccgcgctgcacaccaggg

SEQ ID NO: 80785 - DNA, 544 bp, Heterodera glycines
  Genomic contig location: Contig_ID=SeqID_16392; Location=528..1071; Strand=-
  SCN-specific regions: Sequence locations=1-308,340-478
atggagccgccggcgtcggcacaaaatttttatgtgccagaaaaatgcgattttggcacagacccacaatggtgtggagactatgtgcaacaatatgtcaaatggtttgaacagtatggaagccgtggaaaggtgcgaaaatttttagaaatttataatttcctaatttaaaaaacctaattattcgtaaaaatgaaaatttccattgactaaaaaaatataaattttgaataaattcaaggaataaatttgaaaaaagtaaattttaaactttagaaaaacctgaagctaaagaaatttaaatgaacatataatatttaatttcaattttttttaaatccataaaattttgcgaaaattctcagatttttctttcggacaaaacatatcaaattgattgacaaatacttaattttcttaagaaatcttcgaatgttggaaaatcttttttttaacaattctcaagagaaatttggggaaaattattataatttaattcaattatttaaaagttaattcaatttttaaaaaaataattaataaa

SEQ ID NO: 80786 - DNA, 640 bp, Heterodera glycines
  Genomic contig location: Contig_ID=SeqID_16393; Location=921..1560; Strand=-
  SCN-specific regions: Sequence locations=1-452,474-528,552-640
atgggtggttacggtaacaaatttgggccttcactcggttacggtggctacactaatccgcttatgatgatggacgccggcagactaggtggtggcggaggatacggttacgggccgtataacagaggatatggtacggtaatttaaatttaacaattctcgtttactgcggattactgtaacatattgatgggcagccggcattggcgtcagcggattcaacaacccttacggaatgtactataacaatggctacggtgcagcaccatcgctaccgtacgcagcgtactggccacagagtccagcactacagtacccaatgggcggagccgcggcacaattacagtactccgcgtcacagaatccttattccaccgcctattggggtggctttctgagcccgttgaaagccaaaacaacgaagaagcggatgcttttagaataaacttaagaaaatttaggaaaatttttggtgccaaaaagcttttaaattcaccgaaattggcaattttataccgtatatttttgaccattccttaccataacattttacacagaccctcaaacaccgatattcttcataatgataacattttcctagtgtaatgttattgtatcacaaatattaatcactaataaa

SEQ ID NO: 80787 - DNA, 1122 bp, Heterodera glycines
  Genomic contig location: Contig_ID=SeqID_2626; Location=482..1603; Strand=-
  SCN-specific regions: Sequence locations=1-10,32-48,70-182,204 -448,482-600,622-658,706-1122
atggccaactcaaaaataagaaaaaatgaattaacggtgaaaattatcccaagcctggttgaagacgatgcacacacctaccatatgctggcctactgtactggcaaaaggggactaatttacacagaaaatggttgctcaaaaggaattcaacttccaacggccaagaataattggcggcatgtctttgatgaagttgccaaattagagtttaatgacacacagcaatgtgttgcgtacaacattcacatttggttaaaactgaaagaagaccaacattgggtttcatgggttagcattaatagttatatttttaaatgtaatgaacaaaataaaatagaacattgaaatagtctatattagagtaaagcggtaccggcaactttcactttaaccggtactgatactgaccgtactggaaaaacggtacagatacccgtaaaaatctataattttcagaaaaattttgtatggaatttgaccactttttaacaatttttctcatcggaaaaattaacaaaatctttgggaaatttgagtgaagaaagccttgaaatgggtgcctagaaggaaatgaaatttttcataaaaaaaaaacaattttcctttaacaatttcttaacagatttttcatagaaaataatagcaaaagaaaaagaaataatattatttaaaaattatgaattcttaaattatttttattttcagccaacatcatataacagtgaaattgaaaacaacctgttgaatcatcgagttttgttcgggaaccatttctatctgaccatcagtccagaaatggacagtaacagtgagcacttttacagtatccaagtgtactgtgaggaaaaaacagttgaaaatcagcaacaccaacagatggttgatggcaaaacaggaccgacaaattcggacaaaaactggccaatgaatgatgaaaatgacaaatataatttcaaaacgtacaccaaacggtcaactatggttgtgttcaacagtgaagcgcgccagtgcaccgacagtaacacataccgtattaaagtgtgggcagtgcacaagcaattgctgtattttaatgtaaaaaatttagcttttttttgggagcctattaagtttctataa

SEQ ID NO: 80788 - DNA, 2475 bp, Heterodera glycines
  Genomic contig location: Contig_ID=SeqID_2626; Location=2825..5299; Strand=+
  SCN-specific regions: Sequence locations=1-363,410-488,523-567,590 -649,671-951,1016-1146,1169-1172,1194-1224,1247-1675,1697-1723,1759 -1781,1803-1850,1873-2176,2198-2205,2311-2430
  Gene Ontology: Mol. function=prolyl oligopeptidase activity; Cellular component=cytoplasm; Biological process=protein metabolism
ttattttaattgaattcttttatgttctcaaaacttttattgctacttgaaaaatctactttagcaaataattgaattatttgaaaaaaaatttctataattagccggggtatgcactcgttgattttgatatatttgctcattagcttaatcgaccccactctaaaggaagccgacgacgagcgtgacccttgagccatcaaattaagacttgtgggcaccgcgtaatgaaagggtcaattacataatcgaattaacagccgatggacggacgaatggacgacgacacgcagttaatttttgagataaattttgatgcaatccgattttgtcatctaaatttaaagcgaaaaatttattctcaaatttttactttaaaatttttaaaatttcaattaaatatttaaatgttcgctataaagtgaatgaaaatttaattttagtcaaactatttaactaaaaatgatttggtataaaatgcaaaatggaataattttcatttaaataatatttttaatttttcatctaaaataagcaattataaaaatgtttctattgccgtttctgttttgtttctgctcattgtcagcccattttgtgtttactcatgcgcaaaaacgaggggaatggtcattaaaagaacaaaaggtaattaattaatttattcatctcattaattatttcattacgccaaatcagaaattttggcaccattttcaactgaaaaaagagaagcatttgttgccgacaaaatcgctaattaatgacggcgaccaacaattaacagcacaaaatgggagcaatgtggagaagaaggctgcaccaatattttcgcctgaagatgcttattggtgggaaaatatataagctattgtgtctagaaatcataaaattctatcaacatttcttctttatgtcgtattttataatatatttcgcaattttaaatgctaaattaatttaaacatttttgattattttaattaaaattttttattcaaaaaataataattaagtgaatcatttaacattgatattcatccggacgattatccatctgcgcggagaaatgagtcagttgttgagcgtatttgtggacaaaaggtgtgcaataaattttaatagcaaattcacaaaaatagtatatattcacaaattcaaaaacaaaatttaatatttcaaatattctaagtgaaaaattattgataataatgcgatttattgaaaacagaaattaaaccagaagaaactgataaattttaaatttctccaatgcaatttccagtaattgtttatctttgtgtcaaatatatactaattagaaaaagtacagtaaattttactatatctaccgtaggttatggacccataccgttggatggaggacccggaccggccagaaacaaaacaatttgtcgcggagatgaatgatttgtcacgtccatttctggaaaaggcattcttccgtgcacaattccgcaacaagttggtgatggtgcaaattgccaaagcgatgaaattttgatcaaaaattggccaaaaaaaattgtgggggtggttaggcttttccattatgacaggatgaagcagctgttcgaccaaaaggcgtacggatgcatcaccaaacatggcgactattattattatgcgtacagtgagggcactcaaaaacaaaggcaatttttattaaaaagaaatcattaatcggttcttaatatttgagaaaatttttaacatatattaaattaatcatttattggggttttcttggccccaaatacattaaaggagaaatgaatgttttctaataatcatggattgtgatggtcagatattgagatgagagttaaacaaattatataccaaaaaattcagtgccatttatcgccagcggacattgtcgggtgaaaaggaattgtttttggaccccaaccaattctcgccggacggaacagcggcaattgtgcaaagcgcgttcacccgggatggccaaattatggcgtacaccgtggccgaaaagggcagcgatttgagcacaatacgggcaagaaaattaaaaaaaattatgcaattttagtattaaaatcgaacggtagttatttttgatgagagaacacaaatcgaaaatttataaaatccttgtctgatttggtacatctcttttaattggagaaagctttttgtctttaaaaacattgacttatgataaataaaaaattctaatagaaaagttaataatttcgaatttaaatttgttttacaaaaataatataaaatatcaaaaataatatttaaatttataaatattttcttcataatttagttccgtggtgtaaaaggcaatgacttgccggacaaaattcgaaatgtgaagcaaagttcgctggcatggatgcccaataacaaaggcattttctactcggtaaatacaaattataataataaaaattaaattttcgtattattatattattt

SEQ ID NO: 80789 - DNA, 556 bp, Heterodera glycines
  Genomic contig location: Contig_ID=SeqID_2627; Location=2063..2618; Strand=+
  SCN-specific regions: Sequence locations=1-321,344-487,509-556
atggcggatggtgccacaatagtcaaatttgttaaaaagatacgacacagtgacgaatggcgtggcgtcaatttgaccggcgttacagtaagccaggagtttttccacagtcgcgacggtacaaaggtattaaattgtcatttaaataattcgtctgattttgagtttaccatgatttcgaacatctaaataggtaaaaaatccaaaataaaaagtgacctagaaatttcgtcataatagccaaaaacaggcaaaaatagtcattataaaaagtcatcttaggcgaatcatgcttttttcgtgccaaactaaaaacggcgcgctaattattttaatttttggttcaaattcacacatttttaaaggtgccggttttcattataagtcggaatgatacaaaacgcgatggttcaaacccggcacttctttacggttatggtggcttcaagtcagtttatcttgggatttcaatttcccatcatggaaataaattattaaattaagcattccgttgttacccagttattcttcacaccgcaatattttcgtaaaagta

SEQ ID NO: 80790 - DNA, 1108 bp, Heterodera glycines
  Genomic contig location: Contig_ID=SeqID_2628; Location=793..1900; Strand=+
  SCN-specific regions: Sequence locations=1-56,78-105,147-213,264 -481,510-645,763-953,1009-1034,1056-1079,1105-1108
  Gene Ontology: Mol. function=prolyl oligopeptidase activity; Cellular component=cytoplasm; Biological process=protein metabolism
atggacatgctccgattccacaagtttactgtgggcagttattggatgaacgaatacggtgacccggagaagccggaggaatttgaatacatttacaagtaattgttatttatgaaaaataataaaaaataatttacatttttaaagatattcaccattgcacaacatacgattgtctcgtggcactcaatggcccgcaacactgcttatgtgttttattaaaaaacttaaatttttctttaaaaaatataaatgattaattagggcatgtaattttataggcacgaaaaaattaaaaaaaggcattgaaaaagtaaaaaacatgcacataagttttataaaattggggtaaaatttcacaaaatttcgtcaatttcgttaaacttaagctagagatcccgtgaatcgctaaataaggtgtcacaaatcctttttgaagaaaaaaaaataccaaataaagctaaattcattaattttgaagaaaataataaaaaaaatcaaatttttttgaacttatttttggcataaattgaaaacatgcaaaaataatttttttgaaaaattttcttgtcaaaatggtcgcctctttaaaatttttctggtcaaatggcttagatgttgttctatatacattcatgcatttagaaaaaaaaaattattaaataaatttacattaactaattggaaatttactatttaattttttgctttttaatgcatttgctattaaaaatataattttattattaattattttaatttctaaaggactgccgaccatgatgaccgggtggtgccaagtcatacgctaaaatatgccgcacaactctatcattacttgaagaagccggaggtgaaattaacccaacgaaagccggtgattgtccgcgttgaaaccgacgcgggccatggggcgggcaaacccagggacaaagtggtgagaaaaattggaaaattaattaaaaaataaattagttaattaattggaataatagattgatgaactgaccgatattatgagttttctgcagagagttattcagctaaaatggtacgacgattaatttcaaatgcggtactttaattgtttttaatttattttgtgcga

SEQ ID NO: 80791 - DNA, 1751 bp, Heterodera glycines
  Genomic contig location: Contig_ID=SeqID_2628; Location=2703..4453; Strand=-
  SCN-specific regions: Sequence locations=1-178,214-493,515-541,614 -644,666-721,743-787,841-940,980-1041,1063-1090,1112-1206,1229 -1326,1355-1379,1412-1751
atggagttgggtgattttagtgttgtgatccccacatcctccgccgtcgttatgttctgctccgccgttgtgatccccacatcctccgccgttgtgatctccccatcctccgaatgccagtaaccggcaatttggcttattttttgtaattatcataattaatataacatttattaacaaaattcgcaggaaaaatggaaaatatgacaatttccgtcttgatggcagcaacgcgtcatttccaatcattcggttgcatgtgaaatctgcatataaaaaggtcaatttcaatcaattaagtcatttttttattcaaaaaattgtttaattaaggctaaaaggaaaaaatgtttaccaatttaattttgattttattttttgcaacaaatttttccgagtccgccgctggtgccaaaggaaatgattcgccagaaaagacaaatgaaaagggcgacgaattgccatcaaaggtgatggaagaaagcagtggtgtggagaacgaaaataaagaacagcaaatgaagaaagaagtacaaatatgtttaaaaaaataaataataaaaaatatattttttaaatttatttaaataaattttataaaaattaattttaagattgaaaatcaaaaagcaattattgacaaagggtttaataaattttttattgaaacacttccgtcgcttgttgttgagctggacaaaattgtcaaaaaaattaccaacaccgaaaatcaaatggaaaaaacttttattcatggattgatagaccaaatacggccaatatacggtataataatagtaatagtataaatttatataaaaaaatataataatatttttagttaatgcttgtagtgattttatgcttttacttgcaaaattacgtttgttgaccaatgatagcacgataaagaaggacgcaataaaaataacaaaattggttaaaataataataaaaaattgaaataatttaatatatagcaaccttttatcaacttttcagattatgttaaagaatttgtctttacccttaatcaacacgttcaatcaaggaaaaaatgttataccaattttcttataatatttgaattattatctttgttatatttttaatgtttttccaaataattgatatttattcgtttaagttaattagcatttatcatgaagaccgcacagagttggagcgaaatacgcaacggtaattagcttaatatttgtttttgcttcttatttaaaaagtaataatataagcaaacttcttaagaactatttgatgattaattgacagaaatcggaattggaaaaaagtcatttccgttccctgaaaaatataaatttataatttaaaattacttgctaagaaaagttttatcgaaacacacaaaattttttaattttaaagtttagttgggaaataattaacaatataaaaaaatgcaattatgatctttattctcgcctcgagaacagtctcgggtttctggttctcgtcttgttgagtcatggtctcgagtgtgttttgaggccaagtctcggtcttggtaccgtctctcgagcagttttaaagcattatcaaatcattttttttacagaaaccaaggtgatgcagtactgactgaatatgatcagaaattcgtcaactctttgcgtctcaatgtgcaggaaggccgagactttgggtacattcttgtcgttttggccaaccaacacaaagatgttttgtcaggccttcagcaaaaatctgattaa

SEQ ID NO: 80792 - DNA, 290 bp, Heterodera glycines
  Genomic contig location: Contig_ID=SeqID_2628; Location=4205..4494; Strand=+
  SCN-specific regions: Sequence locations=1-36,72-290
atgattggaaatgacgcgttgctgccatcaagacggaaattgtcatattttccatttttcctgcgaattttgttaataaatgttatattaattatgataattacaaaaaataagccaaattgccggttactggcattcggaggatggggagatcacaacggcggaggatgtggggatcacaacggcggagcagaacataacgacggcggaggatgtggggatcacaacactaaaatcacccaactccataccgaagaaaaaaatattttttcgatgccataatcgaaata

SEQ ID NO: 80793 - DNA, 1787 bp, Heterodera glycines
  Genomic contig location: Contig_ID=SeqID_2628; Location=4583..6369; Strand=-
  SCN-specific regions: Sequence locations=1-438,484-636,658-884,906 -947,977-1020,1062-1164,1212-1372,1401-1614,1637-1644,1666-1787
atggcaatttttccaacaaatgcccttgcggttttcactctgctcttttttgcgtacaatatacaaattggtttcattcacggcgaaggatggggtgaacacataaagttcattttctcacaatttcatcacggcggtggagggcatcaccacggcagtgaagagcatcaacacgatggaggacagcaaaatggcccaacgaacggaggtggcaaaaataaaacagtggcggagaaatttaaaacttcaaaactcgtgccggacattttgccattgccaccaccgaaatttttatacgttgaatacccaaaggatgtgaaggttgaattgggaaatttattgttccaaaaccaaacgatgaagccgccaaaagtgatatggccagctcaaaaggaaataaattacacgcttctaatggtcgacgcggaatcgtgagtgataatatttatttaacacaattatttaatctttttttaaatttaagcacaatggtgcattttggcttgtggccaatgtgccgggaaacgatatgttgtggggagatcaggcgactggcggatattttgcggttggttgttactcaaaaatgatcaaaaagggcgttatttaaaaaacaaccaaatggagatttttgacaaaaaatttttttataatattgctcaagaataataaagattttaaacattaattttattcgatatccctaaattttttaaacttaagtagattttttgaaaattttttcaaaaaatcttttctctcaccagacaagacccccattcttatcagtgcttaaaaatttcgtgtttcgtgccaaaatacgaaacccgaacgcgaaactcagtaaaaaatgaaaatacgaaaaatacgaactctaaacacaaaaggatcaacatccctgatatcaaggattacgaatttggttgtagatgagcaaagctataagcaaaattttttattttgattatttttttaagtaacgcggtcattttggtggatatgagtaaaagtcatatacagatattttcagatatacccacccccaactggcttgttttaatgaagacgatgccctaatcattacccgatttttatagaaacacaccgctacactttcttggcttatgaacaaaaggcaggaaaatacttaaacgccaccgctggtaaaaaattatttcaaaatttaatgctaaaaataatttaattaaattgttttccattttagtcgttcgttttggattcaatgtcaccgactttgccgataaagaacaacttggacaaccttttgctggcaatttctttaccgcaacacaccaagacacggacctcggatattgatgagggacattgagtgaatttgtaaaagtagtagttttaaaaaatttaaagttgaactaacaaatagaaaatgttgatgaaaatagacttttcattttgacgtactatttctttgtctctgttcatagaaaaagaaaggtttcacttcagctttataggcttagcatctgtttatgagtcgcacatgtaaatctttttaactgggaggccaaaattgcaaagctgcgcagtagggataataatttaatgttcgacttgacttttcctccgatgtaatttaaataagtatttaaaagaaaggcaagcacaaatttgaaaaaggacaaattcacaaagaaaagatacgtttatcaattaggtcggaggatgtaaattggaaatacaaaaataattaatgatccactttatgcgcgaaggaaggagcgagttgacacaaaataagaaataaa

SEQ ID NO: 80794 - DNA, 2193 bp, Heterodera glycines
  Genomic contig location: Contig_ID=SeqID_16395; Location=20..2212; Strand=-
  SCN-specific regions: Sequence locations=1-369,391-422,447-526,559 -902,925-1617,1691-1869,1904-2193
atgctaattgcgtttgtgagaaatgaccggcaaatgcaaatcagtgaatattcaaagcaaaaatatgaggcacaccttggcattgtgtattttatgcggaagaattggcaatgtgacaaaattgcgaatgaatttgaagagcatgaacgggcagaatgccaaaaatatcgcaaatatttggacattttatacgaatatttgtttagagaatacgccggaattcccacagttaggccaaaatttgtatttaaatatggaattgaaattgaaggcccaataatttatgcgatgaattgtcttgtcagaatttcgcgattttattttattccatggcctaattttggggaatataaattaaatgaatttttcggtgttcaatttgagccaaaattgttgaatgaggagaaattgaattatggagtaaaatttgaaaatcaaccaaaaatgccaattaatgaaatcattttgcaattggcaattgacacagcaaatgaatgggaaataaatgaaagtttagatggaataatccaaccaaaaatgaacaaaaaatttgaagaaaatttggaggaaatgtttagcgcatggaaaatctatgaaataaatgatgacaaacataaaataattgtggattcgaaattcgatgataaatgggcatgggtgagagatggtgctgggcagggttgttccgggtcgagaaaaatatcgggtttcgggtcgggtcggccgaaaaatcatcgggtcgggtttcgggtcgagaaaaaggccgggtttcgggtatcgggtttcgggtaacccggaacaaccctggtgcatgggtgcggatggcactgcaatatttgcagcgaattgcgccatttataggacgatggaaataaaaccaaatggaatcaggtttttcagccatttgctttgcttaaattcaagaaattcatacaaaatatctttagaaaaaggataataatgaacaaaaacaaatacaaaattttcgattccatttgaacacaatcgtttcaaaaaaaaattctcaatttccttatctaattttcacccagacccccttcttaccagtgcttatttcgacccgaaacccgacccaaaatcatcgggttgggtttcgggtcgggaaaaaggccgggtttcgggtttcgggtaacccggaacaaccctggtgctgggtagagcgcggaaattagtgcagatcccgttgcgggattggaactcaaaatttttgcaggccgggatcccacggagtaatcccgcaaatcctgaaattcccaaaaatgcgggattacggactgggacccagcaagatcacgcgcgggattccgtccagcaccgggctctagtgctgggacgttcaccaaaaaaccagtagattttttaatttttttgttttactagagttacgggaattccaataagaagttccgaggtcccggtcccggaaattttaaaagcccaggtcccagacttttagaaatttttttagcagatcttccaaaaattaaatgcttttcaggaaaacaaataatttttgaaaaaaaattcacttccgatatttcttattctgacattttgttccgttttttactttttttttcattaaagattcaaacgatttttattttttatttgattttttttccttataaaataattaaattaaaatttattgaatttaaaataaattcatggagatttcccggttggtctaggttcccggacgaaaaccgaggtcccggttttggcaaaaatttccagtcccgtacaaccctattttagcgattaatttttacaaaaaaccaaatgtttgtgattcaatggtttattgactaacgtcataccattccacctggagatttaacacccaatgaaaattaataaataaattcaaaatttagagtgaagatgctttagtttcagaatttgtcaaaggactgacgacaaaatttgagaatttttttaagatggtaaaagaatacgcaaattttggtatatttgaaatcgaaaaattgcacgagcatatgacgcataaatatgaagcctttcttggccttgtgtatttgatgcgtgaaaattggcaatgtgccgaaattggagaggagttgaaagaatatgaacgggaagaatgccaaaaatatcgaaaatatttggacattttatatgaatatttattccgattgtatgctgaag

SEQ ID NO: 80795 - DNA, 653 bp, Heterodera glycines
  Genomic contig location: Contig_ID=SeqID_16396; Location=142..794; Strand=+
  SCN-specific regions: Sequence locations=1-97,188-352,385-401,427 -488,510-653
atgttcttgcccaccatattatgggcccacatacaaagtcaaataggcaagaaagttgatcgcacaagaaatggtaagtcgtgcccaattttactggaataatatataataatttaattaattaattttatttaatttttttaatatattaattaatgcaaaattgataaatattaaactaataaaagggttcccatcggctaaaattgttttaagggaccaattaggtgacttcatggaggacataaaggaaaagttttgcgaatttatgtgatgatagacgtcgtggggaaatttttgaaattttaattgggttaaatgaacagatttaactcaaaaatggaaaatttacaagatttttaaggatattttttgaagatttttatagttagttagttcgccaaaggaaattttgaaaaaatttaatgagattttaacagactttgaccaaaactttttttgcaaatcgggaaataaattaaattttagggaaaaagaaaactctttttccattggattttttatatccgtgtgtaaaataccacagctttccaagaacatcaggaaaaagggatatctgcaattttcatggcgtaatgcccaaatccaaggatgttctttgaatccaaggacggatgggatcctgaaaaata

SEQ ID NO: 80796 - DNA, 763 bp, Heterodera glycines
  misc_feature (66)..(66): n is a, c, g, or t
  misc_feature (90)..(91): n is a, c, g, or t
  Genomic contig location: Contig_ID=SeqID_16398; Location=1919..2681; Strand=-
  SCN-specific regions: Sequence locations=1-215,237-328,361-449,471 -530,555-763
atgatcgatcagtcagagggaatgatcaaaagtgagctaaatgatcgggattagcgaaactagatntattaaagtgatcagaaatgagannagtgagggtaattgtcaggttaaaataatctgaattattatgatcagattaatgatcacgagttgggtaaatactcggaattactgagatcagaactatataagtgatcagaaattgggtatgtattggcaattttcagtgatcagagcaatttcagtgaccggaatgatctaagcttaatgatggagataactgttgatcagaggaaggaagtggtgatcagtaaaaccctttttcataaatattatattttttaaatattttaaaatgcgaaaaaattcgcgcacattttcactaatcgcattaacagcatcagccggtgatggcggcatcacttgtgccatgagtgtgatgttcagtgttgtgctcccatcattgtcccaatgctttacaggaagttcagaagcgtcacgcgtcagagccaacttaaaacaaattgaatttttaaaaaattaatattttacagtatactttgaatgcctggcccggtcggagaagtacggtagaggcggaagacgaaccgccgataggggacggtggggatacggtagaattggacgcggcaatgggaacaacgcgaaagaatgggcgcaggaagaacggctcagccagcgtcaccgatacagtacttccctgtcaattgggtttacggtaccaccgtattgcatttaa

SEQ ID NO: 80797 - DNA, 289 bp, Heterodera glycines
  Genomic contig location: Contig_ID=SeqID_16398; Location=68..356; Strand=+
  SCN-specific regions: Sequence locations=1-289
atgctgatcacggagaagaaggtggagctggtgttgaagcagctgaaccgggagaagtggaacaaactgtgctacgacgggggcgaggacggcgccatttgcgacggcggagacgacgacggcgcatttctgttggacccggcggacgaagcggcggaggacgacgaataggcgaagcggaacggacgggcgaagcgaagggcgaaagtgccatcattcgatgagaaatgccatattgttatcactagggcggcgaaaaaagaaattcgcgaaatacggacatagaaaa

SEQ ID NO: 80798 - DNA, 827 bp, Heterodera glycines
  Genomic contig location: Contig_ID=SeqID_16400; Location=565..1391; Strand=+
  SCN-specific regions: Sequence locations=1-356,378-413,435-514,536-827
  Gene Ontology: Mol. function=pre-mRNA splicing factor activity; Cellular component=spliceosome complex; Biological process=cell cycle
atacgaatgttctgaagagattatcactatttccgcgatgctttccgtaaatgcggcggtgttttaccgcccgaaagcgatggtaatccatgcggacacagcgcggaaaggattttggtcgtccagcggcgaccatctgactcttctgaatgtgtacaacaaatggagagaaaccaacttttcgatgcagtggtaaatccagtgtctaaaataactcaaaatatagaagtaattagttgaatttaatttttatttaggtgtatcgaaaattttgtccaacatcgtacaatgaaacgggcaagggatattcgggatcagttggaaggactgctcgaacgagtggagattgagccggttttcttttattttaagctggatttaatttaatattgcatctttccgactttctttccatttaattaattctttaagaaatcttcttccgacacaatggccattttaaagacaatcactgctggatatttccacaacttggccactttggacaagggcggtcaatacaaaactgtcaaacaccgccacactgtccaagtccacccaaattcttgtttgtttgaagaccgacttcgttgggtgatttactacgaattggtattcacttccaaagagttcatgcgagaagtaagtcataaacaaactctcattttttaactaaacaaatgtacctacagataattgaatgtgacccgaaatggatttcggaagtggcaccgcattactaccaacaaacccaattggaagattctgtcaacaaaaaaatgccgaaacaaatgggaaaagcaaaaagtgaactcgtcgggagttga

SEQ ID NO: 80799 - DNA, 666 bp, Heterodera glycines
  Genomic contig location: Contig_ID=SeqID_16400; Location=1591..2256; Strand=+
  SCN-specific regions: Sequence locations=1-666
  Gene Ontology: Mol. function=DNA-directed RNA polymerase activity; Cellular component=DNA-directed RNA polymerase I complex; Biological process=transcription
gtcgacctttctgttcgcccaaatagggcttttatgcaatttggtggaattcaatttaagtgtttcaacccttcggaagtgccaaaaattagtgttttggaggtcactcagacgaacacttttgacgaagtacttgcaaatgttcagtctcgttccctgttcattttcctcgttcttaggccggtttccccgttagaggtgggttgtacgacccgcttctcggcacctccgaaaataaccattgtgagacgtgcgggatgcaggggacgcactgtcccggccatttcgggcacattcggctcactgtgccggtgttcaaccctcttttctactcattcactctcaatgtgtgttttggactcatttggttttttgtatgttctttccattaagatgatgaaagggacttgcatccattgccaccgtttcacctgcaactccaattcggttgcagccaaagtcgtcattgccaaactccgggcctttcgttttggggtgccggaagtcttggacagggtcgagagtgggttgaaggcgaaattcgagaaaagagacgaactgctcactgaacgcattgatttgatcggagagagtgtctttttacgggaaattaatgcgttcatcgcagagctgaaaggcgtgtccaacgctgaccaactgcagaaa

SEQ ID NO: 80800 - DNA, 1738 bp, Heterodera glycines
  Genomic contig location: Contig_ID=SeqID_16401; Location=872..2609; Strand=+
  SCN-specific regions: Sequence locations=1-91,113-347,369-450,472 -1219,1241-1738
atgctaaacgcagcgaatgtgccgacagtgacaatgacagtgaacatcagcaaaggagtgcttgtaagcagaggaggaggagggcattttgccaatttttccaacattttgtgccaatgttcagaatttggaccgcctttacaccagcgaagcgtccctttgggtcaattggggcggcgttcggccgctgaccacgccgttgtgcggctacaacggcacgcaatgtggccaaaatgcgactgtgtacattctgatcggaagtgccgtcattttgatgctgctgattgtggccatgctcggcatcggatacgcactgaggtaggggggaaaaaccatgccaagcgtagtcattcagtttttgcttttcaacaaacagcctttgtgccgttttcagggagaaaatgcgcgagaaagagcggctgatgcgcgagtgtctgattccgtttggggagctgcgcaatttgaaggagctgcaaagcacggaagaactgaagaaggagacggagaaaagcatgcggagcatgcaaagcagtcattcgggtgagaaaaacggtcataccgtaaccaaatgtacggtaacgaaagtacggtaatcaactggactactgttgaggaagcacaaaacttacggtgggcagccacaaagtgttggagacggccaatttcgcactgtttgtgtacaaccgggagattgtgctcgccatcaaataccatgccagagtgcgcattttgggcgacgatttaaacttccttcgtaaggtgaaagacgaaaagtaaccggggaattgcctacggtacttttgaccggggaattggttacagtactttttctgggatacggtccaagcggaacttgaacaaagttctaagtgtaataaacgacgttatatttaaatacttgtctaattatcttattaagcatttgcttttggtcattcccaaaatcgcaatacagtaatctctcatcgtttctttacggtaacagctccgccagtttgaccacgacaatttgaacaaattttacggcgtttgcacagatgggcctcttttgtacggaatatggaaacactgccaacgcgggacattaaaagttggcaattaactaattggcggtaattacgctaattgatgaacaaattaggagctgatcgccaaggagcaatatgtgggcgacaatttcgtaatgttcgctttgatgcgcgacattgcaagtgtaaattttgaacattttacaaaataacaattgatcaatggataagtctgtttgatcatttcacgccttcttcactttaaatgtcccaatttctcagtctgatcattcaaatcccccagtctcttagatcaccactgataactcatgactcatcatctcatccatttcccttctccattaacttttcagggtctgatcgccattcaccaatcattcatcggtgcccacggccttttgtcctccgaaaattgtctgatcaacgaccgatggcaagtgaaaatcagcgactatggactgaacatgatcagagagagtcagccgatgccgaagaaaagttggcattttggcaccattttaattaacgccaattcaaaggccttttgtggacggcgcccgaacttttgcgagaaaacaatcggacgggcacaaaagagggcgatgtgttcagttttgcaattatttgtgtggagatggtgaacagagagacggtttggaatgggacggagagggacgacgacgtggacg

SEQ ID NO: 80801 - DNA, 1196 bp, Heterodera glycines
  Genomic contig location: Contig_ID=SeqID_16403; Location=1047..2242; Strand=+
  SCN-specific regions: Sequence locations=1-12,39-434,457-623,648 -707,742-778,801-936,978-1168,1194-1196
atgcttttttgcatggttttgctgtttttgggccccttttacattgctaaactgcagcagcaacgaaacatccggcgtttcgtcgccgagttggagcagcgcctggtggagagtgaggcggagattgcggcgctctgctccgagaagcgtgagttggccaaacgcgttggacacatggccaacaaattggacacggaacgcgtccaaaatgcgtcggcgatggaaagcgtgcggagggaccggcaattgttggtggaggaaaacgagcgggaacgcgcactgcacgcggtgatgcgcgacaaatttgacgagttgaagcgcaaatttgacacgtgagggagcggggagggcaagggaaagggcaccacggcctgttttttgaaaactagcagaaattttcaaaaaatgtagaaattttttaaaaaaaagtcaggaaaaaattaaaaattttttttagtgatttgcaaatttttttttgaaaaaacgtacttattcattaaaaattctgcgggaaatgcactgcattagcctttaaaaaatttcaaaaaattttatttctaaaaagttatggaaaaaactgtttctaaaactaacaataaacgaactttttggtttaagatttctatttgaatgagtatatacagaaaaggacggatagtatttttaatccgacgaatatttgttattttttgtttaaaaaaataccgaataaaaattttaatttaaaaataataattataaggctcttatccatccaaaaataccaaaacgtatactcaaaattttcagcattgccaaaacggtgttggacaaacagtccgagttggagcaaatgaccaaaatgaacacggagttgagccaacagcttcatgaacaagcggaagcattggaaaggcaccgtaccgagttggaaacggcaacaaaaatggtgatgtcaattaaaaaaaaataaaattaaacaaatttgtttaaaaattgtcacaggtcgccgaacgggacaccgaacttaaaggaagcgaatgcgagttggccaagtgcagggaggagaacaccaagttggacgagctcaggcaacaaatggtccatttgctggaagaatttggtgccaatttgggcaaataaatcatttttatgtgtggcggagaacagatgcaattacaatacaatgtataaaattattttttatttttatacaa

SEQ ID NO: 80802 - DNA, 385 bp, Heterodera glycines
  Genomic contig location: Contig_ID=SeqID_16403; Location=461..845; Strand=+
  SCN-specific regions: Sequence locations=1-385
cggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaagttcgaattactgggtttttgagttcattctggccataacttttttgaaacttaacgaaaatttttgagattttgcaaattaataataaacacatagagctatcgaacaacaccaacaattcttaatttgattgacattgaacaaagttatggttcaaaaagtcttccgacgacgtttcggccgacgacgttttggggtgcaccg

SEQ ID NO: 80803 - DNA, 1203 bp, Heterodera glycines
  Genomic contig location: Contig_ID=SeqID_16404; Location=1146..2348; Strand=+
  SCN-specific regions: Sequence locations=1-1,72-616,638-674,714 -749,771-914,943-1068,1100-1203
atggtggcggtggtggccatggtggcggtggtggccgtgctggtggtggtggccgtgctggtggaggtggttaccgttcaggtcgtacgtacggtacttatggcgcaggcgcacatggttctagcaaaaactgcaaatcaaactcgaattgcaccgaaaaagatgtaaatcttttttaaattttatctttgattgattattttaaaatgttattttatgctggtttctgatgattcgggactttttacttgggttgaaactttccaaaaatctgtacaaaaatgcaaaaaattgaaaatgtaccctaataatgctactcatggagtggactttattattcaacattaatattttcaaaacccaacaataatgagaattaattgaaaactctatttaagcctgactgttgttcctgattgattggctgctcgagtttgattgttttttcgatgaatttggaagaatgggccagacgtggataaagaaagagattgctataaatttttggggtctatttaatcggtcgttttcctaaagtaacttcatcaacgtaaccttcctcacctttcctttttttaaaatttatttgtctgagtaaagcattactatgcaacttggtttttaattacaaattcaaagtactttaaattattttctggcttcattgtaaagcaaattttttgaaaaatttgaaaatttaaggggtgaaaattcttgataaattaaatgattaatgtggattattaaattgagggcaaattaagaaattgattaatattttgtaaaagcacgaattgcttttaaattaagtttttgttttatctcgttttgataaaacaaaattatgtcaacagaattaacgaatttgcaatcatagttattatgatagacttttagaacatttaagcaacaatagagattaaatatttttcatttttcattagctttcattttgattagagaaaatttgaaatttacaacaaatatttttactcgacttcaagcgttatttttgtgattctatttttaattttgtctctaattaatacgatttgaacaattgttctgcattttgaacattttaaattttaagatgggcccacattaaaacggacaatgagtgcgcttgaagttgcggctttgacacttggagcagtaccaagtgttgaagctggacgaccacttggaacaataatggtataa

SEQ ID NO: 80804 - DNA, 263 bp, Heterodera glycines
  Genomic contig location: Contig_ID=SeqID_16405; Location=56..318; Strand=+
  SCN-specific regions: Sequence locations=1-131,154-209,231-263
atgactattttggaaaaaatgctaatggacacgaggtaaatttagccggaaagggaaccgtttagtatcatttccatactctgctaattgtgaaccgatttttaaaaagcgccaaaatagctgcctttttcggaaattttagaaatatttaaataaatccatctatttttagcattgtcgtcgcgatgtttgtacttgccattgttgtgttgtcacttgtgcttggtgtcatgaaaattgttgcccaccagaaaactaattag

SEQ ID NO: 80805 - DNA, 1583 bp, Heterodera glycines
  Genomic contig location: Contig_ID=SeqID_16406; Location=1..1583; Strand=-
  SCN-specific regions: Sequence locations=1-806,837-1469,1495 -1548,1570-1583
  Gene Ontology: Cellular component=integral to membrane
ccccactttttgttgtcccgcattcaatcgctggtcactccacggaattttcaatgcgaagtccgagggatgatggacacggagcatttgttggaacgatgcacagtgctccttaacgtaactgagacacttttggaagacattgtgatgaagtgagtgagtgggttgttcaattgtttgaattgcattcccttaagaatggttgaggaaaagccgctttatcacgggacagcaacggacaatccatcagcagttgaagtggacaaaacccctctcgagtacgtctcctttcggcaaattgctaccaaactgttcgtcccatgtgcggtcagcagcgtaggtgaaggtgtgccatgccgtttgcctgtcgctgatgcgatgcgtccctttgcatagcattcgccctccgtgaacacctccaaggcgttttggcggatgagcatcgtgggctggtggaggaccagcgttggctcgtccttcagtagaccatcccatcgccctccccattttccttggcttttaagctgttcaatcgagcatatttcccgtgcccgtgtctctttcgcgcggctcgccattcccacaaactttggcgtcggattgactaatgttcgcttcgttgtcctcgtggtcgcccccctccaaataaaagagactaaatctgccgcagaaatcgctcggactttcgcttctctgttggccgatccgctgctttaccatgaattggccaccacggccacagaacgccaatttgtggccaaaattcgcttaagggcttacgaacttacaaatgttgtagaaaatgttgaaaatgagaagcaaagggaaaaggtactcgattaactaatatgtaaaagaaaacttttcgaaagacagcacaaaattggtaccccgggaggggactaatcggcgatttccgtcgtcgccttcctttttataaatcggactttctcgatggcattgcggacactcgtgcctttcaaaagactattagctctgctgcttttctctattttattgttcttccgatggcaattgctttgggaatgctaaatgaggagcatactcatggcaaaatcagtgagtgatctctctctctctgatcattgtcaatttcgttcccaccaattaagcggtttcaaaggcaattttgggccaatggattggcggtttggtgtttgggctgttcggagggcagcttttcctcgtgctgctgacgagtccgcccatttccctctatatcacaggtgaatagcgaatgagtcgacttccctcaccgatttgaaagttgtcgaacgcatttcgcattcgttgggctgcgactttttccaactttacgccggcattggcacttggtgctgcttttatttggttctttttgcttttttcgaagtgtccaatgtgatgaaacacgccaaaaggttttacccgtcgcagagaagcgaacacaacgcattgttaaggtcgttggaagagatgttcagcatgttcatcgcctgcactttggccatcgaatcggcgaagaatgctttcgcgtcgctcggaagggcttttctgccgcactgcccgccaaatggacactc

SEQ ID NO: 80806 - DNA, 575 bp, Heterodera glycines
  Genomic contig location: Contig_ID=SeqID_16407; Location=300..874; Strand=-
  SCN-specific regions: Sequence locations=1-198,220-237,259-281,303-575
atgttctcatgtttgaagtattgcctctgctgcatcattgtgttccttcttctcgctctcctcgctgtgtctctcttacttttgtttggcagtgattgtcccaccaattcgcatcaactcacgactcaatttgaacaaccaaaagacgctttgctttatcaggcgagagggcattattaatttcacaatttcactctctttgttttcaaatttaatcatatcaaattaagtgactttaatttactttcaaaccaaaatttaaggaggaaacgcacattcgtaaagagaataatcagccaaagaatggcagcaaataccaccacgaacaattcacaaaagaagcatcccggggaaagaccgttcagccacaattcaagaaagacgaagtgttcaacaatgcaactgaacaacaacagaatgaggaggacgagcagtacagcaacacaactgtacaacaacggaacttgaacttggagtataataattctttgggggacggacaaattgataatttttcaatcattcattcctatgatatgtatgagttcgatttggtaatcgttgacgccgattga

SEQ ID NO: 80807 - DNA, 1287 bp, Heterodera glycines
  Genomic contig location: Contig_ID=SeqID_2629; Location=1..1287; Strand=-
  SCN-specific regions: Sequence locations=1-603,634-838,860-1145,1180 -1238,1260-1287
  Gene Ontology: Mol. function=calcium-transporting ATPase activity; Cellular component=membrane; Biological process=calcium ion transport
tgcgtttctcgacttcgtactgatcccacaaatggtctttcgtccgccgaggcgtcccgtcggctgggcttcagcgggttcaacgagttcgagctgaacgagaaggtgtccctgttcggcaagtaccttgagcaggtgccacttttggcattccgttgtttttcctcgcccttttccaatttatctgtcgtcgttttacagttcaaaaatccgctcatttgtctgctgctcgcctctgccattgtttctgttctggtgaaacaattcgatgatgctttgtccattgctgtcgccgttctcattgttcccattttcttttccaatttgctccaattttcctttttcggtggtcaccgttggctttgttcaagaatatcggtcagaaaagactttggaaaagctcaaccgattggtgccaccgacggcgcattggtccgattctaaaaataaattttagcaattttcttttttaagcattcgcgatggtcgaagcgtcactttttatgcccgagaacttgtgcctggggacttggtacttttgaacgcgggagatcgagtcccggccgatgttcgtgtcatcgaggcactttttagactattttctaaatttaaaaaaaaaaaaaatttttttaagtccgtccaattacaattggacgagtcgtcgtttacgggtgaaaatgaggcgagacaaaaggtggccgcagctttgcccgaaaatgcggccaaattttcgacaaataatgggacagtaaatggaaacggaggcggcagcattgaacacatggacaacatcgcatttatgggcactttggtctgtgccggctggggaaaagtcagtcggtttggttggaagagagaatctaaatggcattttgacagggaattgtgattgggactgggccaaattcaaaatttggcgaagtatttatgatgatgcaatcggaagagtcgcccaagacgccgctgcagaacagttgaggagcaattgtgaacaatttgcactgtgattttcccgtttaggcatggaccaattgggaaaacagttgtcactgtactcattcggcgtcatcggactgattttccttctcggactgattcagggcaggtgaaaattggaatgacccaattccaaacaaattaaatggtatctatttatttaattaatttgatttttctttcgcagggacatgctcgaaatgttcacaatcggggtcaggttgtcatgctcttcccttttccctttaatgctcccttttaagtctcgcggttgctgccattcccgagggt

SEQ ID NO: 80808 - DNA, 1744 bp, Heterodera glycines
  Genomic contig location: Contig_ID=SeqID_2630; Location=69..1812; Strand=-
  SCN-specific regions: Sequence locations=1-63,86-409,431-464,486 -787,809-1470,1508-1670,1692-1744
atgtatttccattttaaaccaattattccacaaaaatcccttgaaattaaatttgtcggtttgtcccattaaatcctttgtgtgtttcgttcttgtgccttagcatttaattgcctcatggcttaatgggatgtaaatgctcgcctcgaaattagcgacaacgaaattgtcgtcccgaataaattattcgttctttgggtggcctgttttgacgttattttcactgttcaacggactttcccctccattataagaacacaagtactgctaaagtttcgcacacaaacggctcttatcagctcattttgatcatcatcagcagataattttgattttgcacctccccccaagaggaattattattcgtttatatttgtgtagtttctgcaaaacaaaacattattattcatttccttttgaatgcttttaataatattttcagtcggtttctgtttattttttgaagaaatggcaaatacatttaaaatttatgaatttcagtcctttttcggtaggtaattgatgaaaaatgcaagcgcaaagaaacgacgaataagaagcgaacagcaaaattcattgggctttcataaaaccgtgcattttttacatttaatttcctctctttccatttgaatgataaaaaacgacattgaataaattcctgggatgtggagagaaaaaatgtgacaacggctggagagagaaaagattaattggtagcaaacgaatgaatgacaatcatttctgcttttacatattaattcattcctttaaattccaaatgagaaaaataacaaaaatatataatgaaaatggatattaaaagtggcataaattacagacaaaacgaaaagccgaaaagaaaagaacagaaaatggacgaaggaacaacggaaaataataataacagaaagagcggtgcaaagaaaaggaagcagaaacagaagcaacaaagcgttgttgctgaagtgactgaaccgcacaacaaacaatcggagacagaagaggcggaaaaggaaaaggtgaggagggaaggcggggttagccattctcggagggagcgaccgaacgaaccataaattaaaattgcgtctgattggcattatgtttgattttgatgtggtggcggtgcgttggcggccttcggcctttagcggtggctaaattttatcattcctttgattattgtattggtatgtatgtcgcaaaattaaacatttgtgcacattaattaagtaatacgggaatgtagtttaagcataattcttggcaccaaattctagaagatatatacatagataatataaaattccatttaaagatttaaacattaagtcgaaaaacggcgacagcgagaaagacggaaaaaaagtgaacgaagcgtcaaaaccgattccttgccaatcaatttcggtaattggagatacagtcaaatcgacaatattattcatcacctttatcctttattccaaaattttgttttatttttctttaattattaaattttgtttagcatcaaaaagatagtactgtcaacaacaccaaaatcaacaatcgttgctgtgcattttttgggttcaccggtgggactgggtttttgcgttcgctttttcggactggtcttggtgagggtgcacatttgttggttgggcagaactcgaaggcgcgcggtgcagcgggaagcaacggcacgacgatgatccccgcgatggacatccaagaggcatccctcgcgcggtgctga

SEQ ID NO: 80809 - DNA, 684 bp, Heterodera glycines
  Genomic contig location: Contig_ID=SeqID_2631; Location=3352..4035; Strand=+
  SCN-specific regions: Sequence locations=1-22,45-65,102-451,474-684
atggggatattgtacggatcacataagaaaagggaaagtttcagcccccagcctcatgggcatttgcccatcaccagacccccagccccatcagcccccaacccaatggcatttcccatcacgagtcccccagccccatgggatctgcccatcaccagaccaccagcaccatcatcccccaacccaatggcatttcccatcaccagtcccccaaccccatgggatttgcccatcaccagtcccccagccccatgggatctgcccatcaccagaccaccagcaccatcatcccccaacccaatgggcacttgcccatcaccagacccatagccccatcagcccccagccccatgggcacatgcccatcaccagacccctagccccatcagctcccagcccaatgggcacatgcccatcaccagacccctagcccccagcccaatgtgcacatgcccatcaccagacccccagccccatgggatctgcccatcaccagaccaccagcaccatcatcccccaacccaatgggcacttgcccatcaccagacccatagccccatcagcccccagccccatgggcacttacccatcaccaggcccctagccccatcagcccccagcaattggcacttacccatcaccagacacctagcaccatcggctcccaacctcatgggcatttta

SEQ ID NO: 80810 - DNA, 46 bp, Heterodera glycines
  Genomic contig location: Contig_ID=SeqID_2632; Location=227..272; Strand=-
  SCN-specific regions: Sequence locations=1-46
atgcccatgaggttgggagccgatggtgctaggggtctggtgatgg

SEQ ID NO: 80811 - DNA, 459 bp, Heterodera glycines
  Genomic contig location: Contig_ID=SeqID_2632; Location=896..1354; Strand=-
  SCN-specific regions: Sequence locations=1-459
atgtcgttccaaaatacgccaaaagaagttcggcgtgcgagaaacacccgccactttttcaaggcaacccctgacaagggaaagtgtctcgaaaagattgagagccatgtcaacgagcgagccaagtttggtataagggagcacgtaactagtttttatttcaaatgcccaccaaatgaagatgcggaaaataattttagaataattatcgataaactaatacacgaggcaaaggaaaaagaacctgcacaaggatggaagacggaaagaatttcgctgaatttatattgtgctgctttgtctgatcctgttatgataccagtgagaccactacaccaagtaacttcggatgttgtgctaaacgaatttatgcatcgtcagcaatcatttggcgacgtaaaccttatggacgaaagaatttctgtgatcgtgaccacttttgcatatcctctcaagtga

SEQ ID NO: 80812 - DNA, 345 bp, Heterodera glycines
  Genomic contig location: Contig_ID=SeqID_2632; Location=1476..1820; Strand=-
  SCN-specific regions: Sequence locations=1-345
atgactcgagaatattccgatagcgagattttggaatatgtgtcagctggtccgaagcagtacgccctgaagctcagaaggaagaaagatggggagatttgggaaaagaccaaaattcggggattcacgttgaataggtccaacaagatgcggtatgaagaattcaaggagatggtgttgggctatcaggaaggagtgaaaaaagtgtttcgttatccggaaaagattgggccgacaagggatagcaggatactctcaagggatgtaaagaaagaatatgggcccgtgcagaggaaagggattgttgatgaaaactttaatgtgttgccttttggatattattga

SEQ ID NO: 80813 - DNA, 3214 bp, Heterodera glycines
  misc_feature (3206)..(3206): n is a, c, g, or t
  Genomic contig location: Contig_ID=SeqID_16409; Location=534..3747; Strand=+
  SCN-specific regions: Sequence locations=1-490,512-585,636-740,762 -981,1003-1381,1404-1892,1916-1944,1966-2213,2237-3089,3112-3214
  Gene Ontology: Mol. function=structural molecule activity; Cellular component=microtubule cytoskeleton; Biological process=cell organization and biogenesis
aattccggccaaaaatgggtgccccgtgcgctgctcgtcgacttggagccgcgcgtgctcagcgacatttgcaaccacgaggccaactcgtactcggaactgttcgacatggacaacttttaccagggaccgaccggctgaggggcgggcaacaattgggcacgcggttactacccgggcggacacattgtggacgacatcatggagctgatggaggcggaaagcgaacgggcggatcatttggagggctttgccatgtgccactccattcttggcggtgggtgaacagagttttgtgtccatgggaatgtttgacaaaaatgtttttaagcggagcaattattgttagttacatccccatatcgtttgcctcatgaaaatagtttaaaaaaacaaacaaattttctaagtttattgcaattggatttttttcctgcattagtgaaaaagaaaaaacctttatttgaaacttcaaaataggtattttgttgtgaaagaattgaaaaattaaaaagaaattttttttttgctaaagaaacctctaacaaataagaatttgacgaatttgactactaaaaaaacttcaattaatttttatattaatttttattagatttaaatttttaataatttttccaactcgtcgtccttcagtacgtcgtatgggcctcgccctggcgcacgccttgttcacatatgccctcttccccttcgtacccgctttgcccctcccccccgccctcaatttagccaagtttttcgttttcagcaattccgccgttttctccgccacccatcgctgcgaattgtccacttccgcggccaaccattccgcgcccgactcttttttggctgctcccaaattcaaatacgcagaaaagatttgtttggacgcctctctctcccgcggggacgacaaacggcgcgttttttccgctgcgattggtcatattttggtcgggtgagagaacaaaagttggtctaacagcagcagaggaacacccttaagacatgtgcaagaagtgttcaatgccgggtcattgtccgaatgtatcaaagcgtgtctaatggccgagtcgagctacgggttcagatgcaaatcactgatgttctacccgacggatgctgatcaggcaaacaaaagcatctcgaaagccgagaggggtcaaaaattggttgttaaccccggcgggcgattagattattttgtgcgcctcattttatttttagcatttaaaaaaacaaatttctgtcggatttgtcggaacacccacccaattttatatgcttttatttcagaattgtctgatgaattctgagagcagattcacccaatccgatgtttttgtacaggaagtgggcacaatctgatcaaaaatgatcattccgttgtcctttggcaggaccaaaatgtgcacatgctttacgtggacatggaacagccgcggcttcccccctcgccgcagcctttgcccgacgacgaaaggcgccgtttcaaggcaaaacatagcaaagaaaaagcgcccaaatttgacgccccttttccaaattaataaaatccgtgccaattaattgatctttgacactttcaggacattcccatcggcgcgagtgtatcagaaaaggacggagatttgcaaaaatggaccctttggtcgaagtgtcctctcagctcatccgttccaatgcttgccgaaatgcggcatcgctatttgaagtgccgcgaggcgaaggacgtgagaaagtgcccaaaagagtcaatgccatgccgaaaaagtgagtggacaaattggatggacagaaaaggagcacaaaagggaggaagagaaagaaggagcaccaaaataatctgacaaaattggcattttcaagttaaaatgtaacgaatgaattaatttatattgaaaataaatccgaggaatgccaaaattggcgaattgaaaatttaaagagcatttgcagtgccaaaaccgctgagaatacaaccgatttggacgttgacagcaaatgcgacggcggcctaacactccgacgaccgacggatgccggtcgattgccttgcggtcagagacgccctcgggcgaaaaaagccaaacgaacgaacaaatgctgacacatatatttattctctcttcgtttttgtttttattttttttagaaatttgcaaaaaaaaaaaatacacaaagaaaaaggaaagggtagcggcgagatcaaagggaaaagggaggggcaaagagagacaatggcaaagccaaagagcacaacaaaagtcggccgaccgatattctccgccgttttctttccgttttatgcttttccccccgtcctccaccaccgttgccgttgtccatcctccgttttgtgtccagtgatttgtcgtcgattgcgtcgtcccattgccggagactgaagaaattgaatcgcatcagctgattgtgaacgtccccagccgatgagcagtcattcgaagaaacggaactcttcccgcacataaacgttttgcgttgtcttcgccgagctaattaagagattgtcattaattagcaaagaaaaaaaaccgattagccaaccgatgtcgctgaagggcatggaacgtaggtgccctttgaactttttgaactgctccgctcaatgatcggagaagggcaggcgaccaaacaggcggaaacggcctgaaggaaaaccaatgaaaaattcgaattgtagtgcttgattagagctgaccactttcgccaccattatgtgctgcttttcgcgcaacaatttgacacgcaaacgattggcgaaaaactcagtttttccaaaatacgccaaggaatttgtggccgaattgagtacaacgccaaagtcggatagacggacgaggatggagaggataatgccgaacgattcgatgccgtagaaagactcgtaaatgtcgaagaaaatgggaagcgacctgaggagagggggatggatgatcagaaaatccagcccaatgcacctaaaaatcaggaatttgatcgcgataaatatggccaccgtccgtgacactttctctctgagttcttccaatgcgaccaccgaacggcgccgactttgtgactcgaaaagccttaaggtcaaccaatttcgaacagagtctgaccaatcactttcactcacatgcgacgagctttcagcgatctgtgcactttgtattccgtgacaattgtcatcaaagtgnatcgtcag

SEQ ID NO: 80814 - DNA, 631 bp, Heterodera glycines
  misc_feature (9)..(9): n is a, c, g, or t
  Genomic contig location: Contig_ID=SeqID_16409; Location=3117..3747; Strand=-
  SCN-specific regions: Sequence locations=1-103,126-631
ctgacgatncactttgatgacaattgtcacggaatacaaagtgcacagatcgctgaaagctcgtcgcatgtgagtgaaagtgattggtcagactctgttcgaaattggttgaccttaaggcttttcgagtcacaaagtcggcgccgttcggtggtcgcattggaagaactcagagagaaagtgtcacggacggtggccatatttatcgcgatcaaattcctgatttttaggtgcattgggctggattttctgatcatccatccccctctcctcaggtcgcttcccattttcttcgacatttacgagtctttctacggcatcgaatcgttcggcattatcctctccatcctcgtccgtctatccgactttggcgttgtactcaattcggccacaaattccttggcgtattttggaaaaactgagtttttcgccaatcgtttgcgtgtcaaattgttgcgcgaaaagcagcacataatggtggcgaaagtggtcagctctaatcaagcactacaattcgaatttttcattggttttccttcaggccgtttccgcctgtttggtcgcctgcccttctccgatcattgagcggagcagttcaaaaagttcaaagggcacctacgttccatgccct

SEQ ID NO: 80815 - DNA, 980 bp, Heterodera glycines
  Genomic contig location: Contig_ID=SeqID_16411; Location=93..1072; Strand=-
  SCN-specific regions: Sequence locations=1-226,252-368,442-676,698-980
atggccgaacattcggaagacaaattggacgaaactgaacgcatttttgaaattgcaagagtaatgtggaaagcgatcaaaaagcatgacaaagtgcgaaaaagggatgtaataagtcaaaaaaaaatcgaaaaacatttacagaatgccgtgggcattgtgccgcggttgcgcttcatcggtttagtgctttggcatttggcggttcggcaaagtccgctaattgaccagcagcagcagcacaacggggcaccactgctggtgttcactgccaaaatgaggccgaacattgacccgcatgacccgacggaatggcaaacgatgctttggcattttgaccaaaatttggcgaacgcagcgatggatgcggaggatggccaaagagaggcgaatgaggggggaattgaggacggaaaaggggagggggaggaggaggaggagcaaaatgatggggaagaaatcaaactgctgagagaattgggggagaaagtgggccaaggccgggcacaatttggggaccgggaaaggcacgccgaactcggcaagaagttcagtctgttgaagaagtcgactagcaacgacggagcagcccatgggatggtcaacttttgtgttatctatcgaccatttctcgtgttcggctcgcaatcagtggacattcttttgttcatcagggtaattaattaattaattgagcaattagtttttgattgttggcactttttcactctccagggccttttggaaggtcatttcaatgcaaaaacaatggacgaatatttggagaatggcaagcaaattgagaccaattcgtacttgttgaccactcatttgtcacttcgaatgatgaccattcaattgctgacagtgggaaaacattttggatataaattttaatgtgaagtataagaaactgacgaaactcataattttgactgttaaatttaatatgagttatctccggattttttgctaataaa

SEQ ID NO: 80816 - DNA, 1930 bp, Heterodera glycines
  Genomic contig location: Contig_ID=SeqID_16412; Location=783..2712; Strand=+
  SCN-specific regions: Sequence locations=1-157,179-364,392-397,425 -431,454-648,670-1179,1208-1352,1374-1500,1522-1544,1566-1930
atgaattcatcctttttattcgttataatgctcgtgctgcgtatttgcggcgaacaaaatgtcgcaaatcgacgctatataacggcggtacatgagggtgctcatgtactcgcactctggaggtcgcgctatggagacaaagtcgaaagcgtgagtattaataaaactttaatttatggatatatttaaaattagagatttttttttttggctctaaaaccgtcaaaataggtagaccttggtcttaaagacacaaagataggctctaattaatacaaaacaggcactaaaaccctgatttttaggagtataaaatgattaaaatttattcaaaaaggtaacaaaattaagccaaatcagtattgagacaaataatttttaaaaacgcaaattcttatcaagaaaataaataaataaattttgtgcatgaatttttgagaaaatttcatttttaatggtgtgtttttgaaaattttagggtctattcttatgggtatattttccagaaatttgtggggtcgattcttaggggtatatttttcttaataattttgggcaaaatgccaaaatagtcaaaattgattttatggctttttatgatctaaaaataaaattggcactataattcgcaaagtaacttatcaacccaccataaaaacttgtttttcatgccatttggagctcaggaaaaaataggctaatacctaaaaaatacatccctatttaatacaggtaacggttgaacgaacggcgacaacatttggtcgaacaatgttttgggctaagcgttggtacactcctgaccagctgttttcgcgtctgattgcgtcaattggtgagaactttcttttttgtaataattgccgcgattttttgcgaaaaaacccttttttttgctcaatgttttgaagaaatgagctaaaaaacgcaattctttttaaaaatctcgattcttatgtcactatccgtcactagaaatcacttttttggcgtttcgtcactaaaatagtaaaaattcactatttgcatttttcactatacgattttttgaaaaaattttcaaataaaaaagcaataaaacgaaaaatagacccctaagaatcaaccccaataatttaaaaaaactcttctaagaaatgaaaaaattttcttaaatttcattttcttgccaagactttgtaattaaaaaaaattttatttaatttttggctgaaaattgtgtcactgttcgtcaccatttcgcactttttgccaatatttggtatttttagtcactgttttagttaacttttcgatatttttcgtcatctaaaagtcgcggccctagtaataactaaaatggtgatgaaactaattttattttttcatacagcaggggaagaggctgagatcatgtttttcaatcaaggccctcctcctgagggccttaaaaccgaccaaaccgaaatggacgacgttgctctaacatgggtatgtgaataaaaatttctaaaacagttatagattataaatcagagttcccaagttttttttcaaaataaggcaaaatggctcaaaaactaagattcggaccccaatttttgcatttttatttacaaactaagaataagcacaaaacaaggaggtcgtgccaaaaaaggataaatcttctaaataaggcatttttaatttctaagatcgggcacgcacctccaaacaatgacaaatcttacaaataaggacacttgggaactctgatatagatacatcacttctatgagaactcacatgacgtggcaccatttgtggttcctgtgcgataccgaacaactgcccaagggcgattaatgatggcccaactgatagcaaaagcacgaagaacatttcgggaagcgtttggtacagaggaaagccgccaatgtttaagaatggtaaacttcaataattaaaa

SEQ ID NO: 80817 - DNA, 1198 bp, Heterodera glycines
  Genomic contig location: Contig_ID=SeqID_16414; Location=294..1491; Strand=+
  SCN-specific regions: Sequence locations=1-5,27-210,233-761,784 -789,814-1198
atgactttcatttctataatagtattggcacttattaataaaataaattgcgctgccgaagttgcaatcattcaggcaacttcagaggattgcatccgaaaaacgaatgggtccatttgtcgaataaaaggtacagcggaaatgacaattcttccagctggtcagaaaatttctctggcactaaaaaatcaatacagccaaactattggcttattaaaaataaaattaaattcactcactctaaattgtgtgcaggaaacggtagcttggctacgagattacggtataaaagtaaaatcagcaagaagatgtcccactatgggtacatgtaagaaagggaaatgtgcaaatattagaacaagtaaaaatattgaagaattaaaagagtattgggattacccaggaaactcgtattgtatggagggagaaagagtttggggttcaaagtgtgccctaccatcattcgggattaatgagtgttttttttataaaataatagcaattccaataactccgacagtgtggaaacaagtaaggtgtttaaattgggattatgaaattaaagcggaaattgagctaaaaagtgaaaataaatcagtaaaaaaggaattaactctgtacccgggaattacagaagaatggaatgagttttcctttacgccccaaggagtaactccgcctatttctcctcttttaagtgattatttctttatttcacaaaaagacataatttatgccggaaaagaagtaaaaactaagttaatttgtaaaaatcaaataaatgcttcaaacttcgaatgtgatttacaaaaagatgtttgtcgtgaatgttggataaacagcaccaaagaggagcctttaatccaatgcgaatgtgaagactatttaattgaagatttggaacctaaactcccgtttactaatgataaattaaatttaagaagtgacggaagtaaaattttaagcgaaacgagttatacaccgatacaattattagtaagagtagaaaatttaaaaatagtggcggaaatagacggaaatatttgcaaagcaaaacaaattggccaattatctgggtgttatgagtgccaaacgggaggagtacttaattacacttgctggacaaattggggagaaagcattgccgagataagatgcccaggaggtttaatctttctagcaaagtgtaaaaaagaag

SEQ ID NO: 80818 - DNA, 1059 bp, Heterodera glycines
  Genomic contig location: Contig_ID=SeqID_16415; Location=40..1098; Strand=+
  SCN-specific regions: Sequence locations=1-108,148-184,207-276,456 -534,556-948,971-1059
  Gene Ontology: Mol. function=transcription factor activity; Cellular component=nucleus; Biological process=ubiquitin-dependent protein catabolism
atggaaaatgggaagaacaattgcgatatttcagaaatggtaatgagcacgggcttaccaaatgggtttcagttggatggcctgaattgggctcaggttcaccaatgtattccccctccctccctgttttatcccaacccaaagataatgagaacagcgattgtacaaccgcaattattggcacaacagcctcaaccattggcacagcaaccgcaaccattgacacaacagccgcaaccattgacacaacagcctcaaccattgacacaacagcctcagcaattgccgcaacagcaaagtcaacaactgcctcaacagcctcagcaattgccgcaacagcaaagtcagcaactaccacaacaacctcatcaattgcaattgcagccgcaacaatcggttcagcagccgcaacagttggttcagcagccgcaacagttggttcagcagccgcaacaattgccacaacaagaagtaccgcagttgttgcaacgagtgttgtattcggtacaaccacccctaccatcgcaacaacgtcatcatcgacctctctttggaagagaaaaccgattcacatctcgtagaattggtccaaaccgttcacatccgtacactattcgactgccagcaacagcacaacaaccattccgtgaagcacaggaagttcagccgtctttgatcaattggccctgggacaccccccctaatctcaatgtgccattcgagattcgccgtgtcctactccgtcgcttagcccaagaaagggaacatgcatttggcctagccggagcagttcatcaatggaacccacccatggcaattcttttgttggccctcgaatcattctacagcagccttctcgccatggcggtaaatgaagatggtggatcggtgtcggcacaacactgatcagtcgcggcgggagtgtcatcgccaatcgattaaagcgatgaggaaagaaggaaaaggatgactaatcgaccaaagatcgaacaaaggacaaatcatatttaaggagtgattgttttacattcgggatcattcaaattttgctattgggaa

SEQ ID NO: 80819 - DNA, 826 bp, Heterodera glycines
  Genomic contig location: Contig_ID=SeqID_16416; Location=2403..3228; Strand=-
  SCN-specific regions: Sequence locations=1-183,205-241,263-671,693-826
atgggcaatgaacactcaaatcgctcaaagggtcatccgtcatcttcgtcctcaaaaaaggatagtccggcgactcgccttcaaaaagcgctgccgtccgcgctaaaattcggctcaaatgatctctcgtcgagtgccttacgacgccttttggaacagtcgaagaaaagtcgaagtttgcaactgaaaggggccggcatcaaaagagtgccgtcgggaattgtcgaggaggtaattaattcttcattttttacttaaaatggtcgataatttggggttcatgaaaaataaggtccaaattttcaaatttcaggtccattctttgctcagaattttggagctgtcgtcgaacaaattgcgcgaattgccttcgaccatcggcactttcagcatgctcaaacagttgtacatcgccaacaaccgtctgaccaatttgcccgacgaaattggctgtttgaagacattggaattgctcgatgtttctggtttgccttttttttgtttcccaattgagtaaatttctaacaataagaattacaaaactaatttatttaggtatttttattttttcccgacttaattttcctaaaattgaaggcaatcagctcactgaactgcccgacccattggccgcgtgcaattcgctgacccaaatgaacgcgtccaacaacaaattcagcacatttccctccgtcgtgacgcgactgctgcggttggaggtcatcgacttgtcggagaattcgatcactgaacttccggacgaagtgaatttgcataatttaattaacacgaaacttttcccatcaaaaatcactatttaaataaa

SEQ ID NO: 80820 - DNA, 645 bp, Heterodera glycines
  Genomic contig location: Contig_ID=SeqID_16416; Location=969..1613; Strand=+
  SCN-specific regions: Sequence locations=1-269,291-645
gatttgcaaaagaccaaacaacaaatgatgatgaggggtgccaggtaatttcggatgaagaaagggctattgtaaataatagggtttttttcgttgacggaccaaaacaaatgtggtatcaatcgtaagctctcgattagacaaatcgatttaaagctgaaagaaattgaagcgactaaaccggtctaaagctcaaaaatgtaaggaaaattgggcatttctaattttaaaacggtcaaacccgaacaaatttgatatcactcgaaaaattttatgagttaggtttaaaaatcagtggatgaagtcgaatcgacggcatctaagcaccgagacaactgagtcctagtgaaaatagacatttaatggcattttccatgttttagtgctgtgagtcgttccgcccaatcgccacttttgccttccgcttcatcgagcagtttgtcctccctacaacaagcatcgactgatagtacgcagggaacattcgccaccagtgggcaacaacagcacggcactttagcgaataaatccaacacaatgctcgccatggaaatgatccaaaaatccagtataatcttttacccgaccaactccaattatggcaaccaacttctgcccgggtttccccgttttttggctgactga

SEQ ID NO: 80821 - DNA, 938 bp, Heterodera glycines
  Genomic contig location: Contig_ID=SeqID_16418; Location=604..1541; Strand=+
  SCN-specific regions: Sequence locations=1-851,873-938
atgtttaccaactcgctttatgttggaggttcttccgaagcaatttttgctgagaatggcactgacaaaggtcaaaaacggcacggagccgggaaagaagccgaaagtaagccaaggaaaagtcaattcgaaatttaattggcagaaaattttcattccattttttttggttttaatcaaaataatattttattgtatttttgtgtgtctgatgaatttgtttttttgtcgaaatatgagcatcatttgaggcgaacaccggccgcgtcattctgttgacgaggattatttgaaggcggagaagcggcatagaaaaagtgcaaatggcacagcaaaaaacagcaatggcaccggcacttgctcaccaacttcccctttggcattagcagaggaagaagcattgccatcagcagcggagggtggcaccaccgccacgcggcggcgaatgccctccggggaggaggagtggggcgtaagccaaagcggaccccaaagaatggcacatgaatgatgaagacaaggcgattgtaatttggcacaattaacaaagctactggcgcagaccttgccactaattatctcctcctttaattttgctttttcgcagggaaatattgccgacaaatgccaaagattggtttctttaggatagggcctaatgtaatgaaaggaacctccgactcattcagttacttaaatgggcatttttcatttggccataaacccaaaaagtatgacgtgccgtcgccatccatggcttaataagtgttattactcattttgtttgcgtataaattggtagtgccctgctgaaatttgacacagcttttaatctcttctcgcgtggacatttaacacttttaattaatttcctacggctgcggctttccacaaaaatgtcgcccatttcgaactgcaacagttcactaatgtgtcaa

SEQ ID NO: 80822 - DNA, 437 bp, Heterodera glycines
  Genomic contig location: Contig_ID=SeqID_16419; Location=2515..2951; Strand=-
  SCN-specific regions: Sequence locations=1-67,89-154,185-411
atgccttaccaaatttcgatgactgagaaggaacgcatcggcgcatattttttggcgaaagataaggaagaatataaacaatgtgaagatgcgtaagatcaaagaaattttcgaagaggaaaatatttgtcgaagcattttgtttttttctaactttaaaaataaatttttacatttttaataagtagggacgtgaattttagtgaagaaaaatcccggaatagttaacttaaatagtgagtaaaaatgccaaaatagtgacaaaatagtgaaaaaaattcagaaatagtgacgaatagtgacataattttcagccaaaaattaagcaaaaataatttttattcactgattgcagttgcaaatgaatgagtagggctgggatttttaagggcaaaaaaacaaaataggtacataaaaaaataatttttaaaattaaa

SEQ ID NO: 80823 - DNA, 324 bp, Heterodera glycines
  Genomic contig location: Contig_ID=SeqID_16419; Location=2216..2539; Strand=+
  SCN-specific regions: Sequence locations=1-87,109-185,217-296
aattgttttgaagaaaggagctcaaaaaacgcatttccgcataaaaatttttcgattctgatgtcattatcggtcactagaaatcactattttgggattttgtcactaaaatagtgaaaattcactattttggagttttgtcactattttttcactatttcgacattttttggaaaattctttaacaaaaatgcaataaaaccaaaaaatacacccctaagaatctacaaaaaaaaatcaaaaagcactcctaagaaatgaaaaaaattttctcaaaaaggtattttcgtggcaagaattttaattttaaaaattattttttta

SEQ ID NO: 80824 - DNA, 270 bp, Heterodera glycines
  Genomic contig location: Contig_ID=SeqID_16420; Location=9..278; Strand=-
  SCN-specific regions: Sequence locations=1-67,89-270
atgaccaccactgttctgatcaccattcttttgatcaccgtcatcggcattcatttttgtttggccaaccattcccaaagtgaagactatgaacacttgcgccaatttttcaagcagctcaatgggcatgggccatcatcgaattcgtcatcggcaaactcggatgcttatgtcaataattccgtggtgccaaatgtcatcctctggtgcattttgctattcgccctggttgcattggtgatcattgtgaggctttttgatcagatttaa

SEQ ID NO: 80825 - DNA, 643 bp, Heterodera glycines
  Genomic contig location: Contig_ID=SeqID_16420; Location=871..1513; Strand=-
  SCN-specific regions: Sequence locations=1-36,58-217,264-485,510-614
atgaaaggtttaatcgatgtttggcaaggaattacaatatttcagaaattaaattttgattgaaatgcgggaagaaagagtttataaaattttgttaaaaaagaatgaaaatttttagtaaattccatcttaaaatttcattaaaaataattagtctaaaagaaattacctattttattaattattttttgtcaatgattttaggaaaaaaatcttcaataaatttgaaaatatataagatgttaatttattaattttttttacctaatttagttttgaatttgctaatttcttttattaattcattatagataacaaatcaattacagcgaaattttgggtatggctgattgatcaatttcagattgacaaaaagagaagcaatggcgaaagcgaaaatgcatttgatgtggtcattaattgagagaagctcgacttttgaccgctttctcggaaaaaccgattaaaaaacgcgataaatggacttaactaattaaactaattaatgatattgatactgaaaaatcacattttccgaacattacacataattatttctttccttttcattgcttttcttcactatatccatccatatctgtaaatttgttttgattatttatttatttttttaaataataaa

SEQ ID NO: 80826 - DNA, 707 bp, Heterodera glycines
  Genomic contig location: Contig_ID=SeqID_16421; Location=812..1518; Strand=+
  SCN-specific regions: Sequence locations=1-99,122-167,191-222,244 -393,460-594,616-707
atgaacggcgatttgattggttatctgaacgagatggagtcaatggaaagtccgcaagtgcgaaagtcaaaatcgagcccaacgattgcggaagttaatggaggaaaagcagtggaaaaaacgcagcaaactcaacaagggaaaggtgcacttaataagcttaatcatggccatgggaggcaaaggaattcgaactcggaaaaggggccgagtccatccgggcaaaattaaaacaaaatgaaaggtttaatttaacagagaaagtgatgagaatggtgaacggacacgaagggagaagcgcatccgaagaagcaaaaggaaacaatgggacggtggtggtaaacggaaggagtaaagatgagagaaacggcggaaggacagtgacaacgataggagagacagtgagagaaaagagagagagagaggggggggagtagggggaggggaagcgagacgaaggcaaagaaaggcataaatttcaccctgacattatgtgcaagattaggcactataaaaagtcaccagcagtgccgcaaaagttactgttacaaatcagttttcgggaaaaacggcatttttttcaaatttcaattaaacctataatttttctcaaaaaataagattttttttctcgaacttgaaaaaattagcaaaaaaattaaaagaaaaaattttgtgtacaagttccctagtgcacgcctggggaa

SEQ ID NO: 80827 - DNA, 842 bp, Heterodera glycines
  Genomic contig location: Contig_ID=SeqID_16422; Location=84..925; Strand=+
  SCN-specific regions: Sequence locations=1-30,61-111,135-802,824-842
atggttagtgatgccaccgacggagaacagcagcaacagaaaaggaaaaagaaaaggaaacgcgggaggtcgtttttcgcttcgattgttcacagaaagaacaaatgaaacgattaattaggcatttaagtggtgatctcgaaagtgaacagatttattgaaaatgaaaaagataaattttagaaaatgacgcaagaaaacaataagtgaaagggggtaattgagtgttaattgggcaataagtgaattcttttgggcaagtgcgcttttggcttacaaatttgttagttttttgtttttttatcaattatctaatttttttttagtccgtccgttcatttgcttttctcagttgctcttaataagcaaccctaaatgtttttcatttctcaatcgtcgcacaaaagttgcgcttaattgcgggcaaaagtttgccccgacattcgccaaaaccaatgcgaatttcgcccgtcggactttcacattttcctgaagttcaaaatcagttgcttaccaccctttgtatttcaattgcaacacccgaaatgatcacttcgtcgccatccttcagaaatttacgcgtctccccactttcgcccaatttgaccgcatttgttcccttccaggagagttccaacagacagccaaaagagtcgggagtctcgaaacaatgaaatgccaaacaaacaacgcaaaaatgctaccggtccactcaaagtgccagagcccataaggtcgccgacccgaacgttgcaaccattggacgtgtgatgagccaattgttgtttcaaagtccaatagagatgctaaacaaaaataatgaggaaaagcgtgggcaaaca

SEQ ID NO: 80828 - DNA, 1234 bp, Heterodera glycines
  Genomic contig location: Contig_ID=SeqID_16422; Location=496..1729; Strand=-
  SCN-specific regions: Sequence locations=1-16,38-434,457-462,484 -823,845-1234
  Gene Ontology: Mol. function=fumarylacetoacetase activity; Biological process=tyrosine catabolism
aggcgattacactgacttttattcatctatttatcatgccacgaatgttggcacaatgtttcgtggcaaagacaacgcacttatggagaattggtgctgatatttgctcattttgccacatttaaatcacactctttcatatatatgcgattaggaaatggctgcccgttgcttaccatggcagggcgtcaagcattgttgtctccggcacggcagtcaatcgcccgtggggccaagtcaaggcggaagatggctcgttttcgcatccatcccatgcccttatcctttggtattattttcagatacccagccgaactttgtgacaagtcggttaatggactttgagttggaaatggcatttttcgtgggagggcccgaaaacgctttgggcacgccaattccaattgagaagacggaggaacacatcttcggaatggttctgatgaatgattggagtggtgggcaaaagagcaaacgacaaaatgggcgaaagacatttcagcaagggacatccaaaaatgggagtatgttccgctgggcccattcctcggcaaaagtttcgccaccaccatttccccgtgggtcgtcacaatggaagcactccgtccgttcgtcgtcgacaatccttcccaaaatccatctccgtttgcccatctgaatcattccgatccgtacagcttcaacatcgatttgaccgttgaaattaaacgtttgtcgtccatttccctccattttcaattggacatttagcggagggaagcgatcgctcagttccgatttgtcgaaccaattttcgagttttattgtttgcccacgcttttcctcattatttttgtttagcatctctattggactttgaaacaacaattggctcatcacacgtccaatggttgcaacgttcgggtcggcgaccttatgggctctggcactttgagtggaccggtagcatttttgcgttgtttgtttggcatttcattgtttcgagactcccgactcttttggctgtctgttggaactctcctggaagggaacaaatgcggtcaaattgggcgaaagtggggagacgcgtaaatttctgaaggatggcgacgaagtgatcatttcgggtgttgcaattgaaatacaaagggtggtaagcaactgattttgaacttcaggaaaatgtgaaagtccgacgggcgaaattcgcattggttttggcgaatgtcggggcaaacttttgcccgcaattaag

SEQ ID NO: 80829 - DNA, 232 bp, Heterodera glycines
  Genomic contig location: Contig_ID=SeqID_16424; Location=1121..1352; Strand=+
  SCN-specific regions: Sequence locations=1-232
atgaatgcatgtctattttgtcttatcccaacagtggccaagctggtcgaggaacggggcggtttggccgtgtccagcgaatgggtcattcaggttggtctttccattttttttaagccatggttttcccggaaagacgtaaagccatcccattttaaaggccatcgtcactggttcgctgcccgacctgggcgagcccggaggcgagaagttccgctacgattttgtttag

SEQ ID NO: 80830 - DNA, 683 bp, Heterodera glycines
  Genomic contig location: Contig_ID=SeqID_16425; Location=171..853; Strand=+
  SCN-specific regions: Sequence locations=1-192,214-357,379-523,545-683
ccgctccccagcccgacaccgatgccgaaaagccacaaccatctgaagaagggccgtcgacatcagaagcaacggcgcaggacaacgacggacaaccatcatcaactccaacaccggtgacaccgctggaaatggacgtgccatcggtggagatgatgggaatcggtgtgtcattcccttcaacgcctgcctacgaagaccaacaaattcaaccaatgccgtcaacatccacggcacgctgtgacgtggtggcgacaccatcgacttcaaagggcgacggtggctttggtctcgacgatggtgagtgagaaatttcaccaaaaatttagttttttaagtcgtttcattttcattacattgaaattttaattttaggttggccgctactctcatctcggcacacaagagaagatcgttgagaaactggtgaagcacacgacgatgttgaatgcactgcacgaccgtggcgttgagaacaacaaagaaaatgacatacccagatttttgaccaaattttcacctcacttttatttattttcacattaatatttcgaaaaatttgagtggtttgaaatgagttaaattgtttagctttcacttagaaaaattctccattttaaaatctttttttgtataccaaatttattcagtttagttgggtatgaagaaagttatcctatata

SEQ ID NO: 80831 - DNA, 3021 bp, Heterodera glycines
  Genomic contig location: Contig_ID=SeqID_16425; Location=1..3021; Strand=-
  SCN-specific regions: Sequence locations=1-468,490-651,674-1272,1295 -1460,1482-1836,1861-1869,1891-1898,1920-2154,2181-2307,2329 -2473,2495-2638,2660-3021
  Gene Ontology: Mol. function=protein binding
aatcacccggactcagtttttatgattccatcaccgtaaatcattctcctgcatttcaatcactgggactcaaccctccagcatttcaatcactgggactcaaccctccagcatttcaatcactgggactcaaccctccagcatttcaatcactgggactcaaccctccagcattccagtcactgggactcaacacaccagcatttcaatcaccgggactcaattctccaggacttcaatcactgggactcaacacaccagcatttcaatcaccgggactcaattctccaggacttcaatcactgggactcagtttttatgcatttcaatcacagggactcaagacaccagcatttcaatcaccgggactcaattctccaggacttcaatcactgggactctattctcctgcgtttcaatcacccggattcagtttttatgcattccaatcaccgggactcattctcctgcatttcaatcactggtcaattctcttgcattccaatcactgggacctaacctcacctgatccttcggcatcgcaatcatcgagactcaattctgcgacattccaataactgggactcaactaaccagcattccaatcactgggactcaattctccatcattcctattcccgggactcaatcccaccagcattccaatcactgggactcaattctccatcattccaattcccgggactcaatcccaccagcattccagtcactgggactctgttctcctgcattccaatcaccgggactcagctctccgacattccagtcactgggactcaattctccagcattccaatcaccgggactcaactcaccatcattccaatcgctgggaccgaacctcacctgattcttcggtatcgcaatcatcgagactcaattctgctgcattccaatcactgggactcaattctcttgcatttcaatcacagggactcaaatctccaggacttcaatcactgggactctattctcctgcgtttcaatcacccggactcagtttttatgcattccaatcgccgtgactcattctcctgcatttcaatcactgggactcaattctcttgcattccaatcactgggacctaacctcacctggtccttcggcatcgcaatcatcgagactcaattctgcgatattccaatcaccgggactcaattctgcgacattccaataactgggactcaactaaccagcattccaatcactgggactcaattctccatcattcctattcccgggactcaatcccaccagcattccaatcactgggactcaatccttcacttttcacggattcttcggcatcgtaataactgaggactcagttctccgccattccaatcaccgaggactcaatccttcactattccaaacaatgaactcaattttacggattcatcggcatgtcaatcacgggacttaattcagacctgttcagcataattttggaattttaaaaacgtatttctattatgaaatacaatttgcgtagaaaatccttttcattataaatacttgttctcttacattttaataatttcttttacataaacatctacgtacaaaaaaagaacaaataaactgaccttatatcgttaaaagaaacttatttttgtcaaaacaaacaataagtgcgataaatccatccaattaaaaccgtatccattaaaagaggcataattgacatccgctttaattacaaaaacaaaaaaactccatttcaaggtcaaacaatttctcgaaccaaaactttttcaatacaatatcaaaactaagtgtaagatcatttccattgactttgcatatacaaaaacaattctttttctttacaaaagtgttaagagcattcatttccaaacgctttttgataataacaaaaacaaaaactttttctcttaagaaatgcaatagaaagcattcattgcgatttcattatcattaataaacatacaaaaactattttgtcattaaaaacgaaaaaaagagaaatttattttaactgtgctttttgcaaaaactgacaaaacaaaaatgaaaaaaagcaaaaatcaaacatttcattttcaaatacatttttaacgcaaaaactaaacaaatcgccacacaaattcaaaaacggacacatacacacactcaactttattatataggataactttcttcatacccaactaaactgaataaatttggtatacaaaaaaagattttaaaatggagaatttttctaagtgaaagctaaacaatttaactcatttcaaaccactcaaatttttcgaaatattaatgtgaaaataaataaaagtgaggtgaaaatttggtcaaaaatctgggtatgtcattttctttgttgttctcaacgccacggtcgtgcagtgcattcaacatcgtcgtgtgcttcaccagtttctcaacgatcttctcttgtgtgccgagatgagagtagcggccaacctaaaattaaaatttcaatgtaatgaaaatgaaacgacttaaaaaactaaatttttggtgaaatttctcactcaccatcgtcgagaccaaagccaccgtcgccctttgaagtcgatggtgtcgccaccacgtcacagcgtgccgtggatgttgacggcattggttgaatttgttggtcttcgtaggcaggcgttgaagggaatgacacaccgattcccatcatctccaccgatggcacgtccatttccagcggtgtcaccggtgttggagttgatgatggttgtccgtcgttgtcctgcgccgttgcttctgatgtcgacggcccttcttcagatggttgtggcttttcggcatcggtgtcgggctggggagcggctaaaaattgtaaaattagagattttacgaaaaaccaatggaaaaactcacctttcttggcccatcggacgtgtgtcgccttgtctattttggttcgtcgctcctctcgcttgttctcccttttttgccttgatcttatttgaattgagcttgtgtggcgaatttctttt

SEQ ID NO: 80832 - DNA, 723 bp, Heterodera glycines
  Genomic contig location: Contig_ID=SeqID_270; Location=8450..9172; Strand=-
  SCN-specific regions: Sequence locations=1-723
atgtgcagcacagggcagtataccaactccgagtgtcacaacacccaatccactgtaccagattccaagcttaacccccaggtaaatggccctattagggttctcgccaggtgctccagtaggctcagtatattggggtcaggagagtgagtactcgtctacttttgccttgaacagtttgataaacgtgccatccatctgccataacagaatagtgacaacgacaagcaagtctcgcttaccaacccatataaaggaatttctccgagcccacccgccctggacacaccagcgcacagacccaatcgaacgggtctgtcgttggagccaacctcagagtttaaagtccagaggcttggactcctgacacctcttagacctgcaatcattgcatggctaatcgctcgtatcattccattcacgtgcggcgaacccttagcgccaaccactactccaatattcattcatgtgtaatttcaaagcaaatgtcgctcaacagattccaaaaacagttatccccagcgccacagaccccctcgaacggtctggcgtccacaagcggcagacgggcattttgtgctgccacgctagtttaacattaacaccagaaatacataatccaaactcgcacgcaatttccatttgtacaaaatagctctgatcaagagtctagctaattttcagaactcggatttatagtgaaaaaaagcaaacgtcaataaa

SEQ ID NO: 80833 - DNA, 832 bp, Heterodera glycines
  Genomic contig location: Contig_ID=SeqID_2633; Location=188..1019; Strand=-
  SCN-specific regions: Sequence locations=1-255,288-718,743-832
atgttccaggtcagagtcctgtaaaattttagaatcagaatcaggaataaaaaaacatttaccggttaaattcactaatcctgatccggaatttagcatgtgtttttgcttaccttctgtaccaacctcacgatcagatcacatgcattacatttggtcttcataataaccaagaaagcatacagcatttgtcgtgatagaacattttgaactcttaaaagcgaacataagaggaataaattcagtaagaaattcaatttatttttatattattactttttttaaaacgctaaacaagtgcgagattcctctagcttggtttaaagcttctatggtggagttccatatcaatgtggacctaaaaatgaaattttaggcttggaacgaaacgtgggtaggcagtgcgcttggcttcctcaaaccagaaatacatggaataacagacgatttaaaaacagtgcggtatcctggtgatgagaagtttcctacgtatctggtggacttaaaaaagagctaagaacagatagaaacaaaatatttttaattagtattagtgaaggattcttatgttctctcttttttttgctaatatttatcttatgaaaagctcaaaagctttttacttattcaaatcaatgcgacgttttaaaatataaaaacaaatttttgactttggctataagactgggttttggtagttttaacacttatgtaggagattttaaaaaaaaatatattttttgacaaaaaaacttatggaaaaaattttcagcaaacagactttaatttcaaaaaattttctgtcgcttcctacggtgtttttgaaattaaa

SEQ ID NO: 80834 - DNA, 1202 bp, Heterodera glycines
  Genomic contig location: Contig_ID=SeqID_2634; Location=202..1403; Strand=-
  SCN-specific regions: Sequence locations=1-304,338-361,383-462,504 -565,587-652,674-675,704-898,921-1202
atgatcagtcaacctttgttgttgctggttggggccgtacttcaccatattgttcgaacgacagtaagccaggcccaagcaaacaattgatgtacggtcaaatgaaaatcagtgcatcagagaattgtcaaagtgcatcaatcaaatgtaattaatttcaaattgaaaaaacaaaaaattaaaattgaaatccttgatttagcaaaaagactttcaattgctgatgatgatgataattcttctaatgataatgagcatgaccaaatcatttgtgttcagcctgggccgagcataatcgaaactgtaataaatttttaaaaaattaaaataatttttacttttagggtgacagtgggagtggattaatgaaaaacaacaacaatatttgggttcaagtgggcgtctcaagccaaacgacttgttatcctacagatcctacacgaacagaaggcctcacaggtgataattatagtattattttttaaaaattaattatattttttgcaattaaaattgccaacattttcaaaccttcttttatttttttagaacaaggtccatttcaagaggaattaaaaatcaatttttcaaaacattctatgccgaattatgtgttgtttttttgcatttaaggacgtattcacgctttagaacttttttattcccccaaaaatcataataaaaaattttatttaattattttggtacttttggggattcctttgcatatttcgtatgctcgttcatgatttatgaaaatttgagattttttttttgtcaaaatttatgaaacatgcaaaaaggaattgatagtccaatcgccagggaaattttaatttttgttggaataagttaagcaaaatttttcaaggattctctactaaatatagctaatggctcaaagctgattaaaactttataattattaggggtaaaattttttcgtttttgaggaaaattaaagttttaacgaaaattgagaaaatggacagattatgacattccactcactcagcatttatcttcatttttgtctataaaaaataaatttccaggtcaatttgctccaattgattgtgcttggattgagaaagcgacaaatggcgaagtgaagtgcaaaaataattaaaaacaattttttgaaaaatggaaatggaaatccaatgtttgtcccataaaatgcactttctcgaccaaataaa

SEQ ID NO: 80835 - DNA, 1565 bp, Heterodera glycines
  Genomic contig location: Contig_ID=SeqID_2635; Location=22..1586; Strand=-
  SCN-specific regions: Sequence locations=1-28,50-191,221-294,342 -358,407-503,548-942,964-1047,1069-1095,1117-1167,1189-1238,1264 -1320,1354-1435,1458-1531
atgttggcaaatctttctttgccaatggttttgcttgctttttattccatcaacagcaaacttttgattgtgtcatgccaacaaagttcgaacttttcggaatgcggcatttccgacttcgaacctcaattggccaatgtgtcaaaaatggcaatcggcacaaatcatgtataaaagagaaggaaagttccaaattaaaaaataattaaaattttaaaaaggtgtataaagggcaagaagttggtgatgacaaggcacttccatggatcgtccgactgatttttggaagtaatcatttaattaattgaaaattatttaaataaattaatttgataattaaaggtgttctaaacaggccaattataattaatcttttttttatttataacattttcatattttttaagagtcgtattgcagcggaacaattatcggtccccgacatattttgaccgcattgcattgtaccgagcacaatgttgcagaaagtgagtgaattattaagggcttaattttaattaaaatatgctttctttctttacattttttgtaccacttaaagtgtgcaaagtttctcttccaaaaattaaaaaacaaataactcattatggtcggttatttacttgcctttgttagtacaaattattgaaaaatttgtagactaaagaatgaataataaatatttcgtgaatatgtaatgatatcattaatatatataaaagtggttgctgttttttgctgatttttttagatcaaattgtcattgcgtatggttccgcaaatttgaaacaacagcaacaactcacgggcgttgcggccgttaaattgcacccaaagggcaccgacgcgcaacgcaatcaaattaatgatgctaaagcagataaaaacgtcattataaaagcgcagagagtgcaaccgaatccatatgacatggctataattgaagtaaaaattcaaataaatcgctaatagtgaggaaaagcggattaaaatgataaaaaaagacgaattttgaattcgttttttatgcttgctttattaattcgtcttctaatttaattccttaaagaaacaagacaatttcctggatgtttaggaattttaagttctgtaaaaaccagaaaattgtaattatgggaataaaaaaattcgtttgtcaattattattttggggtttttaagcattttttcaaattaatcatgagaaagcagataaacattataaagtgttttaggacacgattaattttaaggaaaatatttatatgaatttttctggtttctattcggcttaactcaggaaaatctaatgggaaaaacttttataatttaaaaaacattttttaattttttgatagttcagtccgcaaaagttggttttttagttttttaatagatttttcattttctttatgaattctttatatacacaatataaaatgtaatttaatacaataaaattttagttgaagaacccacttgcattcacagcaaatgctcgtcccatttggtttatggaaatatggttgccaaataaattttaaataacttttttaaaaaataaa

SEQ ID NO: 80836 - DNA, 646 bp, Heterodera glycines
  Genomic contig location: Contig_ID=SeqID_2636; Location=251..896; Strand=-
  SCN-specific regions: Sequence locations=1-615,637-646
atgatcagcccggaaattttacgtcaaaataatattgttgcactcgaacggtaagattttatggtaatctaatccaaaaaaatctgttttaggttcaaagacaaggagaaggcataataactttgccgggagcggcaccttttggattttcaaccgtaaattgtcaggttgtttgggatcttttacgtatttttagggtgttaacaccgccatcgcgtggaacgtagggccgctaagctgggcgccctacgggttagactccaagccaggatgctccgatttcttttaccctgtcatcgacaccctggagcttattaaaaaatatgtattgagacaaaaaggagtgaacggcgacgaagcaaaagcacaagagcaatggaatgaactgaccgtggaaagacacaaaacatattacttacaaattattttattatatgatggatattctagctaagtgcagataatttgcttatacgcaatataaaaaaaatttgagaatatttttccattttagtgcctgttttgagggttttttagtaacatcagcgagggagtggtaaaagtttcctaattttcttaacaaatgcctcattcaaaatcgatttttcgcagtgtcaaaaattttgtgagaattttaggaattaaa

SEQ ID NO: 80837 - DNA, 1948 bp, Heterodera glycines
  misc_feature (1882)..(1882): n is a, c, g, or t
  Genomic contig location: Contig_ID=SeqID_2636; Location=1653..3600; Strand=+
  SCN-specific regions: Sequence locations=1-118,149-351,380-736,762 -772,794-1482,1507-1575,1618-1948
atgttgttcaagaagtcgtcaatttttgacgaaaggtcgtcagccgtgggtaccaaagtttttgatccctcgattgcttcgtaggtagtcattatttttttagcgaggatttattagcaataaatatttattattttaattttaatatgtgaaaaaacctatgaaaatttttttaaataccacaaaaatctacatttaccatttccaataaacaagttatatcctgcataaacgataaaaagcagtgtttaaacccgttctccataatcattctctcatcatctgcctacttaattacgctaaaggttaatgtctctttgtcgtcgacaacgaattagttgacagtttaagtgaaatcctcttttttacattttcccgatccatcatgtatctttctttacccgtttgtgaattaggctaatgatgatgttaatcgtttttagcttcatacaaagattagggaaatccgctttttaaacctccatatttcgggcttttttaatccatattttatgtttatgctttttcgaactttttttttggcctatgatttgattttgtaatgctttttcactagaaattattgggcataaaaaggtgtcattcgactctatcgtagagaggagccatatggttatattttgaaaagcaaaggtgcagtttacctaaatgtaacaaattctaaaagaaaaagtattttctctgataattttcgatgttttttaccaccgtttggatttaattaattaaataattattttggcctttcccatttttgcagttatttgcctcagtgtcacaagtattggcctgcctgcatccctttgattctttcatcttttcaccgattttgagatggtttgaacagtgcgttgttggacagttttttggccaaattcactctgaccttttaaaaatgttgataaatttcttagaaatgatccaattcagggtgaggtacttttcggttttgtgacccccccccctgagttttctaataaaaagccttaacaaaaaaattttcgaaaaagggggatatcatacgtactattaccaaaaaccatttttgttcgagttcgggtttttcgggttcggcgttcataatttcgccaaacaaaagcaatattcgtggtcagcgccacaaataacccaagaaaagactttttattaaaaatttcaggggggtcacaaaaccggaaagttgatggcagatggtcttttttgccatgttcactctgaacttgaatctattaaaaatgatacacattttgcgaattcttcaaattattttcttagatttaaatctctaaaccagaaatttctgctaaaaaagtttaaatatgttaaaaagctaaactgtaaaaataaatggtaaaaactgggcataaaatgtcaaaaattttgaaaaagctattttcccaaaatgattaaattgagctttaaattttcatgatttttgatcacagcaaaaatatgtgctagaaaaccccaaaaaatgttttttatgagttaaaattcactataattcgaaaattgggcgaagaaaatgtgttttatagcaaactttgagcaaccaataatagaaaaaagtagggcaaataatttcaacttttagatcctggtaacgggcgttgccgattcttaccaatggtaattactgattatttactatcacactgggatctgtctactgtgatcggtcatccctcacccattgttctgttccccacttaggcgctgcttcctccctcctgatcagcgcatttagtgatcacagtcaaacaaatagcattcatcgcaccgtttggtcggcacaaggcatttccagggcaacaattttgtaggtccggcatttaattcctctgtgtgcacttaattttgngaatttgaacatcggaaatgagatgcatttcatcatgttgagtgctagtgcttattacaccataaa

SEQ ID NO: 80838 - DNA, 471 bp, Heterodera glycines
  Genomic contig location: Contig_ID=SeqID_2637; Location=1930..2400; Strand=+
  SCN-specific regions: Sequence locations=1-105,127-471
atggcacaacagtttgataagaagcatggagcaaaaagggtagagtttaacatcggcgacaaggtgcaatttgtgaattaccgtgatggaaaaacattatggttatttggggaagttgtcaccaaaaaagggttaatttttggcattcgttccccacaaattgcaaacagaattgtcactcgccatgcaaacgccatgcgactcacacaagcattgggcactgatcaaacatggccaaattttgatgaagagcccaagaagaacaaatcacccgttcgagcaccacaaattcagcgaaatgtcacaccaacaccaccagccgaaagaacccatgatcaatttgaacagaacgaagaacaagaacagaaccaacagcaaacaccagtgcttcggcgatcagaaagagttccaaaacgtgtccgtttcctgagtccaagcatgacgggacaacggcacaatattcgccagtga

SEQ ID NO: 80839 - DNA, 142 bp, Heterodera glycines
  Genomic contig location: Contig_ID=SeqID_2637; Location=1065..1206; Strand=-
  SCN-specific regions: Sequence locations=1-142
tcatttagatttctcggttctcgattcccgagtcgagaaatttctcgggttttttgggtctcggttctcgtatcgtttcccggggtcatttctcggtctcgtttctcggttcccagtaaaaatcacttctcgcacagcccta

SEQ ID NO: 80840 - DNA, 179 bp, Heterodera glycines
  Genomic contig location: Contig_ID=SeqID_16428; Location=292..470; Strand=-
  SCN-specific regions: Sequence locations=1-179
atggatgatgaagaaatgggaacgaacccaaatgatcaaatgagcgaatattacaatgaaaataataccaaaagtgatcaaaataagaaagcagagccaaatgaccaacaaaagagagaaataattcaaaaatttgaagcaattaaagaaaagttgaagcaaaaaggaaaataccaatg

SEQ ID NO: 80841 - DNA, 1001 bp, Heterodera glycines
  Genomic contig location: Contig_ID=SeqID_16429; Location=90..1090; Strand=+
  SCN-specific regions: Sequence locations=1-102,183-261,299-385,407 -520,573-689,763-1001
atgcgcggaaagcgaacccatcgaatgtatttgccattcttgatcgtttttgtatgttttatgttttcaaagaacaattcttatttttataatttatacggctaataatttgtataattatttaattaattttttaaaataatatataattcatttttaaaaatatttaaattgaataaaatggtttatttagggaatcggccttgttttcatgatattttatggaggagctgatatatttgtgaaaatgaatgaaaatggttaaaaaattattaaaaaaaaatattgttaaaaatttcccgcacaaaattcagtaccgaacaactcaaccaacgcatcagcagttgaacataatcgcaccataaaaaaagctgacaccgaactgagcaaaaccacacttcacacaattagtgaaaattttctatttgttttaatttgttttcagattaaattaaatgttatagtaaagtttttatcattttggcattttttcgaagaaaaatagtcattgaattctttgaaattttttcttataaaaaaaatttattgagattttgaaattttttatttaaggctggctactcaatgacacttagtagctttaattaattcattatggcaaaaatttttgtcaaaaattatcaatatggcggaatttttattaaatggccaatattatacaatcaaagatttttttttcttattttatattttatttatatttttcaatttaaataaatttgaaatttttgtttaataattgttttagaaattggttcctatttcttttcttggtttctcacattggctctgaatgtttggctttattcaattgttcttcgtgcctacttttttatgaagcgccaaaatcaaaatatgaatggcgcagaacgaaaccaaaaatttgaaaacattgcactttgattactcaaaatgtgattcattgacaaatttaattgatattaattttctaattaaaacatttgaatgttgacatttaa

SEQ ID NO: 80842 - DNA, 1423 bp, Heterodera glycines
  Genomic contig location: Contig_ID=SeqID_16432; Location=94..1516; Strand=+
  SCN-specific regions: Sequence locations=1-240,268-312,334-689,711 -840,863-1322,1344-1423
  Gene Ontology: Mol. function=microtubule motor activity; Cellular component=spindle microtubule; Biological process=anterograde axon cargo transport
atgattcgcgactaccaatcccagctgatctaccggcctttgtcactggaggacgaagtaatggacaatcgtatttgcgtctgtgtgcgaaaacgaccgttaggtaaaagggaattggcgagcagagaagtggaagtgatcaccgtgccgaaccgagaccatgtcattgtgcatcaggtgggacaccataccaagatgtccatgtgtttttttaatatgtcacataaatttagcctcaagtgaaggtggacttgaccaagtatttggtcaaccacaaattccgctttgactacgtcttcaacgaagcggcgacaaatgaaatggtttacaggtctgtttagctcgacaaaataatcagattatcgaaatgggtgttttagattcagtgcccagccgcttgtccgaacaatttttcaacgaggattcgccacctgttttgcctatggccagaccggttctgggaagacgtacacaatgggagggatcatcgaaggacgacgccaggcaataaaaaaacatttatttggcaaacaattatcattaatttcaggattgctcaaacggaatttacgccatgacagcacatgatgtgtttgcgatgcttcattctcctgagtatgccaatcagaaactgaccctctcgtgcagtttttttgaaatttatggttctaaggtgaaaagggttaaaaacatatttgaaaaatacattttaaggtgtttgatctcttgaataaaaaatcggtacttcgcattttggaggacggaaagcatttggtacaggtggtcgggctgagggagacaaaagtgcacagtgttgacgaagttcgtcataatttctgattaataaatgtactatgaattgaattgtccgtttttaggttttgaaactgatcaagcttgggtcggaccagaggacggcaggtcaaacatcggcaaattccaattcatctcggtcacacgccgtcttccaaataattttaaggaaatggtaagtctattatttttagtggcgttttctttaacatttttttgcagggaaaaggagcgtgacaacctttacggaaagatctctctaatcgatttggctggcaatgaacgaggcgcggacaccatcagttcggaccgacagacgcggctggagggagcggagatcaacaagtcactgctggcgctgaaggagtgcattcgtgcgatgggccaggacgaagggcagcacattcccttccggggctcaaaactgacgctgatccttcgcgattcattcattggccaaaatgccaagacatgcatggtgagaagaaatgcacaaaagttgggcattggtctttcattcatatacattcttcaacagattgcgatggtcagtccgggcattagcagtgtggagaacagcatgaacacgttgcgctacgctgataggtaa

SEQ ID NO: 80843 - DNA, 358 bp, Heterodera glycines
  Genomic contig location: Contig_ID=SeqID_16433; Location=1..358; Strand=+
  SCN-specific regions: Sequence locations=1-211,233-358
agcttggacttcgctcgttgctgcgttttcacaacaaacgttacactgcgccaaagtcggaggagaaaacgcagcggagtctcctcgtggtgctgctggacgccgacttcgcgaagcccatagcactgcgtcatgtgttcgctttgcttgcactcgggtccttttactcaccctaccacattcttaagtggtaattactctaattgcagtcccaactcgccctccttcttccttctccccggtctctctacgtctctctccgtccctttgaatttgccacgcatttccaccgtttctttcacttccgacgggcctccagaattagtctgtctgacagcgaagatacgaaaactgttaa

SEQ ID NO: 80844 - DNA, 1422 bp, Heterodera glycines
  Genomic contig location: Contig_ID=SeqID_16434; Location=1024..2445; Strand=+
  SCN-specific regions: Sequence locations=1-111,136-483,505-1231,1261 -1376,1398-1422
atgtggactgtacttgaaaagtacttccgatcactgagagaccgagattgtcccaaatttcttcgtcaaatttttgatgatgaattgacgccacgatcagaagaatggaaagtggttgtgtgtgttatgtgttttgccttcgatcagttcaatcaattgaatgttattagccaggtagtactaagtacttagaaaattactaggttaatttttataaattcagaaaccgacacttccgtttcccattttggccaaacaaattaaaacattaaaggcgaagctggaactttcattgaatgaggaattttatggggaagagaccagtgaacttttgaaacaattggaaaatgatggcgcgatttatcaaaaaaaacaaattaaaagccgcctttaaggtgttttttcattaaatatttgtttagctttgatttttcagcaattttacgaggacgcatatgcatatttgtgcaaatggtcacggcaattttctgagatggatgaagtgattggagattgggtcatttttgagtctgagccaacatctgaaaaagttcggaaggcgtataggcatttttgtggggcgtcaactgctgatgaaatgaatgatttgtttgctgagatcgctgagttgaaacagacactgaaggagctcgagggcgagcggttcaacaggaaaaacgtggatgaaaaatggccggctattttcaaaaatcctaattttgtcctgctcaaatcactagtctctgcaattctatcaattttcccttccaatgccttttgtgaatctgtcttttctgttctcaagaacatcaaaacggacgagaggaatagtattggcatacctttgttgaattctcttatttcaatcaaattcaattcaaaaatttcgtgcctaaatgttcacaattattttctttcattgccaaacttgctcaaacaggtgaaaagtggtgataaatatgttgtttaaatgtttttacgttgttatacattgaattattggctaaaaaaatatgccgggtttttgaaaatttttgccgggtttttcaactcgcgcgcccggtttttgggttttggcgatcgcacccctggcgcccaaacgagctggcgcccaaacgagcgcgcccaaacgtgagcgcccaaacgcagtggacccgcgacttttagtgaccgaaaatcccaaaataattaactaaaatagtgagtaaaaaggccaaaataatgacataattttcagccaaaaattgagaaaaaataatttttattcactgattgcagttacaaatgaggtaaatttcctttctaataatttcttggcaaatattgacattttaaatcaaaaattttcaccattaccaattcggagactgcaaagaaattcaaatgattcacaaagacaccgatagatcgcattgagccaaa

SEQ ID NO: 80845 - DNA, 1113 bp, Heterodera glycines
  Genomic contig location: Contig_ID=SeqID_16440; Location=46..1158; Strand=+
  SCN-specific regions: Sequence locations=1-284,307-483,505-898,921 -1113
atgggaaaaaggcatcagtgtccctactcaagtttatttaccagacatgaatttaaaaccgccgggggcttgggaaataaaattaacgaggcattcacacatcattacaaaatcaaaaaacaacgtggaaagagagaagccaaggctgaagataccaaagattcaaaaattgatgtcgcaaagagggccgcagaacgcgccgggagagatgtagaaagacatctcaatcatatcaacaatgtctcgagttccatccaaaccaaactaagcacactaagagaagtaaatcctcaaattttagaagagcctgatataaaagtgtggtttgacaaaatggtagagaaggggaccgaaattcaaacataccgaaatgaacttaaatcttttcaagaagaagtagataaagccaaaaacacaacattagagcatgtggaaaagaatgacttgaaagaagcaaagaaatcagccgacgtcgcaaagggaatagccaaacaggcaaaaagcaaatattcatcaactctcgaggaatataatgataaatcggaaaagggttatatcggaatagtgaataggcttaatgaggctttgggtgagcatattaaacgtaaagatattgaaaatagacaagtatcggaagctgagaaaggaccacaaaaaagagagagactagccaatgaggatgttcaatttcaatatgacagcattgatcaaaaatttattgtctatctttctgctgctgtctcccacatagatttgtcaaaacacctcgcctatgtgcttggttttaagaacacaaggctatttcacgcggaagaggcgaattatatgccagatttgacgggaggcgtaaggcagctatacatttatgcaccaaatttaatagaaaacacaattatcgggaaccaaatggctccactcttaagaatagttaacgtcgtcaatgacccagggtcgattagtgaagttatatatagcaccgagtactttcatcgtctacagtcgaaacgaatttcagaaattacaattgaaattcacacaccgtttggcgaattcgttaaatttcactggggaagttgtattctcacattacattttaagaaaagtatattttaa

SEQ ID NO: 80846 - DNA, 262 bp, Heterodera glycines
  Genomic contig location: Contig_ID=SeqID_16441; Location=965..1226; Strand=+
  SCN-specific regions: Sequence locations=1-46,68-139,161-262
atgaaagatttggaaaagttagtaagtttcttctatttttcagataaaaataaacaattttaaatttttagctattcttagtcgctaacaaaacgtcagtaactaatccataagcaaatttattttttaaaacgcccatttatttaaaatcatgtgaaaattaatttttgtcaacactgatggattgtccggaccccattttaatcacttaagagaccaacatcacattttgaccagtgaaattaattcttagaagttaaaa

SEQ ID NO: 80847 - DNA, 1183 bp, Heterodera glycines; identical to SEQ ID NO: 16444
  Genomic contig location: Contig_ID=SeqID_16444; Location=1..1183; Strand=+
  SCN-specific regions: Sequence locations=1-43,65-193,245-270,292 -454,528-548,616-704,728-729,802-824,846-904,926-1183

SEQ ID NO: 80848 - DNA, 201 bp, Heterodera glycines
  Genomic contig location: Contig_ID=SeqID_16445; Location=1..201; Strand=-
  SCN-specific regions: Sequence locations=1-6,29-201
attcacaatccctttgtcagtttatcattctttgttccatttctaaactgttataatggcacaatatttttaattgatattttttagaatgcgttttttaccgtcgtgattatttaaaattttcttaaaagcaaaattaatgggaggcaaacatctgaggcgcaatcatagtcactagaagtaattggacgataattatcg

SEQ ID NO: 80849 - DNA, 753 bp, Heterodera glycines
  Genomic contig location: Contig_ID=SeqID_16446; Location=204..956; Strand=+
  SCN-specific regions: Sequence locations=1-84,114-451,481-659,684-753
ttttacagtaaattggcactcaaattaacggaatgggaatgtccgaggactcaaagcgaatttgataataggtaaaaacgatactaaaatattatattattattacaattaatgttggtaggctccaacttttagactaggttgtttttaagctttctcaaaaacaaaaagtcgaaaattccaacatttaaaaattctaaatttattgcttaaatgccatttcatgattaagccactcaaatttattaattaaatgccaaattaatatttcccttaactttcagttacacatttaaagtgtttctgttccaatttgtcaacttttactcgagtttgttctacatcgctttcataaagggcaaatttacgagtccgtctcatgtgaatcgtgggatcaacgccgatcgaactgagctcagatttgggtatataagaaaattattgcttaacattattatacagatttttatgtttagaaaatcagttttttgaagttttctggcgccataatttttatgaatcttaacaaaaattttttgatagagaacacttagggctattgaataatatctcgacaatgttggatttggttggcaaaaaaaaagttatagccaaaacaacgcgctggggcccaatcctagactagattgtttaacatgtgaagtttttaaaaattaatttggtataaaaaagctatggtcaaaaaggtgtgaaaattgtgtaaattccattttttcatatataattttggta

SEQ ID NO: 80850 - DNA, 358 bp, Heterodera glycines
  Genomic contig location: Contig_ID=SeqID_16447; Location=114..471; Strand=-
  SCN-specific regions: Sequence locations=1-27,62-358
atgtcttcagataacgaaatgtaaaaaattaaacagaaaattttgaaaatttcttcatttttcagctttatctgcagcgattgtgggcttttggtgttcgattttcttgcgccttctcaactcggcctcgaaattgcactgattagccgtcgctttgactgcatcgtcaacgaacacttcaaaacacgcaaatggaaattgggcaaaatgcaaatttgccacgaaattggagagaatggcactaagcaaatgcaaattgtcaattccgatggaaatccattgccaatcccgcaaaatccgttgcccaacaaagtcatcggattcagacgcattcatatcatgtaaaaatttgattaaa

SEQ ID NO: 80851 - DNA, 742 bp, Heterodera glycines
  Genomic contig location: Contig_ID=SeqID_16448; Location=733..1474; Strand=-
  SCN-specific regions: Sequence locations=1-358,381-549,571-742
atgcggaaaaatggacaaaatggtgagtgtcagattagtgttcagcgacccagaaaacccttagaaactatcaccagttttgattgactttaatatagcaaaagcagatcgtaatgctttttcgagataatttcaatttgttgtgcccatttcaaatcattagtaaaataaatgccaaggtctctgactggttcgtttccgggatttttaggaattggaaagtcatcaataaaataatttattttttggtttttgtgtcctaaatgtaaagttaaacatttatttgaagcgattttaaggccgtttaatttacagtatcgattaaatttgttaataaaattttggagtggagaaaaggaaatattgaaagaacatgataggccttaagatcatcggcaaatagtttaattttaacattttcagtttcgcagaattttggtaaatcgtaaatgtaagggtaatttattcaattgttttgtttttcgtttggggaatagtatgttgttaggctacttttcgagttattagtgcctattttctagatttttatttttagagccagaaaattttgaaaaaaatatttaccatattttctctaattatcgccccgtctccattaatgcccccgtctctaattatcctcccctttctgaggagattgaaaaataatgcccccggggtgataattagagaaaatacggtaccctattttgatgaattttttaacaaaaatggcaataaa

SEQ ID NO: 80852 - DNA, 521 bp, Heterodera glycines
  Genomic contig location: Contig_ID=SeqID_16448; Location=1604..2124; Strand=-
  SCN-specific regions: Sequence locations=1-128,150-521
tcggagggtcaacaattgaaagaggtggccctgatggttgctgccatattttcgttaaatgaccgactaattgattgatagtctttgattttcgcttcctttttgttaaggcatttctccgtgccaccgcttcggtcagctacaaaattaaatttacagtgtggaatacatcaattgagccatttgaattggtgaacgaccgaaccaaggaaaagctgacatttgagaaaatgccacgttacggtgctgctgatgaagatggctgtgaattcactgaaagattgctgttgaagcgatgcccaattagtgaaaaggcgacggcggttcaatgggaaaattgggatgccaatttgaacaaagtcacaatttttttgtgggctgacatcaataaatccattgggtgagcgcagcgcagcaacagcaatttttgattttgtcgaaaaaaaatatttaattttaggccattatcgccaccaacggaagaagagaatgaagaagcggatgaaagcaacgaaaaataa

SEQ ID NO: 80853 - DNA, 303 bp, Heterodera glycines
  Genomic contig location: Contig_ID=SeqID_16450; Location=400..702; Strand=-
  SCN-specific regions: Sequence locations=1-303
atggccaatcaaaatgcgtttattaattcgttcactttccatttcagcagattaagttgggcgatggaagcgccttcctcagtcgcggtggacgacgcctcattcgattacagcgccggtggcgatgaattggccaacaaatccacgccgaggcgtcgtcgcgggtacattccgtactcgaccatttacgaacggcaaaagggcggctattgggtgccgggattgcaagtggaggcaacaattgtgcatgtggagcgcgatgtttcgtcgagttaccacattctgaacccattcatgtgctaa

SEQ ID NO: 80854 - DNA, 451 bp, Heterodera glycines
  Genomic contig location: Contig_ID=SeqID_16452; Location=1099..1549; Strand=-
  SCN-specific regions: Sequence locations=1-451
gccaccaccaacaaccgtggttagagtcaaccaaacagtgcccgggttgggtgcagccgttcggcctgatctcctggccgttgacgaacaaaacaaaacggcgctgatcattgacgtggcaatgccattcgaaaaccgctaccaagcgtttgaaaggtgccggcaggggaaacggcagaaatacgaagaccttgccgaacattaccgcgcgattggctttgatgttcttctcgaagcgttcattgtcggaccactcggcggttgggacccgcacaacgaatttgtcctcaataaaatgaaaattggccagcattatcgccaattaatgcgccggctaatggtctccgatgccattcgttggagtcgtgacatttatgtcgaacatttgaccggtgttgcacagttccgagatgatgatgtcgaaggagtccgcggcgaggcaccgaattga

SEQ ID NO: 80855 - DNA, 167 bp, Heterodera glycines
  Genomic contig location: Contig_ID=SeqID_16454; Location=522..688; Strand=-
  SCN-specific regions: Sequence locations=1-15,38-167
atgggccatgagaacggccgaggaggagttggaggccgattggccgaatgttttgcgggtaagtgccaaaaaaatacaaaaaaaaattaatgctaattaatgatgctcctaattcagctctgtgacctgctgatggaaaggaagacctttttgtttgttggaataaa

SEQ ID NO: 80856 - DNA, 899 bp, Heterodera glycines
  Genomic contig location: Contig_ID=SeqID_16455; Location=4..902; Strand=-
  SCN-specific regions: Sequence locations=1-41,64-276,298-899
atgcccaagctctccttttcaaattggaggtgagaaggatgaatttatttttaattattttttcattatccatttttgtttaattttcggtaattttatgcattttttaaggattttccccgcaaatctttgcgtttcatttgtcaaaatgtggcccaattgttcaaatcagatctttttgcaaattgatcaggaaatattatgtgtacttctcgaccatgaccgtttgttgctcaccgatgaatttgaaatttggaacgctgtaaattcgataaatttttcatttgtattttaagttagtttttttttaaatttaggcaattcattgggccgatgaaaaatgccgccaaaagggcatcgaatgttacgatgaaaaacgacgcgaaatgcttggttcggcattgttcaaaattcgttttccaaatatccaagaggaggattttgccaaatgcatcggtataaacctttcacaaatccatcgatgcctacgggcatagtcacggaattttaacaattttgaattttttttttttagatttccatcagatgtgttaacagaaaaagaattgctcggcgtttatcagttcaattcccatccgtttctgtatcttcgtggagtgcccgggctgtactcgctggatttcccaagccatggacgaatttctgattggaacaaagccaaaagcaaccgaaggaggacacttgcgttggaaattgaaaaagtgtcggaatttgcgggagagtctgtcgggagaagcagattcagtgatgccgtggagataaatggattcgaatggaaaattgaagcagaaattacgaaaggcattgatgagaagaaatatttgggattttacttattgtgcgatgcaaaagaaggtccaattttaataatgttttaa

SEQ ID NO: 80857 - DNA, 150 bp, Heterodera glycines
  Genomic contig location: Contig_ID=SeqID_16457; Location=125..274; Strand=-
  SCN-specific regions: Sequence locations=1-150
atgttttggcgtctgaactgcttggccgccattctgtttgcactgtgctgcacctctagcactttttggctcggttccgatactactgatgaacagaacaaagcgccacatgttgaccaccatacgctgaccgaaacacaacaatatgaa

SEQ ID NO: 80858 - DNA, 698 bp, Heterodera glycines
  Genomic contig location: Contig_ID=SeqID_16458; Location=143..840; Strand=-
  SCN-specific regions: Sequence locations=1-455,544-698
atgacagatcgccaacaaaaagcgatggcagcgtttcgtgtacagaaacaattggaaaggcatcaagcactaacggaagagaatgtgcacgttggccttatgttcggctcaaaggcattggtccaactgttggccaaccctctgtaagagggacggagggggggggggggaattggtggccaaaaaagggcgggtgattggctaaattgtcaaattatatgccaaacggaggaacacttttcattcccttttcagcattggaccacttaccaacaagtcagtacatatacacatttacattcacttcttgataagtaattctgattaaattttgccagaatcggctacactttgccaatgtttgccggtgagcggacaaatggcaaatcgcttctcttttcgctctattttgcctctcttttggctccctctcctcctctttcgatacctttttttctctcttttccctctccctctccctgtccctctctctctttcttcctcctttctctctctctccctttctctcttttctctctctcttttttctggccttttatagttttttccatgttcaggcttcgtaatcatgtttctgtccacgctgctgttcgcctttggcacttccttcttcactctttggctcgcccgttctttgcaaggcgtcggttccgcctgtaccagcacttcaggaatgg

SEQ ID NO: 80859 - DNA, 111 bp, Heterodera glycines
  Genomic contig location: Contig_ID=SeqID_16459; Location=153..263; Strand=-
  SCN-specific regions: Sequence locations=1-111
atggctgcttggttggatgccttcgtgcaaaagtaccgttccaatcgtcgtgtgttgctatgcattgtgtacgttgcgcttttcctggacaacatgttgttgaccacagtg

SEQ ID NO: 80860 - DNA, 990 bp, Heterodera glycines
  Genomic contig location: Contig_ID=SeqID_2641; Location=815..1804; Strand=-
  SCN-specific regions: Sequence locations=1-205,227-393,415-990
atggaagtagaacaggacaaaccaccgaagccaagccaaaaagaacaattaaattccgatgcttccgaattcgctgcttctctttcagctgctacgacggggcttgatttgggtcaaacagccgttccaaaagaacaaccgaacaaggctgatgcctcgggatttttttcagctgtttcggccgcaacaatgggaataagtagtgaacaacaacaacaaactacaaccaaaaaggagaaggagcagacagaccatgaaattctcgatgaatttctcgagagcgtgtcggctgccacgactaacatggacgtttcacagaaaagaaagccaaagaagaaagtaaagaaggatatggaagatgaggaaatgacagcaattgcgtcgatcacccgtaaataataaagtatttaaaagcatgtgattatttgatttagcccttaaacatttatcatgattggaaaccaattttacacagataaagaattaaagctaaaaatgcccttcggtatgcttatttctggtccatcggggagtggaaaaagcagctttctagtcaagtttattgccgagtcctcagaacttattgaccctaagcccgcttccattctttacgcattcggtgaaatgtccagcattgtgcctaccctccaaaaatgtggtattagtgtgtattcgggagtccctccggaagagttaattaaacgcttacctaaaccactgcttataatccttgacgaccttttgctatcgattgatgaggcctatttaagtgcattattcacaaaaaaatcgcaccatcagaactttgccgttgtttttgtcacccaaaatttgtttgaaagacggattaaagtggcaagacaaaacgctcaatatttggtactaatgcgggcccccaactcagcacttgctgttcggaatattggagttcaactctttcccgggaaactggattattttctctcggcataccgtattgcgaccaataaa

SEQ ID NO: 80861 - DNA, 587 bp, Heterodera glycines
  Genomic contig location: Contig_ID=SeqID_2642; Location=63..649; Strand=-
  SCN-specific regions: Sequence locations=1-291,314-420,444-587
atgagtatcaacctccacgacaaaaagtcgctcatggacaacattttgccggtggttgagataaatcaaaccaacaacggcattacggttagcagtgaacgaattgcgataccacgaacggttcaattcgatattcttggcaaatgtcgagaatgtaaggcaaccgaatgtgagacggaatggtgcgtttccaaggaaggcgttaccatttggtgcacacgcttcaaaattagcccacgttttgtgccatttgatgtgatctacgatttgcctggttacacatttttcaaggtttgtttctgtgttttgttttatcacaattattactcaacagattcgaaacaaaggacgggttttcaacgttgaccacggtttccgctccaatgcgtgcacccagaccccgactcccgtgtaccatttgcctccacctccaccaccgcctcagctcccgaaaagaaagcaggaaagtcaccaagacgcggaacaacgtgttgcccatcaattcttcgactctgtgtcggcagcaacgacgggattagacattgcgcggcaccaaacgcgacaaggcgacggcaaagaattttttg

SEQ ID NO: 80862 - DNA, 386 bp, Heterodera glycines
  Genomic contig location: Contig_ID=SeqID_2642; Location=904..1289; Strand=+
  SCN-specific regions: Sequence locations=1-50,72-79,122-124,146 -223,245-309,331-339,362-386
atggctcgccaatcgacaattttaccaatctacaaacgacaatcgcgaagacagcagcaacattttcatttcgacaatgtaaaaaaaattttttgaattcaaaaaataattttatttatttcaggttttggtgtttgatggaggaagccgccgacagttccaacttagctggttctgcatcgcactgatcgtcatactttttgttgcctggttcatttggtaagtgaataatttttaatttacaaaatttctatagttaaattttaagaaagcgccgacggagacaatccaaatggtgcatgaaatggatgatgagattgatcaaaaattatcccaatttggttttttctatttaataatattttaatccatttctctcagggcaa

SEQ ID NO: 80863 - DNA, 311 bp, Heterodera glycines
  Genomic contig location: Contig_ID=SeqID_2643; Location=408..718; Strand=+
  SCN-specific regions: Sequence locations=1-46,102-120,164-229,255 -265,300-311
atgttattaattatagtcaggttagttaaataatatttccaaaaacattattaaaaaaattaattaataataattttacagaaaagaaaattattttaattgggtgagcattatttttttagaagaattataaattatgttaattattttgtattgattattcctctctcttttcattaactaaaagtctaatatgtttttatagaaaaaaaaagatttacctttgctcttttatttatatatattaaaaaaatgaaagtcgttaaataatacattatattcttataaaggataatagctttatatgagaa

SEQ ID NO: 80864 - DNA, 623 bp, Heterodera glycines
  Genomic contig location: Contig_ID=SeqID_2643; Location=797..1419; Strand=-
  SCN-specific regions: Sequence locations=1-52,74-271,426-577,601-623
atggaggcggtgcacaacgaaactccatctggaatgccgactcacaaacggaccatcaaagtgaacaaaattttatttgattattgtttaaccaataaatccaggtgggtagtgttgaaagcggccccggcgctttcacagtgccccttggggccttggttaaataataataatgaaacaaacaaaatttagaatgaatctccgaaagcgaatcaaattcagcaagtcattgcgcgaatgaggaaacataataaaagcaaaaattaaaagcaaaaaataaatacaatttcattatataagaaataaatagttatttttttaaaaatttaatgggattaaaaaaccatattaatattatatagaatcatagaattaaattatttaatgaatctatacatattaaaaaaaaaaatatattaatttaaggttaaaactcaattcattaaattttaggacgagattcaccatgagaataaatcacaaaagaattaattttctcaattaatgaatataaatcaacaaataattttaaacattgaaaaaataactcaaattagggactaaataattaggtaacaaatattttaaaattaatttaatggtcgacaaatgctgaaattaaa

SEQ ID NO: 80865 - DNA, 1700 bp, Heterodera glycines
  Genomic contig location: Contig_ID=SeqID_2643; Location=6080..7779; Strand=-
  SCN-specific regions: Sequence locations=1-291,314-420,444-1010,1032 -1198,1220-1283,1305-1457,1490-1700
atgagtatcaacctccacgacaaaaagtcgctcatggacaacattttgccggtggttgagataaatcaaaccaacaacggcattacggttagcagtgaacgaattgcgataccacgaacggttcaattcgatattcttggcaaatgtcgagaatgtaagtcaaccgaatgtgagacggaatggtgcgtttccaaggaaggcgttaccatttggtgcacacgcttcaaaattagcccacgttttgtgccatttgatgtgatctacgatttgcctggttacacatttttcaaggtttgtttctgtgttttgttttatcacaattattactcaacagattcgaaacaaaggacgggttttcaacgttgaccacggtttccgctccaatgcgtgcacccagaccccgactccggtgtaccatttgcctccacctcctccaccgcctcagctcccgaaaagaaagcaggaaagtcatcaagacgcggaacaacgtgtttcccatcaattcttcaactctgtgtcggcagcaacgacgggattagtcattgcgagtcaccaaacgcgacaaggcgacggcaaagaattttttggtgcagtttcagcggcgaccatgggaatggacattgaacaaaaaaacgagaagcctaaactaagacaacagagggcagacgcctcagatttcttttcacccatttcggccgcaactatggggatgaccgctgaatatctaaaacccaagcctaagccgagacaacagccagttgatgcctccaacttcttttctcccatctcggcagcaaccatgggaatggaagtagaacaggacaaaccaccgaagccaagccaaaaagaacaattaaattccgatgcttccgaattcgctgcttctctttctgcggctacgacggggcttgatttgggtcaaacagccgttccaaaagaacaaccgaacaaggctgatgcctcgggatttttttcagctgtttcggccgcaacaatgggaataagtagtgaacaacaacaacaaactacaaccaaaaaggagaaggagcagacagaccatgaaattctcgatgaatttctcgagagcgtgtcggctgccacgactaacatggacgtttcacagaaaagaaagccaaagaagaaagtaaagaaggatatggaagatgaggaaatgacagcaattgcgtcgatcacccgtaaataataaagtatttaaaagcatgtgattatttgatttagcccttaaacattcatcatgattggaaaccaattttacacagataaagaattaaaactaaaaatgcccttcggtatgcttatttctggtccatcggggagtggaaaaagcagctttctagtcaagtttattgccgagtcctcagaacttattggccctaagcccgcttccattctttacgcaaatcgtggtccggcggtgccgataggtgccgccgggcaaatttttttttaattttaatgattttattaagaaaaatcgacaaaaaaatttaaaagtcccaatttttcctgtaaaaatttttaatttttcatttcgggcgggggaaggggggaattcctcccctcacctggctaaggttttatgaattttcataaaatgcgtgaaaaataggtgtgacaaaaaagtgatgcctctattttctaggcgaactacccaaatagccttaacaacaacaaataaa

SEQ ID NO: 80866 - DNA, 1828 bp, Heterodera glycines
  Genomic contig location: Contig_ID=SeqID_16460; Location=973..2800; Strand=+
  SCN-specific regions: Sequence locations=1-165,187-348,379-752,774 -961,983-1121,1143-1574,1626-1723,1745-1828
  Gene Ontology: Mol. function=NADPH-adrenodoxin reductase activity; Cellular component=mitochondrial inner membrane; Biological process =electron transport
gccatcggtcgtgcgctgagtttggcactttcgctgcgcgacgccatggccggctcagtcaaattggacgttcaaaccagcactgtacaggtgagccaaatgacaaatttaccactaataaaagttttataggaatggagtagtaaaaaataaaaataacagccatcaaataaaagggcctaattattttttcaattttttgttttccttcgttcaggtctctgatgaagttcagtctctgtctgattgtgatttggccgatgttcgccttcgtatggtttcttccgtccatattttgctttctcgcgtttgactgtttccaatttccccgtttattccattggtcattgtgtgtgtgtatttgtttctcatttgttccaataaattgttggtttttgaaatgtatttcatggagagttaattttgccattattttcctcaatttaaattcatattccaattttgaccctttgtagtttattaaagtaatgttctcgcggcgaaatcttttgctttggcctggtcaacggtgagaggttttctcgagacatttctcttcttgtacttttaaattcatttagtctgctccaccttaatcggccttgttcttcatctgtgattaaaggtataaaaaagggacacataccgaactaagagggcaaatttccatgtcccaccacccgataatcactgaacaggaacctgactcattccgcacccaattccgaacctcgagctaaatttcaaattccttttgtttttgcttaatttttcggtcccaatattgctgtgattggttcgggcccgtctgggttgtatgtgtgtgctcgactgcttcagcggttgccacgttgcagaatcgatgtgtttgacaaggcacaggcgccctacggactgattttctacggggtaattcggctttttcgagaaatccataatatacttccgttaattatcaggtggcccccgaccattttgacatgaagaaaagcatgaacaactttgagcgaatgttcaacgacaaccgggatcggattgagctgttctgcaacgtggacatcggtcgtgatttttcttatggagtgagtgagaatgtgaataaagtttgaccaattcttacgttaaatgtttataataattggttttgtatcattacaaccataaaataaataactccctcccacaaaattatcgctgcattttaataaagtttgtcttaatcataaaatgagatttacaggaactttgtgacagttacgaagctgttgtgctggcgtatggggccaaccgcgcgcgtcgaatgtccattccgaatgaaaatgccgccaattgtttgtcggggagcgcttttgtctcgtggtgggaaataaaaaaaggaacatcaaaacattccacttgtgggcaatcagttcaaaactggatgactttcttataaatctctaaaatacttttttcaggatcttttaccccattttatgtgattttgagacaaaaatgttttcaggtacaacggcgcgctgttgagcagctccgagccgctgttggacactgaagatgcggtaaaagacaacctctaattgaatttgtaattaaaatagtttttattttgtcatttttcttaaaaatcccaaggtgattattggcaatggcaacgtggccatcgactgcgctcgcattttgctctccgacccggacgtgcgcttggccggcaccgacatcacagagaaggcgcttcgtgcactgcgacagtcgcgcgttcgacgcgtgcgcgtgttgggccgacgcgggccacaaaacgtttgtactgaaccaggcccgggttaagggt

SEQ ID NO: 80867 - DNA, 2727 bp, Heterodera glycines
  Genomic contig location: Contig_ID=SeqID_16461; Location=38..2764; Strand=+
  SCN-specific regions: Sequence locations=1-20,42-280,303-1259,1281 -1688,1711-1864,1900-1946,1977-2584,2622-2727
  Gene Ontology: Mol. function=sphingomyelin phosphodiesterase activity; Cellular component=integral to plasma membrane; Biological process=sphingomyelin metabolism
cttctaccaagcaaccgaaaaatgatgatgctaattatgctgtagaaagtcaaaaacaaaaagttcgagcatcatcatcaatagaaatttcagattcatcttcttctggtgtccagaactctgatgaaaagcggtacttaaaacaatacttattcctaaattttgtgactaaacgtctcaaaataattaatcaaatagtgaagaaaaaggtacgacggcattcgtgactactggacatttcgcctactggaaattttgcctactaaagcaaaatcacgctttttctgtaataaaaaattttattttctaaatgctgctttttctctgattccgattttggattagttggtgagatattcaatggtcgaaattcttaccagtgcttatgttcaatcctgatcctgtcggggttgaaaagtcgcgatcgggatttgatttttttaaaaccaggaccgggattgggttctgaaagccgggattacgggaccaattacagtcgggaccttgatcgcgtgcaaccctaatttaaatccgctttttgtttaatattcaactttacctgtcctactttactaatttacaatcaacttgctttcagattcaatgtggcaacattaaattgcgggttttttcttttataaaattatcaatacaataaattttgaatggcaggcttttacctcttccttggccaatcggaaggaacgacatacaattccgtttgttaaaattgatcaatgagctcaaacattcacggcatgacgtcattgccttgcaagaggtcggttggggcagttctgtaaggaagaagctggctgggcggttaaagcgcggaaagcgggggttgataacatccgtaaaagaaagtgcggatgtgcctcggtagctcaatggtagagctgcccacggaaagggtgcacgaatgggttcgattccaacccgaggcctaacatttttcccattcttattgttcctttaaaatgttttttcttaggtatggagtgaaagaatgttccttcaagttgctcacgaaattaacgaaattttctcccattcgcactatttccacagtggctttacgggtagtggcacttgcgtgcttagcaggttagcagtgaatcagggcttggcgtaactggattttcaaatacggaaatccgtaattacgcccagctctgcaatgactggattcttcagcacttggtttttcatttgatttaaggcatcctatagtgtccactttgctccacaaatactccctcaatggctttcctcatcacgtccaccggtaaaatatttccgaataaaattctcaaccaattatcttatattcttaagcggtgattggttcggtggtaaaattgttggaatggttgagatcatggtggagcagtaccgagttgcattttatacgacacatcttcacgccgaatataacccagagaacggtttgtgtaatattcaaaatgaagcggctgtggtacaaatttcactccgtcttctattgaactatgattttttgatgtcacaattcatccgtcatacctcgcgggggtttgtttgtactgtttatttttaaattgtttttttatactctctaattagacatcttgcttttaggtgctgatttctagttgcggtaggcgacttcatggccagaggctcgattatgtaatgtacaggagtggaaaaagtgagttttgtgaggcaatcgtaaagaatgcgacacctatttcttctttgtttagtattttgtaagagagatggcgcacggaagatgcgtcagtggaaattttaataacttccaatagcaagatgatttaattagattaaatttaagctaaatgatgatttattatagagcaaataaattgaaataataattaaattcaaatatttcaattcattgatacttctgccacttcggctcaccacggacgtttagattaatttgatttgtttattttgccttttctagcggaacttaatctcgttgagtgtgtcaattgcttcaacaaaattcccgggtctgaattgaatttttctgatcacattggcgtttctgccactttttcgtttgtcaaaggtattaaactctgactgacaatgaatctttttttcaaactttagaaaaagtttcagaaaccctttctgagcgaatgcggcaaattgtgccggagaaggaagttttgactaaatcgctcaaaataatagaggagggcgaagttcgcgtgctgggggaccgtcggctttttcttagcctctgtgtggctctaattgctttaactgtcgctacagctaacatccatttgaaagtgccatacttttaccctgccgtttgtatctttcaaaaaaggacgaaattgaaagtttttctttgtttatgtcgcattgttacggtttatgctccctttgttcataggcttctgccttttgtacggtttcattggtgcgtttttttaattttttgcttctatacttgggaaaaccatcgattattattttgtaaatttaggtttgacaattgaaatgaaagcactgaaagaaacgaaaaattctatcaagaagcttttgcgttccttgtgaatttttatagacttataaatttttaaaggtctcattcggtgctaggtcgtaatataaaaactgtcaacatgggcgtttcgtaacattgcttacagatttttcgagaaaaatccgtcataatttttcttaaacaacaccaaa

SEQ ID NO: 80868 - DNA, 320 bp, Heterodera glycines
  Genomic contig location: Contig_ID=SeqID_16462; Location=396..715; Strand=-
  SCN-specific regions: Sequence locations=1-18,42-102,130-196,219-320
atgcagcgcaattttctctccgcccttttcctcctcctttttgtgctgctttatgttcatcaaacattggccggtggttgtgcttcctcaatttcgcttaataaaatcaagaaaaagaagaagcaacagtcatcaactgccgaagaagaagaaactgtacatacaccacggaaccgtgccaatgccgaacatggcaatgtttctgacattggcactggcccagcggggaatgttggcatggcatccacgtcggctgacacacgtctgaatgaggaggaatcacccctaagaaaaacgggtaaaatttcaaaagatcgggt

SEQ ID NO: 80869 - DNA, 406 bp, Heterodera glycines
  Genomic contig location: Contig_ID=SeqID_16462; Location=1340..1745; Strand=-
  SCN-specific regions: Sequence locations=1-119,141-157,179-406
atggaggcagcagcgcgggccaaactgggaacaaagaaaccggcgatgatggcacgaaaaacaacaacgactatggccgtcatgacgcgcaagccgatggggatgaagcgactgacactaaaaaagaatcacagccaacaacagcagcaaacagcaatggtggcggtggtggtggcacagcagtgttgtccggcattggcacttccctgttggacggagtgatcagcacaatcggtggccgagtggccaatggggcggtgaacaaagcgatcagtggcggacggaggggacggaaaatggcataaaacaatggcacaactcagtgattattttcaatgctttcatatttttctatgaaagtttattctcttacttggccattgtcatgtttcacatttataataaa

SEQ ID NO: 80870 - DNA, 129 bp, Heterodera glycines
  Genomic contig location: Contig_ID=SeqID_16463; Location=966..1094; Strand=+
  SCN-specific regions: Sequence locations=1-129
ccatttgcgcaggtccaactgggccaatctggcacatggcactgtgccgatcgctgatggaagcagaagcgcgtcgaacggcactttgctgatctgatcgccgttgtcacaaagcagacgggccaaact

SEQ ID NO: 80871 - DNA, 84 bp, Heterodera glycines
  Genomic contig location: Contig_ID=SeqID_16468; Location=275..358; Strand=-
  SCN-specific regions: Sequence locations=1-84
atggctaatcccaaaagcatatcccaaaatcacattatgccatttcacgactatttgttctcggaagcggagaaaacccgttct

SEQ ID NO: 80872 - DNA, 143 bp, Heterodera glycines
  Genomic contig location: Contig_ID=SeqID_16468; Location=1811..1953; Strand=+
  SCN-specific regions: Sequence locations=1-111,133-143
ttttaatccacaatttatgaaccacaaagaaaagttatatttgtattattcgagctgtccgaattgaaatgcccttcaaactaatcgcataattcgaacgggacgatgacagagaacgaagacaaaaaagcaggaacagggta

SEQ ID NO: 80873 - DNA, 1012 bp, Heterodera glycines
  misc_feature (960)..(960): n is a, c, g, or t
  Genomic contig location: Contig_ID=SeqID_16473; Location=1..1012; Strand=-
  SCN-specific regions: Sequence locations=1-871,893-1012
tctgcggtacacactgtggaaaacccggtatgtaaacatgccttggaatttcctgattcgttggataaaccgggatttgtaccgagattcggattgtgtagatcaaaaaatctgtttaaaccagagtagccaattctgctgatttaccatcattttgctgatttcaagaaggggtcagtgatgattttttttttctgagatgctgattttcaaagtgcaaaattaacctaaaaattgccaattttcagtggaatttgtttaaaatgctcaaattaaaaaaaattttccctgagccgccggcccctttgttcccaaaaagttttttttttggaaaacccgcttttttcattcggaaatttttttctaaaatgttgctttttgaccccaactgctgattttgaatattttcagttggcaaccttggtttaaactcagtagtctgtctgtattcagattgggtttgttttttaggtctgtattagggtagaccagaggcccgggcagatctatacagtgatgatcgatcatacagtacatcaatataatttaattctttactgtgctttgacagccaatgccattccgatggccaattgagtacggcatgcaaactggtgccgaactgatcatgacgggtgccacatacaatggccaacagaagcaatttgttgtcaacctgaacggtcgtggtgatgatgttgtgctgcatgtgaacccgcgcttcaaattcttggaggacacaattgtgttgaacaatcgcagctatgctggctggcaaaaggaggaacggcaccggaacaagtggcacatttttaaagccagggatggaaatggatttcggtttacgaaaaattcctgggtctcgtaatccgatttcccaaaaaattttaggctcgaattcggtccgaaaattttgaggacttgaatttcgtagtcagttgacctgtaccaagccagggnatggagaggaatttgatttacgaaaaatcatgggcctctgaatcccgatttc

SEQ ID NO: 80874 - DNA, 1292 bp, Heterodera glycines
  Genomic contig location: Contig_ID=SeqID_16474; Location=18..1309; Strand=-
  SCN-specific regions: Sequence locations=1-329,354-433,455-501,525 -621,644-911,933-964,986-1013,1036-1059,1081-1096,1127-1242,1265-1292
  Gene Ontology: Mol. function=structural constituent of cuticle; Cellular component=membrane; Biological process=cuticle biosynthesis (sensu Nematoda)
atgaactcaacgccaaccaatgtgacagcagcacgacggacaaaacgccaggccggctatgaggccggtggaggcagcggtgccgcgaccaacgttgccgtagacgcttacggcaccagctgcgattcttgctgtttaccgggaccgcaagggcctccgggttgaaatgatttttatgaaaaaaatctggcattctgttctatattgtttgaataactcaatttttactcacaggagcaccgggaagacctggacggcctggaaaacctggtgcgcctggcctcccaggtaaaaatggtttttatctgatttatagtcattttcatatgaaaatttaattttttaatttttatcttttgctagactaaaagtttttaataattaatggtttttgtggtaattaatgattagtgttcctccctgatcagaattattttttatattgtacaatcatagcatatatgtttagggccacttgctattccgataaaaacgcattcataaaattttcttacagatttttcaatgctcaaattcgagattcaaaaacttttcatcaccatatgaccatacgaaaattggggtgtggtacacacagtcaaatataatttaggcaataaccattggaaatccaccaaaaaggttgcaaaaatattaaatcaaagaactatgaaaaattttatgaaagattatttttttttatcagaatggcaagtggtcctgtgtgtatatatgattattactttaaaacccattaaattgtcaggaaatccagggcgtccgcctatgcaggcttgcgagcccataacaccggtaaagccaagactatatggagattgaaatgacacaccgaaagtagtcgcgactaacatccttaaaacatttttcagcccccctgcaagccgtgcccgcagggtccgcctgggccccaggggccttccggacctccaggcgaccccggaacacccggcatgcctggcagcccaggacgtgatgcacagcctggcgagccagggccaaaaggaccacctggtgaaatcttgcaaaaaaatttccatatttcatgttttcatttttcataaatttaggtcctcccggagagcctggacttcctggaccccccggcggtataaattgacggggaattggagaagaagcacattcttggcatttttatagacccgggagtgccggcattcagtgagccacttctgccaggcgaacctggaccgccaggtcaaatttttggaaaatttaaatttttaaatggtaatgaatttcaggcgaccccg

SEQ ID NO: 80875 - DNA, 160 bp, Heterodera glycines
  Genomic contig location: Contig_ID=SeqID_2644; Location=71..230; Strand=-
  SCN-specific regions: Sequence locations=1-160
atggttggtccatgaatttttccgttttgcagttctccgattatttttcactttcggctcagtttaaagaactgctgttcgacagttggctaatcgtttatttcttttcaatgtttgggttgtgtgttcagttcgtttatcgttttttggtgttgaacag

SEQ ID NO: 80876 - DNA, 1195 bp, Heterodera glycines
  Genomic contig location: Contig_ID=SeqID_2644; Location=546..1740; Strand=+
  SCN-specific regions: Sequence locations=1-95,118-160,182-300,324 -756,786-1195
atgaaagaaatgttaataaacgtcacttgtaatttgttcgctaaatccacagtgtaagaaaatggaaaaataaactcataactttggttgaaaagtaaataattttcaattcttaataaaattcggcaatatatgaaaaatgcgaattttgtcaccatggaaattgaaaaactttaaataatgacaacgaattaagaatatttgttggcacttttttaaaacgggtaagaatggcgagtggtctgatgagagaaataatttttgaaaattgagagaaaagggaattttttgggaagaaataattattttaatcagttctttttagggattttggaatttttcagtaaaaaaaaattcgtgttcgtttttcgtattttcgtgtttttagggcgtttcgtgttcgtgtttagtattttatttttgtttcgtatttttcatttttcgcattttatttttcgattcgcaacaaccctgttgtagataatgattctgagcttttcgattcccaaactaaatgcctttcttcatattggaatcacgcccgactcaaaattaggcatcatttaaatgaaacacataaagcttaaaattcccaaagacaaaaattttagaataattgatttggttggcagaaatatcaaaaaattgtattacaacaactgcagcaaaatgtttacatatgtacgaatgatgtaacatgaacaagaatcgcattcgaagagagcactgccctaaaaagaagaaggatggatttttaaccataaatgaaaatatccagaaaatttgcttttcaatgcaaaattcaggcataaaaaagcctttatgaaactgagattcggattttttgaattgaaaaaccgaaattctgagtctgacgggtcaaagccggaaccgaaaattatatcatttaacgatttggacaataagctgacggattttcttcaaatatggattttgagaaaaataaattaaatgcctttcttcatatttttggaacagactactcttttgcaaaagcatatcttgtgaaaagttctgaccttttttaaagcagatacatcaagccaaaaatttcctggtagcgcctgttggaactacaagactaaatttttttttgaatttcaaaaaaatcccaaaacctttctaaatagtttgtggcaaaatatattatgaattttagtgaattcaaaaaata

SEQ ID NO: 80877 - DNA, 371 bp, Heterodera glycines
  Genomic contig location: Contig_ID=SeqID_2646; Location=683..1053; Strand=-
  SCN-specific regions: Sequence locations=1-57,94-371
atgagaatattttgtattttgattttaattatttttacttgtttttccaaccaatccattttctttctgaatttatcaccaccatcaccacagcacttttttctatcaattttagcggttttcgaaacagcggcactttttacaccggtggcattaatgccaaccgccggtgacaaagcggacgaggacgaggcaccactgttggcagccgatcggatggcagaggagtgatcatccaacagagaggaaacactccagccacgaattttaatcattttaacggataaattttaacagaaaaaattcttatgaagcaacaagtcgagagaaaggcatatttttcgcttatgtgaaaaaggccaaaaattaaa

SEQ ID NO: 80878 - DNA, 1289 bp, Heterodera glycines
  Genomic contig location: Contig_ID=SeqID_2646; Location=779..2067; Strand=+
  SCN-specific regions: Sequence locations=1-182,219-290,382-514,591 -669,692-724,760-860,886-1027,1066-1184,1220-1289
  Gene Ontology: Mol. function=myo-inositol transporter activity; Cellular component=membrane; Biological process=myo-inositol transport
atgattaaaattcgtggctggagtgtttcctctctgttggatgatcactcctctgccatccgatcggctgccaacagtggtgcctcgtcctcgtccgctttgtcaccggcggttggcattaatgccaccggtgtaaaaagtgccgctgtttcgaaaaccgctaaaattgatagaaaaaagtgctgtggtgatggtggtgataaattcagaaagaaaatggattggttggaaaaacaagtaaaaataattaaaatcaaaatacaaaatattctcatgtttataatctctacataatattatttattttatatttttaagcattcattttttaatttctatttcctttcttttttataatgaaattttattaattttaaattactttagcgagccacacaccagtttttgcttgctaaaatggtgtctatgaatattgtttcgccaaccgccgctggtccaaaacttccaaaacacaagccaaagcttgggaaatttatctatttggtgggatttctttttatttcttaatataaattaaaatttggtatttataataaaatattcaaaacaaaacaaaaattaattttaatgtgccaattttatgctttcagctcgcttttattgctgtcattggtggttttttgtttggttatgacacaggtgaaaaacattcttctatattgtaaaatatgataaattatattctaaatttcaggggacttaaattaaaacagtaatttattttttaattgaacaattcaaattaaggcattgtctccgctgcgatgctttacgtgccaaaaaattcggacctgaagccgatgagcaacgcatggattgggcttattggtgaggaatttttgttttagaaaattaaatttttattatagtttcaattacgccgggaatggccggggttggagcactgcttgccggaaaagcatcagacatttttggcagaagaaaagtaaaattgtttaaatgatggaatttaaaaatagtagaaatttaattgattcacaaaatcttttatttaaatataaaacataaaaattaattaattttcctttccagatgatcattctttccacaataattttcacatttggtgcaattgtatgtgcaattggtgtaagcaaatggattttgttggccggacgaatttttttagggatagcaattggtattatatcttaataatataataaaaaataatattcaatttgtaggttttgcctcaatgattgtcccaatttatgttagtgaatcctcaccagcgcatattcgag

SEQ ID NO: 80879 - DNA, 987 bp, Heterodera glycines
  Genomic contig location: Contig_ID=SeqID_2646; Location=2775..3761; Strand=-
  SCN-specific regions: Sequence locations=1-14,37-161,198-201,241 -715,737-776,799-987
atgcaaatatggtatcattgtaaagcccataaaaaatgctatccaatggtatgctacttatctgttgaaattggaaaatgacaattttatacgcaatttttttttcaaagcatgatgggacaacacttatgaccatgactgtatcaagtttttccaatttggttgggaaaacccttcaaaaataattcccaaaattcgtcattttttaatattttggacaaaaataaataaaaatattcatgttgcacaacggactcgaaccaccaccctttgtccctttactatcttacaaaaaccacttcgccacacatgcaaatctttttggaactgagaggccaaaattgaaacggtgtgcgtagaacccatttaagtgaacagattcgagataagaattaatgcaaataggcgagatgttcagttggagaaggcatagataggtcaagataagggttgaaagtgcctagtcacaacacataaaaataaaaaaggactttattcgcaaaattagtgtgtgctaacaaaatagcgaccttttagatgttgtttttattttaagtgtttacttttttttcatattttcatttaaattacagtctatgaaagtgaatgcaattttgaaattggtttgtagtgacggattttacaggccatacgaaaaagatttaagccattaattcattttttgtgtccataatgcttttcatttttactgtacttaaaaagatactgtaaaattaattgacgacgaggaaggtggatccgagatagcgcctatttttaatgtgaattttgcatattcacaaatttgtgtgcgtacactttcaatcacatttgccaaaatagtgatttctagtgaccgataaagacatcagaatcgaaaaattttaatgcagaaatgcgttttttgagctcctttcttcaaaacaattgagcaaacaagttttttcactaaatttgcggccctatttattacataaaaacattaaa

SEQ ID NO: 80880 - DNA, 321 bp, Heterodera glycines
  Genomic contig location: Contig_ID=SeqID_2647; Location=586..906; Strand=+
  SCN-specific regions: Sequence locations=1-4,26-59,101-321
atggccaaaacggtttgaagccggttagaaatcggagcatgttgtccccccccccacggaaaaatttaaaaaattttctaattttttttttgtaaaatttctgttttaattttcaggggggaaatgaagtgcacccgttagaaatggctggtttataaatccatctaataacctagttgattttatcttcaatgcaaaagaccccatccgcaaattagggctcgacctattcctaatcattggagccccagttagcaaagtctacacggttaaaaatcataatacaaaaaacaaacaaactaaaatcatcctttgacttta

SEQ ID NO: 80881 - DNA, 176 bp, Heterodera glycines
  Genomic contig location: Contig_ID=SeqID_16476; Location=275..450; Strand=-
  SCN-specific regions: Sequence locations=1-176
atgactatcgcagagacgagaaaaatgccgggattcagaccggggtggccaaaatctttaggttcacgattagggatgagaaaatctcgggacttggatctggacggcaaaattcctcgggtagtggattggagaaaagtaatttatgccctcattaatattttatcgctgttact

SEQ ID NO: 80882 - DNA, 403 bp, Heterodera glycines
  Genomic contig location: Contig_ID=SeqID_16476; Location=456..858; Strand=+
  SCN-specific regions: Sequence locations=1-403
atgcccatttacagtattttggcggcactttgcaatggcattgattataacccgcaaaatcagcaacaacacaattggacatatgaagggagtcagtcgccatcgccagtgggccctttcgccgatggttccacggatttttcgttattcgccaacatgtcgcagccgtggcacagccaaagcgatagccaaaccgaaccgccgaagccaacggattcatatgccgaagtcgccgctaagccgccgacagtggcaaacactcggtacaactcaataatttatatggatatgagatttacaagatgataaatcatttttttctcaagttctgctcgtgatcgaaactttctcgatattcgagaaagactttttcaaaatattttccatattctttcaaaatcaa

SEQ ID NO: 80883 - DNA, 1072 bp, Heterodera glycines
  Genomic contig location: Contig_ID=SeqID_16476; Location=1049..2120; Strand=+
  SCN-specific regions: Sequence locations=1-564,591-630,652-713,735 -968,991-1015,1037-1072
atgccattggcttcagtggagccaaaaaagaaatctccgactgtcggagacgaagatgagaaagccgcaacggataaccttcaaaagagccaaatttgtcatttttgggaggcccataaaagtggaaaaagtcggaccaaatgtcagaacggcgccaattgtaaatttgcgcatggggagaaggaattgaagaagattgtcccaccctacttcaagaaccatctttgcaaggtcagtgctccgttcgggattatcaacaatgtccgggttcagcactggagctcgggcaaatgtctgaacggcgaaggatgccatttcgcacatggacccgaacagttgcgtaaagttggacttactaaaggtgggtgattggcaccgtttgcattctttcttttcccaaatggactcctttcgacccatcaaaattaagagtcgtcaaatgtgcctccgtcaccctccaaaagtcatcaaagtcgtcgtaagacgtgaacacgcacaaaactcacacaattcagccccaccgatgattttggcctctgttcaatgccccgatgatttgttacgatttaaaaacttttctttaaattctttctgttattttcttcccaaaagatcagtgtaaaatctgattttcttaaaaatttctttactaggattattttaagccctaacacgaatctgacgtttatttgaggctatcacgtattttacgcgacttatgtgaaaatttacatgtgaattttaaactttttttaaaattagcttttttcgttgatccacaaacgggggcacacacaaaaagttcgtcgatatttttgccattttttggctcagtttaaaaaaaataatatttcatgacatcattcaatagctctagatgttctctaccataatattaatttagaagttttttaacaaaattataaaaaagttatggtcataaaatttcaacaagtcttgagtcaaaattttttggccagatctttcgaccaatttcgaacgacgtgaatttgaacaaaagttcgaaaattcaaaaaatacgcgagatcaaaatcaactcattaatacttca

SEQ ID NO: 80884 - DNA, 2280 bp, Heterodera glycines
  misc_feature (2257)..(2257): n is a, c, g, or t
  Genomic contig location: Contig_ID=SeqID_16477; Location=119..2398; Strand=-
  SCN-specific regions: Sequence locations=1-202,224-260,282-451,479 -1279,1302-1419,1442-2122,2144-2280
  Gene Ontology: Mol. function=myosin light chain kinase activity
atgggacatacaatgaagagattgacagagaatttatggacaactgagaggccttcaaaagttgaatatgcatggattggtgaaagatgtgagacaacagtgaatgatttcattgagaaaggacaaggcggaattctggatttttatttggtaacatcgtttggacataactttaatccgtacaacggatgggaagaaggacaaaaatggacatttatttgggaaattccggaaccaagtgaggcttattgggcaactcatttccctgtcggtgattttgtggcagaagtaacggagaacgcaattgtgttagaaagcgaacaaagcgtgttttattttgaaaaagaaaagggcgatgaaagagagggtattgttggcgtaccagacgaggcgtataaaatgtcaaatgacgttttcattctgatacacactccgagtccacaaaaagcgagagaaaaaagggaaacaaagcagaaaagtgaacctcagagaaaagagcgaccagcgaaacaggaagtgtttctgaaaatcaggccgggtcaaaattcaaaatttgaaaatttggacccagcgtccagacccaaaagcaattggacacgaacaactttgagtcctaaaaggaacacaacggagctaataattttgagtaccccggttccccagtccacaagcacagtggggagtacgacaaaagtaaccatggcaattccgaccaaaattattacaagcacggttccaacgactataaggcctaagacagaagtcaaaaaaccaattttcgagaaaattcagataaaaaatgagcaaaaaactcagtcagtatacaaggcagttgggaaaaaggtggaacaattggtagctacgacaactaaagctccttttacaacgactaaaaaatcgaaaattgaaaacacactgaaaaaggcaacaccaaaaccaaaaattgtgggtttgaagagcacaacgcagaaggttcttagcacagttagaccaagcactaataaagtggtcaatgagctttttccaaagtcagttacaactccgagtacaattttggcagtaaaaagcgcaaataattccaaaaatttttctaagcatgtgctgggtaaaaaaccggaggttgaactgaaaaaggccacaacagcaagtctatttccaaagacaattaaacacacagaaccaacaatgaatgtgactgagattccagcacttatgactccaattcctccaaccactcaaaaaattgtggaaaaggtggaattgccgaaagagaaagtggaaaacaaatcagacagcattaaagctgaaaagaaaaatgaaaagttattaattccatccacggcaattacggttgtgaagaaaattgaggacgaaaaagtaagagaagtgtcggaaaagacagtaaagaataaaaagagtgaggaagaatacagtcaggaagttgaagctgaggtcattgagagcttagctaatgatggcaatgaaatggaagaatttgaaaattcattcgaggatgaaagcgatgaggaagttagtgtggaattatccgatgagattgaaatcttcgacatggatcgaagaaaaagaacgacagttacaacacctgacgcccggtggattaaaaaagttgagaaaagcaaagtgcgaaataaagcaggacaggaaaataagaatttgaatacgcgagtcaattatgcattgtatcgactaaatgaggagaaaagaaggcaatacgatcatatttataaacaagcgtgcgaaaatactaaatttcagctacaattggccaaagcggttttacaaattaatccaaatgagggagtcagaaaaatatttaatcgagacgatttagtggcacgatggaaaggagataatttggaagttggtttttgtgcaccggttacaccagaaaaaatattctgggacagaaaaatggggaacgattgttacgaatggataccaattttcgcagaaaatacaacattttttattcggccgggtaccagagaattgagcattataggcaaaagaatggagtgtacagaaatggaaaaaaccaataatatgaacaatgcgacacaaaaggaaattgttcaaagattaactgaaaatttgggaaacattaaaccgaaatacagaaacatacaaaatcctttggtcctgagagcgggagctctttttgaatcggacagcttacgtttagaagaagcgatgcgagaatatcgctctaaaatgaacaatttgccattgtcaattnttgagagttgttcagagacctaa

SEQ ID NO: 80885 - DNA, 1089 bp, Heterodera glycines
  misc_feature (992)..(992): n is a, c, g, or t
  Genomic contig location: Contig_ID=SeqID_16478; Location=82..1170; Strand=-
  SCN-specific regions: Sequence locations=1-86,109-207,229-524,546 -597,627-637,660-795,817-1089
atgaaaaaacaattgtacaaattaagaaatgaacaagagtcaaaaattatttcccaggggcaaaattcagttaacaaatttatccgaaataagttatcaaaattttttgagattcctactctaattgataatgctggaaatatgttttccagcaatgttcaaaaatgtaagatattagcagaaatatttcaaaagtcttttttaagaaaatcaattgttaatggtccacaaactcaatcaacacagaataagattaaactttctgacattgaattgaatgcgggaataatttggaatatattaagaagacttccccggcgtaattccacttcaccggataatgttccttacattttattaaaaaattgtgcataaccaattacaaaaatattagcagatatatttaggcaattttggattccggtcaaattccggaaatatggcgaacatcattatttgtaccaattttcaaaaaaggcgaaaaaactgatccattaaattacaggccggtttcattaaccagcactgtctgtagagtttttgaacgaattttgagtagcaaaattttagaatttctgaacagtacaagattctttgataaagaacaatttgggtttttaaaaaatagatcgactacaacccaaatattaaaaatgatggacgatatatataattctctacaaaaggatcaacaaattgacattatctatattgattttgtcaaggcgtttgattctgttctaattgatttattacttcaaaaaatcaaaaagattggaattgaaggaaaaattcataattttttaactaactttttaaaaaaatcggagttttaaggttaaaattggcgaagaattgtcagaaagtttcagaatattttcaggagtgccccagggaagtgtcttagggccattactctttttaatttttataaatgatctgccgtcctttattacaattgaagcggcatcagttggcataaaaatgtatgnccgatgatgttaaattatattatgcccacgaaaatgatgaccattcgaatcagttggataaagcaattgaggctttggaaaaatgggcaaaaataaa

SEQ ID NO: 80886 - DNA, 1283 bp, Heterodera glycines
  Genomic contig location: Contig_ID=SeqID_16478; Location=1394..2676; Strand=-
  SCN-specific regions: Sequence locations=1-481,505-796,830-1154,1195 -1213,1235-1283
atgattaccgaggcaatcatcaactccgaacaactgaaagagaagtccactcgtgcggtcatcgaaaaattgccggaggcgatggaccaacaggcagtggtggagcaatttgcagaacaatgcggtgtcaaagacaaattgtcgcccgacattcaccgccacccaaggacacggcctgaaggaggggtaaaaagggatcggattttaaaagtgccgttttttggacaaattttcacgtgacaaatttctctttaatttccgtaatgctgtgaaaaaattgcccaatgtgccccaacatatcaaagtccaaagggatatgacccaaagtgagctcaaaatcttatactcccttcggcaacaagcctatcaggccaatattgccgcaggtgagtataagtattttgtggttgacttggagatcagatctctgaaagacccccgcccgctcagaactcgctagggatacgcgagcaaatcaaacaaaaatattgggaatatgggaaagaaaaatccttggatttcttgcctattaataaacgtccgatcgataacaaataaaatagttgacatagaacttataacccaaaaatacgatccttttataattataataaatgagacctggttaaacttcagaaacacagtagaatcagaatttacagtaaataatcaatatcaaataatctttgcaagccgaaatgataaaaagggcggaggatcggcaattttattaaaatcaaacatcccttatcagacacttttctctgggacaaaattccaaagcgaaattattcacataaaattactttttaaaaaacctattcaaattataaatatatatcgtccaccaaattgtacattcagaatactaaaaaactactcaaattcatttctgaccagagcgattctgaaaataccatattctgtggtgattttaatatcccaaatatattgtgggatgaaaataaggtaaaaaaaataaaagatccggcgtctaattctctatttgagtttatgcaccaaagacaattgatacagcatgttaaggaaccaaccagagaaaaagcaattttagatttagtaattactagtgaattagaattaattaatgaattgacagttctagaaaatttttcaacttccgatcacaaaatggttggatttaaaataaaagtaaaattcagtcataaaaatcctaaaatttacagaagagattttaaaaatattaatttttcgaaattaagtcaggcgttacttgaaaatcgaattgatttatcaataaa

SEQ ID NO: 80887 - DNA, 1647 bp, Heterodera glycines
  Genomic contig location: Contig_ID=SeqID_16480; Location=1..1647; Strand=-
  SCN-specific regions: Sequence locations=1-456,478-597,674-1067,1089 -1090,1128-1434,1457-1647
  Gene Ontology: Mol. function=NADH dehydrogenase (ubiquinone) activity; Cellular component=membrane fraction; Biological process =mitochondrial electron transport, NADH to ubiquinone
tcatacgtgtgcaaggggggggggggtcaggaaaagggtcgtgcgttcggcgatgaccccccctagtgggggtcagcgtcaaattttttgcggccgaccatttttgccccgttgaagacctcttttttttttgcttttcaatacttttttttgcggaggccttttgtcagcggccggccaattttttgcgcgaccattttttgcatttttcatgtcagtttttttgcgttgcacttttttcgaaaaacttttggggaacgggcggttgggtcaggcggtgccgataggcaccgccgagaaaatttttgaaattttgattgtgctttgttaacagattttcaccaaaaaatgacaacatttttgcgattttgggtcaacttttaagagaacttaggaatttttattgagatttaaaaaaataggcaagattttaggaattattcagatgtcgaacgcagaaaaattggaaaattttggccaaatttcttagggaaatagtcaattttcaagtctccacttttgcgttcgacaaatcgccctcatgtcagggttagtcgaacgcaatgcacgaccctttccttgatctcgccgctcccttttctctctttctcccttttttctttcccttttctctctttttttttctttcccttttttcctttctcccttttttcacgaccccccccctgacccgcccccttgcacagctatggtcacagtttcactttaggtccaattatctgttcaatgacaaaattgcaaacattgagaaatgtgatgcacttttattggttggtactaaccctcgttacgaagcacctgtgctcaacgcccgaattcgcaaaacgtaagtgtggaaaatgcctcaaaatataagactggtaaaaaacggattaaattaatttaaaactcttgtccaatgtttgcagacgcatattttcttataagttaattttgttagacaatttcttaaactatgtttgcctgtttacatatgcgaggatgttttacaaactcattgggagacttcgtaccatgggaaaaaatgtaaattcgagtacttgccctaatataatttttttttaattgctttgaaaatatgtatttttcctttccttcctctctttcagatatttgtattcggacattgaaattggccttatcggtgcgaatgtcgacctcacttatgactacacttatttggggcccaattcttccgttttggacgatcttttaaatggaaagtcgtcattttcaaaggtttttttcttcccccattattttcacggtcagtgtcaaataagaaattggaaaatgcgaaacatccgatgattgtcgtcggagcacaagcatttcaaggcgaaaactcctcgtccctccttcaaaaacttcatcaattggccgaaaaactccgttcaacttcacagacgaaacaaaacaccaagggtttggggggaggtgaagccatgggcaacgccgtatttactacaaacattcaggcaacggacagccgaaagtgctcaatttgcttcatgagttcgctggccacgtggctgcgtttgaccttggcttccgtcccttcaatgaattaaattcggaagtgaagagatccatcaaattgctttatctgctcggttctgatgaaaa

SEQ ID NO: 80888 - DNA, 646 bp, Heterodera glycines
  Genomic contig location: Contig_ID=SeqID_16482; Location=389..1034; Strand=-
  SCN-specific regions: Sequence locations=1-336,358-489,516-605,628-646
aatctattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 80889 - DNA, 1450 bp, Heterodera glycines
  Genomic contig location: Contig_ID=SeqID_16487; Location=112..1561; Strand=+
  SCN-specific regions: Sequence locations=1-20,42-164,262-1033,1056 -1353,1390-1419,1441-1450
atgcattttactgcaatagttgatgctttttcaacaaattctcaatgctggccaagtcccgaccgtagtcttcagaggcgagcagtgtttcgacctgaaaaaatgaaaattgtataaaaaatgtttaatacattggtaatatcaaaaaacaatttaagagatagaaaaattagtaataaaaaagtaaaaaaaattaactaattaaaaaataaaataaaaaagtttttatcatttttatcaaaaatgattttaaaaaaaaatcgcatcattcaaattgatgtttttaaatagtcaaaaaatatcactaaatctcggaattcagtttaaaaaaatattcaaaatccttaaattcttaaatttaattgatttatttgcggcaaaaactaatttgaccgctagtttcttaaaattcttcagaaaatttgtaattttatggcgtagtgtcacttagattttcataatttttttttgaacttttgcagttaatagagaacatttagggctatcgaataataccaagaaattaaaaatttggctgctttagagcaaagttataagtagggataacatttatagttgctaaaaactgccaaaataattaatttttagtttctaaaaaaccccaaaatagttgctaaaaatgggtaaatagttgctaaaaacttcaaatttatgggggtgtaaaatcgtaaaattttaccaaaaaaggcaacaaaattaattcgaaccagtattgagataaataatttttaaaatcacaaattcatgtcaaaaaataaataaataatttggagatgaatttttgagaaatttttcatttcataggggtgcatttttgaaaaaaaatttgagtccattcttaagcgtttatttttgaaaattttcaaaaagttgatccttaggggtgtattttttctttttattgcatttttgttaacaaattttgggcataacgccaaaatagttgaaaatagtttttttcaaaaattttatagtttttttagttgctaaaaataaaactgcgactgcgaagtttaattttattatatttttaacatttttgaaagggattttgaaaaacttgacagctgtgaaagtgattacagataaaaaatgtacagcgataccagtgaacagtattgagaacacaggctaaaaaatatcaaattttcagtatacaaactgcaaagacgaagccaaaggaaattaaagcgattgataaaataattgctaataactcgaaaagtagcttaacgacagccgaaaaaaacatgtttttcgtgcatttcaggctacggggagctcaggaaaaaaatagtgaaaaaattataaatgttatccctagttataagcaaaatttttataaattttgtgaattattataaaaatcaaggcattttcgtttttaacattaatgtcaacaaaacgagaaaaaattgaataatattta

SEQ ID NO: 80890 - DNA, 930 bp, Heterodera glycines
  Genomic contig location: Contig_ID=SeqID_16488; Location=87..1016; Strand=+
  SCN-specific regions: Sequence locations=1-119,211-298,332-366,388 -403,440-509,535-623,646-769,810-930
  Gene Ontology: Mol. function=ATP binding; Cellular component=nucleus; Biological process=negative regulation of cell proliferation
atggaacgcacattcatctgtttgaggcccacaaatccgtcgccggttggacgagtgattgcccgctttgagtctaatggactcaaattgatcgccatgaaaatggttaaaaatttaggattttttaaaaatataaattatattttttttcagtatttaaattaattaaatctttttaactttttttaaattatttaaattaaatttttagattaacgctacacgaaatcaagcgactgagcattacaaagagtacagagacagaccgtttttcaacaaactgatcaactacatcacgtcagggccagttgtggccatggtctgggaaggtgattaaattggaattttttttttaaatttaacctattgggtcaaacaattttattaaatctaattcaaatggaaaaaatatcataaaaaaataaaattattaaaaaaacaaaacaatattttcataaatctaatggttgccaaataaaaatttgtcagcatataatttttcgtgttaattaaaaagtaatttaaaaaattagtaggacacatcatttcaaaatttaattcaaatggcaaaaattaaaaattaaatcacaaaaacaattagaataaacttgcattaaaaatttaatataatggttgcaaaataaacaattttcattatttatttctcatattaattaggaattaatttaaaaattaaggaattgactcagtcaagaaaagtctgcatctgctggagtcggcatgtttctacaatttgagggtgaatttgatttaaaaaattagaaaaatttttttattttattattttagaatatggatgagtgccgtgacattgtgcgccatggttcgtgcaatgtgcaggacgcacaacgcaaaatcaacatttggttctcaccaaatgagttgcgcattaattccacaagcagataa

SEQ ID NO: 80891 - DNA, 320 bp, Heterodera glycines
  Genomic contig location: Contig_ID=SeqID_2649; Location=1..320; Strand=-
  SCN-specific regions: Sequence locations=1-320
cggagtaggacaaaacgtcgtcagccgaaacgtcgtcgaacgaatttttcgaccataacttttttctttctcaaccaaattaaccattcttggtattattcgaaagcattcgaaaaatgctattagcctgcaaattttcaaaaatttttatttatgcacaaaaaaatcagagcaaaaaaagttcgaattactgggtttttgagttccttctggccataacttttttgaaacttaaccaaaatttttgagattttgcaaattaataataaacacatagagctatcgaacaacaccagcaattcttaatttgattgacagtg

SEQ ID NO: 80892 - DNA, 1130 bp, Heterodera glycines
  Genomic contig location: Contig_ID=SeqID_2651; Location=60..1189; Strand=+
  SCN-specific regions: Sequence locations=1-87,109-456,478-505,535-1130
  Gene Ontology: Mol. function=transcription factor activity; Cellular component=nucleus; Biological process=development
atggccgaattggcagcgaaaaatttgatggcggcgaaaggggcgacggaaagcgcaagacgaagcaacggcggaacgaatgcgaacggtgtggtgggcgcggggggcggctcaaaaaagaaacggcgccatcgcaccattttcacacaggcgcaaattggtaaggaaaacaggcgaaaatggcacaaaatgaaaagaaatgcaaatgccaaaaagtcaaaaagcaaatccaatcagtaaatcattcattgctttgttattttctgaatcaaattctgcattgattcatcgaaataatttcatggcacttttgagatgagttggaatcggtgttcgaaaaggcccactatccggatgttgtgcaaagggaggaattggcaaacaaaacgcaattggcagaagatcgaattcaagtaaagtgaagtcaaaagaggaaagagcacaaagatgggcctaaattaaggtgtggttccaaaacagaagagcaaaatggtaaaaaatagtgaaaaattaattaaatttcttttaaattaaggcgaaaaacggaaaaaacgtggggaaaaagcacaattatggccgagtaagtgagaaaaagaaggcaaaacgaattgagccacccaaaagatacggattatacggggcgatggtccgccaccaattgccattgcccgacaccatcacgaaatgtgttggcaatccggacgacccccaagaatcagccgctccctggcttttgggtacgttcactgctcctccatcgcaaatggcattttcctatgccaaaacattttgaaggaatgcataagaagagtatggaggctgccgttcaatttgatcagatcggagaccaccaggacattgatgagatgggggaggaactgaaggcgatggtcgtgggaggggtggggacgaagtgcggcgcgggggcactgatggaattctcggaggacgagaaattcccgaaggaagagcagcgcaattgcagtggccaagggcacgagaagaagcggagaccgcacgggaaatacggcggcaagggaatgccaacggcgaacaacgacagcacattggaaacgcaattggggggcggcgacagtcgccaatacatttttggaattagcggacaataa

SEQ ID NO: 80893 - DNA, 269 bp, Heterodera glycines
  Genomic contig location: Contig_ID=SeqID_2651; Location=4625..4893; Strand=+
  SCN-specific regions: Sequence locations=1-269
atggctctctgcgtggcgatttatgataagcatgtgagtgagtgtttgtttatttgttcgattaccattaattgctcccaactttctctttttaggatgccctcctctatttacgcctcaaagatcgaatgtccgcttctcccttggaagtccaacgtttcctgcacagttcgtgtgacattgttgcggacaaaatgaactcccctggtaacaaggccacccaacaggaaaattttctcggtgcacttcttttgagtgatcgctttcgg

SEQ ID NO: 80894 - DNA, 624 bp, Heterodera glycines
  Genomic contig location: Contig_ID=SeqID_2652; Location=507..1130; Strand=+
  SCN-specific regions: Sequence locations=1-25,48-67,89-486,508-624
atgtcaaaacccggtggaattgtacgcatcaaaaatgtcagtgatttcgtcgagccaagtcaggttagctgcaattttgtaatgttttgaccggaacaattcaaaaaaaaaccctgaaatttcatttgaagcggattattaaatatcaaatttcgaatctgaccatgagaaagtcgctgacattatattcgtttagaaatgcattcttccacttcgtcaaaacggggaaggccaaaaggctgtggtcggcaagcgattggtcggaatccatgccaaatccgtcccctccgccgcgacggccaaaagggtcaaagtgacgctggacgactgtttggtgtgcagcggttgtgtcaccacgggggaagtcgaattcttctgaccttccatttttttgtttttcttttcatggtaaaaaaatgtgaaaattttattatgcagaattgtatttgtttaatagtaataataattaaatcgtgattcgatcatttccatttgaaagtttgatttggtacgttcagccaacattttacttttcttcactccgaaggccacacaattcgcacgtcgcgctgtgttaagagaaatttatggtggttttaaagtttaaacattcctctaaaacaa

SEQ ID NO: 80895 - DNA, 398 bp, Heterodera glycines
  Genomic contig location: Contig_ID=SeqID_2652; Location=1..398; Strand=+
  SCN-specific regions: Sequence locations=1-344,366-398
ttatctgacaacaccggtacgaagttccttttggtcatcgatgcggaggagggcactctcaaagatcacgaaattcggctctttttcaaaaacattcacacaaaatattgcagcgccatttcaaatccgttttattcgtttggaagtactttgcaatccaggtgatcatctccttttgcaatgtcactgctattttggagggcggaaattgaattggaattgtttcgccttcccccccccccatctcctaatcgtttttcaaattagaattccctcttttagtaaaatagatgccgtggttaacgaactgcttgcatccttttgactgttcagaaaagcagtaattgatcacagaaaagagaactattgcaaataaatataaattattttcttttgag

SEQ ID NO: 80896 - DNA, 1691 bp, Heterodera glycines
  Genomic contig location: Contig_ID=SeqID_16490; Location=891..2581; Strand=+
  SCN-specific regions: Sequence locations=1-204,232-419,441-486,508 -627,790-867,889-1360,1398-1458,1480-1490,1607-1691
  Gene Ontology: Mol. function=pseudouridylate synthase activity; Cellular component=small nucleolar ribonucleoprotein complex; Biological process=N-linked glycosylation
atgggatgtatggaaatgcacttttgtcgcgttgactcgcacattgaatgcctgtacaacggcggtgcaatccttcggatgtgcgacgaatgcaatggcgagcagttgtgcaacgcgaaggagggggccaagcttgcgcaccattccccctcgcttgccgcctttttgcgtgaccgattgcagcccgtagttggacaacaacaatggctgcagcagcagcaagctgctcatggcatacatcaggctgctgcgaatgcgatgcaataccaacgcgtacacccggcgcccaaggctgcagcggcagttgctgcattttttccacctcatgcaggctcagttcagcagttgcaaccacctgcagctggtggttcagtgcttacgcagcaacctgcagcagcgcatgccttaagccaagcacaagcagtgcagaagcagcagcatgcaaatggtggtgcaaaaggattgcaacatcctgcacatggttcaaacattttgctgcattctgcaagtggctcaaagcatttgcggccgcgtctaagatgcttcgtgggcagtgaaggtcaattgcaattggtcacatgcagccaaagcgagctgtgcacgagcagtttatgcgatactggtaggaaaaaatttttttattaaaaaaatgaataaaaatcccaattattatgcaattttatcatgaaattttttatttttgcaatataaataataatttttttattttaaaaataaaataatttaaaagttaaaaaaaactattttaaaaattaacaaatattttttcagttacatgcaaaactaccttcaaaaaatgtgcaatttttttacatttatatttgcatattctttgacattgttcggttgccaaaaatttggcacttttacattagcataattttttatttacaaaattagtagatggcgaattgacggaggtgaagttctgtggcgtgccacagttttgcacaatgacaaacgatttgtgcaaacgatttaaccgtggcatttcgttgaactgttcgcagtgcgacaccgattcgtgcaatgggaacagcgcgttcgcactggcatcattggtcaaccacacttttcgggatatcatggccgcaaaaatcaacactttgacagcactgaatggcacaaaagtgtcaaagaagacggaggacgataagaaaagcaacgacacaacgccaaatgtttgtgtttaactagagccagaactttgagaatatccggaacagggcccaggtttgcgagtcagaatccggacagaatttcggttaaaaaaagttattttaacaggacttcgggtcatgttgcatttttgaaaaaaaaaataccggacccggtctagggcccaaaatcttgtacaaaattctttccttccatataaaaaaaattaaaagaaaatttaggaaaccaagatgaatgccagacagaaaaaaaaggaggaggaagaaataaaaaagaaatttgaagagatcaagaagagagaggaggaagagttaaaaaagaggaaggcagagaaagagaggaaggcaaaagagaaagaagaagcggagaagaaggagaaagaggaaaagaaggaagagaaaaagaacagagagaaagtgaaaggaaatgaaaaggacaaaaaggagggagagaaaagagcagaagaaccttgtagagaatcggtgttacaa

SEQ ID NO: 80897 - DNA, 811 bp, Heterodera glycines
  Genomic contig location: Contig_ID=SeqID_16493; Location=464..1274; Strand=-
  SCN-specific regions: Sequence locations=1-76,117-447,525-566,589 -736,794-811
atgcctcgcttctgtttgttcggcgactcggtgaacaccgcgtctcggatggaaacttcttcttccggtctgtttcaaaaataagaattttttttaaataaattcttttttaatttcagctaacaaaattcacagttccaaggaaacgcgcaatttgttgctcgaaaattctaattgcggttatataattgaaagcagaggagaaatgatcattaaggtgagaaccagccgaagaaaaaacatttgttttggtcattaatttaattggcatggtaatgaatggatttttagaagcctttgatatgaattaagggctttataaagagttccaaggtttttttcatcttttatttcgcgaggcgaccaaaatgaaaaaacttttataaaaattgctctatttttcaacaaaaaagtaagagagagattgttcgtcctggcgattgagccaaaattaaattttgtattgattaatgaaattcttttttatttttttttgaaatacttttatttatttatttttatttggggaaaaggtgtaatggaaactttttggttgttggacaattcagaaaatggtggtggcacaatggccataaattagaagacaaaaggcaatgggaaaagacaacaaatgggaagagaacaaggaatgatggcaaattaatgccaaaacggcaccaaattatcagcagagttggataggcaaggacaacaaaatccatttgaagcaattcatgttaagccccaaaacacaaaacaaagcacatgaaaaataatttaatttttaaattttctaaacccctaaaataaa

SEQ ID NO: 80898 - DNA, 1794 bp, Heterodera glycines
  Genomic contig location: Contig_ID=SeqID_16494; Location=530..2323; Strand=-
  SCN-specific regions: Sequence locations=1-172,194-237,259-439,469 -554,579-1069,1091-1109,1139-1277,1309-1346,1369-1397,1419-1506,1530 -1626,1649-1677,1699-1794
  Gene Ontology: Mol. function=serine protease inhibitor activity; Cellular component=cytoplasm; Biological process=regulation of proteolysis and peptidolysis
ttctcgcccaacctctctggaccaatttacgaggaaatttaaaaaattcaaaatgccttaattatatgaaatgttttgtttaatttcagcttggtgttggtcaacgctgtctatttcaagggcaattgggcggagcgattcaacgcaaaatataccaagaagaagacattttttgtggaccaacagaacaaaaaagaggtggcgcaaaaaaacgattggaaagactcatcccaatcttagaaattaagtctttcaaaattttacaaaatttggcttaaaaatttgacaattttgtacagcgaattcaccaaaaattcagagaaaatttgcacggcggcggctcggcaaactccaaatgctttaaatgaattaaaacgaaaccaaaaattttttgaaacttgaacacataaaaccgtaaaatttgtaaacactcaaatggattaaaaaatgaattattttattttttttcagttggaaatgatgcacaagacagctgatttcatttattttgaggatggccatgttggtggtgtttgccgttttccattgtccccttttctttaaattgtgtcccttccttaatttgaacagctccaactgctcggcatgccctacaaaggtggtgaagtgttcatgtttgtgctgttgccgaaggatcgctttgggttggctaaactgttggccaatttggacgggaaaaggctgctggaattgaccaaaaagcgggacaaaatgaaagtgcaggtaaaattatgcgccaaatgtgtgcttggcgttatgtttgatcatttatttcgcaaaaatctatcattttatgccattcatccccccgtcttttcaggttgtgttgccaaagttcaagttggagtccacgctccaattggaacaatcgttggccagcatgggaatggcgaacgctttctccgacagtgccgattttgacggcattgccgagggcgattcgttgaagatcagcgacgttgtgcagaaagcattcattgaggtgaagtgaatgcccaaaaatgaggtcatgcccggtggggggagctgctctatttccgagctgatgaaactaaaatattattattatctttcactaacacgaaacgaaatataaatttagaattaatttttaaatccgaaatgaaacgaatttggcacatacccctgtttacgaggggagggtacgtgcggcaacacatccgccggtgttcagcgggggttgaaaccgcggacaatccatccgtcagtggaataattatttggaaaaatgatggtttataaattttttattaattaaaattttttccattttggcttttctgttaaaacattattcaaactttcatcttttctttgcttcttttcacttgcttttataactttatttatgtttactgcttaatttgtccttaaatttccctgcatttccaatgcttttccttttgtctctctgtgctaaattttgcttagtttatccactaatttctgtcttcgctttgctattgccttgccttctcttccttttactgaattttttccctgcaatgcctctgctgttaatcatatttatagcactatcagtgtcatttagtaattactctgtccattcattcatttgttaggtcaatgagcagggaactgaagcgaccgccgccacgggcattcgattggtgccattaataaatgccaaaaatagcccggctcgtttcattgcggatcgtcctttcttcgccgttgtcgttaacagtgatgcccttgccctttttggcacaattttccatggataatttg

SEQ ID NO: 80899 - DNA, 324 bp, Heterodera glycines
  Genomic contig location: Contig_ID=SeqID_16498; Location=263..586; Strand=-
  SCN-specific regions: Sequence locations=1-227,250-324
gtatccaatggcttcacttcgttctcacttaaaaaatcaccatcaaccaaaattgaaagaattggaagaaaaagataaggctgcagaaagcctcaaaaataatgaagcgaacccgagacaaccgacgttaaaacgaatttttgcgacttcaagtccagtgattaaaaaaatagcgagggctgaatctgctacctcgtcgcaattaaccatcgaaaaaaccttttgtaggaatttaattttaaatgaatttacataacattttcagctcaatggacacccgacggagaaatgactaagaaaattgacaaggcaattaacgatttg

SEQ ID NO: 80900 - DNA, 101 bp, Heterodera glycines
  Genomic contig location: Contig_ID=SeqID_16499; Location=128..228; Strand=-
  SCN-specific regions: Sequence locations=1-101
atgatcaccgcgctcgcatttgtgccaattcagcatttgactgctgcaattactgcgctgaacgatgtcgtgggacaagccctcgagggaattttgggatg

SEQ ID NO: 80901 - DNA, 289 bp, Heterodera glycines
  Genomic contig location: Contig_ID=SeqID_16499; Location=797..1085; Strand=-
  SCN-specific regions: Sequence locations=1-289
atcggcaaattgctcttagcctatcgcattatgatgattcaacggtaaatgacgcacaaattgcggaagccatgggtaaagcgtggcaggagcaagcggatgccgaattagctagacgattggctgatcaactatagtgtaataataatttgggcagacaatttttaatgactaacaataacaagttatccaaattaataattaattaagaattaagaaaaaaagccaaaataataattaaatgctcggtcaataagcagtcaaaaagatagatcagaacgaaaataaa

SEQ ID NO: 80902 - DNA, 630 bp, Heterodera glycines
  Genomic contig location: Contig_ID=SeqID_16500; Location=35..664; Strand=+
  SCN-specific regions: Sequence locations=1-164,191-231,316-630
atggagatcaaaatggcaaaaaatagtaagtttctgcgaaaacggctaaacattttgtaaaatacaccccccataattcgggatttaaaaaaatgaaaaatacacccttaaaaattgactgataaccaaaaatacacacctaaaaatcgaatttttaacttcagcccccaccccccccccccccccccccgaagcaagggcctggctaatgtgctttaatttgttattggcatttttttttgaatttatttatgtattaatttgctttaatttgttattggcatttttttttgaatttatttatgtattaatataacttcgcaatttggcaatttttcagcaggaattgatgcttgtccttgttttatttcatctaaacagattgggcattcatcatttgttgctgttttatgtttcgttggagcggtgacaacggcattttttaattttttccatatctttggagccgtgccagcggtatgaataaatattattatgatgcatagaataattaatgaatggcaaatagacatcgtgaacaaattgttaaatataattaaaatgacaattttgggcaaaaaaatggttcaaaaaatgcaaattgaaaaatggacaaatcgaagctctata

SEQ ID NO: 80903 - DNA, 382 bp, Heterodera glycines
  Genomic contig location: Contig_ID=SeqID_16501; Location=647..1028; Strand=+
  SCN-specific regions: Sequence locations=1-232,255-382
atggctgccattgctgcccataaaaagccgtggagaaagcttgttgcgactgccctgcacgagggaatccattgtggtgcagtttacctgggtggttgttccaagcgagataatatctgccgagcgatggccaaggcctacgggaaaaaagtgacgccacaatttgacgctctgagaaagattgtggagaaggcgtttccttttgtcaagccccatctggacgtatacgaatgtaaaagaaaaatactaaataccatttacaaagagattgtttatagaggagctcctccggcgacaacggcagttgtgtggtggtggtaggtgttggttgtgaaatgggggtaggtgttggttgtggaaattttaagagaacaacaacaaa

SEQ ID NO: 80904 - DNA, 1131 bp, Heterodera glycines
  Genomic contig location: Contig_ID=SeqID_16501; Location=1097..2227; Strand=-
  SCN-specific regions: Sequence locations=1-73,95-205,244-400,423 -911,934-1003,1038-1131
atgcctccaccgtcacttgcgccacgaagaacatcaagccgtctcagccatacaccatctctattttcaacgcccgtctcttcgagaccatcctttcttccaataacgtcccaatgtgcatcacggcattcttcacattttggatatggttgcggggccaaaagtgcaagacatcttccagaatattacgattccttgaaaaatgtatttaaatatatttaattttgttaaaaaaataatttaggaacaaatcagttgtccaaagtgtaatgcgctattgttaccgtcagaagccaaagggccaactgcattctcaaagtgttgtgcaaaaggacgtgtgtctctcatggagcgcttcaacgatctgcaaaaaaggccttcaagcattatggcactttttaacaacaacgacacaacaaacattcgttggcattcccatctcacgcaacattcaatggcatacaacgacagccttgcatttggttgtgtgcggattcagcgagatccaaaactgcaaaattccttccggatcgtaaagtgcaacaacatgattcgttacgttctctgggacttcaatgcgccaaaggacgatctacctcaattgcacggtcaactttttacaattccgccagaacatgcacgtctacgcttggatgaaattgcaaaagaaaagcatcttgatgtaaacttattaaaaaatacgacaatgaaaaaggcttttaggaaaacctgcttaactatctgcatgctgttttgcgtgagcatcatccttacaggaagatttatttgacagctgcgcaaacatttaaagcactcaatgaggatgaaaaagtgaatttcaaaatgttggttgttgacacgaacaaaaagggcgaggaacgatgtgtcaagaccaattgccaaaatgatgatcaactttgctcacaagaacgacaaatttccgaaattcatcctggtcgaattaatgtcgaaactgtcgcaggcagtaagctggtcgcacaggtaaaaatattttttaattaaaaaataaaataattgtagtttttccttgactcgggagcaaacgtgccaccatcccatgaatacgacattattttacgaggaaaacacggaactggtcaacacatttga

SEQ ID NO: 80905 - DNA, 1837 bp, Heterodera glycines
  Genomic contig location: Contig_ID=SeqID_16502; Location=376..2212; Strand=+
  SCN-specific regions: Sequence locations=1-236,260-357,380-531,566 -581,609-932,954-975,1001-1169,1192-1567,1590-1785,1808-1837
atataaatgcaaggaattggaaagtgaaactgtcccagtttgggcgccgatattcaaatcaaaactgtcggaaaagcatttagtgtaccttggtagaaagctgtcgttggactcgtcccaaatgggccaagtcggcctttggtttggcaacgatcgaatggccaatgaaagcgaattgtcgcatagactgcgcattctgagcacaaacagcgaatttgacaagttgaaagcggtcaaaacattcatggaactctttttgatgcaaaactcacacattggcattttggtggtgcgtcatccgctgacattttcggcaggtgaatgaatggatgggtagtggacggatgccgatttgcgatttggaacttttttaaggcattggaattccaattttttggggaaggggggggggggttcggattacgggtgaaggggtgctattgcgttgattaaaaaccataattgcttataccttttgaagcttaatgaaatattttaaaagttataggctaatagagaatatttagtgctattgaatgatattaaaataaaataagttactttagatcaaagttagcaaaatttttatgtgataattttttaaaatacgccctttataatatgttggacccgcccccccccccccattctctttgtcagtggttaccgtaattactgagaccaaggagtaacaaattcatgagggagtagtaaaccgataagtacggtatttggttccatctcctaagggattaaaagattaactggaattttgtttttttaaattcggctcatgcgaccctattaaaaataatattgtaaaattcattataatccacagaagtaatgcgtgaaaatgaattgtttatatcggtcagcaatctgttggaagcaaatatgaacacttcttcaaatgccgttcgatggctcgaattttattttattttcggaaaaactttctcttatttcaaacaaatttataatgatgaagttttaaagacgaaaattcaaaatctgtgggaatttttcaccaaagttttgaaaaaagtgcaggaggaacagcaaacattatcagtgaacgaaatgacaaattcaatctttcaaattttatcgcaattagaaaacaattttggcacaagaaaattggggcaaaagagtgaagatttgttcaaaaaatatgcacaacatttgtcggcattttacaaagaaaatgaatcatttcgcaaaaaatttgacagaaataaattgggaagagaaaacataaaaaagatttttcaacttattgaccaaagtcaacgaataatgccacgcaaattttgggaacttttcgataatgcaaagaacgaattccacgctaaaagctcgtcctatttggcatgtccaagtggatcagaaatttgggagaagcctacaaattcatcagaagattcttccgagtgtaattataactagggatagtatttttaggttttagcctattttttccctgagctccctatgatctgaaaggcacgaaaaaaaacctttttttggttgttgttaacctacttttcaagttattagcaactattttatttttataatttttagaacctaaaaaactaaaaatatttggacctattttgaggtttgcccaaaaatttattaccaaaaatgcaacaaaaacgaaaaataacacccctaagaatcgaccacaaaaatttcagaaaaatacacccttaagaaatgaaaaattttctcaaaaattcatctccaaaatttattattcctttttaggaatttttcgtttaaaaattatgtatctcaatacggggttggcttaatttgttgctattga

SEQ ID NO: 80906 - DNA, 1924 bp, Heterodera glycines
  misc_feature (668)..(668): n is a, c, g, or t
  Genomic contig location: Contig_ID=SeqID_16504; Location=1365..3288; Strand=+
  SCN-specific regions: Sequence locations=1-969,991-1406,1428 -1846,1868-1924
atgttccccgatgacgatggctacgaatcggaagatgatgaaattctcttgccacctccgccgatccccccgcaacttggccaccctccgccaaatgtgccggtaatttcggtttcgcttttcgttgctttttctcaaatttccgagtgcttttttcaggcagttcgtgttcagccaatgcatgttgggcagcagcggctgccgctgagagacttgccacaattcgaggaccatccgcaaaatgtgccagtaattttgggtcgattttcgctgcgtttttctcaaatttctgcgtgctttttttcaggtaattcgtgtccaaccgatgcctcaaccattgccgctgagagacctgccgcaaattttccaccctccaccaaatgtgccggtaattctgggtctttctttcgattgctttttctcaattcccgagtgcatttttcaggcaattcgtgttcaaccaatgcagcaacccgtagcaatgagagccgtgccacaattcttccaccctccgccaaatgcgccggtaatcttgagtctcgttttcggttgctttttcataatcccgagtgcattgtttttcaggaaattggtgtgggaccaattcatgatgggcaacaaccactaccactaagagcgttgccacaattcgcccaacctccaccaanatgtgccggtaattttggctcgtttttttgttactttttttaattcccgaatgctttttttcaggccgttcgggtccaaccagttcaacaaccgataccactgaaagacgtgccgctatttgtcaacccaccaccaaatgtgccggtaattttggctcgcttttgttacttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacttaccgtatcatccaccagaaaacgttccggtagttgggtcttgtttttcgtgcgtttctcatattttcggatgcttattcaggtaatccaaccacggcaacgaccgcgccagctgagagatgtgccactattcgaccacccactgccaaacggacaggtaatttcagaccctgtcttttacctaacaccgaaacatcttttcttaagcaaatgtatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggattttttttcatgtgcattattttggtgctagtaagatattgtcgaatgaattaattggtttttttcccttcattttaaaaaatttcacgtccccatgccctgcccacttcccgcggaattgatcaaggaaataattgacgctctcccccctccaaaaacacatcggcttttgcgcgtaaattttgttttggcatactttgttaagtgtcggttttattccatgatgagaagattgtttcgcccagagcatatatcaataccaatggcccgaagaactggaatttatttctttttcgatgtttatactccccctatttattttccactctaccaataataacatttaa

SEQ ID NO: 80907 - DNA, 505 bp, Heterodera glycines
  Genomic contig location: Contig_ID=SeqID_2653; Location=964..1468; Strand=+
  SCN-specific regions: Sequence locations=1-124,148-386,408-505
atgtcttctgtgagcaaatttatcaccaacaaagggccctttattgctgttggaatgggtgtggttggaatgggctattttggctactacaaattttggcgttcggtacgttctccaattcctttttggattccaattgttactgccgttttcacttaatgattacttaatttttaagtcgcgtgagattgctatgtcttacaaacaagaagacgaatcggatggatacacagtgaaacgcattgaggaggcatacaaaactcttcaggaggcaaaggattgtaaatccctgttgaaaaagcactttactgctgatgtgaaagacaaattgaagtacaagaagacgaaattgggtgcctctctcttcgacgtcatcagatcgggttaaattattaatttttattcccgggctcctattgcagttcacacgaccataaaaaaagacacgaccataaaatttttttgcaagtttagtgaaccataactttttcaagaagcatccaaa

SEQ ID NO: 80908 - DNA, 1986 bp, Heterodera glycines
  Genomic contig location: Contig_ID=SeqID_2654; Location=1418..3403; Strand=+
  SCN-specific regions: Sequence locations=1-507,530-584,606-610,654 -1069,1093-1325,1347-1986
  Gene Ontology: Biological process=peptidyl-diphthamide biosynthesis from peptidyl-histidine
gttccgtcgcttcaattgatttggacacattttttgaggtcgatcgcatctgctcatggattttgtcaaacaaatttcaaaggacggctttacaactgcccgatgaacttctcgaacattcattccatctcgtagaagcggttgaacgtagggtggaatcggcaggaacttgggaagaacagagggggaggctgtatgtgttggccgacacgtcctatcgaaggtgggacaaatcaccggcaaccgtggcgaatggttcaggactttagttgtcagaaatttgtgtgccttgttattatattcccaaaatcagttgttgtctggatgagattgcggctgaacatgtcgcgtgcgactccatcgttcactttggagacgcgtgtctaagtgcccgcagcagttccattcccgcgctatacattttctgcaggttggaaattaagattgaaactaacaaaaaaagttacaggcacccattcgaattggaaaaattcgtcgagcagtttcgaattgaattttctgaatttggaactgaaaaacagtgggatgactgtttactgttatgtgaagccgcctatacacacattcaaagtcatccattcagagaaagattttataaaaaacataatttaaatgaacaataaattaaatttgagattcacttggaagtgccatttctcgcattcttccgccgtctgttcgtctgttcaattttgaagtgtcggagccaaattcgccctcttcctccattctcgggcgccaggtgccggtcggattcgtcatcgatcagtgttctgagaaaaagcggcattgttttttgctttttgttggatctactgacagtcctttattgcccatcgcgcatatgacatttcgacacattgaaaaggtaaatgatcgtttttggttgttcttcatttaacaatagcaatctttgaacatgttctggttcttttggaaaaagctgattattaatttaagaccattgtctacacccccgaaacaggccaattcaatgcttcagagtgagtttctttgcccgcttttttcttagatttggattagcttcaatttgtcatttttgtttgcaactctgtcttccatttctgataaaagccaaactgtttttccagcactctgaccaatcggatgttattgcggcgattgtatttgatagagcgactacgcgacgcgcgtacggttggcttggtggttggagcggtggcattacgcgggtgccgtgaggcggtggcccgagtgcgcaaactttgcgaaatggccgggaagaaactgtacgtcatgtacataggaaaggtggggagcaagggtttaaacacttggtattttaaattgcgcagctgaacgaggcgaaattgtccaactttggcattgatgtggaggtgtttgtgttgctcagttgtccctttggcattatcctagacggcaccaaattttgtcgacccattctcagtgtgtttgaggccgaaatggcgttggacccggcacaaagtaattggctggccgaaatgcgatggacatcggacattgaacggatttctatgggtaagtttaggacgaaataaaatattttaatgaaaaatatagtcgacattagctgttgtaacaaaagcaagaaagagggcaccgatgaagatgtcggattaatgagtttaacatcgggcaacattcgccgttgctacggtcctacgaatgccgatgaggaaaaaaacaatggcattggaccaacaacgggtggcacttctaacaccaaacaagtgatggaatataccgcaggtgtttagactcatttttgtatttatttgcaaaaaaattctaggtgatcatttcgcaatgcgttcttggcatggactcgaggacaatagtggcaacaacttttgcatttctgctgatggcgtgacagaacgacaatgcccatgcgaactgaagcaaggaatggatgggattgccacgcgatatgccaatgaa

SEQ ID NO: 80909 - DNA, 614 bp, Heterodera glycines
  Genomic contig location: Contig_ID=SeqID_2655; Location=1195..1808; Strand=+
  SCN-specific regions: Sequence locations=1-156,178-371,393-614
  Gene Ontology: Cellular component=clathrin coat of trans-Golgi network vesicle; Biological process=Golgi to endosome transport
atgcgcggattggccgttttcatcagcgacattcgaaattgcaaaagcaaagaggcggaattgaagcgcatcaacaaggaattagccaacatccgatcgaaattcaaaggtatttagaaacattcaattttgataatttataatttagtccatcaatgtccaaaaatattgtttttaggtgacaaaactttggacggctaccaaaagaagaaatacgtgtgcaaattgctattcatctttctgctaggccatgacatcgattttggccacatggaagcggtcaatttgctgtcctccaacaaatacacggaaaaacaaattgcaagtttccccatccaataaatattgcgatgatttatacgaaatttcgtcaaaaatttctggaaatttcactcaacgtctttgcaactttacagggttatttgttcatttccgtgctgatcaatcttaattccgacttgatgaaactgatcatccaatccatcaaaaatgacttacaatcgcgtaaccccgtccacgtcaatttggcactccaatgcatcgccaatattggctcccgcgacatgtgcgaagcgttcgcccacgacttgcccaaactgttgacttctgggtaa

SEQ ID NO: 80910 - DNA, 1599 bp, Heterodera glycines
  Genomic contig location: Contig_ID=SeqID_16506; Location=1675..3273; Strand=+
  SCN-specific regions: Sequence locations=1-595,634-844,867-1532,1554 -1599
atggcgcaacggcttgcaaaaattgttgatgattttttacccgaagacattgatcgggcgaatggacggctaatcatttcagtgacgaaacagagagtgagtggatttggtcccttttcggcctcggatttgttatctccaatgatttaattagtatagccaacattttaggactggtcaaatcgtctgatttcagaatatccgagcagggaataccttctgcagtgcctcaatgccacctgttatgtccccttatattcgagcagtactcctcccgcaatcgatggcgaagtattgttaattaattacgctcataattcaattcaacttttgcaagcgctacattgacggggtttattccaacaatttgcctgtccccgatattccaaatgttcacaccattacgatcagtccgttcagcggaggagcaatgatcgcgccacgtgaccaaagcgctttcgactggcagatgataatgggacagcagagaataaatgtgaatttgaggcttttaattgtaattgattttaaagttaacgggtccgggcttttatgttacgcaattggctctattgcagtttacccgaccctaaacttaaaatataatataaaaaaatttatatttataattttggatatggttagtaatttattgtgctttttcaatggtcatgaaatttcccaggtaaacatcagaaatgtcatgcgcggtgcacagtcacttttcccacaatcattggaaagactcggccggctttaccgagcggggtattacgacgcaatgctttaccttctccgcaagggctgtttcgaaagagaagttggaagtgaaatttgattctattttttgtattttctggtgtttaattgagagaacattgttagctcaaatgttacatatttttcaactattgttcattcaaatggttatttattaatttctcgacaataatggatgtttgtttgtctcttatagtaccaacatttcaataacattactcactccgtttcttcgaaattctttcctaaggacgccttttgcttcggtaagttttcatctgtcgaatggctaatgttttgttgagttcagattgttattttgaccatgggcatcaaggatttgtcaaaggtcattgcggatcattcgccgttcgccattaaaaccaacgaaatgaaagcgtatttcggacggcgcatcgcaatcgacgcgtcgatgagtctttaccagtttttgatagcaattcggcaggatggtgctcaattgacaacggaggagggagaaactacgaggttttacggaaaaatgccattgttagtgccacaattacatcgactttagtcatctcaatggcattttttaccgcaccatacgaatgatggacaacggaattcggcccatttatgtcttcgatgggaaaccaccggagcttaaggtcaaccattgagcaaacgttttgccatttcgtgttttcagtcaatcgaattggacaagcgaatggaacggagggcggaggcggagaagcagcacttggaggccacagagaggggcgacaaggcggacattgaccggtttggacgtcggctggtcaaagtacaaca

SEQ ID NO: 80911 - DNA, 137 bp, Heterodera glycines
  Genomic contig location: Contig_ID=SeqID_16506; Location=1..137; Strand=-
  SCN-specific regions: Sequence locations=1-42,64-104,126-137
ttctttccaatttcatcactttttctttcccaatgtaattgtaatatcatccttttaatattataatttagcgattgaattcaataccccttcaatttggctatcatgcaaatcttcgtcaaaactctcaccgggaa

SEQ ID NO: 80912 - DNA, 367 bp, Heterodera glycines
  Genomic contig location: Contig_ID=SeqID_16507; Location=863..1229; Strand=-
  SCN-specific regions: Sequence locations=1-241,269-367
atggcacactccacggaaaggttaatttgacaaatgggggggggggggtaattagactcaacaaattgagaccgatggccgttcagcagaggatttaaaatggagtaagggagggaattgtgtcatatttcagcacagattggtcggcatatgaaagaaaacaatgggcaatgaaagacaaaagagaggaggacaatggaaatgccggtcaattggaaggataatcattaaaaaagaaattgctaaaaatatatatttatgtgcaattgtggtattcatccattttagttgcaaagttttgcattcgataaaaaagcacgcaatcgcgtgacttggaaacttagcgaattaaaagacattgaataaa

SEQ ID NO: 80913 - DNA, 963 bp, Heterodera glycines
  Genomic contig location: Contig_ID=SeqID_16508; Location=349..1311; Strand=+
  SCN-specific regions: Sequence locations=1-339,361-480,514-839,880 -898,920-963
atgacccaaagtgagctcaaaatcttatactcccttcggcaacaagcctatcaggccaatattgccgcaggtgagtataagtattttgtggttgacttggagatcagatctctgaaagacccccgcccgctcagaactcgctagggatacgcgagcaaatcaaacaaaaacattgggaatacgggaaagaaaaatccttggatttattgcctattaataaacgcccgatcgataacaaataaaatagctgacttagaacatataacccaaaaatacgatccttttataatcataataaatgagacctggttaaactccagaaacacagtagaatcagaatttacaataaataatcaatatcaaataatctttgcaagccgaaatgataaaaagggcggaggatcggcaattttattaaaatcaaacatcccttatcagacacttttctctgggacaaaattccaaagcgaaattattcacataaaattactttttaaaaaacctattcaaattataaatgtatatcgtccaccaaattgtacagttcagaatactaaaaagctactcaaattcatttcggaccaaagcgattctgaaaataccatattctgtggtgattttaatatcccaaatatattatgggatgaaaataaagtaaaaaaaataaatgatccggcgtctaattctctaattgagtttatgcaccaaagacaattgatacagcatgttaaggaaccaaccagagaaaaagcaattttagatttagtaattactagtgaattagaattaattaatgaattgacagttctagaaaatttttcaacttccgatcacaaaatggttggatttaaaataaaagtaaaattcagtcataaaaatcctaaaatttacagaagagatttaaaaaatattaatttttcgaaattaagtcaggcgttacttgaaaatcgaattgatttatca

SEQ ID NO: 80914 - DNA, 1045 bp, Heterodera glycines
  misc_feature (604)..(604): n is a, c, g, or t
  misc_feature (680)..(680): n is a, c, g, or t
  Genomic contig location: Contig_ID=SeqID_16509; Location=181..1225; Strand=+
  SCN-specific regions: Sequence locations=1-130,152-460,482-626,649 -1045
atgcggcagagcatcaataacctaacaaattcccaggtctcaacgaacacgcctgctcaaagaggagcaatgacttccaaaggcgacagcaaaacggacaagccaaaggacaagaaagaagcaacatcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttcaaaggcgacagcaaaacggacaagccaaaggacaagaaagaagcaacatcaaaaggcggcagcagcaccaccaataacgcgccgaatgcccaggtagatgaagcaacttcaaaaggcggcagagcatcaataacccaacaaatttccaggtcacagcgaacgcgcctgcccaaggagaaggaccatcttctgaaggcggcagcaccaagaagccaatcacagacaaatcaaattatatgagtcaaccataaactttcttggaaaatgatcctgtatttatgttatttgtggtgataagtttataattgatccgtattttatgttattgtntgatcattctatgattcgatccgttatttatgtatttattgtttcattgttgattgatccccgtattatgtatgtntttattcactcatatacgaaatataaaaccccaacctcagggtttgtcagatctgaggattttatcctcattttgtggctttattgatatgtcaatgagggatttttttgaaaaatgatgattttttgtggcttttcgaggcctgtgggaaaaatcctcagaatcttttaaattttgataaattggcataatgaaccaaaagactgtattttattaatttgaatgctgtttgggtatttgggattgaaaaattgaagattgaacccgattttggacataggcgccaatgtcgggacgcaaatgtgggataacctttaaaatataacatttcatgttcgcttaaaaaatttatcaattttttaaaa

SEQ ID NO: 80915 - DNA, 1060 bp, Heterodera glycines
  Genomic contig location: Contig_ID=SeqID_16509; Location=1253..2312; Strand=-
  SCN-specific regions: Sequence locations=1-291,313-517,541-565,595 -803,830-1060
atttcgcccgtggcgatcactttgcttcgtgacgagtcaaatgagcacactctgttggtgaggcataaacgcagtgctggccaagtgtacacgtgcattgccggtttttgttcggtcggtgggggcatcattttaaaaatgattttttccaacttgtaaattacaaaattgaaaaattataatattaatgtaatccttcgattaagattatagaaccatatgatcggggctccatgggattttcatgggatcaccggccaataatttaccctgtcgttttttttaaattcatcatgtctcttcttgttgttgatgaatgctatatttggcttttcttttcagccgggcgagcgtcttgaccaaacagtccgacgagaggtcgccgaagaagttggcattgagtgttgggatgttcggccgctggacggttcgcagacgtggccattgcccgccgggtcgctgatggttccatttgtcgcgactgctaacatgggtgacgaagtgtgtgttgtgtaaaaacatgtggaagcatttttggggcttttttcttggaagttttacgaacaaattttaatttttttctattattattttccgcaacatattgccactgtttttttttgttgaagatccaagcgagcatttccgagttggaatacgccaaatggtttagtcgacaagaagttgcggaagcattgcgccgttctgaagaagatccgctgctgatcaagctgtaccgccatcttagcggttgttggggttaaacaattaaattacagtttcaatttgatcggatgggcgtgccaaatattccatcttggacatgagaaatgacgttttaaaatatttttaaacagaaagtggaaaggatcccgagacgagaatccaactgcgatacattccgccccagggcgcaattgctcatcacatcatcaaagtgggtgatcgagatccagaggaacggatggatattccctcatgtttttttaaaacgcacttttcagaattggcttctacgagagttctaattgcaagcaaaaagtccatcttgctgttttga

SEQ ID NO: 80916 - DNA, 2409 bp, Heterodera glycines
  Genomic contig location: Contig_ID=SeqID_16510; Location=32..2440; Strand=+
  SCN-specific regions: Sequence locations=1-238,261-426,449-472,589 -621,664-718,905-1020,1043-1142,1221-1348,1453-1533,1620-1651,1674 -1748,1772-1938,1960-2061,2085-2097,2155-2239,2262-2300,2323 -2343,2365-2409
atgaaacctaaatgccacacaaatgccaacgaaatggcgccaaattcaaaattggccaacctttggccctccaccgattgtgtgcatcgcatttgtccatttctgttcctgttgctgttcgccctgttactgctccaacaacacatgcacacggaacagttggagcagcgactgtcccggttggaacagcggtgcaaaaatgttgttgaactgctcgaagaaccggtaaattgattgaaatattattttgcttttttaatacaggggaggggtaactgggtgccgtaaaaattcccgaaaattctgcctctaaaatttgcagattaggaaactgctcggttaaaaaaaatatagactttaggaagatatttatacttaattaaaggatttttatgaaaaatctataattagtgggatgccataacatttgggccaaattttaaatttctctaggtgctgaaaaagcattaactaattaatttgtttttatatgaaattatatttttacattaaattttaaattgtgtaaaaaattttaaaaatagggttttctaaaaataaaattaaaatagaattttgaaaaaatttgatctactttttgagatccctcaggaaaaaaccaaaaaaaaaaaaaaaaaaatcaaataattcaataattaattaccaactagagacgcgatttgactttttgccattgtaaaaaaaatttcttgtcaagtttttaataattaaaattaataaaatttgaataataatttttttttggtccaaataatttaatttaattttaaatatatttgttttttaattactttaaattatatttttaattattttccttctttttttattatttaattaatccaattaaatttggcttgtattttgttttgttttttttgttaattggtaatgtatttcattaatcggcacaaaaaaaggtgccaattaaatttctatttggcccccgcggggattaaccggtgtcagaaaatgggcacggatttgcataatcggaaattggaggttttttgggggataatctccccgttgcaaaatccattttttctgctggtgaatgagatgaatgaatggggaacgcaaaagaaaatgagaaaattgagaatctggaatggaaaatgtaaattttttaaaaattaattattttaattaataaaaaaacattttagatttaatttttaataattttttaaaaataacattttcatgtgactgaatatttataagcatgatttgttatttgttaatgaattgtttggtttttcaacgaatggttttgtttaatataaaaatccgtttatctttgtttaccttttaaattcacttcaatttattatttattaaaatattttatgttttaacattcattttttatgtaaaaatgtttttttttatataaaaaagtttcaaataaatgttttttatataaatggtttaattttactaatttcactaatgctactaggtaaaaaatttttaatgaaatttttgacaaaaaaatcctttgattccaattttttatctaattaatgaattaattacatatttatttaaatttttttggaaattgatatttcattaataaaaatagaaaaaaactgctttatccgtagaattcaaattatacacatattttgtgcaaaatgtaaattgccctactttatccctccgacccaatcaatttttgtctgtttgtttatcccatcccaagccatccttatcctctcatttttgtgtcccccctccccattgtgtcagtacaaaaaaaaattttttgctttgcctttggcaatccttttttaaataactaattaattgcatagagactcatcaaaaaatggtctgagatttttggccccaaaactattcccgattttcaattgaccattattttgccaatgctttttcttcaataaatttctctctctgaaaacggtaatttgaaatggtttaaagccttattaaacccgtggacacaacaaaaacattagaactcattagaattttacaaattaattgccgattaaattttagaatggctttttaattgtttaaaaacttttggcttacattttgtaaaattataatttatttattttttttttattacatttttaaattgtattaattttagtcggatgacgtcttcaccattgaaaatgctcaacagttgaggcgaacattgcgttcactgtacgacgatcggagacggcaaagggacggcggcggcacacggcaccaccaaaatcggcaccaccaccacaatcagcagcagaggacagcggcggcaacaacaacggcatgcatgtgccctcatggtaattatggcaattaaaatattggctaaatgatttcagggggtgtggggaactcagctgcccatcggaa

SEQ ID NO: 80917 - DNA, 996 bp, Heterodera glycines
  Genomic contig location: Contig_ID=SeqID_16511; Location=1804..2799; Strand=+
  SCN-specific regions: Sequence locations=1-17,41-47,95-150,172 -307,329-475,498-605,664-737,759-996
atgtcaatttcacgaattgcatcatcccattcttcaatagaaattggtaaatttaaatgaaaaactaaaaaataaattatttttctaaaaattagcgcctaaaaagtcggtcgaagcaattgaaaatcaaataataaaacgaaaatcagaaataaatttggaaaatgaattggatggacaaagcgccacaaattcaaacatttcgccaaatttcaaatgtcctctcaacgaatatttggccgctgttgttgattataacggcttttatttcaatgttccggcgaaaacaatcgcaaaacttgcaatgaatttgatttttgctgttctgtcatcccaaaattggtccgccaaacagcaacagaattctgatcagccaatttttgatggcattttgacatttgaccatttttcggtgattcgtcaaaatgaatttgaatttggcgccgaagaattggcgggaaatttgaaaattgaatttaacaaaatggtggaaatggtcaaagacccacgggaaaggacacttccgccagaacagagaccaaaacagcagataatttggctcaaagatgtgctgtttatgagtccagagcaaatcaaagtttgtcattaattgcttaattacccatttaattacccaattaaataaatatttattaaataattcaggataaaagaagcacaacaaccggcaaagacttggtgtggttcgtcggtttgctgctctaccgaatgttgttcaacaacaaacaccccatggacaattgggagccaaagcgccgtttggacatggaattcatggccaagatgggcttctccaagttgaagcagttcaattgcatgtacaaaacggacgattttgtgacgggagactttggcatcgttccactgaagccgaaaagtcggtggatttggatgccggagagtgggcgagacgaaactggggaaatggcactggtggaggaacggattggcatggaacaggtggctgccaattaa

SEQ ID NO: 80918 - DNA, 741 bp, Heterodera glycines
  Genomic contig location: Contig_ID=SeqID_16512; Location=153..893; Strand=-
  SCN-specific regions: Sequence locations=1-9,33-103,232-741
atgattacccaacaacagcagcaaaaccaagaagttcaagcagtacaacaagaacagcaaattttgatgggaaacgagatgaagatggacaacagcaaaaatggagaaacaagggaagaggagggaaatagcattgaggaaggaggagagacggaagagaaagagaggaaaaggaaaaattcggcgcaaaaaggaggagagaatgaagctgaaaagagaaaagaacagcagcaaatcggcacttaatgttgccggtgctaattgctaattttgtgtgtcgtaaatcccgcgtcaaaatcccgaaaattaattgccacaattttcaaggagaaattcatacattcgatagatagcaagccatttttatacaatgttggagtttttttgcacttaaacccatttttgaaacttattaggaccgtgaaatggggtccacttcgtttcggtgccagctcgtttttccactaaaaattttttctgagtcatctaaatccaacattgttgatattagagcccggtaaaaaaaaatttccgggagcgggatcgggagttcaaaattttccgggacgggagtcccgaacgggattcccgtaaaaatcccgatcccgttcaaatcccgtctatttttaacgggagtcccgggcgggagcgggagtaattcgaaaatttaattaaaactcacaaaaatatttttaatgcacaaattttgagcggcaatacgtttattaaagaaaaaataaa

SEQ ID NO: 80919 - DNA, 1197 bp, Heterodera glycines
  Genomic contig location: Contig_ID=SeqID_16513; Location=91..1287; Strand=-
  SCN-specific regions: Sequence locations=1-483,522-610,632-904,926 -1197
gtacatcgatcactccgtcatcgcttttcttcgttcaaatcatcaaattttcgacaaaagaggcacctatttacacttgcggattccatcatcacacaccatggaagagcagccaattttggatgtttttgttcgtgaaatttggcccattttttcgacaaacattcgctgtttgggcttttcctgtggtgatcatttggacaatttgcgtagtctcatttcaccgacaattctcactgatctcaaccaattgaattcaatcgattcatttgatctgttgcccgctgcgattgatgctgattttgatgggccaaattcaacaatttctgctggccaagcattgtccaaatggttgcactctccgagaaaagctggccaacccaagcgatttcgtttttgcagaaatttgaaggacttctattgggtcaacagtttcaaggaggtgtggtccgggggggggggggggggacaaaacgtagccgcaaatttttattttaatttaaaaaattatttaaaatttagttatctagcctaaatcaaaaaaaatagataaattcgaaaaaaattattaagaaaattcaaggaaatgtaaaaaagtcgttttttatttatctggaaattcagaaaattagtttttatacgagacggcgacgttttaggggtgtacccggtctgtggatggcattctgagttattttctgaaacctgaccccaaaaaagttataaatcgaaaatttctgaaaaattccgaattttatcaaaaatttcggaaatcggaattcagtgccatccctggtgtgttccaacatttttggcaaatcactgattgttgttttccaaaagctgacattgaccaaagaaaacgaaaatgaattggacaaaagttggataatgaaacgatgcaaaattatttgggagaccgcggcggttcattgggaagacggaaattgggacaacaattttaacaatgtgtctgtccatttggcttttcagtactgattgcattgggtgagcaattaaaaaaaacatttagttttgttaaataattcaaatttcgcataattaaggccattgtctccgccaccggaagaagaagacgaagcaggacaaagcagcgaaaaaggggcgtcgtctgctgacaaaatgagtgacggacaaaagaacaaatacagtgatcagccgcagaagaagaaatga

SEQ ID NO: 80920 - DNA, 762 bp, Heterodera glycines
  Genomic contig location: Contig_ID=SeqID_16515; Location=912..1673; Strand=+
  SCN-specific regions: Sequence locations=1-165,188-194,267-289,312 -468,550-577,601-679,711-762
caatttttccaaatctgagcacatcggaggaaatgagtgttctgattgcccgaattgctgagctgaatcgagccaaaacaatggagccatctgttgccagttttgaagtgtttggacaagacggatacggtagggaattttgtataattgagtggatacagtatgaaaattatacaataaaagaaatggttttgaaattttaaaatcaaagaaattattttgaaatttattaataaaaaagattattttgaaatttattaataaaagaaagcgaaaaatttggccctattgctgcagttcacaggacaataataaaagaaatggcctaaaattatttgaacacttgaaactatagcattttatagaagcaccacccaaattaacattctttgtatcatttatagctccaagagtccttttattctgtaaaattcataaaatttgttttgttcaaaaaaagtaatggccaaaaatatttagaaaataacttttttatttaaaatagagccaaaattattattttaaattttatttcataaattttattttgaggaatgaatgatgatcagttcagtctggaagaagaagaaggaaaagaacagcaagaagacaggaaaactccgacaaaagatggtaatatacaaatattagaagacattttcagaataatttgctaacttaacgacaatttaaaaaataattgaaaattgcttcaaatttcagtttcggaagatcatttgaaagcaattttggagagaattg

SEQ ID NO: 80921 - DNA, 130 bp, Heterodera glycines
  Genomic contig location: Contig_ID=SeqID_2657; Location=605..734; Strand=-
  SCN-specific regions: Sequence locations=1-130
gcaggcgacggcaacaatgtgtgacaatttgaagtggcgcgacgcgcaggagggcatttcggcattcatcacacgaccaaaacggcagccccagtggacgcacactgatcagagagtgatcaaggactga

SEQ ID NO: 80922 - DNA, 250 bp, Heterodera glycines
  misc_feature (7)..(7): n is a, c, g, or t
  misc_feature (11)..(11): n is a, c, g, or t
  misc_feature (16)..(16): n is a, c, g, or t
  misc_feature (21)..(21): n is a, c, g, or t
  misc_feature (29)..(29): n is a, c, g, or t
  misc_feature (33)..(33): n is a, c, g, or t
  Genomic contig location: Contig_ID=SeqID_2658; Location=1137..1386; Strand=-
  SCN-specific regions: Sequence locations=1-250
atggtgntgantggangtttnttggaagntaanagtgagttttatttattgttaatttttgtatttaatcaaatgttttcggtccattttttggatttttttgccaaaattctttcatttttttcattaattttttttttgctttgtccattttcagttttccatgggttcaatcttcattaattttggtattcttaacattttctgtatattcttccacaattaagaaaaactgtttttttgaaataaa

SEQ ID NO: 80923 - DNA, 2160 bp, Heterodera glycines
  Genomic contig location: Contig_ID=SeqID_2658; Location=2078..4237; Strand=-
  SCN-specific regions: Sequence locations=1-621,653-1127,1152 -1664,1694-1989,2016-2160
atgagtcaagcatttggccaccaattgctgcaccgttttcgtcgtccagcattatttgcattatcatcatcaaagttttgtccattgtttcgtgccaccgccgccttcgcaacggatggagcagcaacaaaacaaccaactgcaagtgctgctgcacaacaccaacatcaacaagttgaacagcaacaaccgtcgacgacaaagacggaatggcacctgggcaaccgggtggcaaggctggtcagtcagtaatgggggtttttttttttttgttcggtgccgtcggtgagtcagtcaatggcaactcgtacaactaatatatataaaaaacgcctgagcttaaagcttaggcctagcctaagccttagcgcgtttcccatcgccgactctaaaaaattattgaattttacaaaaaatggcactcaaatttcaaaattttccttgccgactctaaaaattattgaattttacaaaaaatggcactcaaatttcaaaattttccttgccgactctctaaaaattattgaattttacaaaaaatgtcactcaaatcaaaattttcctcggcggcactcactccctgttcatcagttttcgccgccccaatattcccctccgaactaaaaaaaaaatttttttttttagtttttttctttaaactagggagtaggctgtctcggctcggtatgaagcgcatgtttttcatttttggcaggttatggacgacaagcgggtcaattcgctgtccttgtccgccatggaaatgttgcacgacacactgcgcgagttggacgctcggccggaggtccgggtggtgatcctcgccgcctcggggcctgcctactccggtggacaccatctaccggaattggcacggttttcattcaaattttacttgatgggcgagggaaaagttggcactaatggggggtcggtcaactggatgtcggccccggtttttggggtataattccgttcatatttctccgaattgaatgaatttgatagcatcagataggcctaagaattctctatttccttgcaaaatttcatgaaattcattacaatatcaaaaaagttatgacccaaaaagcttcggaaaagcaattttttggtaattttttttcgaaattttgcaggcaaattgagaaaacttagggctatcgaatgcttaacaaatgctttcaaaccgaagtaaaagaaaggacttataccccaaaaactgtcctctttcaagttttggcgctcagtcatgccaatattcgaagtttggcagaattacggaccgagattttttccaaaaaaaaaaatactgaaccgaacatttatttttatttatccctttttaaattttacttttaatttcattttagacggccgaatccggcacagaaatgcaccgcaaagtgttcaacaaatgtttggaactgatgacattcattcgacaaatgcaattgcccgtcatcggtttgtgattttttgtttcattttttttaatttgtaaaaccgacgctcgaaatccggaccccatccctaccaaaatatatcagagtcgagccaaacactcatttttaaatgtggaattcatcaggtttattcaaaaaaaaaactttcgaattatcgtttcggagccataaactttcgactcagatgtgtttttctgcaatttttctaatttaaaaatttttttattcgcatttcacttttcaatgcattgttttctaaatttttcatttgtcattttatttttgtaatttaacaagccatttttctgcccggattgcgataatcctctacttttttgggtcggttcaaaaaaaaatttttttttttggccctccgatttatcgctacgaaaggatacgagcgatattgtaaattcttgattgccctttaacactttacccatgacaatttgttggtggctccgttcacattttgacccctcggggttcatggttcgaggcccaccggcggagggtggtccacaattttttttttttaattttttttttgtttagccgaggttgacggcctcgtcgctgcggccggcacgcagctggtcgcagcctgtgacattgtcattgcgtccggtcgtgccagctttaatgtcgccgggtgagtgacccccagggaaaagggagggggaaattcattaaa

SEQ ID NO: 80924 - DNA, 425 bp, Heterodera glycines
  Genomic contig location: Contig_ID=SeqID_2658; Location=4574..4998; Strand=+
  SCN-specific regions: Sequence locations=1-28,50-83,106-375,398-425
atgatttgttgttcgaatctacacccggatatccgcatacttgatgcgaacaatttgatggatctcaagtttcgcgtccattataaatgtattaatataaatcttgaatctatcttgacaaatatattacagggctcatatccagggacctatttcaattcggaccaggtcctcgacttgatttttgcgaaatggactgcaaaaatcctgtttcaattaaatcgaaaaaatcgagtgtcgcacttgattttggcatcaagtcctatttttttgttgcaattaatcaagtcgaggacttgatcaccaagtcaaatgtaaaatcgactgccacattcgattttttaatttttgtttcaattcaaataacagtcatggtgaatgaaaaaagttttcaaatttatcgagagaaaagttaaataaatcga

SEQ ID NO: 80925 - DNA, 118 bp, Heterodera glycines
  Genomic contig location: Contig_ID=SeqID_2658; Location=4403..4520; Strand=+
  SCN-specific regions: Sequence locations=1-14,49-118
acaaaaggggggacccttttgttttgcaaaattttttaagataaaaaaccatgataattttttatccggggttttaaaggtcgctaatcacgaatctgacatgtattttgactaattt

SEQ ID NO: 80926 - DNA, 1971 bp, Heterodera glycines
  Genomic contig location: Contig_ID=SeqID_2659; Location=914..2884; Strand=+
  SCN-specific regions: Sequence locations=1-348,371-1477,1504-1971
atgcggcttgaactttcagtggcagacaccgaagcgccgagcatcatgggattggattggatcatccctttcgagcgtgccacccaacagccaattgccacgactttggagcagcagtcgctcattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccgcggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctctttcctgggtgcgctcaactattacggtcggtttgtcaaggaaatgcgcgatttgcgtgcacctttggatctgctcttgaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcggagctacaatcagccatgtttttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaatatgttaaatctgcaaattttggacaggccgacgttttgtctcgattgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacatgttcaattttgacaggaaaccgagtcattgttcctgcgccgcttcgtcaacgtgtactcaaagactttgcactttgctcatcctggcattgtgcgaatgaaggagtcgtacaaaacagaagaggattgttgtcaggagcttttaataatgttgttgcactgcacacggcaaaacagacaacagcccaaagcaaacagcaaaacacaaaacaatgccgaagataatttattaattccaa

SEQ ID NO: 80927 - DNA, 1210 bp, Heterodera glycines
  Genomic contig location: Contig_ID=SeqID_16519; Location=844..2053; Strand=-
  SCN-specific regions: Sequence locations=1-2,138-158,308-395,419 -718,743-1036,1058-1210
atggaggagcaagaggaggaaacggagagagtggaagcggaggaggaggaagtgatggaagcggaggaggaggaaacggagagcgtggtgggaatggagcggtaggaggaggaagtggcggaagcggaggaggaggaaacggatagagtgacgggaatggaggaggaggaagatgaaatgggggagagcaaaacggaggttgggtaggaggggaaaacggagcgggcctaggaggaggaagaggagaatttgacgagtttggcgggaaaagtggagggagtggaggaggaagaggacaaggatggagcaacgcggaagcggggggcggtgaattcgatcttccatcattggatgaaatttatgggtgtaaaatggttactagggattgcaaaaggattatataattaatttaaaaaatccgaccggcttgccgatttcggcttgccgacttcagcttgcctacttcggcaagccgaagtcggcagaccgatatctaactaaatggattattaactcacagacgatccaatgctccgtaaaacgggaatgtctcatgacttttccacctcactcattagttcaactaaaggaattagggacaatcaagttgaacaagtctcacgaatttcatcacccaccgagtgccttgtaaaactgatgaacgcaaacggcagtctgtccaaaacggcctgtgctccagtacggttcaccgttgcgcgaatttctttaaaaggaaaaaatacgcttttttcaacaagttgcattaaaattcctactcaaaaaggcgatggtgtctcggttcaagtgatagtggaatctccattttcctgcacaatgactcgtcgatgttggcgaacacctccacagctttcttctccgttgacgtgccaatgaagaggaagcctttttgtcttttgcgtcgtcaattgcagcgctaaatcgtatgggcgacagcttctcaacgtgtacaatcagcaaaacactgggaagggcaaacggggcctctctaacaaaaattaaatgaaattatgcaatagaaaaaggatttttcaggaaattggaaaaacaagattttaagattaatcaaaagaaattctagttttgttttcgatttcgtttattttttggatgaattgaaggtaatttggtaatacttagtttgtccccccatttttttgaaaaaaaattttcaaaaaaattttgcaataaa

SEQ ID NO: 80928 - DNA, 387 bp, Heterodera glycines
  Genomic contig location: Contig_ID=SeqID_16520; Location=20..406; Strand=-
  SCN-specific regions: Sequence locations=1-191,240-287,385-387
atgcaagaacacctgggcaaccgcaacgaatggttattattggatgtgtgttttttggtgggttgccatctttttaattatttttgacacatcaattatatagatttttatatttttgagaaaaaattcaaatagtaaattttgaatttacaattaaaagagggttttcactaaaatacaagctttttgagttttataaaaaaatcttatttttaattagtataacaaaaaaaattttagcgtaaggaagcattatacagtttgaatagtgcgtggcataagtatttgaggacgggagagaggatgaacagcgatgatggtggagatgatcagaacgaggaagaggagagcgaggaagaggaggagagagatgaagaagaggagaga

SEQ ID NO: 80929 - DNA, 1536 bp, Heterodera glycines
  Genomic contig location: Contig_ID=SeqID_16523; Location=914..2449; Strand=-
  SCN-specific regions: Sequence locations=1-6,28-170,219-658,745 -890,912-1043,1065-1227,1262-1462,1514-1536
atggctaaacgaaaagcaaatgcatcagaagaattgcgcgttttgaaggcgagaattgtggaattggaattggaatgcatggagcaaacgaatgtttccgaggcgtttgaacaaagcagaaacggtaggaaaataattttaaatttgggatacggtaggaaaatattgcataaatttgaaattcagaaaaactgagtttctaataaatataagagaaagagagcagcaataacttacaattagcttaaaacaatcaaaatttgtatcatccgatagcccaccttttctctattagcctgtaaaatttcaaaaaaaaaattggtcaatataaaaaaaattgtaagcaaataacaactaatatttctgcactaacttatgttatatttgctagtgtttagttcaaattttgcaggctaaggctaatagagaaaaagcttgcttatcgaattataccataaatgtaaatttgattgcttttaagcaaagttatgccaattttttgtcgaaaaaaagagttaaaatgccggattttacgactacattacttaaatttcatttaaattgatctacacaatagcaaattcagtagaagtgatcgacgacggcgtgcaaatcgtggaaattcaaggacaaattgaagccgatccgcagcagaaagtaatttttagaatattttaaattgcaaaaaatttttatacaaataaattatgttttttaaattagttatttattatttgtttaatagaaattccgtgaaaatatttcgaaaatgaaagaggaattgagcaacacagaacaattgtgcatgattacgcagttgaagaatgtgggttatttattatcatttaaaattatttggttgggaaattttacaaattttaaaaccatctttttcacatttcaataaatattcgtttcatcaatcttaattaatttcactcaattggttttatgactagggcgaatatttttaggctctaaaaaccgccaaaatcggtaggctttaggctctaaaaacccccaaaaataggctctaaaaatggaaaatatgctccaaaacgcctcacaaatttcgtggtgtaaatttttttttagatttttgagaacatttttcatttcttatggggtttatttttataaatttttgggtcgatgtatttttaaaattgccaaaaaatagattcttattagcacctattttttggggtttttagagcataaagccttcttattttggcggtttttagagccaaaaattgagtcctaatataaagaattatctgttaaaaatgttccattgatctttttttagctaacgccttaggttatcatttgggttcaatttatcgaaaaataggtttttttttaaatcttagattttagaaattacttcaatcaaagttgaagcatcatgagcttatggaggagcaaaatgaactgcaagcgaaggtggccaaaatggtggaccaccaccagcagcagcagaagaagaagcaaggacgaaaggaaggcgagcaaggacaatacggtagatga

SEQ ID NO: 80930 - DNA, 733 bp, Heterodera glycines
  Genomic contig location: Contig_ID=SeqID_16525; Location=402..1134; Strand=-
  SCN-specific regions: Sequence locations=1-128,152-161,205-253,316 -328,373-460,482-539,561-733
atggcattgataaatgttgtccttttcaacagcagagcctctccatcggcaagtgttgttggtgaagaggggcctccaattgtccaattcggtgccgctcgacgacccggaaagtgccgtcctggtaacaaacagcagcaacaacacaatggtaatgatgaacaaccaccaccaccaccatcagcaccagcagcagcaacatcaaggtgggcaaaatggtcacatatataacaataataaactttggatgttattaatttatattaatattattttttttattttcattttctattttaattaaaattatttttaatatttaaacaagaaaaaaatcttttttaatatttaacataataaatatattattttgaacggacgaaattcaattcgtaatacgtctagactcgtactgtttccgacaaaaaaaaatagtcggtcattttttggcaaagtcaaccaaataaacaattttattctcattaaatgttttacctattttgttatctcttattagcatttattatacacaaaagatgaagctcattagtgacaaaaaatgtactccttttcagtcgctcggctcgttttacaaaaactttatcgataaaaactttttttcacaatcagaaaaattttttcattaaaaaactcaaaattgatttttacacaatttttaaaatcacaaaatttgggtattagattttcaaaatcaaatttttatatgaataaa

SEQ ID NO: 80931 - DNA, 228 bp, Heterodera glycines
  Genomic contig location: Contig_ID=SeqID_16525; Location=1222..1449; Strand=-
  SCN-specific regions: Sequence locations=1-114,143-170,210-228
atgtttgcggttggcagtcgcattcaaatgcacgccaaacggcgccaatccgtcgctgttggcattggcggcatgccaaaaagtgggttttccgtccattattaaataatgctcttaaataataatatttaaatttaattatcgagttttctaagcttttatatttctgcaatattttacttttctatatttttattattaaattattaggtgtttttagaggtttaa

SEQ ID NO: 80932 - DNA, 543 bp, Heterodera glycines
  Genomic contig location: Contig_ID=SeqID_16527; Location=6..548; Strand=-
  SCN-specific regions: Sequence locations=1-120,208-341,513-543
  Gene Ontology: Mol. function=structural constituent of cytoskeleton; Cellular component=insoluble fraction; Biological process=epidermal differentiation
atgcagcgcatctttctcgtttcgcttgctttgttccctctttcccatgctttcctcttcggtgggctcgtcggaggcagcagctgttgctgcccccctccctgtcctccgccatgttgcggaggaggtggcggaggaggttgcggaggcggatgtggaggaggcggaggaggttgcggaggcggatgtggaggaggcgggggaggatgcgggggtggtggtggaggtccaatcatagtaaactgtggaggtaagtaatacgcaatcaatctttggcggccaactatgttaatgtttcaggcggaagtcagggaggaggatgcggtggaggcggaggttgcggaggcggaggaggttgcggaggcggaggaggttgcggaggaggaggaggttgcggaggaggaggaggttgcggaggcggaggaggttgcggaggaggaggaggttgcggaggcggaggaggttgcggaggcggaggaggttgcggaggaggaggaggttgcggaggaggatgcggtggaggtggcggatgcggtggtggtt

SEQ ID NO: 80933 - DNA, 62 bp, Heterodera glycines
  Genomic contig location: Contig_ID=SeqID_16528; Location=8..69; Strand=-
  SCN-specific regions: Sequence locations=1-62
atgttctccgaggaagggtcggcagagataattagacggaaatatctggggaatggaaaaag

SEQ ID NO: 80934 - DNA, 1031 bp, Heterodera glycines
  Genomic contig location: Contig_ID=SeqID_16528; Location=1573..2603; Strand=-
  SCN-specific regions: Sequence locations=1-341,363-415,437-519,542 -796,818-964,986-1031
atgacaaaacggacggaccaccgattggattcgatgaaagtgaacagcaattgcaaaactgggcaaaagcaatcagtggacatacaaatggctattgaattattacgtggcccaaaaattgtgcccattgcgctccctccggtgataaaagcggtcgctctttggcgatcgcttggcacagtcaacgaaatgccgtaggatttgagaagcccaatttgggctaagtataaaataaattacgataaattagtttgattatttaaaacccaatccaatgccagcagcaattcgcgaagcgatgagaacgaaacgaatccaatgggaggggaaaagcgaaacggaaaaatacagaaaattgccacagaataaacaaaagttgcaaaatatgctaaaaggggagcattttacaattatgaattttattaaattatttttacagcggcggtttaaagcgacggatgcgattggaccaaacgccgaacaaagccgaggcgacgatcagcgaaagggaaaacaacgcgatcaaaaggcccaaaaaaccttcagagagagaagtgtccagctgaaataaacggtaatcaaatcactttccaagtgattgcgtacactgtcaatcattttctcactaattaactcattaacattcggtggccctttttgttgcctcaccgtcatcaaatatggccacattgacgctgttaacagagtgaattggacagatgccacgaaagtgaacaaagcacagagataaatggaaggccaagcggtgcactgaattttggtccgttctttgaccaaaggggcgattggcaaatcggccaaaaaaggcattggcccagcaaaagtcactggtggcaatgtcgacctgcagctgcggcagttgggctgatccaaagacccataaaaggtcgttgtcggagaggggacggatttgaaattggggggcattcggtgaaaaagccaaaaaataattgaacttaaaaaataatggagtaaattcaaagtacctaattgatatgagcataaataaa

SEQ ID NO: 80935 - DNA, 1347 bp, Heterodera glycines
  Genomic contig location: Contig_ID=SeqID_16531; Location=140..1486; Strand=-
  SCN-specific regions: Sequence locations=1-412,442-541,563-1347
ttaaattctgggaagcaatatcccctaattgttcgattattgattccaaaaattaactcatcgcaagaaaaatccctaattgacacaggggccagtattagtgtagcaccgaaattaatggcaaaactctggggttgtacattatacccaacttcagtcagtgtaattagtgcttcaggccacactttcacacttaaagaaaagggcacggtcattttttcaattgggaattattcagttgaaggtattattcattttgttgatgattttaaattcaaaactcatttttataaggcacttattggctgcgatattcttggtaaattgccagccttcacttttgattatccaaataaaaagttccaaattggtgactatatcactccattaggaattcaacagaataattgccttattaataatttgagaattcaagcaagtaactcaattatcctccctccaaacaggggtatgattgtccaggcaaatatagacacctcaatagacctgaataagcctatttttatccattcactcgatgaaagacttaacaatatttcctttggtctaattcctgtaattgcggcgccctttcgagggacagtgaaaatgtttataattaacccgtctgctatgccatttcaactttataaaggccagcatttagcttatgctgatgaggttagacaaatcagtaatggtgtaatgactgatagctctgaaaaagtgatgagtatgtcaccaatgatggacatagtgattgaccccaatttcaaaatagatttttccaaaagttctgtaacgggttcagacttagaaaaattgaaaatactatgtgaagaatttcatgacattttcagtcattcccaatatgacttagggtcatttacagagggtgaacatgaaatagttaccacaacaaatgagcccatgtctgccaaacctcgcagaactccttataggtatagggcagagctgcaaaaacatatcgatcagcttttaaagtctggagtaatggttgagtcagatactccttgggtcactccttttgtcatagtacagaaaaaggacgggggaattcgaccatgtttagactttagacaattaaatgatattactgttcctgatcattacccacttccccgtatggacgcaatcatggaaagagttgcaaattgccatttttactcctctttggatttatctagtggatatttacaaataaaattaagtcccgaggcatccagaaaatgtggagttataacagaagataatgtatatcaaatgactcatatgccattcggattaaaaaatgctaccgcagcattttcaagagcaatggctcag

SEQ ID NO: 80936 - DNA, 1386 bp, Heterodera glycines
  Genomic contig location: Contig_ID=SeqID_16532; Location=33..1418; Strand=-
  SCN-specific regions: Sequence locations=1-157,179-273,295-471,493 -895,917-1386
atgagttatgcttttcgtcatgttgcggcctccacgtgtgagctcatgggagagacgcatcgttgggccgaaacggcattgcttactgacccaactgctttggctcgcatgctgttcactaactataaattaattgcaaaaagggttggtgcttcacttattaaagtttggccatgtacacaattaaaaccaaaggattatcacttcgttcctactaattccgaaaataattgttttgaatttataccaattgcatttaagactcatactgatgaaataacagcatttttaaatccacaatccatgattattgtaccttactcccgtaagacggactgcttagaaaatagggaaattattctccaactcgacggagatgttttagtcattgaccaaatcacggctcgaatttcaaagctaaatattctcagggacgataatattaagtggaacctaaacctaattccccaaattccaacacacgcttttcatcacattgttatgtttaatatcaccgatataaatttgcatgccttcatcaataatttagtcaaagttagcgatattacttatcagattcatcaaagggacacgaaaatttcttcatctatttctggtacatgggaaaaaactaaagaagagttaaaaagggaactctttggcgactggtcttacatttggaaagtaagcataacaattatctcactaatcactatctgtgatgtccttatcaggtttagtgtatttgctttacagatatacctgggagagggacgtttaggtcaattactcctaggaaatcgaggtgctagactagctcagaatgttgtacagtcccaatctcaaaatattgtctgtaatcctattacatcaccttccgctgatgagaccccggacattcaatttgttcctgttaataggatagcctcatctactaatgacttgaactctcttcggagagaaagaaaaaatgcaacaatttgtgaatcagtcttaatgctcagagtttatccaaatcaagagaaaattggttttacttcagtatgcttagatctctcaatcactcgaattaaggtgaatggaattgaattagtatcagtaattgatagcgcttcacagacttctattgctcctttacgaattctcggctcattacgagtacctgaatttaatatgatggaagtctgcgttaaattaagacctttcgggatggacccggagaaagctgctgataatgcacccgagggcaagactgtggcgtgggttctcttctcaaaaggaggggtcattttgggcgaggcaccacttttatttattaataatgctttctttgagaaggaagggtttgatttgatcattggtgccgatctgatcgatcaaatggtg

SEQ ID NO: 80937 - DNA, 1746 bp, Heterodera glycines
  misc_feature (591)..(591): n is a, c, g, or t
  Genomic contig location: Contig_ID=SeqID_2660; Location=346..2091; Strand=+
  SCN-specific regions: Sequence locations=1-1628,1650-1702
atgcgcaaggagcataaggagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcagcaaaacagcaaaaattgatcgagaagaaggaccacctgttggccatcattatgtctgatccgcagagattcggcgcaactgaccgtgtgaaaatcattaacccaaagacgggccgagagttcattgactcggacctggcctggtcaattgaacgcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaagcgggcgttttattccctcaaaatggacaagaaaataaacaaaatatacaccgacncggccaatccgggcgggtatgcgggtgcgagtgccctgtacgcggcggtgaaggagaagcacccaaagttaaagcgtaccgagtttgaggactttttgcagaggaacaccacctacacgttgttcaagccaaagagagacaagttccgacgcctacgcactgtgcctgcgggttttatgactggtgagattttgtgcggcctttttacagtttattcacgggttcagatgttcaggcggacttggccgatttccaagccctttcgcgcaagaacagcggctaccggtacctgctgttggctgtggatgttctatcgaggcgaatgttcggcacccccgtaaagagtaaacgaccgacggacatgaaaagggcttttgaggagctatttgagcaaatgccaagggtgcctgacacactgtacaccgatcggggactggaatttgtggcaaacccgctgaaggagttttacgctgataagggcattcaaaagtttgagaccagttcaaagaagaaggccgccatggcggagcgggccatccgcaccgtaaagactcggctgtacaaatatttttccgccaacaacacgtcggtgtgggtggatgtactgccaaagtttttgagtgctatcaacaactcggtgtgccgcgcgaccggacttagacccaacgaaatcagcgacaccaatgcgagggaggtgtggaagagggtgtacggcgaaggactcgcacaattggacaagacaccaaagatcagagccggggaagcggtcagaattcccgagcctaagcacattttcgaaaagggtactgtaattcacacattttccgatcaatttattttaatttttaaggctatatccccaattactctgatcacgtgtacactgtggatgagacccgctcaaccaacccccagcactatttgctcaaagactattatggcacaaagttgaagagaaaattttatttgccagaattaacaaaagtacaagtggatgaaaacacaatgtatcgaattgaaaagaaatacaaagaacgagtgagagatggaaaaagagaagtattggtgaaattcattggatttcctgaaaaatattgggtgaaaaatgatgaaataaatgaataaaaatattacaaatttaatgaaaattaaaaa

SEQ ID NO: 80938 - DNA, 1542 bp, Heterodera glycines
  Genomic contig location: Contig_ID=SeqID_2660; Location=2102..3643; Strand=-
  SCN-specific regions: Sequence locations=1-89,112-164,186-271,318 -395,421-531,553-725,747-1085,1107-1222,1244-1542
atgtacccgcgcggcttgatcgaccccgagtacaattgcgatcattttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaaaattaataaaaatcattaacaaaaatttaagcaagcggatatccagcgtcttgtacggaggcgggcatcagtgaggaggagtcggaacggcgcaagcaggaccacagcgacaaggccaaacaaaaggcccacgttcatctggaggctgaccggatcaagcacaatcccgggctccgctacctgtccaagttgtgtttaaactcgctgtggggccggttcgcacttcggtaaaattttggttaagaattatgaaaaaatacaaatcatacagaaaccggcttaccaaaaccgaaatcgtcgagtgccatgccgagctggccaaactgctcaacgactcgaagattgaggtcagcagcattgatcagctgacggaaaagttctggatggtctgctacaaggccaaagatgagcatgtggtggagcacagcacaagcaatgtaagaaaagttttaaaatatttaaaaaaagacaattgaaattttctcaggtggccattgccctatggaccacctctgctgcgcgaatccacttgctggaatcgctgaaaaaggtgtatggccctgcaccaggtgtagagcgctacgacacccgcattctctacatggtaaaattcaaaaaataaaatgaaaatgtgaagtaattttttaaaatcaggacacggacagcatcttttacgactacttgacgcggctgggggacccacttccgggtggtgagcagctcggggagctcgccgacgagtacccgaaccacacgattatggaattcatttgtggtaagactcattaaaaatagatcaaaataaatggaaattttttgtttagcggggcccaaggcgtacggattgtggctgcgcaacaacgcaacgggggaggacgagtacaagctgaagctgcgcgggatcaccctggactcggatgcctgcgagcgcatcaccttcgagaagatgaaggagatggtgcagaacaagctgggacagccggacaacaacgtccgcttcaactacccaacgaagaacttccggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgcacctgtctgttcaacccagacctcaatgtgaacatgttcacagaagaggagctgaacgaccccgacattatgccataa

SEQ ID NO: 80939 - DNA, 1800 bp, Heterodera glycines
  Genomic contig location: Contig_ID=SeqID_2660; Location=4593..6392; Strand=-
  SCN-specific regions: Sequence locations=1-354,379-853,876-896,918 -1082,1104-1212,1248-1369,1401-1800
atgccatttcatcaacaaacgcaacacacagcaaaatgcaaatggaaatgccacaactgcctgcgtgttgggtctgcctttcgaggaaactgcgtccaaggcaatgacaacttttttcagacctgcttggggtgcaataaagtaaagttatttgagtttcgtttaaagaatttttttgtttagacatttaaaagtcgtgattgctatgaacaccatgccaaatgcacaaactgccgggtcaaacgtgacaacgaagaggaaattgtgggaaaatcaatctgcatgagctcgaaaaaatgtgttgactgtggtgtgatttaccgaatggcggtaggccttgtattttaagattcgtaaaataaaataataaatatcacaggatcaagacaagaaaaaggggcatgtctgcggccacaaattctgcaagatttgccttggcttccacgccccccgcgactgctacattccctaccggcccaaagttaagaaggagaagcgctttgtgttctttgactttgagtgcacaacggacttcaagcctgacccgcaactcatgcggttcaagcatcaggtattttgttttttcaactttagcaaattatgaaaaattcaaaggtcaacttctgctttgcccatgtcacatgcacccgctgcattgaaaagggcgtttgggatcaggaattggaaaaggcctgcgcgctttgtggccgattccgaacttatgcctggtccccgttcgaattctggcacacggacgtggaatgccgcaaggtggtcgaagacccactggcagccttcaccaagtggttgctgaacttcgaaacggaagtcctcggcatggagcccggtgcgaagaagcgcagaaaaaggaagaatgccgaaaacaccgacggcgaggctatggaatgcgaagaagaagaggatgccgtagatgaggacgccgagaacaactggatgctggggtacgaagaagccggggagaagccggagtcggtgacaacatacgcgtacgcccacgccggtaattttggaattatttaaaaaaacttggaagaaataaaatttaaaggttcccgctacgatcatgtgctgatttatggtgaaatgctgcgcatgggtgtccgccctgaactcatccgccaggtgaaccatctcctggaaatgaaggcccgcaaaacaggagtctacacaaccaccgttttccgggacaggtaaatattttgaatattaaatcttttaaaatttttgatcactttagttacaagttgatcccaataaaacttgccaattttgtcaagacgtttggcctagaaattgagggcgtggaaaacaagaaatattttccacacaaattcaataaggtaagaggaatttataaaaaaattaaataaaaattaatacaatcttaggcggaaaattatggcactgtgttggacaccctgccaccgattgagaattattacccaggtggactcttcccggcagagcgcgcaaagtttgagcagtggtacgacgagaaccgggaaactggttttgagctcagtgaagtcatcgcggactactgcaagacaggtacaatttttgaaaaaaaaacatgcaaaaataacaaaaaaaattgaagatgtccaaatcctggcccatggtatggtaaagatgcggcagctgttcttgtccgagactcggcatgacatcacggattcggtcaccatcccgtccggctgcatgaagtattgggtgcagttggctcaccacgacaaagaacgtgtcgccattattcctcacctgggatacgagaagtga

SEQ ID NO: 80940 - DNA, 371 bp, Heterodera glycines
  Genomic contig location: Contig_ID=SeqID_2660; Location=7390..7760; Strand=-
  SCN-specific regions: Sequence locations=1-175,197-349
atgagccaatattccgacaattccctcccctctaccctcgacggaccgtattcccctgttggggatgacggcaccgaattgatggacgaagcaccgccattggatgaggttatgaaacgccttccgatctcggttagtttttacgaaatgtttttctaaaattcttttctaattttgggagacattttcaggttgtgccatcggacaacaatgagcgcaaggcccagaaggagccgtcaattacccgcgaattggaggcggaattgttcaacggcgatggctttacatgtctctctgccacacaggtggaagcgggacgttttaaaggtgtggttgtaaataatacatcatataaaattattattatttaa

SEQ ID NO: 80941 - DNA, 749 bp, Heterodera glycines
  misc_feature (678)..(678): n is a, c, g, or t
  Genomic contig location: Contig_ID=SeqID_2660; Location =10350..11098; Strand=+
  SCN-specific regions: Sequence locations=1-238,260-749
atggcccgcgctcacttggcggcgctcaaatggctggcgctcagttggccatacacccctcccacacctatggggggctaccgtaatccggacaaaatggagtgggtaactactcagatggatgaaaaattttacaaatttgtgccatttccgttgcccgagcgtccgttgcccagaaaaatccgctttaaattccttaagattgagtaatttaaaatcagagttatggcaataaaagcatttattccattttcagttacatcgatcacttcgtcatcgcttttcttcgttcaaatcaacaaatttttgacaaaagaggcaccaatttagagttgtggatttattccgcacacagctcggatgaccagccgatttgggatgtttttgtgcgtgaaatatggccaatttttgcatcaaacattcgccacttgcgctttatcgatggtgatggtttggacaatttgcgtcgtcgcacttcgccgacaattctcactgatctcaaactgttgaattcaatctattcatttggtctgttgcctgatccaattagtgattttgacgggccaaatgcaactgctggctaagcgttgtacaaatggttgcaaactccgagaaaagatggccaacccaagcgattgcgttgcaaagattttaacaaacatgtggatattgattggngtcacaaatcaaggaggtgtggccataatttcggcaaatcactgatttttgatttgacggacaaacaacaa

SEQ ID NO: 80942 - DNA, 824 bp, Heterodera glycines
  Genomic contig location: Contig_ID=SeqID_16533; Location=144..967; Strand=+
  SCN-specific regions: Sequence locations=1-328,350-824
atgtcccaaaaaactgttgatgatactagcagttggtggtactattttatccgtacggatgaaccccatgtcaaatgtaatagcggtgaatgggagcgagtctatgacagaaaaaagggacaaattcattgaaatgccatttggaaaaaaacacgatgataagtttaaggaaaaagaagaagcagagaaaaagaaaagagacgctgaaataaacggaaagcagcgagagagcagcagccgaagttttcaagcatgggttttcctcctcttgtcaaacagagcaacagtcatcacgcaaacgtcaacattcgccaataataaattttccaattttcagtaatttttattaatattgctaccttcaacctttttagaaaaatttgaatcgggaagtgaaaacgaggcgttattggaacataaaatttcggaaaagattgcgcttgattatcagccattttcagtggtcgaggacgaaggattacaaggcttttgaattttcttgcccctggctacaaacaaaagtaagatgtaattttgcgacaaaactactatttaacttaattaaggacacgaaagcacttttccgactgattaattcccagcatttatcaaaaattattcgcaaaactcaagtcaagtataacaaaatctgaccatttttcattaaatcgacggttggacttcaaggaatgaagcgcagtcattgatttcactaacagttcatttcattgatgaattattcgagccaaaattttatattttggaggcaagaacccgttcatgggcggcacacggccgaaaactacgttgaaattttaaatgta

SEQ ID NO: 80943 - DNA, 1260 bp, Heterodera glycines
  Genomic contig location: Contig_ID=SeqID_16535; Location=548..1807; Strand=+
  SCN-specific regions: Sequence locations=1-21,43-308,330-1260
atggagaggggactccaggaagcaatccaaatttttcaaggacatttcgagattggaatggcagcaacgggagcagaacccgcaggtcaccaggacttcttctacgacatactgacagcgccactgccggcggcgacgaaagagttgcagttgcgaaaccatccaacaccagctgaactgcttcaaattgcggacgagcacatcggagacttaaggacgatgcgacgggcactcgaggatgaagaagaagcaatcgcgcggtctcgattgagcgggtcattcgggaccaacaacagccatccggtgggggacgacccacctccactggaaaatcggaacatggaagaatgggagagatccttccaagtggcggccaaacgatggaaaaacgacggacaaggtgtaccgcaacacaacagaagaccaatgggacgagtcgcgatacccgtcatgtcgtatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcatcaggctcacgtgaacgacgactatcgggagcgtcagacataccccattcgacggcatgctcgagacgagggagaacatgatcggaagcacgggagggacgaaatcacgggaatgacaacattcgagactcggctgcaaccggcgattttttccgaaaagcccgaggattggacgacattttgggcctatttcaagcgagctgtggacgacaaacccattcccgggttcgagaagcagcttcatctcctgcgctgcttaaaggagggatcgccagcccggcgggctgtcgaagtctaccctccctccgacggcaactacccggtggtcgtgcaacttttgaaagagcgattcggcgacacggacgatttacagcgggcaattcgggcccggcttcttcatttggcaccggcaaaggacaatgtgaacagcctgacgacgatgatcgacgagtttgagcggtgcgtgtgccaactcgagcagctcggagcgaacgtggacgacgactcatttggcccattgctggaggcaaaattgccggtgcgactgctcacggaattgcggatcagagaaagcatgatgggctcgaaatggtcagtgcgcgatttcaggagagcgttgtcggcacaagtgcgatga

SEQ ID NO: 80944 - DNA, 978 bp, Heterodera glycines
  Genomic contig location: Contig_ID=SeqID_16536; Location=1251..2228; Strand=-
  SCN-specific regions: Sequence locations=1-276,319-597,619-854,876-978
atgctttccctagggttaccgtccgcaaattcgatcattggtcgcacatttcgtgccctcttttggattgtcgccgtgaatgtcagcctgtgttatttctttctgatcaaaccgtacatttcctcaccgatcactgcttggttcttcaatgttttcgctgcaattctgctgaacattggctcagcttccattggacccattttatattttacgaggtataatcacatctggcatgcaaaaatccgtggcttttcttgtaaatttagctaacttatcaaaaaataaaaataaattttctattttgttttgtaaaattttcaaaattgagacgaaaattttcttgaaaatcccggacaatccgtcagtggacaatcaattcgtcattgatggacaatccgtcagcatgtaaaactgcatccaattgtttaaatatttaatctaacaattgcaatcgcaagattttttgtaattgctcaaaaaacaaaatttgaactgacaaattgtccactgacgaattgtctgttactgacggattgtccttcactggctgattgtctaatgacggattgttcactgacggaatgtcgcatatagtagttattattaaaatactttaaaaaatgcaacataagtcatatttcagcactgattatcgtctggcattccaaaaggaacttaaaaaagcaattaaactaatgacaaaacaaaatcgagtgacgccaaagcataatacgccaatacttttagtctctacaaatagaattttaaataattgattgttgtatactgtatgtgtggctcttgtaaaatgtttattgttgtttaactcaaaacttatggcaatagctcgctttttgataaatttatttatttttcgctaagacttttttaaaatggtcaaaaaaaatgtctgactatttcggcatttttgtgtctactaatgcctaaatatctatttctgtgtctatgcgcaataaa

SEQ ID NO: 80945 - DNA, 429 bp, Heterodera glycines
  misc_feature (374)..(374): n is a, c, g, or t
  Genomic contig location: Contig_ID=SeqID_16537; Location=1680..2108; Strand=+
  SCN-specific regions: Sequence locations=1-46,90-135,209-239,261 -287,309-429
atggtgaattttggagtaagaatgaagaaaaaaagcaaaaattacgtaaaaataaattcaaaaaataaataaattatttcatattttatgtccaactttcattgttattatgattttttttgtatatgtaagtgcttaaatttaatatattttttataaatataaataaacagcgcaaataaaaaaatgtaaaattaattttaaaaaagtccgagatttagatttaaatcaggccggaatttattttgacaaatatttttatcaaatatttaatacaatttttacaattcaaattctttctttcttttggcgttgctgcttctctcacaatttcagagttgttcacttgcaattttgcaagttgagctgcaganaggctgcgtttctttaagcagaaatttttcattggacaacgccttgttacagtaa

SEQ ID NO: 80946 - DNA, 1179 bp, Heterodera glycines
  Genomic contig location: Contig_ID=SeqID_16541; Location=226..1404; Strand=-
  SCN-specific regions: Sequence locations=1-534,557-584,644-675,697 -836,863-1179
atgatcgatgcttccctatttcaaggtattggtggtgccaaaattgcggacactaaaataatcccatcattacacctttatccgggaggctataaccagcagaagagccgttgggtggacaaatcggatattgacgacctggccaaggctggtcgttcgctgatcatcggcgagtttggcagtttaccgccacaaaatggaggctccgattgggctggaattgtgtcttatgccaaatcaaaagggtaagtcaagtaaatctggctaatatagaaaatgaaatatattgtagtatccccaacagcagggctgcacgaaatcgtttcgttttcgttttagagtttaaaatttttaaatcttcgtttttcggttttcaaaattttatttttcgtttcgtatttcgttttcgtatcaaatgccctttttcgtttcgtttttgtattcttgcagccctgccaccaattaaaggcattgtccagatcagctttttttgctgcgtaccttttccaaaaaatgactaagtttacgattttgagcaaattttttgatgaaaattaggcctttttgtagaaatctccaaggacaaattttattttttaactaagtttattaagaaaatttttcaaatttttcttaaatttaaccaaaaatctatttatatagagaaaaaaatcagaaaaatttcctctaatttgtaagctaacttttgatgctgaacaaataaatcttttggaccaacatgatcagattactccttcatggcgatctgaatctgataaattttatttacatgttaataaggctctctgatgctttttctatcaaaaaggaagatgattaaaatttttaaaaatttttaattcctttttaaacaggccaaaaagtttaggcttaactttttagtgaaaattaatttactcatttttcgagtagtgctcagaagcgcaccaggttttgcagggtaacagctgagaagaatgcttattcatataattatttaactgtcccataatgtttctttaaaaattttagacattgcaattttgcgtacttttccaattttttgcaaaattaattcatgaatattttttcagaaagtgctctgaaacgcacctaattttatttacacgttaacaaggtcctcttaggcttatattatgaataagggtgaagaataaa

SEQ ID NO: 80947 - DNA, 591 bp, Heterodera glycines
  Genomic contig location: Contig_ID=SeqID_16542; Location=72..662; Strand=-
  SCN-specific regions: Sequence locations=1-19,41-353,397-591
atggtgacaaaaatttaaagacatggcaaaagaaattattgaaattcaatttttcgattaaataaaaatctcgaacggaaaatgggtcagtggaaaatgcgtcagtgaatcaggatttctttaaattgagatacgatagtaatattaccgaaatcacaacttgtttttttagggatttgggaaagtttcaattaggtattttgacttttaaaaacttaattgataaaattcagaacaaaattattagacaattttgtccttttgtaataatacaatacttaatgctacagtaactttattttaaaaatactgtattattgacaccttttccactgacgcatttgccaggagccaaaattattattatttttaaaaattaattttcatttaaattatggcacaaaaatttccagcaaataccaagtgtatgtggtggaggagacccgtgacacatttgttgtgccgttgaactcgcagcatgccaacgaaaaggaaaatgccacttttgaatgcgaagtgaacgacaaggacatcgatgtgaaatggttctatgacggtgccgagatcgggatggacgggcggcactttaag

SEQ ID NO: 80948 - DNA, 363 bp, Heterodera glycines
  Genomic contig location: Contig_ID=SeqID_16545; Location=2168..2530; Strand=+
  SCN-specific regions: Sequence locations=1-3,36-145,180-363
atgaaaattaaaataatattttcaatattatttttcataaatgcaattgataacatttatgctggaaaaataaacgaagaaaaaagttttgacgaaatatttggccaaagatgggacgaaaaattggaggaaaacggagagaatgaaaatgatcaaaatggaagaataattggacaaacggatggccaaaatgagacaaattatgacgagaatattgcacaaagattatttgcagaacaatttgatcaaatttttgatgataattcggaagtgcatgacgagcagagtgtactattgtccacaaattgtgatgaattggaacaagcgccagtaaaatttgtgatcattttataatttttgaaa

SEQ ID NO: 80949 - DNA, 1821 bp, Heterodera glycines
  misc_feature (943)..(944): n is a, c, g, or t
  Genomic contig location: Contig_ID=SeqID_16546; Location=1215..3035; Strand=-
  SCN-specific regions: Sequence locations=1-146,197-197,275-366,388 -503,525-581,605-799,822-880,902-1041,1083-1107,1141-1468,1500 -1637,1659-1789,1811-1821
atgtttaggctatcagggcttgaaaaagtttattttgaagcagattttggagataggcgcagtcggagtccgagaccggatgaggttggtaactcgtcgtgattttttcaagaatctgagccttacattttgtcagacattttaccattttttaattattttaattaaattgtcaaaattcaaattataattttatggagagagaggggaggtgaaagatagagagaaagagcaggtagaaagagagagagagagagagaaagagagagagagataaaaaattcaaaattttgactctaaatggtcaaaatttggcggaaatggccaagatttcccgtttttctgctcggcgccaaaaaaaatgttgttttgttcaggtgatggtcaacgaacgcggcgaaatggtggtcgacgcacagtcgcttgttgtcattgagaacccggagcagaacaccgcgggcatggagacagtgaacgatgtgagttcaaaagttaaaaatgcgtttaacaaggttttgatgtgcgtttttttgccaagcgtactctttaaattttgtgtccaaaacacaattaaattttgcaatttttaatggaccaattttgggtgtgttcctcaatcgcttaggttctattagtaaatactcaatactagtagagattttgattgatgccaaatttatagaatttggtcaactaaaaaaataaaataaagaatcttggtttcttataggccattttcggattttgcggtctcgaagcaatagcttaaaaaaatataaacatgttaagctttcgagtgataccaagtttattggatttgggtgacaaagaaaaaagttatagtggaaaaatatgctggggaccaactgacgtagaccgaccgatataggtatatattataaatgttttttgccatcatttattttataattcgaaaattttnntataggtattttttctaagaatcagtgctattaatttgaggtggtcgaaaaaaaacgttttaaaattttttgaaaaaaaagaatttttgaagacgtatttaaaagtcataaattaaaaatttctactaataaaacaaaacagtaacagataaaaattcgaaacttttttattaattaattttattttttattttttcggtgccattcattttttttgttaaaatatcatttttgacagccatttattggtcatcataggcaccagggatggctcggaattctgatttccgaaaaatttggggcctcggaatgccatccctgataggcaccaagttcaagcagtacagtcagtaactgttcagtttattaattatataagtaaatcatcatccaaaagctaaggcaaatttgttaatcgttgcatgattccctccaaattcataaattgtatcacattttcacctttaattaaatgccaaaaatatatgagcaatttttgcatttttcaggttttaattaattccaaataaatttaatttaaaaggaataaaaaactcagggaaaaatatgtgttttaaaaatttcagtcctttttgaatttttaatataagagttctctgattcttgtccatattttggcattttatggccacaatttcgatttcctatttttgccaaattgttggtgccatcccctcaattaactctcttctgtctgttcagctgatgaccaactttggcacgccgcgtgacgtgaagggcaaacatctgaagcgcatttgggagttggagtttccggaggaggcggctgactatcagcaaccgacggcgccggtcaatgccgcgccacagcagcagcaacaggcggcacaggtcg

SEQ ID NO: 80950 - DNA, 133 bp, Heterodera glycines
  misc_feature (16)..(16): n is a, c, g, or t
  misc_feature (44)..(44): n is a, c, g, or t
  Genomic contig location: Contig_ID=SeqID_16546; Location=269..401; Strand=+
  SCN-specific regions: Sequence locations=1-72,97-133
tgaagaaagttgaatntatttacacgaaatgaaaaagtcatttnaattcggctgatcggcctgcaggcgtgattcttcgtttttcttttgtttctgatcaattcgcaacttccgttttgtactatttggattt

SEQ ID NO: 80951 - DNA, 1275 bp, Heterodera glycines
  Genomic contig location: Contig_ID=SeqID_16547; Location=220..1494; Strand=+
  SCN-specific regions: Sequence locations=1-525,547-751,773-885,924 -1066,1088-1275
attctttatagggtttacgggtttttccaacagataaaaatttgcatatgcatatttctgcctgaatataatccgaatttcgtaaggtcctcaagccaccgtatcagcacaaatcaagagggaaacacaaaagaatgggtcagacatataatcagatcatcgatcagagagggcacattgattgtaaatccaaaaaagtgatcagagaccttttgattatcagatagaatgatggcattatgaaatttcctgacacataaacgaagtaaatgctgcaattcgccatttaagctacggcatttccgtcgtccatcagttggaacgcggtgatttgggaccggacggcagcaccggcggacgggcgcagggcgcggcgccgagtggggacgaagcggcgattattgtgcacggagtcagcaacaaaataacgcgcttcaatgtgaaattttgtcaaaaatattaatgaaccctcaaaaggcaccattattaattaaataacccagggaacactcattaatatcaattaccaattaaatgatcaattttatcccgagggcatagtattaaaaggtccttatggcactaattatcaattaaacactcccaagggcattatcaatgcgttgcgcgcccgtggcatcgaagcgtacggcaccacgtggggagacggcggcacgacgccggtgggccttgtggagctgaaatgtgcctatgtgaagcagataaggcgggaaagcaattaatgtaattggttttgattaaaccattctcattctcagaagtatgattatcgcggtgagggaatatacgggcaaaaaggtggacgtaattgcctattccatgggctcaccattggcgcggaaggtaattaattaattgatggattggaaatttgaaatttaaattttaagtgctggaatttgttggccttttccaattttttgcttaatcatttgccaatttcaggcaattttgggcggcatttgcgtggacacgcgcgagttgctcggcgtgccgttgacggaacacgtcgatacatttctaagcgtggcgggggtaacaaaaaattaaattgtttcattaaaatgggtatttgttaattaactctccccctaattttggccaataatggcgccgctctgtgcgttttgcccgcccttctgccgcttggcacgtgcaaccgcaaaaacgggttgcactgcgagtccgagtttctggcggatgtgaactcgcgcaggaattacgagggcgccgccacgttcagcatattctcga

SEQ ID NO: 80952 - DNA, 1080 bp, Heterodera glycines
  Genomic contig location: Contig_ID=SeqID_16548; Location=207..1286; Strand=-
  SCN-specific regions: Sequence locations=1-118,148-328,351-371,436 -956,983-1006,1037-1059
atggcccttctgacggtgaattaccgcgggacgactttccaacgcattgtctaccgggacgactacacactttgggaacttttatgtgagggcaaattgtcaattaaacaaacaccccaataaataattaaaatattcatttattatcatcattaaaaatgaccaactgttcaagaaaaagttacaacaaataaaattatggccaaaaatgccatgaacttgggtttctctgttaagctggtcattgttattaaaagttatggttaaaaatgccatgaaaccctgagtttctctgtaaaatgttttctttgagctttatcttgtcaatcataatgaatttgacaaatttttgatttaaattaaagcaaagcaaattaaaaataaaaattaaaaagagaaataataaaattatttattattaatttttgtttatttgccaattttacttttagcggacgtcggcggagttctcggactttactttggcctgacaattatcgccgtttacgaattggtcgtttttgcacttttggtggaccggaaaaatgccagaaaataattttaaatgccaagaatcgttgagattgaattgaatatcttattgaatacatatatttcaatctgaaaatttatcacattaaaaaaacataattttggagtatggcataaaaaaacatattccgttagcacattttttacttgtagccaaaaaaaattatttatgaattaatgcatcagaaaaataagagattaggataatgaaataatttaaacaattttgacaaaaaaaattgtcgttttgtaagtcttttagagaaaaatagtagagaccggattttccaaaagtgcccgaccggaccggtctgatattttcagaagcaaccggtttccgggcccggtaaaaaccgggcccggtcaggtcgttctctaaaaaatagcctgttttaaacaaccttttggctttttcttccagtttttgttcggcatttttagcaattattttgtgttttaaaatttaattcaaattttattaattgaccttttaaatgtttaagttgattattgttattttaaaataaa

SEQ ID NO: 80953 - DNA, 303 bp, Heterodera glycines
  misc_feature (18)..(18): n is a, c, g, or t
  misc_feature (33)..(33): n is a, c, g, or t
  Genomic contig location: Contig_ID=SeqID_16548; Location=1343..1645; Strand=-
  SCN-specific regions: Sequence locations=1-63,86-96,122-274,299-303
atgggggagacaaaaaancagcggagaatgttnggagaggaaaatggaaatggtgcggcaattattggacggaaacaattccatcgtaattaagccaattaattaattaatcaatcaattatcaatcaaaaagcaattaaatttgctgttcaaatttcagaattggtccgtgttggcaaggcgacccaaaggccgtcagagcaacgaatggatggaacgatttgccaaatttttggctcaaaacagcggcgcgcgacttttggaggattttatgaggcaaaaagcaaaataaaaattgtttaa

SEQ ID NO: 80954 - DNA, 569 bp, Heterodera glycines
  Genomic contig location: Contig_ID=SeqID_2661; Location=395..963; Strand=-
  SCN-specific regions: Sequence locations=1-146,169-193,215-270,292 -378,406-569
atggggccgatttgcgacgctatttgccgtctttggacgggttcagttggttccattttgaaagtatgtcaattcttgagtcactgggaattattataattttctcgagcaattcgggatgcgaataataattgcccagccgggcaaacttattggtttttactaattaggtaattataaatgtttgttagacttaaacggtatttaatttattttgtttgactcattgattgattgttactcatcagaatttttcttaattgaataaccagaaaaatttatcttttttgtagtgcccaatttctatacataacgcatcttggaaataattaacttttgctaattgagtaatttgtaactaattgttacttcttatggaatttaatttatttttaaattttaaaagttgcaaaaatttttagctggttttacgtcaaaaattgagtcggtggtcgaaatggttgaatatatttactctgccagcaacaactcttcttcaaatgtggccgaaaaatcacagaaaattatttcaatcgaatttgagcatccgttggatgagccgatcatga

SEQ ID NO: 80955 - DNA, 714 bp, Heterodera glycines
  Genomic contig location: Contig_ID=SeqID_2662; Location=1369..2082; Strand=+
  SCN-specific regions: Sequence locations=1-40,79-80,113-126,159 -283,305-587,611-628,651-714
atgcgaccaatcagtagagagagagaaagagaaattattcagtttttaaaaattgcatttttaattattcaaattgaaattgaagcagaaaagaaaaaagtggaacaaaaaccatttgacgaaatatttggagaacaatgggaagaaaaatgtaatgatcaaaatggaaatgatcagaaaaagagagaaatcgttgaaaaattcaacaaaataaaagagaaaactaaacaaaaagaaagaaaatgttcaataaaagaatggagtaaaattgaagtaaaaatagcgaaaaaattggggacaaatcgccaaaacatttataaatggatcaaagaattaggcctatataaatgccacaacaaatcaaaaacggatgaaaaaaaaattgaaattgtgcaaaaatttattgcaaagaaaaatgagtataaacaaaaaagaaaatatttgaaaaaggaatgagagaaaaattatagtgaaatttgtaagaaaatcggagttggccatacggtaattgaaaaatggaagaaacaattcggaatgagtgaaaaaagaataacgaagaaagaaaaaatggaaaaagcgaaaatgtattttcaaatgaagaaatatttttgagaagaattaaatgaggattaaaaaattaatgattataaatttggttcattgttcgcttttttctttacggattataaatgattatttatatatcttttagaa

SEQ ID NO: 80956 - DNA, 765 bp, Heterodera glycines
  Genomic contig location: Contig_ID=SeqID_2662; Location=2437..3201; Strand=-
  SCN-specific regions: Sequence locations=1-765
atgtttgtgagaacgccaccactaacgtggcaagaaaattttggcggggaacagcaattgagaaacagattgttgccagcgacaaggaacaccggcaactcagtggtgattgtggtggatgaaattgaacaaaacgagcgaacggcgatgaatgtaccggttgtgagttctagttcaagcgtgaacaaaagaaatgtgagagaaaatggtttgggagagacaaacgaaagatttttgtcaaacaatttcgatttgggtgtcagtaatttgaacactgcgggattagtgcctacctattcccccgcccatgaatcaaatccagtgagtttattgcatggtattggccgaagagttggcggacatggaaatgctattgggtcggcgagaaatgatgtgcagtatacgcagtcgagattggacggcgcccacccagtttttgtgcgtcaaatggctgtccactcccaactgacagctctgcgtcaatcggctaaccaccgatctggtatagcgacaaattcggccgaacaccttgctctgaacgctcgaacggagaatattctttgccacaacaacccgcagcaacaaatggagaattttcagcagaattttggacggcaaacatttcgtggagttgaaaattttgaacccggaaatcgcaattatgtttgtgatgggcgaaacgcaaacgcagaactgaacaagcccgcgctagccatcatattagacgcttccagattatattttaaaatttttgagccactttaa

SEQ ID NO: 80957 - DNA, 1712 bp, Heterodera glycines
  Genomic contig location: Contig_ID=SeqID_2663; Location=1..1712; Strand=+
  SCN-specific regions: Sequence locations=1-428,453-814,841-1206,1230 -1526,1549-1712
caaaatttttggattgagccaacaattggaattggaaaggacgagaaagtcatagccccaatgacgaatttttcgagtttgtcagtcaaattggacccagggaattccatcgggaaaaatgaagtcgtgagtcatgtcgaagaatgcgaaaattttcttgcaacttcgaatgaatacttcaaaaataattatgtagcaacagatgatcaaaatgtgtcaatcgatagaattttgattgaaattctggaaaaaaggcaattccagattcggaaaaacaaagtctgttggaattggtttcgcaattcaagagtattttcgctgtttccgattcacagctaacccaaacaacccttattcagcatgaaattgagacaggaattgcagcaccagtgagatcgaaaatgagaccagtgccttacgcatatagagaaaaagtggccgaaatgttgaaagattatttagaaagggatttaattcgtccttcatattccccgtgggccagcccagttatcgtgccaaagcgcgatgggtcgctccgtttttgtgttgactatcgtgccgtgaattcgataacacgaaaggatagttttccattgccaaacatagacaatactcttgttactgggaggtaaaaaattttttacaacgcttgatttcatgtcaggctactggcaaattcggatgaaacccgaatcggtcgaaaaaacggcgttcataactgagtttgggctccacgagtttgtggtaatgccgtgggttatcgaatgcagtggccacttttcagcgttttatgaatcgactttttgaaggaatgatcaataaatttttatttgtttatatcgatgatgtgttaattgcttccgaatcacttgaaagccatctcgaacactagaaatgcgtttttgagcgtattgaaaaatcaggcttaaaattgaactctcgaaatgccaatttagtgccgaagaattgccgtttttaggtcacactttgactagaaatggaatcaaaatgaacgaagaaaaaatacaaccagtcaaaaatttaccggttcctaaaacaaaaaaagaattacagtcattattaggcttcttcacttattataggaagtttatttactcggttggaaccattgcagcaccactttttcgtttgttaaagaaggagacaaaatttgaaattggcgaaatggaaaagaatgcaattgataaattgaaagagaaaattttaagtgatgttgtactttatttcccaaattttgaggcagcgaaaaatgacccattgaggaatttcattataatgacggatgccagtaaaattggcatttcggcaattctcagtcagcagaatgaaaaaggcagaattcgtccaatttattttgcctcaaggcaatgtaacaaatttgagtcgttatgcgccgaccgagctggaagcattggcaattcgatttggagtcatcagttcataacaatgattcctactagagtaataacggaccataaatcgctgatcggaatgtttaaaagtaaaaaggaaaccggaaatgcacgagttgacaaatggatccttgaattaaactcaaaattcactctgaaagttgaataccaaccggggaaaaagaatatgattgcggatgttttgtcaagaacattcgagacaaaagagtgtgaaacgttagaaattgctgcgccggaagatattgcattgattgggat

SEQ ID NO: 80958 - DNA, 1394 bp, Heterodera glycines
  Genomic contig location: Contig_ID=SeqID_16549; Location=627..2020; Strand=-
  SCN-specific regions: Sequence locations=1-605,655-1024,1046 -1160,1182-1246,1268-1313,1336-1394
  Gene Ontology: Mol. function=creatine kinase activity; Cellular component=cytoplasm; Biological process=phosphocreatine metabolism
atggctgtccctcaggaagtaattgacaaaattgaggctggctacaagaagcttcaggtgcacacaatgtgtgtgttaactactctaattttggactaactttcaggcggcggctgattgcaaatcgttgttgaagaagtacctcaccaaggacgtcgtcgatgcatgcaaggacaagcgtaccaagctcggagcgacttttttggacgtcatccagtcgggggttgccaacttggacagtggtgtcggcgtgtatgcgccagatggtcagttaaatagccaatcaatcatcaaccattaaacattcattcagccgaggcttacacactcttcaaaccattgttcgacccgatcatcaacgactatcatggtggctttggaccgagcagcaagcaaccggcaacggaggagaattgcgtcgatatggaatcaaaggtcacagcggtcttcgagcagctgaagagcggtaggcaaccgctaattattttctttgtaacattatgttttagatgccgagttgggaggcacctactatccgctccagggcatgtgccgttattggcccaccggacgcggaattttccataacgccaagaaaacctttttggtgtgggtcaacgaggaagatgtatgtttgtttgttttttattccatcttgatataatttttaattaagcatctccgcatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaaaatcagcgcaaaacccgaattcaagtccatctgcgacggcctgaaattgcaaatccgcgggattcacggcgaacattccgagaggtaattgtttattgttgtttttgaaacaattgtcctttatttagcgctggcggcgtttatgacatcagaaacaaggcccgtcttggtctcacggagttcgaagcggtgaagcagatgtacgacggagtgaaacacctgatcgaattggagaagaaagcataatgggaggatcgatctatgatgatgactttatattgcataatgtggagattttctagttgttctgaatctcttaggccttagctatttgtatatatgtgatattcctatattgttcatatcgcgcttgtgtgtaaatcagagttcccaagtgtgcttatttctaagatttgtgcttattttgaggggtcggatcttagaaagtaaaaatgtgcttatttctaagattcatgcttatttcagcgttacgtgcttattttgtgcttatttttggatttgaaaataaa

SEQ ID NO: 80959 - DNA, 1459 bp, Heterodera glycines
  Genomic contig location: Contig_ID=SeqID_16551; Location=788..2246; Strand=+
  SCN-specific regions: Sequence locations=1-270,292-416,439-641,663 -1459
atgtcagaccgccgaaaagaagtggaaaaaaagatggaaaaagcaatgtaaaattcaaaaatgccaattttcaatttcactttaatttttgttttcctttttttcagtttcatctccggcgacggttggctcaaagtgttcgatttgctgccgccttcccaacttggacttgaaattgcgacgatcagccaccgttttaacacatacgtggacgaccatttcaagacgcgcaaatgggcgctgaaatttattcaaattcgacgcgaatttggaaagaaagggaagaagaaattggaattggccgctttggatggagaaaaattgccaattccgaaaaagccgatgccaaagaaagtggtcggatttgaagccatttcgataaggtgggatggaagaatttcgttgttttcaaatgtaaatgccattttcacagattcatcgaccaaaatgccctcacttttctgcaccgttttcgtcgtcttttcgccgcctctccaattgtttttgccatcggttcgacgagtgatcgcattttgatcttgattttggaattgatttggccaatgttcgcgaaaaacattgattccatgcatttgatggcggatactttcttccgtttgcgtctattcgaatcgtcatttctcaacaaatgtccttcacttcgcattgtcaaattttgtgacgatgacaatttcttcatcaaatttccggccgatgaccatgccgcggcatcggatggacaagtggtggccaaatggcttttcactgccctccctgacaatgtgccgccgaagatgttgaaatgctcgttggacaaggatgatggctttttggagtcggacattgaagacttaaaagaggtgaattcggattgatttgattgacacttaacgctttttgggattcactgaggagtatttctcgcctaaaatgacatgtttcaatcaaaaacgtcctatttgttagcattttattatggccaagtgccatgccaatctttgggtttttgtgccgttccccaatcataaagtttcgttcattgtcatcatttccaatcttttaggcttttgccgaagcttcttccgccgtcaatttcatttttgtcgtccgatttccgccgtcttttgccaagtccgttgtgccattttcgctgatcaacgaattgactcgcgaacaattggcattgaaaagcactcccaatagccgtctttttgtgttcgtccgttctccaattgagcgtgtcgcgagcgaatggacaaaatgggaaaatgaggcgattggctgggattttcttgctcaatcgaatcgaattgacatttatatgtatcatgaggatcaaattggcgatgggtgagcgaatgattgattatttaaaaaacgaattcaaatttattgtttttttatttttaggattctcaacacaatgatcggcccaattaatcggaagaagaagaagtga

SEQ ID NO: 80960 - DNA, 1014 bp, Heterodera glycines
  Genomic contig location: Contig_ID=SeqID_16552; Location=388..1401; Strand=-
  SCN-specific regions: Sequence locations=1-149,171-288,312-351,373 -1014
atgcagaatatagcagttaaacatcaaacaaaaagtgagcgctcacttgtccaccataaaaatcagattcagaatgactcccttcgcagtgtcatacatctccgaaaacaacaaccctttgagaatccaaaatctaaaatgcaatatattattatttactcaatttttctcatttacgtgtcccaataataaaactcgcgaaaccgtccgcccgggataatgaatgaatgtggaacatagaggagggaatagcgttcttggtgaatccgaacgtcgtctttgaccttcagatgaattaaaaattaaaatggaaagttgaaatcagccggttactcgtctgcaaaggtcgcgccaaattctgtaaagaaaagggaagcaataagtgcaagggatatcccgaaatcaccacccctcgccaacttaaaaatgagaaggttttgggtaaaagaataaaaatcatatttcagggggttatcagttaacctgtgcaagtggagagcccaacgtttcaatcgataatcgtcgatgtgctgaaacccgtttggatagggagcccagtcgtccgggtacacctcaatcaattcttggcccggtgcttcgaaatgcgcctcgacaaaggcctccagaaccgaaacttcttttaccgaatcgcccaattcgtaaaaatcccgtagagtgctcactaatatttgtcaaaagtataagtgagcgagcgttagtttaggcaaacctgggtcctgcttgagtggcatgtcaacaaaatatttcgagtctggaaagaggtgtgcctcctgaacagcttgaagaatgggcccattacagtagatctggcttagaagtgaaacaacataatatagcatcgaattaaatccttaaattaaattgatcattacgtgggttacagggattgttagaagcgatgatgctgattctatgtcattttttcatgcaatgatttggtggtgtcatgacaactcgtacattgttacaaaggcgactcgtacaattgattag

SEQ ID NO: 80961 - DNA, 825 bp, Heterodera glycines
  Genomic contig location: Contig_ID=SeqID_16552; Location=531..1355; Strand=+
  SCN-specific regions: Sequence locations=1-499,521-560,584-701,723-825
  Gene Ontology: Mol. function=alpha,alpha-trehalase activity; Cellular component=extrinsic to plasma membrane, GPI-anchored; Biological process=trehalose catabolism
gatttaattcgatgctatattatgttgtttcacttctaagccagatctactgtaatgggcccattcttcaagctgttcaggaggcacacctctttccagactcgaaatattttgttgacatgccactcaagcaggacccaggtttgcctaaactaacgctcgctcacttatacttttgacaaatattagtgagcactctacgggatttttacgaattgggcgattcggtaaaagaagtttcggttctggaggcctttgtcgaggcgcatttcgaagcaccgggccaagaattgattgaggtgtacccggacgactgggctccctatccaaacgggtttcagcacatcgacgattatcgattgaaacgttgggctctccacttgcacaggttaactgataaccccctgaaatatgatttttattcttttacccaaaaccttctcatttttaagttggcgaggggtggtgatttcgggatatcccttgcacttattgcttcccttttctttacagaatttggcgcgacctttgcagacgagtaaccggctgatttcaactttccattttaatttttaattcatctgaaggtcaaagacgacgttcggattcaccaagaacgctattccctcctctatgttccacattcattcattatcccgggcggacggtttcgcgagttttattattgggacacgtaaatgagaaaaattgagtaaataataatatattgcattttagattttggattctcaaagggttgttgttttcggagatgtatgacactgcgaagggagtcattctgaatctgatttttatggtggacaa

SEQ ID NO: 80962 - DNA, 309 bp, Heterodera glycines
  Genomic contig location: Contig_ID=SeqID_16555; Location=1151..1459; Strand=-
  SCN-specific regions: Sequence locations=1-17,40-81,103-264,287-309
atgataatattagtaagaataatattttaataaatttttggaccttacaatttatatatttagagatattttaattacccattagttaaaagtgctttatttatttaagttattcgttaaaattgacgctttaaatttttaattcacatatattaatagttccggtcgataagtgaaacgagtataattgttatttaccttttttgtgaattaatattgtacattattgattttgaataatattatttctcacaatttatgtgatattttcttatttgtttaaaaatagtaatttattacaataataaa

SEQ ID NO: 80963 - DNA, 1164 bp, Heterodera glycines
  Genomic contig location: Contig_ID=SeqID_16556; Location=152..1315; Strand=+
  SCN-specific regions: Sequence locations=1-169,192-493,519-581,644 -654,676-753,775-1005,1028-1084,1106-1164
atgtcgggttccctaagtgtcggatacccaagtgtcgttcggtccccaaatgtcgggtccccaaatgtcgggtgcccaaatggcgggtccccaagttgcaaatccccaaaaagtcgggtagcccagcaaaaaatctattggcttcgttcatacaaaccgagaggagtcgattggtttttatttagccattttgggcttcggcccatatgaccgatgttttccctaatcataatagcaaaatgaatttaattactatgttcgtttcagcaattttgtgcttcatcaaaaggttcggatcgaccaatgtggtcgcgagtgaaactgatcgcctcgcctcatataacttcgaattgtttcgcaaagacttggccactattcgctacatgcttctggatgacatcgaacttttccagagagtgcctcgatgtaagttgttgaggccgcatttttccgcgttttgcgaccgcggtgaaattaggccacgttctacatcaattttcaaaaatttaaatgatattttttccaaaatatatgtaattaattagttgttgtacagggaccgggaatttgttattttcaagtaaaattataaaaattaataatttaacgcaaaattaaattataatatatttaatcaatatttcaaaccaaatttatttcaaatatttcaaacaataatcattttggactaaatgatcgaatattattagaaatccagatttacatttcaaatcacttttttctgcgcgcttttttcaaaaaacttttgggaaagaagggggtccgggaaaattcaaaatattttaatttctgtagagggattgaaccatgggaagaagattatcgatatcgaaaccgggaaataaattttaaaatccgggaattgggaccgggacctcggatgtccgggaatcgcccggtaccggacccgtacaactctagtaattaggcttcagatttcctaattttttttaaagattacagtaatttttattttttcttcgaaatttattgtatttctttcaggaaaggtactagggaattgcccataaacataaaaattgttatattttgttcattacaattgaaaaattttcttgtattttgtcatttataatctatatatatatatttgctaaatttgagtgaatagcaacacgtaca

SEQ ID NO: 80964 - DNA, 524 bp, Heterodera glycines
  Genomic contig location: Contig_ID=SeqID_16556; Location=1451..1974; Strand=-
  SCN-specific regions: Sequence locations=1-39,61-112,134-164,201 -210,232-399,421-470,497-524
atgcaaaggatttcaaacccgaaaaataatttctatttagttgctctgaaaaagttttggaaaccagaggccttcagagtaagtaaaattttatcagcaaatccgagattcctgcataaaatgcttcaattatgcaatatgtttacatgaaattttttttcgataattctagaaatcttcttaataaaaattagttaaaattccgccaggggaaaagaaaatgaaataaattcagagcattacccaaaattgaaaaaaaagtttaaacaaaaatattcaaaaattttcagttcatatttttgtgcataattttttaagatttttaaaaaatccaaattttaatgaaaatttccaacggtcaaatgaaggatttcttcatttttcccagaatctttgtgtccattcatcttcctcctcatagaacgcggaaatgcagtctaagtctaaaaattaatgggaaagaatcatgcaaatataaaatttttattttaattatctaggattgggatttgaaaaataataaa

SEQ ID NO: 80965 - DNA, 834 bp, Heterodera glycines
  Genomic contig location: Contig_ID=SeqID_16557; Location=394..1227; Strand=+
  SCN-specific regions: Sequence locations=1-1,26-38,60-77,99-108,145 -174,196-247,269-468,500-744,768-834
atggtaattaataaattaattacataaagacttaaatgatacaaaattataaattgtcaattttggtaatgctctgaatttatttcattttcttttcccctggcggaattttaactaatttttattaagaagatttctagaattatcgaaaaaaatttcatgtaaacatattgcataattgaagcattttatgcaggaatctcggatttgctgataaaattttacttactctgaaggcctctggtttccaaaactttttcagagcaactaaattgaaattatttttcgggtttgaaatccattgcatccagccaccaccattgaaaataagtggctggcttggttaaaacaatttttcaaatcgaataaaagcctggggggaacgcatctcggtgatcggagatcgtcggggaggacaggtcgaggataggggacgaggaaaagggaactcgggagagattaacaaccatatttttatataattaataaaacattaaaagttttagtgtccaaaattcaaaaaatggtgggatgaacaatttggagagtggctgagggtgaattcattttacactcatttgaattgtcagaaaaggggattaaatttggcaaacaaaaattttttctatccgtttttaggaccagtgatcaatccgtcagtaagtggacaatccaatccgtcagtggacaatccgtcagtaactaacccataagcaaatttatttttaaaatacccagatttatttaaaataatgtgaaaattatttaagtcgctaaaaatgtgaattaataatttgtgttattttataaaaatgtgaaatgatcttaaaagaa

SEQ ID NO: 80966 - DNA, 1164 bp, Heterodera glycines
  Genomic contig location: Contig_ID=SeqID_16558; Location=601..1764; Strand=-
  SCN-specific regions: Sequence locations=1-125,196-228,424-562,609 -688,872-901,934-1091,1113-1116,1139-1164
ctacaattatcctggagcatattgccaaattggaattttatggtcacacaaacaagaagaagttgggcacatttaaagcaacatcagtggcacaaattgacgtcaaaacggagggtaattagaacaaattatttattaagaaatataattaaaaaaataataaaataattaaagaaaaaatgttttaaaatataagtcgtaaatttttttatttgggaattcattcaataatttaaataaaaatttatttaaacaaaattctaataaaatttataaaatttaaattaaatttcactttagtaaatttttttgaataaaattaattctaataaaatttttaattatttaaacaaaattcaaataaaaattataatataatattttaaaattagattaatttttaatttttaaaataaaatttttcaggcgatttgatcaaagccaacctaacactgcccactttggtgctcaccgacattggcactgacataaaaagtggcatgacccaagatgggctcgactcactgaccggcctggtgaaggacaaagtgcccgaggttcgaatttttgaaaattttaagaaatttaaaaaatttttttgaaaatttcagtcggcaaacaaaaaattggcaaagggatgcaaattggatttgccaccaggcgttggtggcctaccaattgtaagagcaaattttttattataatgaatttcttttatgaaaaatatttaattaattaccattttgaaatattaattaattaattagttaattaaatttcattcaattttatataaatttattaattagtgtatttttttccaaatattttttcaattttttttactaataatttgttattttaaaaatttcggcgtaaagcaaatctcggtttcgggctcaaataattattatatttaaataaatttattttctttttagcgtattttgaagcccgaagtgaattttgtggcccacgcggttcatttgaagtccaattttgagctgtattcaactgatggctcttcaccgcttggcgccagcgaaccatgcgaatgatttaactaattaattttgcatttttttaaaaaatttctacattttaattcgtttgaccatttttgtatataatttcttttgttgtaacacttaaaaaacaaataaa

SEQ ID NO: 80967 - DNA, 705 bp, Heterodera glycines
  Genomic contig location: Contig_ID=SeqID_16560; Location=20..724; Strand=-
  SCN-specific regions: Sequence locations=1-200,222-705
atgtcggacatttatgtcgaacgcatagaaacagctaaatatgcaattgagttatatctggacaagccattgcccattcttccgcaaggggtgttaacctctcaacagagacataatttaatttgtgatcaaagggaatggaaagaagttgcggacgagattcagacgcaagtggacgaaataaaggcagcaagggcattgtacaatcaagaggcttctacgcttcacggcgatgaaaaaacggagtttcaacgccagtatcgtgcatcagtcaacgcaaacgatctgcaaaatttgttgcgaagagcaaatcataaattggccgatacccgcacgctgaaagggaacattgatcgtcttcttcaagatgggcccggaggaacggcacgccgaaacattgccttgccaaaattaaacctaaaggagttcgatggcagtaattgggatgacttttggccattattcgaatcgacaatacatgctgatgctgatttggattacgtacaaaaaatgagttatttggattccctgttgaggggtgaagccaaaaaggtcattcaaggacttttgcccttctccagggataattatgatctctcggtgtccttattaaaggacaagtatgggaaaaatgaaaatttaatcagagatttacataatcaattggcccggctctcaattctaagtctcttggagacgacatga

SEQ ID NO: 80968 - DNA, 1355 bp, Heterodera glycines
  Genomic contig location: Contig_ID=SeqID_16562; Location=869..2223; Strand=+
  SCN-specific regions: Sequence locations=1-347,370-866,894-949,971 -1355
atgcccgaagtgcgggagccaaagttcaattttgggtttaactctgccgggacactaattgaagtggtcaaaagtctgggccaaatttgggcattcttttttgataagcagctcagaaaacggtttggcacctattggaaatgcatgagtgagctcagtaattacaagcgtaagcccaaattggcaaatgaacgagaaatcgtcgagattttggagacgaatgccctgaggctttaccaacattatgaatatctgtttaacaatagcgaaacggccactctgagtcccaactcaaagttggaaaatttattccgaactcttcgcaaagtttttgataagaatttggaagaaatgtggagcaaaatggaaatgatcaagtcatcattgaatgaactaaatgtggaaatttcagagatgccattttatgacattgacaaagcggtgagttcaaagagaaagttactgccaataaactaattatgcacaattaaataattcattaatatattcgtcatttatttgatttctgctgatcttcagatcaaggacagtgcctttcttacatttatcatcgacagaaacaatctgaaaatctttagtatgatattaagcgctaaaactttttttaacgtttttggatcggtgcataaaataaatgtcggcacttatcctgagaatgtggtaggatatttggcgcaagaatatgaagcttatcttggcattgtgcatttgctgagagagaaatggcaatgtgccaatgttttgcacgagcagaaaaaatgcgaaacgttccgcgattatttggacattttgtatgaatttttgttccatatgtattatgaaggtaatcacacagaaaagacaacaaaataatttaattaaaaaatatttaagggcaaaatttagcgatggaacaaaataaatgcgcggttaggccaaattttgtgcttggcaacgaaacgaagattctgtcactgattgaactgttgaagaaattgggccgaatttcggcattctttttttctccaaaatattcaatgactttcgcccacaaatgggaagtgtttgtgcattataattccgagctaaaattggtgattgaccagcaattagaaaatgaaaggacccaacaatgtccaacacttgtgaaaagcattaaacatatgaagatccgatcgcagaaaaggaagccgaccatggatttaagcacaatggcacaaattagggggaactttgtcaatttgctggcgatatgtgccgaaacagtgaaaaggatgaatttgaaggacgtatttggcgagtacgataacaactgggattggttgttttcaaacaaagaccaattaacggtttaa

SEQ ID NO: 80969 - DNA, 1415 bp, Heterodera glycines
  Genomic contig location: Contig_ID=SeqID_16563; Location=74..1488; Strand=-
  SCN-specific regions: Sequence locations=1-256,316-405,432-749,777 -917,939-1303,1325-1367
atgtcattgaaccgtttttgtgccatttgttgttcccaaatgtatcggtgccattggtcacataaaattagcaaatatttattggcaattattcttttgttcgctttggcaatttctgcaccaattctttggcattctgtgtgctttcgattgtctgaagtgagaacaccgtttgaggaaggacaacacaaaattgtcggcctcgtgttcatggagatttcaacccaagtaaaaaataggagtataaaaatataggaaaattaattttaaaattaaaaaaaaattttgtatgaaaattgtaaatttttttaatatgggcgggaatggaggcgctactcaaaatatttttgtcagctaatacaaaatgagttatttaacattggtgattttttttaaagttccaaatttatttttcttctaaatttgattttcgaatcttttttggataaccggccgttggaattcacagcttcggtttacaaatgtttgatattaattatttttttttgaattttcttcattttagcaaatttattacaatatcaccaaaatgtttgccatttgccacttggcttttctgctctttgcttatccgttaatgtgccgaagggtcagacaaatgaatttgaagcagcgcagtcaccgtgttgaagttcgaatgtgttacgccatcattttgctttcaattgcaaatcttctcttcgcaatttatctaatcacttggtaattttaaactcttattgaatagcaaataattaaaaataattcatcaatttttccttaaaaagtcaaaaaagagcaatcatcaaaatcccaaaaagctgaaaaacgccaaaaaagtgtgaaggaagcattaaacaaagtttaaaatacttttttgagtcattttaaggccatttgattcagtagaaaaaaagtcattttttaaaatctaaaaactaattgttttggccgtttttagcaactataaattagagccctagtaatatgtcccaatcctcaaaattgctcagaaaggaattagggcactgaatcgtccattttttaaaagggaatccgaaaccaaaaatgaaagaaaaaaaaactataaaatcaattttcttgataaaaaatgagttgactacaataaaagccatttatggtttagaaaagagtaagcaaagtattgtaataattgtctatttaaagcatcattaaatttagggaaattctgtcccgagggcatgccgaactttcaccaattgccgaatggattctccttatgattgtcgatttttacgacttgaacagtccttatggactgataattacttcaaaaattatacgtaaatacacgttgcccttctgtttattaatgcgtcgaaatgaaataaatatataatttttaattatactaaaatattatgtttaataaa

SEQ ID NO: 80970 - DNA, 559 bp, Heterodera glycines
  Genomic contig location: Contig_ID=SeqID_2665; Location=87..645; Strand=+
  SCN-specific regions: Sequence locations=1-377,399-559
atggtatatcatttatatgcattttcctagttacagctcggaatgttcccttgtaaggtgtataaaacgtgtttcagagggttttcggggtcgctaatcacgaatcaagcatccatttcgcccaattccgaaccccggactcgattgattgtcgttaagctgtgttgtctgtcagctgactggttcttacgcggcctattttaattcttgagaaaatttagaattcttagaggtgtattttctgaaattttttgggtcatttcttggtgtcgtttttattgcaaaaaaataggcaccaaaaatggcgaacaaggtacaaaatatgtaggatatcctacgatacttttattctgaaaagtcgtcttctgaaagcgccataaaaaattttattttcaattcgttgctgtattaattttttttgatcctacactgtgtaacattagaataaggacaccctatttttgggagtttgaccacttcccatgaaccgatcgagttgaaattttaactgtacgtagcaattctgaaaatattaagattctaaaattgagaacccgaa

SEQ ID NO: 80971 - DNA, 862 bp, Heterodera glycines
  Genomic contig location: Contig_ID=SeqID_2667; Location=49..910; Strand=+
  SCN-specific regions: Sequence locations=1-309,399-553,575-594,616 -616,638-862
atggacggaccgacaaaggcaaaaggcgccgccccaccaaacgccgcggggccaatgggacttttggtgattttttaattgcataattaaataaatcaaaattcagcatttattgaatggcaatgaaaagggaaaagcgccctctggcgaaagtaagccaattttggggcagaagccgagcgtagaacggcaaaagagggacgttttggggcacgccggcggatacgtcggaggatgggaccatcccattgactcgacactgtaagaacataaatttaataaaaatggtatattcaaaaatggaaaatgtattttaaattaaataattattattaatttgaattattatttttaaaaagtttagaaaattaaaatatttatttcttttgaatttaattgtcctttattttagtgattgggtaaagagtcagtggaatgatgccaattggctcgccgatgttgtcaacagaaacgggtgggaaaataccggctctcctaccggcggacgatgaatcagtgaattgtgccgacaaaagaacgaaagatgatggcatttttgtttgggaaggaatttaattcgacatttcgggtgaccaaaaagactttcctttttagttttctatgtattaataaaatagcattttcttcactgtttacagattggtcggtgtgataaaaaattttcatactcttttggatagttttgcggttaagcaaaaacggcaaaaatcacttactgacgaaatcaccgggaaccgttttggcccagccgttgggctataacttttttttattcaaccaaatctgacgatcttgatatcattcgaaagccattcacatttcaatttggcgcatgctttaa

SEQ ID NO: 80972 - DNA, 1665 bp, Heterodera glycines
  Genomic contig location: Contig_ID=SeqID_2668; Location=1177..2841; Strand=-
  SCN-specific regions: Sequence locations=1-240,262-1384,1415-1665
atgtcttctgacgaatcgacgacttcttctgccagtgctgtgagcgttcagctgcgtgaagtgcccatcaaagacttcaatgacgtgcttccggtgctgcagaaaacgctcaaccaattggaacatccgttcatcaagaaggctgaagaaataagcggaatggaacgtgaaaaggtggagccagcctaatctcttgtttcttcttttaatttacactgttttgcccgggttttcagctcttctacatcacttcctctcttgtgctgctcgtgttgatgtactgccctggcaatttgtttctctctactcttatcagtgcgttttgaggagagagtgccgtttttgtgcagcctctgctaactaatcgctttcctttgtttaagctgtggcctacccaatgtacgcgagcttgttgaccctcaacactcaaaacacatgtgagttttctgctgtgctttctctccgagtacaaagccaattccccaatttccagcggaatacacccagtggctcgtttattggtgcgtgttcgccgagttttgccagttggaccttctctttggctctatcaatggctgccttctgctgctgtacgtgcctttgaagaccgtctttctgctctacttggcccttccgcaaacttatggcgctcacaacatgtacgtgaagcatatccgcaaatggattgccatgacgaacgtattggacaagatgaagaagatgttgtgatcgaggagacaacatatcactgtgtaatgtgtgtaggatgattctttgttgtgattcctatattgtgtgtatgtattgtttgtggagtaaagccctataattgtataaacaatatttctaacagcttcatcttcatgcgcacttttttaaactaattcgactgttaggcatccaaatttgtaagctcaccggtggtacttatgctgtttacagaccataaaaaaagtttataaatcatacataaaacatttctagggggtttcgggatccttgatcacgaatctgacatccatttcgacctatttcgaatcctgggcccgaattcgcacaaaagtcaaaattaatttttcacttaaattccctttatgttagaatctaaacagaattcaggtccgcggttcggaattggtcgaaatgggtatcagattcgtggtcagcgagcccgaaaaccacgtacaaatgtttatatgtttgatttataaaaactattttttttatagtgcgtaaacgacataagtaccagctcaccatttcggaattaaaaatgtgattttttttcaatttcggcaatgatttcattaacaagatgaacagttgcacacttttgcctactccgaacccgaaaccaaattcgaacaaaaggtcgaaaacctcgaattttttaaaaatttgcttttatgttagaatctgaacaaactgatcattttttggtgtttcaatgatttatgactacttttagctttttttaaatcaattttatggcagtagtgagaattttcaaaaattcaaattttcgtaataattttcatattcgtgatcggcgacctcgaaaccccctgggttgctaaagccactacccatgcgcgtttcgtaaaaccgccagcgcgtttcgtaatccgccaatgggttcgaaacaaaaaatatgtaacaaataaa

SEQ ID NO: 80973 - DNA, 1120 bp, Heterodera glycines
  Genomic contig location: Contig_ID=SeqID_2669; Location=742..1861; Strand=-
  SCN-specific regions: Sequence locations=1-631,664-821,843-952,977 -1033,1055-1120
atgtggtgcccagtgtcgatgttcctccagccggtgccgctgcggtcttctgcgatgcggtggcgatgcgttgcccagtgtcgatgttcctccagccggtgccgctgcggtcttctgcgatgcggtggcgatgcgttgcccagtgtcgatgttcctccagccggtgccgctgcggtcttctgcgatgcggtggcgatgcggtgcccagtgtcgatgttcctccagccggtgccgctgcggtcttctgcgatgcggtgcccagtgtcgatgttcctccagccggtgccgctgcggtcttctgcgatgcggtggcgatgcggtgcccagtgtcgatgttcctccagccggtgccgctgcggtcttctgcgatgcggtggcgatgcggtgcccagtgtcgatgttcctccagccggtgccgctgcggtcttctgcgatgcggtgcccagtgtcgatgttcctccagccggtgccgctgcggtcttctgcgatgcggtgcccagtgccgatgttcctccagccggtgccgctgcggtcttctgcgatgcggtgcccagtgccgatgttcctccagccggtgccgcttaatgctgcggcagtggacagaaggtagcgatgcttctgtcgtggctgattttttaaaatcatttcccttttcattttcagaacacggaagagccgcaaatgccggcgggacaggaaggggcggaggccagcgccaaaccgacgggacagagcgcagcacctggtggaacttccgcggtgggacagctgccagccgaagcctccaagaaatcattggctccagcggggaccggatcggcgggtgagaggagagggacgggcgggcggggaagcgtttttttgttcaccctaacatttttcctcattttcagtgccctcagcgtacgcggcgcccggcacggggacggctatgagcacgacatcgcagaagtcagcagcgcctgctggaggagcctcggcactgagcaccgcgtcgcagaagtcagccgccggaggaaccgtgtcacagaagtcagcagcgcctgctggaggagcgtcggcactgggcaccgcgtcgcagaagtcggcagctggaggagccgcgtcgcagaaggcctga

SEQ ID NO: 80974 - DNA, 435 bp, Heterodera glycines
  Genomic contig location: Contig_ID=SeqID_2669; Location=2690..3124; Strand=-
  SCN-specific regions: Sequence locations=1-74,96-231,253-435
atgttcggcacattgcgattcattgcgacactttttgctgttactgcactttttcttgatgagtaagtgacaaatttgtttttcttttaacttgggtttggtggtatcaattttcacttaattatagcgcattggcatttggtccccgcgcgtttctgaagcgccaagcgcctcccagcgcagaaatggcaccaccaaaagcggccatggaccagcaagttgcgatggagctacagcagcagcagaaacattttgagcgctttgtgatggagccgcagcgtgtggtcccattcgtgccgtcgccagctactgcttagtacggtggcggtgttggtggtgtatcgtatagcggcgccgcattcgcgccccaacaactgcagcagaagcggttcgattacgtaccgacagacccctacagctatgagaggtaataaa

SEQ ID NO: 80975 - DNA, 1409 bp, Heterodera glycines
  Genomic contig location: Contig_ID=SeqID_16566; Location=32..1440; Strand=+
  SCN-specific regions: Sequence locations=1-24,46-371,468-504,537 -1175,1208-1409
atgtcgttgaaccaagtgcgttaatattcactgaatatctattttcaacactttcaaaattttttggctcaaatttattacatctttcaaaactcccttagaattaattattcgctaattgccttttgatttgccctctaaattttaaaagatcgttcgttccagaggctgtcttgtaacaacggcgctggacttactgcatcatttgccccaacgccgtatggccaatcgcctcccgaccaaaatcaagccatgcttgccgtcccgatggcaattcgtccaacctccggcgcaccaccgacaatgatccaatacgggaccacgaccgcgatgtacttcaatgcaccggcccaacagcaccaaatgatggtcagcagcagcggcacaagcagcagtgccgaacagcaacaagctgctgcagtccatgcctatcaacagcagcaacaacaacaccaccacgaacagcaaatgttgtacgccacgggcaccatggccggcgggtcacagcagcagcaacaaccacagcagcagcagcatttcttcccaccgcaaggagggccaagcggagcagcacacccgggtaaaagttcactcattcccaacagcaacatttaaatgacacaaattcgtatgtaattcgaaattactgtccaggaaccccttcaccatttcttcctccgtccatggcgcgacaaccgtccttaaccacaacagctgcgccttcctcttccccggccacaccggtgtcaactccgaccaattttttggaacgcaacgcggacattgaggcgctggtggcgcgcggagtgcacacgtggaccgtaagatttaaaaaattttgcttatgggcccacttatattttttatccacagaaggaagaagtgtccaaatgggtcaatttcgtcaccggctccgaaaccaacggggaccgttttgtcgaggaggacgtggacggcgcttcgctgctttgcctccagtcggagcagttgaaaacggagctgaagttcaagctgggcccgcacataaaaatttggagcgctttggaggcgcttaaacggacgatgatgtgctgaataatggagggagggatctcgcgaagcaaatataaatctgctgctgacgaatggtcatatattgtagttctcctgtgtatttctatcacattgaatttacctaattattttcatttatataaaaatatttattgtccgtaactctctcttttctcgcctttcatatacaaacacgcttcaaatgcgaagtataaaagtatgtttgttttttttggtaactgatcgggtcctaatatgtgaccataacccatatcgctcagttgacatcgccagcccttagggattggtaaccatcccgctgtagcttttaaattccagtttcaataactattaaa

SEQ ID NO: 80976 - DNA, 310 bp, Heterodera glycines
  Genomic contig location: Contig_ID=SeqID_16566; Location=1002..1311; Strand=-
  SCN-specific regions: Sequence locations=1-73,106-310
acaaacatacttttatacttcgcatttgaagcgtgtttgtatatgaaaggcgagaaaagagagagttacggacaataaatatttttatataaatgaaaataattaggtaaattcaatgtgatagaaatacacaggagaactacaatatatgaccattcgtcagcagcagatttatatttgcttcgcgagatccctccctccattattcagcacatcatcgtccgtttaagcgcctccaaagcgctccaaatttttatgtgcgggcccagcttgaacttcagctccgttttcaactgctccgactggaggc

SEQ ID NO: 80977 - DNA, 1197 bp, Heterodera glycines
  misc_feature (1011)..(1011): n is a, c, g, or t
  Genomic contig location: Contig_ID=SeqID_16567; Location=30..1226; Strand=-
  SCN-specific regions: Sequence locations=1-578,601-1197
atgcttcgtgccggctcttcagcatcaacttcatcccgactctcaaaggaagaaattgatgaaattcttgacaggtattcgtagtaaaaaaaataatacaaaaattatggggttttggatgtagcaattaccaagaaaatataaaagaaaaaaacatttcccggtagaattgaacctcactgaatcattcatccatattttctggtcgttgcaatttagatagaatttcgaccatttccgttcccggcaaaaatacgtacaaaaaacgagtgtttttcaagggttaatgatgctgtcccaatcctaaattttttaattgtcggttttagtttttttttcaaccataaaaagcaacttaactgacaaaaaattttcaaaaaaattcgtaaaattaatttcgagtttttttagtccctatgagacgaggtacacctattccgactcagccgcctacaagccgcacattggctctcatgactacgtgcatcctcggctttgtcgtcgttttccagcaacccaaataccacgctcggcatcgccaccattcttgacatacccaacgggcacatggcaaaattattggtaaataatgatttaaactccggttttcaaccaaaaattcaattttataatatgtaatttttgtaacatcaattccgttggaaaatgcattttaaggcgtcgtcctgatcaatggacatggactcaactgttcttttatgcagtgcagttttttgcaatttttgcctacaccgttgttcaatacgcgttagtgcgaggtatgtttttgtttctgaattaagtccgactctttttttttgatttcacgatttaattaatttttctttgattttaaaaattttgtatagcagagaatttcttttcacgccgaaccatttttgagacggtgccaacaaaattttatacaaaaaatatcaactccttgcactatgtttcacaaggcatttattaatttggattcaactttaattaacccacaaatggttgtanaatgggaagataaacggaaaaaatagtacacctattgacattgatttccgtttttaatttcagtttattacgccttccgctatctgaccactcgggctgcttggtatgccatcaaatacaccattctttggccaattttggcaccgtataatgccgcagtcagctactacaataaaggcggatttg

SEQ ID NO: 80978 - DNA, 810 bp, Heterodera glycines
  Genomic contig location: Contig_ID=SeqID_16568; Location=818..1627; Strand=-
  SCN-specific regions: Sequence locations=1-110,135-289,317-479,502 -508,614-624,696-810
ctgacagatgacaaaagacagcagcagcagaagcgaattaataaccgcgaacaatataatgacatgagtacgaattatgaaataaaaaatttgttaaatttttttgcaccattttaaaaatttattattattttggggataagaaaaccggatgacgcattttaaaacaccaaaaatcggataaagttttttcatggtaatggcatggcaccctgaaattttccagttctgatggatttggcaaatcaaatttagggtaattaattttaattagcacatttaaattttaagtgtccagcagcagcagcagtggttgttggactccagcacagctcattagctctgatgaatggtcaaaatggacggtgaatgaggcggatttatcaattcggccatgcccaaaaacggttcaattgtcacttcgattgccaaatggacaaatggagcgcatccgaatgtggaaagcagcgccattgaatgtaaaaattattttttcaaatttccacagaaaatataattaaaaaattacaagcaaaattataaaaaaatgatcaaaagaatgaattttgattaaaatactgtaaataaataaatttgcttattattatatttagtgagaatgtcaaaatatcaattttaaaaatctaaaacaaaaattgatttaattaatttttaacaatttttcttttaattaaggccgtcttctcaatgctccttgctaaagggcataattattcgtcaaacaattaccaattggtgttggactatccaagacgagaatttgttctctgcccacaagtggctaattaa

SEQ ID NO: 80979 - DNA, 2057 bp, Heterodera glycines
  Genomic contig location: Contig_ID=SeqID_16569; Location=37..2093; Strand=-
  SCN-specific regions: Sequence locations=1-205,228-331,353-523,546 -566,590-590,614-1003,1058-1106,1132-1225,1266-1268,1294-1549,1573 -1582,1749-1940,1962-2057
  Gene Ontology: Mol. function=1-phosphatidylinositol-4-phosphate 5 -kinase activity; Biological process=phosphorylation
atgggcacatttaaattacggttctgtgccccctatatgttcacagcgttacgtgccgtatttgaccatccacccgtgatcaccagtgaagatctgatccgttcgatagcggaaaagccgcttaaattgatgccaaatccggcacaaagtggtgccagctttttacgcactaatgacgcccaattcttcatcaaatcggctgatcaaaatgaaattaaattcttccacacatttacagatagaatgtatttttttaaattactaattttacctttagcaatttttttttgtataattttcggtgcccattttctgaactattttgaaaattgctattaagatttaaatatttattgggccgaaaaacaaaaatttagaggcaaacagaaagaacaaataaatttttttgttggcggaatttgggactattatgaatattttcgtgaccaattgatcaatggcaaacgcacacttttgcccaaatattttgcattatttgatctgaaggttgtctttattaaattaaatgatttatttcaaaagttcatacaattctaataattatcattcctatgttttataattacctcatatttattttaataattttaatcattctctttttcaagcactctaaaagcaaggaacatcaaaattttataatgataaacagcgttttcccgcaaaactttccaaaaattcactacaaatttgatctgaaaggcgcttcaataaatcggaaggaattaaaatttggcaccagtgacgaagcacagcacaaaacatgccgcgatttggactttttccgcttcaacagcgaggacaaaaatggtacaatggcggagggactgtttcggcacggcatttgcattggcagggaaaagcatgaagaattggtacaacttttggaggatgacacatgggtaagaaaggggggtggggtattttttataagaagttaaattctaaaaaaatttacaataaaactaaaagagagatttggtttttaattattgaatttgattattataaaattcaaatttagtaatttaaatttcagtttttaaaagcacacaatattatggactacagtttattgatggctgtgcattttgttggaaaacaaaaattaccggatgaatggcttgatgagctgtaagtgtagtaattatagataattttttaattattcttctagttttggataattttcaattaaatttccaattaaaaaataatttattaaataagttctattttaaaaaccgaaaaactttttcaaaatattactacatattgtttattttttaggccatttggcgtgttccatggcaaatgtaacaattgcaaaaatccgtttcgtaatgtgtacgaaaatgaccaaaagctgttaattagcattggcataatcgacactttgcaaacatatgattatccccgagaactcgaagatatatacaaatcttcgatgtccatttttagaaaggtatgaaaattggccgaaaatgacaaaatgtcggcaaaaaatgtttatatttttgaatttagaaagatggctttctttttcctccagaaacacggcaaaaatatgtaaaaattatttattataaaaatattaatttagatttacttaaattatcttaattaaggaaacaaaaaatttttattgtaatttttaaaaaatatagctatatttttaatattaaaaattaagtatctttttattaataaataaataatttatttttgaaattctttttaacttaaatgatgtttagaagccaaactcggtcaaacatccgtccgtttatcgtaatcgctttctggaagccattttgaccgtatttttacgaccgaattgcatcagttcgccagaaaatgatgaaattattcatgaaaaaagagaatataaagccgaaagtcaatcgaaggaattcattttgaaagcaatggcagaaaaaagtgatcagacacaacagaaattgattagtccgtcgaggaaacaattggaacgacggaagcagcaagaaaaaattctggaagacctacggaattag

SEQ ID NO: 80980 - DNA, 1522 bp, Heterodera glycines
  Genomic contig location: Contig_ID=SeqID_16572; Location=256..1777; Strand=+
  SCN-specific regions: Sequence locations=1-753,776-859,881-891,926 -934,959-1050,1072-1381,1407-1522
atgtcaatttttgggtgtgttggtgaaatgtccgaatttggattagccggcgaaatgtccatacacacctttctcattgtaattttttgccatactgttaaacgaaaaaaaattttgaccataaaaaatttagaaaacttcaactataacacgattaaaccatgtgttatgacttttgttttaaaaaaaataatggaattttgtgaatttgtttttaagtttcgaataaatttagctaggcctgatattagtgctgacaaatggttgctgagcacgaagttttgagccgctttaatctcgaaaatttttgtaaatcagcaagtcgagaaaaggaattgaaaaaagtgaaatgaagttgacaaatttgtaaacgattggtcccccatacacagaattttgttttctttgtgtgatcattgattgatcagaatcagagcaacgacggcggtgagcccggacgatcgggcacttggccattttcgatctaaatttaatgaggtgaaattatcacattgaactgaatgttttaagcaaaattggtgcgtgaaacacaaaacaatttccttattaagctcgggcggaagtcgtatttcgatagctatgaaactttttaggcagcgcccaaaacgctaacgcacgcgaatcgccaatttttttttcttgcatcatttttcctcgtcattcttgtcttgctccctaaaatttatttccaagagccaaccttaattccattcatcaaaagcaattttttggttatttaattttttttttttttgtaaggcccaatcatcgcccctcccctccactggtgatgagaaaactttctgaggttgtgatgaggataatggtgatgatacacccaccacctgttgtaccaccaactgcttacagcaacaccaacaacacaacacatcatcacaaccaccaactcattcggcggcggggggggggggggggcattttgagtcacacacaaaaaaattttctgccctccggcgatcgccgagtgatttttccacttcttcaccttctgctggcgcctggcttaataatcataaaaaataattattgcgcagattcgttgtcttcgtcgcctcacagatcagccagcaccagcagcagaagggagcaacaagcaacaagttgaagccataataagtgaatgggtgggcaaatgattggtgaaaattatgtgacgaaaaaaaagttgggtggtcgtagttgatgaggtggcggcgcacacacacacaataatcaagttgaaggtgctgccatagtaatttgtattagggccttagccatcggggtgggaattgatcaattgatcgcaggagccggagggcgaaccaatttttctttagaattttacaaattttgcaagtatatttaatttttttttaaatattgatagcatgtttgataaaattttacagctgtgaaatttctcatggtgcatggttcatttaatttttctaattttttttttaccattggcatcggttttttggggaacgtggaatta

SEQ ID NO: 80981 - DNA, 399 bp, Heterodera glycines
  Genomic contig location: Contig_ID=SeqID_16574; Location=27..425; Strand=+
  SCN-specific regions: Sequence locations=1-310,334-399
atgacaaatgaatttaagcaaaaaagaaaatattcaacaaaagaatggcaacaaaattatgccgaaatttgtaagaaaattggagttggctatgaaacaattaaaaaatggaagaaacaatttggcattagcagtaaacgaataacgaagaatgaaaaaatggaaaaaatgaatatttattggcaaacaaaaatagaaaatccgaaaatgagtgagaaagaaattgcaaagatgttgaaaattgatagaaatagtataagtaattggaagaaacaagttgagatggaataatggacgattattaattcggaaaaattaaaaaaaattttaataggcctatttccgataaagttactcacattttacaatttatatatgtcgatttgttagaaggttata

SEQ ID NO: 80982 - DNA, 1052 bp, Heterodera glycines
  Genomic contig location: Contig_ID=SeqID_16574; Location=2068..3119; Strand=+
  SCN-specific regions: Sequence locations=1-108,257-259,281-417,439 -848,870-1052
atgaaattccgcctattataccttacaattttattttttgtgattgaaatcaatcaaattaaaatagaaaataaaaaactaccgcaaaaatcatttgatgaaatatttggagaaaaatgggaagaaaaagaaggaaaacaacgaaatgaactcaaaaaacgagaaataattagaacattcaacaaaataaaagagaaaataaaggaaaaaggaagaaaatatccaagaaaagaatggaataaaattgatcagaaaatagcgaaaaaattggggacaaatcgcaattacattcaaaaatggatcaaagaattggggcttaatcaaaaaagacacaaaagtcacaaatcaaaaactgatgaagaaaaacgtcaaattattcaaaaatttattgaaatgaaaaatgaatttaagcaaaaaagaaattattcaagaaaagaatggcgccaaaattatgccgaaatttgtaagaaaattggagttggctatgacacaattagtaaatggaagaaacaatttggcattagctgtaaaataacggagaaagaaaaaatggaaaaaatgaaaaaatattggaaaataaaaagtgaaaatccaaaaatgagtgacaaagaaattgctaaaatattgcaaattgatagaaggaccatttcaaaatggaagaaacagtttggaggagagattttggaggatttaaatggatgattataaaaaaaattggataaattttcaaacaagaaaattatttacgacataaaaactgattaattcttatattttatagaaccattgtcaaaataactggcataaaatccgtttatttttctcaattggatacgctgaatttgcttctattgtaaataattttttcttagtaacgaaccatcattgttatgatttccgaccagggctgcacgcaattacggattgcggatttcgggaaattacggggtttttggacccccgtaattacggattacggatttccgtaactgagaaattcgccgcaattacggattacggatttccgtaattgcaaacccactgtccatata

SEQ ID NO: 80983 - DNA, 795 bp, Heterodera glycines
  Genomic contig location: Contig_ID=SeqID_16576; Location=645..1439; Strand=-
  SCN-specific regions: Sequence locations=1-141,163-246,270-339,364 -655,677-795
atggctggacaagcagatgttcaggtgagggagcaatactgaaaaggggtggactcgaacaaataaaggccgaaattgccaactaagccggtattcaggtctaagtccaaacagaaactagtagacgtttaaatctcgtttaaacaaccatataagattgccaggtttccatacataaattttttaattttcaagaacatataaatttttaagcacaaaggtttttaaagttactaaattttagtcatttatataaaattttatataatgaaaaactgaaatatatcattgcttcaaaaaaaatattgaacccatttttagactaaaaatagaaaatcgtaaaatttgaattttcgactttttgttcgaattcgggtccgaggaccgtaattggtcgaaatgggtgcagaattcatgatcagcaaccccgaaaaccccataaaaagtgttttttatgacttttgaaaacacaaaaaattttcgaaaaaaggaggggggggggacaaattgcactattaccccaaaattcattgactcttcattttagtattcgtcagcatcagaagcaatggcctactggcgctctactcctaaccccgaatccggattcaaagatttttcgaaattttaaatttccatatcttttttgttaatgttgctaaagcattggtttgatgtgtacaaccaacatgtgtgtcagggatggcacggaattccgatttccgaaatttttgataaaaagtcggaattttttttttccaaaaatttaggatttgtacaatttttgttaataaa

SEQ ID NO: 80984 - DNA, 967 bp, Heterodera glycines
  Genomic contig location: Contig_ID=SeqID_16577; Location=1013..1979; Strand=+
  SCN-specific regions: Sequence locations=1-332,354-439,461-967
atgcaatctgaaaacgtgccacctaaaccactccaaaatgaggcagaaaaattggagaaacagttgctgaaggcgaaagaaaagaagcgaagtgaagagaagatcacggaagcggttggcaaaatgatggatgagctcaagagctcgatcaaagaagagatcaaagtcgctgcggaggatttgtgggccaaaaccgagcctttgctgaaggagcaaaagcgagtgactgcagcaatggtcgaatctctggacgaattcatggctggaaaaaatggaattgacgaagaggaaggcacgtgtccggcaccagcaagtgatcagcggtcggaaggcacagtggagaaaagctcatcggtggaagatggagagcctgcccaggctttgcccccacagaacccaggccaagggccaaaagagcaaattaatcgggcgcctctgggaaagagaggcaggggctatgccatgggagggcatggccctagaggacaatggaagaatggaggccagaaaacccaaaagcgcgtgggctatctggtccgtcagctggagcgcgaatgaacgacgagacgtctcgaaggaggagagggattgcggtgtctgcatttcggtcttttttatttttgtttttggcatttttgcattgacccattttccaccaattctcatcgtaaacattttatccatccacatctctcaatccttaccaaatccttctctcaaaaaaattctctctccgctttgtgtaatgtggcctagaccattctcacccgcttggcttcgcttgactcctcccaaaattgtgccgtatttaagctctctttctgctttggatttcacccttcttactgccattctcccttcctacttactctccctttgcttactcttaaccaattttgctataaccaattttgcttattcttactcttaaacgattttgctttgctttaataactgttttgcttta

SEQ ID NO: 80985 - DNA, 1042 bp, Heterodera glycines
  Genomic contig location: Contig_ID=SeqID_16577; Location=2340..3381; Strand=+
  SCN-specific regions: Sequence locations=1-1042
atgagcaatcaaaattgttctaattcacaaagtggagaaaatgaaattggctccgattttgacccagttttcttcaccgctgaagaaaatggaaattttgcaaatattctaaaccgaatgagactttttgagtcggctgtttgccggcaatttcggagattggaatacgagttagcggagataaacgggatgttccaaaaatcgaatgagaacttacgtggtggaaaattggaacaatcaatggctgatttggaagaccgtgaagaattggaccattttcagatggaggaaaaggtcataaaaattgagggaagaatagatacggtcggtttaagtctgaaaagtcttgagaagtttacgaaagtcagatttaacaaaataattgagaaaatgaaaagtgaaatggcgaaaatgacagaagacattgatattttgcgaaagcgagttgaatttctggaaatggaggaagtgtcagacgaaaacctatgggctgagaatggacattcctttgagcatgagcaatttcttaatgaggacccaccaaattccggagaaaactgtgaaataatgatctctgacccatttcttggtggaattgccccgttggaaagttatgacggaaacccgagtatttcattttcgaggtggtcctcaaaattcgaagacatgctttcgctctatccacagcttactgaggcgcagaaattaagtcgtttaagaattcttttgattggacaagcccgcgccgagttggaatcgatggaaccgcaaccggaaaacttagctagtgcattaaattatttaagacaaaaatttgaaaatgagaatacacgctcaattgcccgtcaggcactctcaatctgtaaacaagcgccggtagagcgagtttacgagtccgccaatcgattaaatgaggcaataaggactgcactggccggagagggtgaagacgtgataaggaaaagacttgaagaatttgtggaaagattaacccccgacctacaatttgaagttaaagctggaaggccaactaattattcaa

SEQ ID NO: 80986 - DNA, 91 bp, Heterodera glycines
  Genomic contig location: Contig_ID=SeqID_16581; Location=859..949; Strand=+
  SCN-specific regions: Sequence locations=1-42,79-91
tttttgggccccggggtcgtttgggccccaacccaaaaatagaaaaatgtgcttttttaaaaattaagattctaaaaactaagcctgaggg

SEQ ID NO: 80987 - DNA, 3118 bp, Heterodera glycines
  Genomic contig location: Contig_ID=SeqID_271; Location=79..3196; Strand=-
  SCN-specific regions: Sequence locations=1-439,463-581,611-649,689 -848,890-971,1080-1268,1291-1545,1591-1649,1692-1700,1722-1807,1829 -1899,2006-2084,2106-2265,2446-2483,2505-2560,2595-2822,2845-3118
atgggactcagtcccgagactcaatcgggaaaagatcccaatttgacgactgatcaatggggtgatcagaagcaaggatgtgatcagaatttttgaaaaaacattgccaaattggttagagaccggacgggggattagagtttccgatcggggacttattacacagggaagtggcaatgattctgtggccgagctacgatcggccactaccgttatgattacggtaaagggatgccgcccaatgagaactgtccggtctctaatttgagttggcaaaaaactgtattcaactgttggcaaaagccattgtgtttcagcaattgctcgactcgcctttgatggtgggtttttgtggcgtatgttggttactgtaatacaataattccatccccgaatgctaccataactcattcattcactaataacatttttatacgcataacagtttaaaaattaaaattctttttttatagtaggatttgcactgttaattaccgtaaccctgctctattttagagaatagtaatttgtttaccagagtgtatttacattaacctactgtagcccattaaatttactgtatttatctagcttttcctttgtttttaaatttctgtttgaatataaccgtttgaataatggaagtgccaaaattttttaaattaattatattttataaaaaaaatttcagcggctgacgaggcggaaaaggacgctaaattgtgggaacttgcaaaccctgaacattttcgggtcgacaaatcgtacaaagggccgactatcagtttgccgttgcgaagtgcacatgtggaaacaatgcttgaatacttcaaacaaaataaagtgccaaaaatttttaaaatgtttttatttattttaaaatttttttgctaattaaaattcgaaaattaaacaaattttacaacttatcgggcatttaaatgatcaaagaatttatatggatttaatggaaatttttttttttgaaaaattatttaaagattttctataaaatgataaatttattgtgacaattttttattaaaaaatatttttctacaaaaatttttgaaaaatttgcgaaaaaaatgaaatttgctgaccgatttatctttcattgacagaatgtccggacacatttattttctgggaggggacagagactatattggggataggtactgtatttgaggagatactatacataggaataaattcagtgggacccttcggtagttaaaattatagttagttacttcttaaaaaaccattttccaaatttaaattttgtgtgccttcaggttttgcccgcccgctaccttctgaccattctgcacgaggcgcgtaaatcgctgaaagtgatgcctaccgtaacccatctgtccaccaacatgtcgggccaggttacgatatgcggcgatttgcacggcaaatttgacgacctgtgcatcattttgcacaaagttagcgcaccaaaaaaaaatttaaattgaaaacccgtttttttagaatggtttcccatcattggacaatccgtaaacagtcataaatataattaattatacaattaaatttattttttaaattttagttacgtgtttaatggtgactttgtcggtgagttttttttcaaaatttccattaaaagcaaaataattttttgttgaattttaagaattatataaaattaaggaatgatatttaaggcaaaattttaataagcattaaaaatttataattttcattcaaataatttccaagaagaatttttgtgaaataattcattttttcagttttaattagccattttgacatttaaattattactgttattaattggccaacaaaaatcattttaattcaattgattgcctctagaaattttgtgattaaacattcattttttaatttaaatctttatcaaaattaatttaaattatttaaattggaatatttctttttttcaaaaattgcttacatattaaatttttaaataaaaatatttcactttttttaaaacaacaaattaagaccggggaggtcagtccatcgaggtgcttgctgtgctcctaacttttatggtgcttcatccgacagcggtggcgcttaaccggggaaaccatgaagaccacataatgaatttgaggtggtggcatttttcagtccaatattaataggaaaattgcacaaaaaaaaattattcaaaatttccgaaaaagctactaaattgctgttgaattttttcgataaatctaagtgctctcttctctctctctttctctctctctctctctctctctctctctctctctccctctctctctctctctctctctctctctctctccctctctttctctctctctctctttctctctctctctctctctctctctccctctctctctctctctctccctctctctctctctctctctctctctctgttagcctgtaaaatttttcagaaatttcgcttgattttttaaataaagttatgaccaaaaatataagatatactagtgtgtgtgtgtgtgttttttttgaagtttttttgaccataatttttaaatgttaaattattattattttttgttgtaattttagtagtccaatagagagagaactttaaggctatcgaaatattcaagaatgaaaaatttcgttgctttggagggttcacaaaaattttccattttttttttgcctctggttactgtattgactttatgatatccgggaccatataatttttttacgatttaggtacggtttcgtcaaggagttgcagacaaaagtatgtgttagacaatcatggaaaaatttatttgtttattaattttacagtaattacagtaattcttgctttacgttacagtacaaggactccgcctccgccatcatacggttgcttgaagacattttttcttggtagtcatttaacacagacagacatattgttgcaactaatatatgtctgtcgtcccaggctcccgttggccactgttgtggacaaagaattgtttgtggcccatggcggcgtgtcggacaagacggatctggactttctgcagcggatcccacggaatcgagtcagtcggtttcaaggacggtccca

SEQ ID NO: 80988 - DNA, 828 bp, Heterodera glycines
  Genomic contig location: Contig_ID=SeqID_273; Location=309..1136; Strand=+
  SCN-specific regions: Sequence locations=1-145,167-269,291-543,565 -619,642-667,692-828
atgccgcaatgtcctccagggatgtgtgccgacgccctccaattcgacagtctgaaattggaattcagacggcccaaaaaagttcaaaaatcggaaatcggcatgccgacacatctctggtgtgctcatttattaattggtaagattgggttttaattttgaaagatttttacggtttgttcggtaaacaataccagggtcaatggcaactcgtacaacaaaaaaaaaatctaagaattttcaactaaaacttagaattttcagataaaaaatatataaatggattttttagcctagaaaaactttaaaaaaaattctttaaagttttttaccaatttttcagctgactttttttattttcttaaattttttgaaaatttaagtgttttaaaaagtttttctaggctaaaaaatccatttagattttttttaatctaaaaattctaagttttagttgaaaattcttagaaatttttttttgtacgagttgcctgtgtacgagttgccatgacaccacaataccaaacccacaaaaaagtgagcaaatgccaaaaaatgctaaatttattttggaacagaatgggcaattagcaaaaaaatcccattagaccgaacgacagctttttggggccacacctgctaagcaaattgttagttgcccagattcaaaatgatgatgattttgatggcatttgatacagtgtgtcgtgccgtagacacattttcacgtcatattagtggagtacgggtgggattaatttgtgccctccggggaacaaattaaatgcggcaccaaaaaagcatcggagaacatccagctccacaaaa

SEQ ID NO: 80989 - DNA, 1020 bp, Heterodera glycines
  Genomic contig location: Contig_ID=SeqID_274; Location=1183..2202; Strand=+
  SCN-specific regions: Sequence locations=1-1020
  Gene Ontology: Biological process=protein modification
atgacgacgataacgccccaacaaaaaccaattcttaaagcggtgattttagtcggcggcgcccaaaaaggtggcgaccttccctttcattcagtgtccccctcccctttctgcccatccctttcattctccacggcgactggttgcttttcgtagagtcacttccttccattcaattcattgatcaaaatgtggatagccgggtcggctctggtggcactttattcaatatttctgttgttgcctgtgttaattctggcgtttgtgatccaaaagtgtccactgagactttaaaacagaaaaaccattaattgctgatcatttaatccctaattgccccgaaggtatacaaataattgcaaacaactgttatagactttgcacattagcttgcacttctgttaaggcactcgttttcggcccctctctctccaacttccgaagccattgttccccgttgccggtgtcccactgattgagcatcacatttcgcagctttgcgaagttaatgcatttatcgttatgattttttcattttttccttttcagcagttggaaaacctccacgaaatttttattgttggattttacccggccgaacaatttgcgaactttatttctgattgtgagaaaaagtatcgacgcgtgccaatccgatacattcaagagaactgtccgttgggcactgccggtggccttttgcagtacaaagacattctaatcgacgtacggatttgtgttttaacttttaataatctaccatctgatttgaatcattgttgttttaagagaaaacctccggatgcactctttgttctgaatgcggatgcttgcggagaattccctttccttgaaatggtgcaggagttgaaccaaaagacggaggcgaaatgcttgattttgaccactgaggcgacacgggagcagtcggtcaactacggatcggtagcaattcaaatttggttattccgaacccgacaaaaatggtaccatcgaaagctcaccaagagacaaaccgat

SEQ ID NO: 80990 - DNA, 496 bp, Heterodera glycines
  Genomic contig location: Contig_ID=SeqID_2670; Location=353..848; Strand=-
  SCN-specific regions: Sequence locations=1-165,188-311,334-496
atgtggacagactggacgaacttggcgacttggactttgaacggccgacgaatggctgcgacggcaattggctggacgacgaagttggcacttttgcaatggcaattttatcacttgagtttaacgaatttggccaaaatcataaatttaaacaagtttaaaattccgggtaaaaattccattttgagctcacaatcagcaggtggaaaactcgactttggcattctgacatgcaatatccgggatttgaaaaaaggcaaacaaaattatgtcccgaaaactctcggttttgatggattttcgctatctcattttaaagaaatgaagaaaaaactatttgacatattgtgcggcaatccttcagaatgggtgtccctaatttatctttgtaatttttgagctaaaaattgctatattgggttttccaggagttatgatcacgaattggaccttggatttgtcatattaccttgccaactatgcttttatttattaa

SEQ ID NO: 80991 - DNA, 501 bp, Heterodera glycines
  Genomic contig location: Contig_ID=SeqID_2670; Location=3143..3643; Strand=-
  SCN-specific regions: Sequence locations=1-169,206-297,323-501
atgtttgaagtttggccgaaagctgagtccgggcaactcttggatttcgtcatgggccgccgatgtgagacgaaggcacaaattggggtcatcaacgaacgcagcggaaggagaaaaaagcaaaaatggaagaaaaagcaaaaacggacgaatgacagccattctaaggtaattagttaattaataagtaattaattcattaatttcaatttgaccatatttaatttcagttcaattcattattaatgagctccattagaaataagtaaatatttaaaggattaatatagctgattgctttaaaatttttacaattttaaaagtgattaaatgaaaatgcgaacactaattaattataattgctaaaatcgggaaatgtaaaagcaaaatcacaaaaagaatgtatagaaaaagtggtgattaagattaaatgatcgaattgttccataattcctttccattcttcttatcagaattgctgcgagaaaaacgaacaataaa

SEQ ID NO: 80992 - DNA, 2154 bp, Heterodera glycines
  Genomic contig location: Contig_ID=SeqID_2670; Location=3482..5635; Strand=+
  SCN-specific regions: Sequence locations=1-205,238-301,358-372,411 -456,478-545,567-746,779-1161,1209-1568,1629-1733,1763-1872,1901 -1931,1953-1975,2018-2154
atggctgtcattcgtccgtttttgctttttcttccatttttgcttttttctccttccgctgcgttcgttgatgaccccaatttgtgccttcgtctcacatcggcggcccatgacgaaatccaagagttgcccggactcagctttcggccaaacttcaaacattactcgggtccgtccgtcctctaattgcgtgcattaatcgcccaattttaatttttttttaaattcaaaaaaaaacatttactttgcattatgaggagtatttggtattttgtattacgccatttgctgtttggtgctgtattttaataagaaatattcttatgaatattttatttatttggaaaattaaaatttgcaagaaatggcggctaaaaaattatttttttcaattgaataattaatttaatcgattcaaaaaaggatttccactcgtttaaaaatttatggcaacattttttcaggctttttgaaaacaacgtcaaaaaatctattccattattggtttgtgacctcggagaataagccgtgccaagacccattggtctgaaaaatattttctttttggccaaatgaaattgccaattctttaaagcttttttggttcaatgggggccccggctgttcatcattgggcggtctgctggacgaattgggcccatatttgatcaacgccgacgggaaaacattacgcaaaagcccatacgcttggaacaaaaatgcctccgtattaaaattaattcctcaaaattaaataaattttaaatttcataaatttcattaatgtgttatttttgtcagattgtttacatcgagtcgcccgctggcgtcggcttttcccactcagtcgacggattgcctgccccgtcaagcgatgactcagtaagaaaaaaattgtaaaaataattatccaattaattaatgaaagcaattaaaaagagggaagattcacgattcaaaaagaaccgaaaatttgtgatttgtcaatttcagacggctgcagaaaattacgaagcggtcaagcagttcttcaacaaattcccactgttccgttccaacccaacgttcatcaccggagagtcgtatgccggcatttatgtgccaatgttagtggccaaaattgtagatggacaggcggaattccccatcaatttggaggtgtttaatttttttaattattcatttctaatttaaaataatttttttttcgtttattttaaatgtttagggaatggccattggcaatggctttgtgaacgcgccgttggacaccgacacattggcacgttttgcctatgcccatgggcttgttgaggagtccaaatggaatcagattgccaaacagtgttgtggaggatgtcttggtaaattggcattggcgtgtgccatacacttcacgataaaatgcctaatattaaatttaatggattttttttcaatttcttaagatacctgcgatttgggctcactttacggctcatgtcgatcaattgtaattaactaattgaagaattaatgtcatctcattaatgaaaacataaagattttcccggaaaattgcatttttgataaatattaaaaaattataaatatcattttatctatttaattataaaatttattttttaggtggctgagattgtccatttctgttggaggggcggactgaacgtttacgatatttatgaaaattgcagtaaattttgcaaattaatttactcattagccttatgatttttttttgaaattttaatttatttttctaagtgccgcacccaaacaatttggacataatgagaagaggcattttcaacgcaaagtcaatgcactcaaacgattcagttttgtggcggactgacgacgcttttgaagtaaaataaataaataaaaaataaattttcaatcaaattttctgtcagaacgccaatcagccgaaggaggaaaaagtgaattatttgctccgctgtttgaatggtaattaaaattaaatgtttttattaaatttaaaaatattttaggtcaaccattggttgattatttgaacaaggaccagggtaagaggccaattgttatttgttagagatcggaattccagcccttatccgatctctatttttgtataaagtgctgctgctggagctgtgcaagaattaa

SEQ ID NO: 80993 - DNA, 831 bp, Heterodera glycines
  Genomic contig location: Contig_ID=SeqID_2671; Location=226..1056; Strand=-
  SCN-specific regions: Sequence locations=1-33,55-185,224-267,314 -405,461-518,560-596,619-831
cgcaacattttggagcgccgtgtcacttttgcgagtgggtaaaattcggaaaaagaaactttattttttattttttcaattttattcattttcagatgcttcattacttacactgacagagatgtgaaccaatttacgcagccgtaccaagttttgaacacgacatttgcttacgaagtcattacaattttaaaaataaataaaaaccttataaaattattttcaggccactgaggtaagcccaacagctgacagatgggcaaattgaaaaattatttaaaattgaaatttttgtttaatttgtataaaaaatgccaatatttcctcgccgataggacagatgcttggcacattgtatgaatgaacaaaagtgccgtctggtggtctatggctatgtggtaaaacaaataatttaaaaaatgtgataaatatttaaatattaattaattttaataatttagggcggccgcgaagttttcgcatgcgaattttatcagggtaattagcataaaaaccagtataattttgattaaaattaataaatattattaatatttttgtaggtactccttaatttaccaaaataggcatttagcaataataaattaaattttaattgtaattagcaattggattattattttcagatgccaccgtccgttccccactgtacacaccgtacacaaacatttacataaagcggacatcggaatgcaaaaaatcaggtgaaaaaacatattgagccaattaatttttctactgtatttagctctaggctcccaagcattggaaacagccgaacccgacgaacggacatttaagcgaaaaatg

SEQ ID NO: 80994 - DNA, 1215 bp, Heterodera glycines
  Genomic contig location: Contig_ID=SeqID_16582; Location=198..1412; Strand=-
  SCN-specific regions: Sequence locations=1-419,441-608,630-1017,1040 -1123,1145-1215
  Gene Ontology: Mol. function=RNA binding; Cellular component=nucleus; Biological process=post-embryonic development
gtcattcaatgactgtggcttcgaccccgccattctgcggaatattcagcggcgcaattattcccggccaacgcaagtgcaaaaggccgtcatccctctaattcagcagacggactgttcgtaacttgcgtcgtttgtcctttcatcattcatttgaattcaggcgatttggtggcacatgcgcacactggcacgggcaaaagtgcggcgtttctgctgccgttgatcaacgaagtccaacagatgcgcaacgcgggcaacacacagcacaacggcgactcgccgtactccgttgtggtcgcaccaactcgcgaattggtgcgcatttaaaagggctggcgacactggggatttttgtattcaaaatttgttcccgtaaatcattcaattcgcaaatctcttccccaattattgaataatattttaatcagtaaaatggtatcaaattgtgtggttaaggttaaacaattgtatgaagatgcctgcactttctcagctggtgttttgttttatttttcacccttttatttatttttgttatttttaggcacttccgttgacgtggcgttggcgtacggagacattccgatgggcgtctccattaacaatgtcagaaagggttgcgatttgcttgtggcgaccgtcgggcgtctctttcattacgcacgagagcacatcatcaaattggacaaactgcgcttttttgtgttagacgaaacggacaaattttttgtgtacgaagacgcgcggacagtcattagggaccttttcaaagagatgaaacgatcggtgagcaaagcaaaagcgtggggattaaaaaatgcaaaaattctgaagggtttccggcaccgaactttgatgttcagcgcaaccatcgacagggaagtacaggaaattgcgaactcttttttgaccgatgggtattactttgtgagtgtaggggaaataaatcaggcggtcggtacggtcaaccaaacggtgttaaaggtgaactttcattttctgcactgacagttcccccgttttacaggttaacaaatacgacaaaatgcccatgcttattcgtcttctccgaagcaaatcgaacgaattgaacaacggggacaatggtgggagggaaggagaaaaaacatttgaaaaggaactgtcattaaaggagtgacatatgagacagaaaagaccattgtgttcatcaacggacggagggaatgcgac

SEQ ID NO: 80995 - DNA, 618 bp, Heterodera glycines
  Genomic contig location: Contig_ID=SeqID_16583; Location=1084..1701; Strand=-
  SCN-specific regions: Sequence locations=1-214,264-437,459-618
atgggccaaccaaacgccgcaccgccagcggacgccggggaggaggacgaaaacgcgtgtccgccccaattggacgcggaagaaacgatggaccgaccaattctcagcattccgaaacgccttttggagatggcattgactgcgataacagcgcactcgaagaagcagaaaggcgcggatgcgtcggccaccctttgcccgcgtcccgcgccgtccctcccctcctccgtttgcttttcctcctcctcaagcagcagcaacatctctgacgatccatcgtcaaacgaaagaaagagacgtaacggacagactgacggaggtgcggaaaggccgttgcggaagcgaagacgcgtcaggtcgcggattggcccaaggcggaaacaccgcgggcagcggcaaaaaggaagggacgcggaacgacacaacggggaaggagaagagcaacagcacatcgacaacggcacagcaccactcagaatggcactgatcagtgtgccaaaagaagcggaagcgaatttggaagaccaaaagaggcagaaaaagcgcaacagaaaaggacaatcgatcgcggcaaagcacaaaaggcaaaatccctctggatttggccgttttaagtga

SEQ ID NO: 80996 - DNA, 173 bp, Heterodera glycines
  Genomic contig location: Contig_ID=SeqID_16584; Location=684..856; Strand=+
  SCN-specific regions: Sequence locations=1-173
atggaaatggaattgaacccggacccgtcacgagttcaatgggaagttgatctgctgatggttcgggccgagttggcatggcgaaaacagacgacgacaaagaatggtaatcctccgatcagaagtgatcagagaagtattattggcttttactcgattttaccaaattggtg

SEQ ID NO: 80997 - DNA, 242 bp, Heterodera glycines
  Genomic contig location: Contig_ID=SeqID_16585; Location=599..840; Strand=+
  SCN-specific regions: Sequence locations=1-84,118-242
atgcttaaatgccacggaagaactgaaactcgccgaggaatgcttggcacaatgccacgttagtttttggggaacattttctcgaaaattaattatttttaacaatttacagaatttgttaaaaagtgaaaatcaatgccaaattaaccaaagcaatggcattgaacatgttcacataaacatcaccaaacttccacatatgagaagtgcttcggaaatgccattctcacgagaagtaatta

SEQ ID NO: 80998 - DNA, 1543 bp, Heterodera glycines
  misc_feature (49)..(50): n is a, c, g, or t
  misc_feature (78)..(78): n is a, c, g, or t
  misc_feature (103)..(103): n is a, c, g, or t
  misc_feature (133)..(133): n is a, c, g, or t
  Genomic contig location: Contig_ID=SeqID_16587; Location=795..2337; Strand=-
  SCN-specific regions: Sequence locations=1-288,317-400,422-524,564 -666,696-775,799-890,912-1303,1325-1543
  Gene Ontology: Mol. function=heat shock protein activity; Cellular component=cytosol; Biological process=G1 phase of mitotic cell cycle
gaaatgacgcgcaaaaaaatcggtatacaagcagacgagcggactcggnnaatgcaattgcaggtgcacacagcggangggaggggggggggggggggctcanttttttgaaaaaaattttttttttagaatntactagcccttcaaaataaggagttaatctttgaattggggcaaactttttcatttttttgtgcttttaattggagtacaatttttaatattttacaccatttttgttttgtttttaggcacgaaatgaggacacaacagttgggcatggtcggctattaaaaatttttttttacaattttttgttttcatttgttttaagggtcgttttcaaatgttccaagttcgcgtgtgtgatgagtgtccaaatgtgaagttggaggcgcaaacaaagaacttggaggtccattttaagtggatttgaagacaaccgtttgtctaagtggtccttgtggtagtcaacaaaaagataggcttgggttcaatccccctatatgctttgaattttttcgtttaatttttttaaatttttttttctattttaaataattcatttttggatttttaggtggaagtggaggttggtgctgacaatgggcaagaagtgcgcttcattggcgagggcgaaccgcacattgaggtagagtgaatttcaaaaaaaaaaaaaatttttttttaattttgccacactacacagggtgaccctggtgatctcatcttcaaagtgcgcgtggaaccgcacaaacttttcgaacggcgtggcgatgatttgtacacaaatgtgaccatttcgttgcagcacgcgttgtccggctttgaggtgactgtttttttgtatcatcccctctctattattctgcaaaattcaaaaaattgcgtaatttaaaaaaaatttttttgacaaaaatgctcaaaaaattggtttttttttaaatttttggttttgtaaattttttttgcttcaaattaattaccaaaatttcaaaaaaattaacggtcctcaaaacgtagatttcttaacgcttttcagatggacattgaccatttggatggacacaaagtgcacattgttcgggataaggtaataccagtaaaagggtgacacaaaattatttgctctaataattttcggatttatccattctcgacaaaggggaaagagcgaaaaaatggtttttttttttaaggcatcggttcaaatccaattgcctgtaaaatttttcaattttgtggggggccgatgattacgaattttacgcatccatttcgcccaatgtcgaacccgaactcgaacaaaaattttttcatttttaaaaaaacacactctttcccgcagatcacatggcccggtgcgcgtattcgcaaaaaggacgaagggatgccgtcgatgaccaacaaccaggagcgcggcatcctgtacatcacattcgatgtggaattcccgcgcggtgagttgaccgctgaacagaaggcactgttagctgaactgctcgcccagggcgaccatgtgccacgggtgtacaacggactg

SEQ ID NO: 80999 - DNA, 1355 bp, Heterodera glycines
  Genomic contig location: Contig_ID=SeqID_16588; Location=141..1495; Strand=-
  SCN-specific regions: Sequence locations=1-271,294-803,827-849,880 -1210,1246-1329,1351-1355
  Gene Ontology: Mol. function=Hsp70/Hsc70 protein regulator activity; Cellular component=cytosol; Biological process=protein folding
ttgataaaattcaaaattgaccactttgcatatagcgccaaaaaatgcatccaggttcaggaaaaatcacaggcttatcgtgtatttttttttcatagttaaaaaaacattcgttacttgaaaaaaattctaaaatattatccagattttttatgcctaccttgacatggtccctgcatttattacaatatagaaaccagggccaggaaaatcgatttgagccaaaaaatgaactgtacccaggtccagctcggactctaaatatcacccatttttagtaatgtttattttttgattttaggaaaatggcccggcaacatcacccggacaaaaacccagacagtaaattggccaactaaatgacattcaagaaatttgcaattatttttttaagacccggatgcccatgaaaaattccaagaattgggcgaagcgatcagtgtgttgggaaatgcggaaaaacggaaagtgtatgacaggtttggattttcgtaacacaacttttttaaataaatattttacaccgggaaatttttagaaaatttttgtaagctctcggatttcgctgattaatttgaatctgccacattttaattaacccccccccccccccccactaggcatggcgaggagggcgtccgcaaaatgggcgacggcgatgccttcggtggccatgacccgttctcgtcatttttcggcgatttcttcggccatggcagtcaagagcaggacgaagagacgccacgtggtgctgacgttgttgtcgatttgtacgtcacactggaagaggtttttaaaattttgaaccattttttaaggaaaaaaagggggggggcaaaccgaaatcccataaattttgattaaattaattaaattattgcacaaatttatctgttttttttgccaggtttacaaaggcaaatttgtggaaatgacgcgcaaaaaatcggtatacaagcagacgagcggaactcgggaatgcaattgcaggtgcacacagcggagggagggggggggggagggctcatttttgaaaaaaaattttttttagaatttactagcccttcaaaataaggagttaacctttgaattggggcaaactttttcatttttttgtggttttaattggagtacaatttttaatattttacaccatttttgttttgtttttaggcacgaaatgaggacacaacagttgggcatggtcggctattaaaatttttttttttttttttacaattttttgttttcatttgttttaagggtcgttttcaaatgttccaagttcgcgtgtgtgatgagtgtccaaatgtgaagttggaggcgcaaacaaagaacttggaggtccattttaa

SEQ ID NO: 81000 - DNA, 144 bp, Heterodera glycines
  Genomic contig location: Contig_ID=SeqID_16589; Location=934..1077; Strand=-
  SCN-specific regions: Sequence locations=1-82,106-109
agcgggaccgggaattttgggcaaaaccgggaccgggacttgccgggacctgagaagccgggaccgggacctcgatttttcttcgggaccgggaccgggaccaaccgggaaattttaaaaattcaaaaaaattttaaaaaattc

SEQ ID NO: 81001 - DNA, 493 bp, Heterodera glycines
  Genomic contig location: Contig_ID=SeqID_16590; Location=850..1342; Strand=-
  SCN-specific regions: Sequence locations=1-96,149-259,281-309,427 -452,481-493
atgttgaatcattgtggaagaaatttaaacgaaacttcaaacatcaatttggaaacagaaatgaaacgtatgatagttaatgtgccggtatttggcattaaattaaaaaatagaaaaatgaaaatttaaaaataataaataaaaatttgtgaacccaaacatggcattttaattgaaaacaaacaatggtgccaagaatttaatttaaaaatacgattaagtgggccatggattttcgcacaatttatcaacgcgattatcccatacaagctgttgcaacgcattctcttgtggattgaaaccaatttctaaattatttattaaatttaaaaaatgaaaatttcaaaataattattttttaaagtaatttttttaaaataatttttatttagagaattcattaatttcttctatctttaaattcaattatttttttccatttagcaaattgcttaaaaaatataaatttaaatttttaaaggataaaaataaa

SEQ ID NO: 81002 - DNA, 665 bp, Heterodera glycines
  Genomic contig location: Contig_ID=SeqID_16590; Location=1350..2014; Strand=+
  SCN-specific regions: Sequence locations=1-355,390-603,625-665
atgagcttgattgttggcaggattgacaaagttctgggaatgatttatgcgtgtaattttggggtaagttcggaatgcaacggtaagaacgctattcatccgaaataatggtgttctctgggttgatgtattgttggatgagcaatatcagacggattgcggaacgtgattccacagggaccaaaaaaatctcgacgaaccgtcctatgttgtttttctgggaccaataatcgaaatgattgccaagaagttttgataaaaactttttggaaaatttttgaattttttaaaattttctcggggacgggaggaaaagagctgctactccccggcggaggaacataacacacttccctataatttttcaaatttttttttaaattttaaaactttccagggtcctccaatcgtccagtccactccgcttgtgccaccgccgctgggaatttctcagaactacgctcggcacagtcaagcaccgacaatggcattgccgtctccaatctttggccatcacttcccatcatttgggccaatgccgacggtcagcagcagggcacgcgttttttggggggtacattcagaaagtgctctgaaacgcaccaaattttatgtacaagttaaataaggctctctgatgcttttattatcaaaaaggaagatga

SEQ ID NO: 81003 - DNA, 468 bp, Heterodera glycines
  Genomic contig location: Contig_ID=SeqID_16592; Location=225..692; Strand=-
  SCN-specific regions: Sequence locations=1-353,375-468
atgcatatttacgtatgcgttcttaatttcggattattaagtccaagtcttctaggatttggattattttgtacaaaacttatgttagaccgttattggaatatgctcctgaggtttggaatccatctattcaaaaaaatatttaaaaaattgaaaagtgtcagaaatatttcaccaaaagagttcttttcaaatgcagccttccacccattccataccaacaaagattagaatacctgcaactgtcaacacttgaaagcaggcgaaagctttctgatctgttcatggctgataaaataatttatggccgaacagatctgaatccctttgaaatattcaaaccttctgaacgctttaacattcccttttatagacttcgaaatataaaataggcaaaaaatttataccttttgtagggcgggtaactaaaatttggaaccaactcgataaaaggcttattgaaataaa

SEQ ID NO: 81004 - DNA, 414 bp, Heterodera glycines
  misc_feature (399)..(399): n is a, c, g, or t
  Genomic contig location: Contig_ID=SeqID_16593; Location=60..473; Strand=-
  SCN-specific regions: Sequence locations=1-128,150-188,211-414
atgcccaaattcgctggtgacttggaaattgcattggatacagtaagcaatcggaaatcccacaaaactttggattggtatggtattgttccacgcccatcacttcgtttgctgttaaaatgccggatggaactgtaaatatggaaagactggtgaataaaaaaaatatttcgttgaaaaaatctaacaaaaataatttataaaataaaactcaaaagaggcggaccatacataacaaatattatttattttttaccaattttttcagaaaatttcttttgcgagaaaagcgaaaagcgaattttgaacagtgccgggccaagaatttgacggcgattctctgctgaacattcaatgccagtttcacggcatttttcatcggcccaatggagtgccganaagcaaaacaataaa

SEQ ID NO: 81005 - DNA, 782 bp, Heterodera glycines
  Genomic contig location: Contig_ID=SeqID_16593; Location=2321..3102; Strand=+
  SCN-specific regions: Sequence locations=1-207,229-239,261-623,645-782
ttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaagttcaaaggaccaaaagcgaaactgtctgaatggatcgatgacaaatgggtggcatttcctttgccggaccgtccgctgcccaacaaaattcgttttaggaaccttcggattgagtaattcaaacataaagggaagaaaatcactcctttttcaccattttcacaggaaacccgaccattctgtgctcgcatttctccgtgccaatcagcaaatttttgaaaaagccaccaatttatgtttgtctgtttcttcatgcttccatgattgcctttcattattcgtcgacaataatgtccagccgatttgggatgtttttgcctgtgaaatttggccgatttttgcgccaaacattcgccgctttaactttcgcgatggtgatcatttggacaatttgcgtcgccgcatttcgcccacaattctcaccgatctcaacaaccttagtgccatcacttccggtcgtctgttccccgatggcatcgctgatgatgggccaaatgcaactgctggccaagcattggccaaatggttgcacactccgcgaaatgatggccaaccgaagcgattgcgttgcggtggtggttatatgtcaaaaactgaatttgtcaacattttcaaagag

SEQ ID NO: 81006 - DNA, 1785 bp, Heterodera glycines
  Genomic contig location: Contig_ID=SeqID_16594; Location=340..2124; Strand=+
  SCN-specific regions: Sequence locations=1-176,207-603,933-968,1146 -1200,1422-1446,1468-1785
  Gene Ontology: Mol. function=protein kinase activity; Cellular component=cytoplasm; Biological process=embryogenesis and morphogenesis
atgggtgccttcgccgatcgccgtttggctgctaattttggcgagattctctccataaatggcggcaccaaaataaggtcgcgaattcaatttgaccgaagaataaaaagcgaggacattgacgaagaggaggagcaaaagtacaaattgcgtgccaccggctaccgaaagtgccgcgcggcggtggcggaggacggcggcggcgcagtggcggtgctaaacccattatcaatgcatttgttgaaagtgaccggcggggcattgccccaacaaaatgccgaacagaacggcgaaacttgcgaggagtcattggaatgtgagaccgttgaatttgcattcattaatcattcttttctttcagacctcagagaaacgctgaatttgtcccggtctttaaagttcgaaattcccgacaaatcgccactgaaccgttcgttgacaatgaatgggcgaattccaatttggagaagggaagcggagccaaaagcagacaatgagccaaaacagcagaggaaaatggcaaacggagaaaagcgaatggtaaaacaaaggcaaagccaaagtgaaaaaagaaacaaaaagcaaatttagagagtaaaagccgaaaagagaagagaacggaacagaggagaagagccaacccaaagaagagtgagagcaaagaggagaaacgcaaaggaaggaagtgaagggcacagaaagagaaacggcaggaggaaaaagaaagaagtggaagaagagagaaacggaacgagagaaaaggacgaaaaggaggcggaaaaggaaaaagaagaagcgaacaacaacaaagagataggggaagaggagagaaatgagacgacgggagaagaggaaaagggcagggcgaaagcggacgacggagaggaaaagaatgagggagcggtactggacgaagaggaggagaagcaagaaacagcggaagagaagagcaatacgtcttccatggcagaagaagatggaggagggaaagagagaaatggggcgaggctggaagaagaggaggaggaggaaaaggagagtagcagtaagaacgggacagaaaaagagagaaaggaaaccataggagaagcgaggatggaagaaaaggaagaggaggagaacagagaaacagcggaagagaagagcaatgggacttccaggcaaaaagtgaacgacggagacacggctgaagaagaagatgaaggagggaaagagagaaatgaagggaggttggaagaggaagagatgagcagtaagaacgagacggaagagaagagcaatgggactttcatggcagcagaagatggaggaaggaaagagaggaatgaagggaggttggaagaggaagaggaggagaacagtaagaacgagacggaagagatgaaaggacaagaggaaaaacaggaaatgaacggaaaagacaaatcggaagaggggacgatgacaaaacgaaaaatggccaatgactgcccgaagcccatcagagtttcgaagcggaagcgcaacatttccccggagtttaatttgaacgaccttttgtacgaagattaccgaacgaagttcggtgatgccattccaagggatgtgtacaggcattagcaaaaagtacaatgcaatgagtttatattgttgtgccgttctactacccaaactgtttttatggggactgggtcgttttggcgccagcgcgagttttttgattataacttttttcattgttggccaaatctaacaatcttggtatcattcgaaagcccttcacaagctctattagccttacaaaaa

SEQ ID NO: 81007 - DNA, 1505 bp, Heterodera glycines
  Genomic contig location: Contig_ID=SeqID_16596; Location=282..1786; Strand=+
  SCN-specific regions: Sequence locations=1-282,304-334,356-416,438 -466,489-643,687-887,912-1505
atggtgaaaatgtgtgttcagccgttgctccctatcgttgcatttatttcattcgcattcgcaccaccacatgtgggcccctcctctgctgacggtgtgcgggggggggggggaaacgagggcccaaaaacgggggcccaaaaacgggggcccaaaaactggggcccaaacgcccccgactcattggcaatgcttcttccaagccaaatgtgccagtgattccgttggcacaaattgtccgttggcattgggacgaaaatggggcacaacagattatccaagcaataaaatatgtataaagaatggatttaaaatttggttaacaaatttagaccaacacactaaacaagggcactgaactaagttacggcagctgtgccaatgccaatgcttcttcatttgttataagaattctcaaaaaacgggagaagaaaaagtaatccattgaaaattagcgtttcaattatggttaaaaattaggattttttgagttcggatttaattttcaaccttacaattgggtccaatcactaaacattttttccattagtctcttctcggcgccttccagcttgcctgacgacgacgatttaacggtgaaaattggtggcaaagaggtgaaacacacaaaaaggacaattgcttttttaaatttaaaaaaaaagaaaataaaaattgttttaaaactcgagtaaattgagaaagagataactcccataaatctttgtaaaatcactgacaaaatgttttgatcagatcactgattaatcttggtcagatcactagtaaagcccggtcagatcactcataatccattctgatcagatcgctgtgtccgcccattggctgtcgtccgtttccccggtgatcagttgcatgctcagcgtggagatgaaggagaagcagcagcgaatgatcactttggacgaattgggcgtggacatggaccaattcatggagtttttggaggccatctcttatcttaaaggaccttttttgccaaaccgtaattcatgatactgtatctattctactatatccccaggagaaatttctctccccttttatgggattggaatatttttaattatgaaacggattcctaatttttagccaaaaatgtgctgatgctgctcaatttggctgactacttccaggtgagtgcccttgcagaccagcagggctggacgtagttacgtgttacgggaattacggcgttttcgaccctgtaattaccgcttacgggttacggctttttgagatttctccgtaattttgatctctaactaatttggaccctacagacagactccatcatttttttcaaaaaattagtttttactatttttgaatttattaggctaatatattaggggcactaattgctccgttttgaggtgaccgcgttgaagtcgcgctgcgaattgcatctgatcaattgcgtggaaattccactgatcgaccgtttccttctgattgatcgctacggactcgacaatttgaaa

SEQ ID NO: 81008 - DNA, 996 bp, Heterodera glycines
  Genomic contig location: Contig_ID=SeqID_16597; Location=906..1901; Strand=+
  SCN-specific regions: Sequence locations=1-20,42-189,301-477,721 -729,756-794,844-845,871-996
atgctccataaaaatgcaattaattgctttattaaaatcaaaaaaggtgggcgttagaagcctttgaataaaccgcacataattatatgcactaaatttattccaaatgtgcttaatgggcgtcattcatcatccattgggattaaattgaaaatttcttttttttttggaacagccattttttgacgcttaataagaaaataaaaattcaaaaataattttaatttaatttaattttagataaatttaattttttaaaaaattctgtaaatgaaaattttgatttatatataattaaatggtagtattatttcattttaggtttttaataagcaattttccattttctaagcattttcccccaattcatttgcctaaccaaattggttttcgcaaaattaatttgttttggcgttccgtctgatgtcattgctgtgtgtgacaggtgaaaaatgcacacaaaaatagaaagtgacaaataaaaattaataataaaattggaataataataataatttaataaaattaaataaataaatcgaaaattaattaaattaattaaaaaattattaataattattgaataataattataatcataataataatttgataaaattaaataaataatcaaaaattaattaaaaaattttattaatttttttaacaattattgaataataattataataataataatttgataaaataaataaataaatgaaacgcaaataaataaaaattatttaattattcagtgaaaaaggctcgtcttcaaggcacaatcggttagcaaattaaataatttaaattaattaaattattaaaaaaaaaaaaattaaaaatgccaaaattaaattttctaaaattcttttccagaagatttcccatgcctatgtgacgttaaaattacaaaatgtgaagtcaacaaccaatcgctgtcaaaggcaatccagccgcaatgggagcaggaatttgtgttgtaagagaatataa

SEQ ID NO: 81009 - DNA, 252 bp, Heterodera glycines
  Genomic contig location: Contig_ID=SeqID_16599; Location=1175..1426; Strand=-
  SCN-specific regions: Sequence locations=1-252
atggaagacgaattgtcattggaagtgcccgcggcagtggcagatgccgacttgtctttggaagtgccagaggaatggtcagatgacgatttggtgttcgctccagatccattggcagatgccgacttgtctttggaagtgccagaggaatggtcagatgatgatttggtgttcgcagttccagatgcattggcagatgccgattgctttgaagcggaagtggtcttcttcgaagttttgacagagccgtaa

SEQ ID NO: 81010 - DNA, 545 bp, Heterodera glycines
  Genomic contig location: Contig_ID=SeqID_16600; Location=83..627; Strand=-
  SCN-specific regions: Sequence locations=1-545
atggtctacaaaatgcaaaaaacaacaattctctacgacttatacccgctgaggtatgtgcacttcaatttcggtatcagcaaaaagtactgtatttcttaaggcgaaaaaaatcgttaaaaatctgcttttttgattccaaatgcaccaaaatttattaattgcgcattttcttcccaaaattgttaaaaccgataatgggagatgaaaaatataatatttgatacatttttgtatcgaataaaatgtaaaaacaactgttttgaagaattttgcaaaatgttctgatttttgaccccaaaatctgatttttcgggcttgctgttctgattttgaaaaattttcgatacgcaccctggtttaattatgcattaagccggggtcgcacatgtgttgaaagagcatttggcattttaaaacgccgtttttcggcaaatcattccggttataggctgccaattcaaaatatttcaaatgcaattattgcaagtgttgtccttcacaatttggcattgaaaaatgcgtttgccgttagccggagatga

SEQ ID NO: 81011 - DNA, 66 bp, Heterodera glycines; identical to SEQ ID NO: 53774
  Genomic contig location: Contig_ID=SeqID_16600; Location=871..936; Strand=-
  SCN-specific regions: Sequence locations=1-66

SEQ ID NO: 81012 - DNA, 1432 bp, Heterodera glycines
  Genomic contig location: Contig_ID=SeqID_2673; Location=621..2052; Strand=+
  SCN-specific regions: Sequence locations=1-30,66-149,171-919,941 -963,985-1096,1118-1407,1430-1432
atgacttgggcatggaatgaacgagtgaccatgctgctgctgctcattctgctcgtactgatgtgccagttcgttttttggaacatcaccatttgagattttttttggatttttaaatgattcgatgctttcaatttgatattaaaaaacttttttcattctttattaattttattaagtgtttttcctcatttaaatatcgcgaatattttcttagcagctaatttattgtttgtttttgtcagtggccgcacttcgaagaggccgattgttttgcaggtttgattgggtttagatgaaaatgaagagaaatcagggcactaatttggtttaaacatccaatgatcattaatgaacatctcagttatcaggtcatttctattttagggaattgttattagcacatgtttaaacacttctaatgactcagctttcatttgatattgtgaatgttaatcacgtaagaaaaaagttatggtccgataactgagtatgatcattgtatgactcataaagtgcaattcattttgaactgattaggaactaaattcgtaatctaaaacaaaaattataatttacatagtcatgtgtgctaatattggttgtatgatttacaccgaatcaacccatggcttcccctattattagatttgtcgtccaaaaaattgtgagcacggtttgctttcgtcattatcgtcgaccattgaccggttgaccatcgctgctgcaacttttgtttggattggtccgcttaatgttcgccgacatttttatgttttttttgctgtgacactttttaaaccggtactattatttagtgccctttacaatcattttgcggtcgctttgtgcgccgtttccgtcaacgaattgcaacacgtgggacgtgagcggagggcatttttggctcatttttgcaggtttacaaatttacggtttttcggctctgatttagctaattttattcataaaaattgtaaattacgaaaaagctaggatcaaaaactctaataaacttgcatatcggaaccctttatgtataatttttgaaattttcaaactgacgatcatgtattagggatatctaatgtagcaaaaagtttttatttctgaaagaagttataccataaagccataatggcgtcctgctgtgttctcttttatgatttagttaggtcattcatttatacacattttcgatattttcattcttctatttccttcacatctcttttttcagctttgccattgttttgaaggcgtcgcccattccaaccgccatattcattggcaaattcaccgtccgttttctgaatggcaccaaaaatgacaaagcaacgaaagcagagtggacaacggaaagcaatttccagaaagaaggcggactgtgataacggggtaggaggaattttaaagttaaaaatcataaata

SEQ ID NO: 81013 - DNA, 1206 bp, Heterodera glycines
  Genomic contig location: Contig_ID=SeqID_2674; Location=349..1554; Strand=-
  SCN-specific regions: Sequence locations=1-379,402-593,615-1206
atgccgaaactgcgtatgccccaactacagacaacaatatccctgacgctcagcgctggtggatttgggctgacgaaatcgaccaacctcccgctgagcgccaaattattcttggagtaagtctgagctggctgggtattgatatttccatcggtgcatgtgtacccgtgccatttcagcaacatgagcgaccgggagtggccctactcgtaaacgacataccgatgcctatatacactgtggaaacaccgtggtggattcatcaattacaaccgcatcgtcaacacccacacaatccgcaccaatttgttatggaagatggtgtgcaacatccgcaaccgtatccgacggaccattggacgcctaacgataacaacggggaggagggggaggatgaagattatagtggagagcgaaacgtcatacgccgtaagtagtgtgaaagttaaaaagttttaaatcctattcggggttctttaagaaatgttagctgatacgccttggtcgccctgttctccacgccaatacgcccatgctgagtgtcggcacgacaaggaaaacatgccaccgcttgcggaaacacccaaaagcagtggtaaacactcattttttctatctttgactttataccatatttatacaggacgctttttgccacctccttcaaaaagaggaattttttcaatgcgctcgcctacgccacgccctattggttcaatacaaatgagtttgacaaacgcgcacacaccaccggtggtcgcacggcgtcggcaacacttaatgctggaggctcgcaggcaattggtaagaaagtgcaaacggaacggaccccaatacaaatgtatcattggtgtacagaaatcacccccggcggtcgcccatcaacgccgtcatttaatgtcggagacccgcatgaaattggtgaggaaatgcacattagacgggcccaaatataaatgcatcatttgtgtacagaaattgcgacgcaatccctttcgggtgtgccgcggtctgagcgcacggtgcgcgttttgttgaggaaaggaggcatacgaggaagcgcacagtactgaggagcgattgatcagaagaaatgatgtgagaatattgattgtgaggagcaattagtaaaaattttggtttttaaaaatttaaaaaatcgacagggcagaacttattaatctaatatcgcacaatgtcaataaa

SEQ ID NO: 81014 - DNA, 817 bp, Heterodera glycines
  Genomic contig location: Contig_ID=SeqID_2674; Location=2793..3609; Strand=+
  SCN-specific regions: Sequence locations=1-430,534-761,783-817
atgagtttgctcgatcaattcacgaatttgtttaactgttctgcttatgacgttagtaacagactgcttagtgatgctgagcgaacaaaggctttagtgttgtgtaatcacaaacttctcactaccatgtacaaggaccgtaatggactgaatcacacgttcacgtgtactggtctgtccgcagagggagcagaatcccttctcgcttatggaaaactgagagaaccgttcaatatttctgtcgctgcccattattacgcacgtcatcgtataatgctgagtcaccccaaagcaccatgtgctattgagcgaacaactttgtctcatcgtggcggtcagcgaaccaccgtattaaagttctatcccttggaactcgtccgattctcctcctattgtgcaattccatcacggtctcctcatatgaacacctatgttgattatgctgattactatgctgacgatgatgatgatgaattatctgatactacgcttctccgtgataataccaatggggataatggtgatgatgatgactctgacggtccactaatggttttaccatccaataacctacctccaatgtgttccttacgtctggaatattggaaagtgtccgatgacggagaatgggcaagggatgaagtatgggttgcggatgatgagctagacaaattgcgtacaatactgcataatttataactttctcttctatttattaatttttatcaaatttactctctcttgcactaattttatatttttctgcttaaaattatacatttcccaaagctaattttgtaaaagtttactctttaaa

SEQ ID NO: 81015 - DNA, 1870 bp, Heterodera glycines
  Genomic contig location: Contig_ID=SeqID_2674; Location=3632..5501; Strand=-
  SCN-specific regions: Sequence locations=1-8,38-700,722-983,1005-1870
atgaaggagagggtagaggaggaggaagaggaagacgctggaggaattgagcttggagataacggaaacggagggatcgacatcacttgggacgcgctgaccattgcgagcgcatcaatgaaacacttccgcctcaatcatttacggagtgatcagctcgcaatcgtcccagagagcggatatgacacggcaaacaatcagagcttgctcgcgctcaaattcatggaatggtacgcagaggagaatggactgcaaattcagaccgcccattcctcgggcggagagcaccgcattggccgctatacagtggacggttatatacatgagacggatagcgtaattgaggtgaacgggtgctgctggcatgcgcatgaccatcaacgacaccgatttaaagctgacactgtaatgccgagcggaaagacagctgctagaattcgggaggacgatgcgcgaagaatggctttcattcgctcacaaattcgtggaactgttagtatattctgggaatgtgatattgaggaacggctaagacgggaacccgacatgcggcaggcgttctcttcctatcgaaacagcggacctattaatctaagggattgctatcatggtggtcgagttgggccgcaacgccttcactatcaggtcccggaagggtggcgtatgcgatactttgacgtccgttcttctaccggttaaatttgatcagcgtttgctgttcccactttgcggaacatgcgcacgccttcatccagagggaggcgtctccgcttcttatcgatgcacgcacagcgatgagcagcgcggttgggtttctacggttacatcgatcgaactggcagaggcattacgcaatgggtaccgctgcaccgcctattatcgatccatagaatggacacaggaacaatggagtgagcgtgtttttcgcggttacgttgcagaatttatgacaatgaaaacacatgctagcgggtttccggaagaggtgggaaatggggaggaggaacgcgaaaaattcatcacagagtgtgaggagcgctttggtatggtcattgacccggcgcgcatgcaacacaataaggcgaagcggactatagccaagctatgcaacaattccctttggggacggttctcactacgtaacggtctatcaaagactgtggttactgattcgccatcagaactacgtgcgtacctcgacaatcctcagctggaagtcagctctgtggacccattaaatgaacagtgtgtgctgattacatacaccgctaaaaaggaatggaccgatgagcacgattgctccaacattgttctctccttatggacaacatcggcagcacgcctccatcttctaaaattgatgaaacgagttgtgcgtgcagaaaacacagagctgatatacacagacacggacagtgtctgttttgcccatcgggaagaggacgggtgtccgctggatattggaccccaccttggagacttgtcagatgaatggccggatcatgaactgctcgaattcgtgtcaggggggtgtaagcaatatgcactgagaatgcgccaccgtcaaactggtaaggagcagacggtggtcaaagtgcgcggcataacacttagcggcgacgcatgccgtcttctacattttgatacgttcaagcgagcggttctgcggtacgccaaaggaccaaaagagtacgacggtaacaataccgatgacgaagttatactaattgataatcctaatttcctacgacccaatatacgcacaggtagtgtacactcggtagcacttaccaagcgttaccgacccgttgttacgaaaggtattgtttccccaaacgacactcgtgtacttaattttggatttgtataa

SEQ ID NO: 81016 - DNA, 788 bp, Heterodera glycines
  Genomic contig location: Contig_ID=SeqID_16601; Location=38..825; Strand=+
  SCN-specific regions: Sequence locations=1-186,215-393,415-788
atgatgagaatttaccatcggtgttcccatcgtctgattgtgagtgccgtcttttcccttcgtccgttgttttgccgtgggctgaacgacggagttgagtgccgaaataaatggcggccgattcttcgaagggctgaaggaccaaacggaccaccaaactgccgaggcgttcgaccgcgtcgtaaattgctgcaaaaatggcaaagtgaaaaaattaaacacaattcatgcagaattatgtgaaaaattggaccttgaacttttaggggcaacaaatcggtgaaagacatcaaataattggcgccatcagtcaacgattgtttgagcagagaatggcaaaggaaagtgccgagcaaatgcaaatgggaggagtcgaaaaggcgaagagaggcaaaggaaaaggggagggaacggtggagccaaacgaagaggagggagccgagcagctgaaaaagggggacacaaattaacggggaaagaaaagtgccaaagatggatggataaatgccatcgcaaagcccagtcaaaaacaaaaagacaaggatgccgaattttaaagacactgtcccaaattcgaacacaaattccattcggattttgtgttttgacctttgcttttgctttacctgggcgacggggaaaacgaacaacggattcattccgaagagaacggcgaaaaaagcgatggccttttgactgagcaccaaaatggcattgtttttcgcatattccgctatgctaaacgataaattggtttataattacactttgagttatgaatttcgtca

SEQ ID NO: 81017 - DNA, 774 bp, Heterodera glycines
  Genomic contig location: Contig_ID=SeqID_16601; Location=1866..2639; Strand=-
  SCN-specific regions: Sequence locations=1-452,474-774
atgggcagtggcgatgcgcgggtggtgttggacggactgcactttgccaacggagtccaacttcatccggacaaagtgtctgtgctggtctccgagtgctcaatggcacgcattcagcggtcggttcaattgctaattgtaagattaaaattgtgtcttgggacggtcctgcccgctcttgctgacctcgacattttcttcccccgctcctttcccccagttaaataatgtttcaggtatttttttgacggtccgaagaagggtcagcacgaggtgttcatcgacaatttgcccggcttccccgacaacattcgcttgtcccatgacaaatcgtctttcctcgtcggtttggcttccgtgcgttacgctggccaatttctgtcctccttcatggatctccttggccctcttccggcagttcgaagattcattctgcaggtctttttccgtggatttctttattttccatacaaacccttacatttttctttttgccaggtcgtccccgagcagtatctgttcccgttgatggaattggtcgccaagaagtacggattcgttatggagttggctttggatgggcacgtcttgcgcacttaccaagacccgaccggttccgatgtgccagatgtgtcacaggtcaacatttcaccaatatatataatcaaaaaactacaaaacttgtcatttcaggccattgacgatgcttcccatatttatttgggttcgttccattccgatttcatcgcgcttattccgaagaagtcaaagtga

SEQ ID NO: 81018 - DNA, 567 bp, Heterodera glycines
  Genomic contig location: Contig_ID=SeqID_16603; Location=357..923; Strand=-
  SCN-specific regions: Sequence locations=1-72,140-152,332-346,368 -512,534-567
atgccaaaagcgccacctcactccttctacaccccgacccggacctgtcaaactgggaaaatgccatcagacggaagagaaagagaggaaaaggaaaaattcgaagcaagaaggagggggagaaagaagaggaaagggatgaaaatagcagtggggaaggaggagagacggaagagaaagagaggaaaaggaaaaattcgaagcaagaaggagggggagaaagaggaggaaaaggatgaaaatagcagtggggaaggaggagagacggaagagaaagagaggaaaaggaaaaattcgacggaagaaggagggggagaaagaggaggaagagagaatgaagcagaaaagagggaggaacagcagcaaatcgacactttttaattttgccggtgctaattgctaatggatgtcgtaaatccccgtcaaaatcctgaaaactacacaattttcgaaagaaaaatgcattcattcgattacataggcaaaaaattttgtgttgtggcgtgggttttgcaggagcacagcttgttccccaaatcccattaacgatttaaaaaaatcattaaa

SEQ ID NO: 81019 - DNA, 103 bp, Heterodera glycines
  Genomic contig location: Contig_ID=SeqID_16603; Location=83..185; Strand=-
  SCN-specific regions: Sequence locations=1-82
ttcttaactttttaatttttttatttcttgcggctaatatcttctacagtaatttgtcagtttggtcggatgtgcgtcaaacggaaaaaatatttaaaatttt

SEQ ID NO: 81020 - DNA, 1954 bp, Heterodera glycines
  misc_feature (123)..(123): n is a, c, g, or t
  Genomic contig location: Contig_ID=SeqID_16604; Location=648..2601; Strand=-
  SCN-specific regions: Sequence locations=1-370,489-513,537-695,720 -756,779-1372,1394-1868,1891-1896
atggtgctgctgcattcttcttcattatccattagcattgccattctgttgctgctgatgcccaccatgttacagagttgccatccgacagataatacggccgccgctggaaccacagcaccnagaaggtgttcagcgacagtttttttttaatttaatcgattaggggctactgtaatggaaaatattttttgctactgtatttcctaaaatattccccccccccctcccgcccccctctctaaataaatgccccctttttgagatggattgaaatattttaagggatattagggatttgccagagtctcggttctcgactcaaaccaaattaacatgacttaccacattttttgtttaaattaaagggaattaataaataaattgaataaaaaataaaattttaaaaaattgttaggaaaatcttaaaatttattcttaaaataattattttattctattttttaattgaataagattttttaaaagtcttagtcattgagaaatttcgagttttttggggggtctaagtttctcgattccctggaccataaatcaattttatgtagagaaaaagaaaaattcagaaaaagggaataccgtagtcatacagtaaataataaattgttttctgtattcaaaacaaaaattttctgctcgaaaatttctatgtattaaaaattttgttgaaacggataaattttttttttaaattatttcttccatcaacagccaccacaaatgtcccaacgcttacaactgcttcaactgctgcaacaaccggtggaggtggcactgcggcatgcacaacatgttcgcccagcgcccttcggctgctgagcgtgccggaagcggttgcgtccggcttgttacaagcaactgccacaacaacgccaaccaacactgccggcacgaatgcggccggctgcgcaacgctgacgcccaactgtgacgcaggccaagtggtaagtaatgaatgccacaggggttgaagcagggcggcgacaaaaaagtctcgggtacggaagcagtcggcggtttgaaaggtgatcgagacttgaaaagttagccgagaaccgagatcgatatttatctccaagactcgaaaacgagacccaaaaaaacacgagacttttcgcgagtcgagaccgggactctcgcgcatcactagcggtttggatagctgtcagactctggtctggagaaaatttaggttttcgggtcggaaaagtcgcttacaaattagggcctggaaaaactatcagggttcaggctcggattttggccgggaaaaatcagtcgggtctttgggtttcgaattcctggaaaatcggtaggaaatcgtcatgtcttacaatcaattaacgcacttttctgtcttcccaggtttccatacatgtgatcttggcaaacggtgacacggactttggcaactacgattcgggttccctcccgctggagtgcaattccaacgggaaatgggttgtgccggcaggtcgccaacatgccggcaatgttgtggacggatattcatgtgtgacatcggcaactggataaaggaagacaaaaaaggaaaaggaaaatccatacctatatttagaattaattgttttgtaatgtttcgagtcttttgctcaatctttggtctgatcattagagaccggatttttttcagcaccaaaaaatgatcattaagcacataattcagcaccaaaaaataatcattaagcactaaataagcatgaaaattagagtgcagcgggaccgggaaatttgggcaaacccgggaccgggacttttttggttgaaaaatggcggctgtcactttgcttattattgccgatggattaaaggatttcatggatttgaattaatttgaaaaagttaattggccggataaaatttatttatgcaaaatttaaatcaatattaatattgaaacaatataaataaa

SEQ ID NO: 81021 - DNA, 1298 bp, Heterodera glycines
  Genomic contig location: Contig_ID=SeqID_16606; Location=369..1666; Strand=+
  SCN-specific regions: Sequence locations=1-282,304-676,734-752,775 -820,862-876,898-1179,1201-1298
atggacaaccaaatgttcgacgcggataataaaaaagagttcgagataaacaacaacggcatggaaaacgagtcacaacggtggttatgtgctaatttgaactacgcgtccgtgggcactgcgcttctgaagggcacgccaaacagagacagtgccttattagtgcaggcacttcgccaggtgtgggggagaactgttcgagagtacagtctcggctcatctgttgaggaatttcggatcttatttgatattgtgtgcgactagctttttttgattaattataaaaaacaaatgcatttttatagcaaataacgaaggcaggctcaatgaccgctggagaggccaaccttagcaaaatgatctcaaatgatattttcatgttgcgcaataaaaaacaggtcgatggttttgaagaattttcatttggggcgagggaaaaagcacgaaaaatacgttttcaactttatttgtatgaggaagagctgattaattatggtgaatttgggattttcatgcttaatgctgaaaatgagcatttatttgtgtatgtttatttggacatttttgaaaactttcaaaacaaaattgcaataaaaattttttaaagttttgtttaattatttgtgtgcttaaaatccggactctaaataattattgaaaataattaggtcactacaaattaatcattaaaaaaactttattttttgaaatcattttatttgaaattttattacgctgaaagttttcttatgaaaaaaatttaaatattattttcaaaagctatgatttttctagcggaaaaacacgcaatattccatggaaattttcataatattaattttttaatgtatttaatttattcagtccgttctgtccttgtttttggttccctcccaacaatcctcgtccaatttcacttccgttgattctcgtcgtcccaatttgcttccttccttttcctccacctctctcatcagtggcacatcctccacttgtgctggtgttggccttccaccatcaataccctcatttgtggatctgcttaaggcaagaaaagggagcaaatttaatgagtccaaattagtggcaattgttattaattaatggcaaacttacaaattattgcaaaacggctggggtcgtttcggcgaggattgtttcgaagccaagcgacataagcccacaaaaaattttatatttggtatcaatttaaaaagctggacaactcttttagcctggaaaattcaaaaaatttcgtttgggtataaaaaaatatggcaaaaagtgcgaaaatttga

SEQ ID NO: 81022 - DNA, 733 bp, Heterodera glycines
  Genomic contig location: Contig_ID=SeqID_16607; Location=221..953; Strand=+
  SCN-specific regions: Sequence locations=1-503,525-573,595-733
atgatgatgggccaaggtgctggcaccgtcgccccgggaataacgaccatggcaaaagcgtccgtgacaaaccctcttggccagtcgtcggggccgtcctcccaacaggcgaccattacgaagcaaatcgatcgcgccaagtcgttggtggccaccggcaatgtgaagggcatggaccgggtgtcgatgatgcggtcggcgttgaaggtctgtgacataggacgttcacgcggtgcacctcaaaacgttgccggacgatttttcattgcgacattaagaaaaaaaacatgatgagggagcagcatttttcgagtatattcaagaatattttttgtctttaacccagaaattagctatcaaaaatttgtgcccttttggtttgggtgtttcatttttccttccctttccagagcaccttcaaacactccttccaagcggccactgttactgggtcggactattcgttaccaggcaatctcaacagggcacttttgtggtgaaacttttttccccctcatttttagcatctgacccgaggccagaatggaaaatcaaattggacgaacaggcggaaaagattaaccaatgcatcaacagacaaaagcagcaaggggaagaaggcgacggagagggaaaagtgccaccaaattcggagccgacaaaagcggacgatggacagcagccaaagcggcgatcgagatggacatgaccacacggcattgatccatgacaa

SEQ ID NO: 81023 - DNA, 395 bp, Heterodera glycines
  Genomic contig location: Contig_ID=SeqID_16608; Location=70..464; Strand=+
  SCN-specific regions: Sequence locations=1-121,145-395
  Gene Ontology: Mol. function=lipoic acid synthase activity; Cellular component=mitochondrion; Biological process=embryogenesis and morphogenesis
gcgaatccccggcgtgttgaccaaaagttcgctgatgcttggccttggcgaggcggacgcggaggtggaggaggcgatgcgcgaccttcgcctggtcggcgtcgaggccctcacactgggccagtacatgcagcccaccaaacggcacttggccgtctccgagtgggtgagcccggccaaattcgaccgctggcgcgagttgggcgaccgtctcggattcgtgtactgtttttgtgacaaatatccaatttgctcattttgtactcattattttccttttcagttacaccgcgtccggcccattggttcgttcctcgtacagagcgggcgaatttttcttgaaaaatgtgatcgaaacgcgaagaataaaagagaacggaggtggaataggatga

SEQ ID NO: 81024 - DNA, 229 bp, Heterodera glycines
  Genomic contig location: Contig_ID=SeqID_16612; Location=2031..2259; Strand=+
  SCN-specific regions: Sequence locations=1-229
ccgggactcaaatgtcccgctgaggccaaaaattttttctatttccgggaaaaaatcgaaaattttccgaaaaaaataccagtcgatagagctcgaaaaactatgttttggaagtggtcttcgtttttctgcgaaaaattcgttaaaaattcttaaaattcaaaaacccaaaaaccgttttttaggcctagctcgaaaaattttgaaaatttttcaaaatttttaaatt

SEQ ID NO: 81025 - DNA, 87 bp, Heterodera glycines
  Genomic contig location: Contig_ID=SeqID_16613; Location=907..993; Strand=+
  SCN-specific regions: Sequence locations=1-87
aaaatcgagcttccaaaactctacaataagtctgctggcaccccctcgctcagttcaaaccctggcgagttattcgcctggtactga

SEQ ID NO: 81026 - DNA, 1500 bp, Heterodera glycines
  misc_feature (1392)..(1392): n is a, c, g, or t
  misc_feature (1418)..(1418): n is a, c, g, or t
  misc_feature (1465)..(1465): n is a, c, g, or t
  Genomic contig location: Contig_ID=SeqID_2675; Location=16..1515; Strand=-
  SCN-specific regions: Sequence locations=1-353,375-539,562-1034,1062 -1500
atgattattgtgagatcgccaaaaaacactcgccagaggacggtgaatcttggggttcagccgttaagtggagacaatgaccaacagaggggacaacagatagtggagaatcctgtgaatttggcagcaaacccgaatgtcaacgagggaaataggcgtaattctgtttcttcagcgaacacatcagtactcgacgcaaacgaaattcgacgcagactgaaaatgacggaaaatgccaacaatgcagcggatggacgaaacggacagcagcaagtgcaccgagaagaagtgcttctgaatgaccatggtaacaatttgttggcgaatgcaaatttgggtgaaaatgtggaaaaaagttttgttcaaccattggtcaatgaccaaccacaacaaatacagcaaaatttcgaaaacgaattgcggcaaaacgtaattgtgggggaacagcgcgtagcgacatcgactccttacatcgaaatgcaacaattgaggcaacaaaacatagagcggcgtaatataagtccacttcggtcaccattcgaacaaaattttcgggaaaatgtggttgtaaacccgaatgtgattgtaaacccgacccgtaacgaaaaccggggacccaatctgcatttttcggaccgaattgatgtaccgccaaatcctaatgcccgtctccaagtttttcgagagcaacacgtcgaaatcgatcgacattattcgagtgcttttcatgcaccggtgccgatgcgacaaacctgtcacggacaaattcaacaagctgcgtatatggagcaacacggtgcgcatcagcctatgctgctccagcaacaaaatatgcgaggagtgatgcatcatcagcagccaatggcggggagaaatgaatattttcctgaatattacggcggaagacatttgtatcccgacggcagagaacaaccaaactcggggaataatgaattaaaaatcggtaatttggaatatgtgctgaccatggaccgacttcccgagctaaatggcaatgagggaactgacaaaatgaaaagttttttcaaaaaattttcaaatgccacggaagaatggccggagaaaaaacggattaaagcgttggaatccaaagtcaatggacgggcagagcgtgcctttaatgctgcgcttaacacccagccctatcgtttcgattcaattcgacgggcaatgcaacaacagctcgaggacacggattgtcgcgaaatgagcgcattcgacgagttaatgagcggagtaaagcgaaagtcaaacgaaagtctggacgcattagccgatcgaattcaaagtcttgtttcccgtgcgtacccgggcttgacgcaaaatttgtgcgatgattatgcaattcggcacctaatcagagcactgtcnaatcccgatctctcattaacgctcgnaatgtcgcgaaggccagaaatgtcgtacgatgaattcgttgcattgnccgcacgcgctgagtcaattcagcgtgcaccaaaa

SEQ ID NO: 81027 - DNA, 502 bp, Heterodera glycines
  Genomic contig location: Contig_ID=SeqID_2676; Location=366..867; Strand=-
  SCN-specific regions: Sequence locations=1-353,375-481
atgattattgtgagatcaccaaaaaacactcgccagaggacggtgaatcttggggttcagccgttaagtggagacactgaccaacagaggggacaacagatagtggagaatcctgtgaatttggcagcaaatccgaatgtcaacgagggaaataggcgcaattctgtttcttcagcgaacacatcagtactcgacgcaaacgaaattcgacgcagactgaaaatgacggaaaatgccaacaatgcagcggatggacgaaacggacagcagcaagtgcaccgagaagaagtgtttctgaatgaccatggtaacaatttgttggcgaatgcaaatttgggtgaaaatgtggaaaaaagttttgttcaaccattggtcaatgaccaaccacaacaaatacaaatgatcatttaaaaacgattcatcataaattttttgaatctaattatgaattaagactttttttttagccatttaaattcattttcaaatgattttaaataaa

SEQ ID NO: 81028 - DNA, 1673 bp, Heterodera glycines
  misc_feature (1071)..(1071): n is a, c, g, or t
  Genomic contig location: Contig_ID=SeqID_16614; Location=532..2204; Strand=+
  SCN-specific regions: Sequence locations=1-208,229-279,301-348,384 -446,479-597,619-1259,1283-1473,1509-1673
atgcgtcttattgttgacgatttttttgaccaacaagtgcgacagttttccaccgaactacgtcttggcaatgcgtttctgttccttggtggtgccccgtcggggttagcctcccaactcgtccccgacaatttgtaccccttccggggttgcataaaaaaggtgtgttttgggtttatctttaattatccataaaataattacaataatatatatatatatatatatgtgtgtgtgtgaactaatatgaatataaaatatatcatgaaaatttagccaaaatttcccattttgcaaaatctgttaaccaatttaaaaaattttcacagaggcgcttctcggcactgcatatttttttttttaaatttatgtttaaataaaaactcaaaaattccccttttttggactaaatcaacaacaaatccatccaaataaagaaaatatgaagatatttgggtaataaaatggtgaaaagatgccggggtggagaacattttccgttgatggggaaacgaataatgagaaatcattaatgcccatatagattaattgattgagtgacacatcaccagcagttgacgaatagacaaattaggaggaggcaacaaaaacaattatcagagaacaaacggaccaaatacaactcgtagtgttttaaaaatcgttttaacttttgtcaaagtaaactaaattaaacatttttggcgctacttgcaaagtttgaaattttttttcacttttttttggtcaattttttttttgtttatttttaatgcaggatttgcttttttaacatgaaacgtatttcatactatttaataaactgaaaaaaacattttaaaagaaaatttagcgctagttaaaaattgacaaattttgagttttatcaaaaaccaaaggggggaccctattgttttgcaaaatttttttgagataaaaaatcgtgaatatattttttattcgccataattatgctgttaatacttaatattcatcattatgtgccaaaaaaacaaaaaaaaaatgaccaaaaaaaagttaaaaaaaatttcaaaagggtactctttgcanagtagcgccacattttttggtctcaaacgatattagcaggattttggacacggatcctgggaaaatcctaatcaggattttgtcccattcgagctctagtagctaaatgtcaaaatcgtttaaacagattgctttccgtctattttaattattttacacatataccatatattccaattatttgtatgaaaaaatttttaaatttataaaagtctacagtaaaaaattcttttaaattttaggcctttttccaatcgggtcctgttaagctcaaccttattgcattggctgaccaaggctatggccaatcgcatggtaatctaatacattttattcagtttttaatttatttttctcaaactattagaatttaatttacataacttaaaaaaatttgttcccaaattttcttaaaaaaaaaaaaaaaattaaattttcagttcaaacatttggcgatttatcctattcatgttccccaaatgctcaagtgcctgaagtgtttgccttcaacagtggcaaaaattttagcaaattgccagcctggaaatcgccctccaggggtaccctaggtaaggtgaattgttttttcgaaatttcaaaaa

SEQ ID NO: 81029 - DNA, 867 bp, Heterodera glycines
  Genomic contig location: Contig_ID=SeqID_16615; Location=1061..1927; Strand=-
  SCN-specific regions: Sequence locations=1-128,165-305,327-438,494 -599,655-668,691-693,745-789,816-828,858-867
atggataatgaatattcacatatcttttactgtacatgcactactgctgtggacttggtatatttttttgctgaaaacaataattttaattgccatgagtaacatgaacttcacaaataaaaataagcttaaataataataattaaaataaattttgtaaaatagttacatgaaaatcaatttttgacggatcaaaaataaaaatatctaagaaacaaagaaataacattctcaaaagtaattttctacagtctaattaataagcaaaaaatattgaacaaagagtaattatgtcaaaattaacaaaatgattaaaatgaataaatcgcaccaaattactaaatcatttactttgcaataatataaataaaatcatcatgaaacaatagaaataattaacctaatggaaactggaagcatctaagttgctttttggactttttttcaatatacaaaaaacatttttaaacaataattttaaatataaattttacacttgattattatgcttttgcatcaaagtgcaaaagtaattcaaagatcttggaattttcctgactgaaataaatttaattttacgattaggaaaaataagaagcaatttataataattttaaatagagttaaaatttattattataacaataattaaatcacccaattattacaaaaactttataagtcaatattctcaaaaattttcataaaaaagaaataaacaagaaaaaataataaaattattatgcaaaaattgaacaacttcagaactacaactatacgaatgggcaatgtttaacaaaaatattaaaatgaaagtttaggaatttgaaaattttatttattgaaaataattttaagcaaaataaa

SEQ ID NO: 81030 - DNA, 1731 bp, Heterodera glycines
  Genomic contig location: Contig_ID=SeqID_16617; Location=749..2479; Strand=-
  SCN-specific regions: Sequence locations=1-51,73-76,98-125,166 -229,315-612,726-864,886-980,1002-1007,1029-1081,1120-1160,1182 -1198,1236-1257,1293-1486,1553-1567,1599-1684
atgaattattcggctaggaattatttaatgaatgtgcttattaccagcacagaagaaaaactttggaaaaaagacaataaatattcaaaatttgacaatagcacctataggcacttatcgtatcgaaattattttttgataaatttttttaattaagatttatttctttttggcatttttgagaaaactctgtaggaaaaatacaagaaaattgaaaaaaacaccacccatattttattacaaataaaatgatcaaaataaaattattaacagtaataaaatcacaataaatagaaatattacatttatttttactcgtcctcaagatttatattttaagatcacatcaaatatttcatggttttcagtgttcaaatagagaatattaattataccaatatttattcattcacatgccattctcacgtgttattcactgtcccaattcatgggttaatgcatggtcacggtcgagattcacggttaattcatgatcacctagatgattcaagtaatattgagtggcagtgttcacgtgtcaattcactatcacaattcacgggcaaattcacgttcgggtaaatttactgtcacgtagatgatttacgtgtcatattaaatattatatatatataaatatcatttcaaaactaattgcctttatcatttttaaataaataaatataaattcataattttcttttcattaaaatatatttataattctccaaagtcctaatttcacttttctttctaaatgaaataaagaaaatttaattttcaattaattttcatttcaatttcaatagataatgtgaaacccgagtgtaataatatataacagaagaaaatagatataaagcaaaatatgaatatatgcccacaataatctaccaatataatttccaaaaatttaataggcgtctctaaatgattatcggacaaaaaagtcgtaatttttgacagaattcgagaagaaagataaagttaagtttattaattaatcaagaaatactaatattaatttaatcgaagcgctcatcaaattgttccattaatgttcgccttttaaaatgggaactattattattattattttaattttaatttattatttttcgcataataagattatttcatcggtcttatgttcatgttatttttatgtagatttattttttcatcatttaatgcagtgtattttaaaattattattttttataaattaaataaaagttactctaaaatttggaccagtttatttttatttgttttttaaattttatatttttcctaatgtatgttttagaggccgagccggaccggagacccggtaccggtttttactggatccgtaaaacagtccggcgtttttttggaaaaataaggattgaccggttttctggtttgaccaaatccggaaaccggttgcttttgaaaatgtaaattcggtccggaccggcaaaacactttgttttgtatattctaaaaattttcaaaaagtttagtttatttttttttattatttatttaaatttatttacaataaaaagcaaaatttgtaaataaaatggaaaaatttttaaagctttattattctaatcattatgaaagttaaaattaaaaattcccttaatcgattaatttttcagcaatcttgactaaaggatataaaaatatgtgcatttattaatcattaagaaattttataaaaaaattaaatcaaataaa

SEQ ID NO: 81031 - DNA, 1096 bp, Heterodera glycines
  misc_feature (6)..(7): n is a, c, g, or t
  Genomic contig location: Contig_ID=SeqID_16618; Location=10..1105; Strand=+
  SCN-specific regions: Sequence locations=1-121,143-986,1008-1096
atgggnncggcgttggcgcaaacaccagcaaaagcgctattctttgccacactaacccagcattgccaacgctgcaacgattttgagcttaaagcgctccaatctggtgcacaaaaattcgaaaattgtttttaaatattttaaagagcattgtcgtccaacgggatattttgatgtgtacacgtgcccagcagtggcggagtacaaagtggacaatggcacaaaatcacatcatactatcatttataagtgagaaaaaaacaaatttttttttcaattttggcgctagtgaaaaagtgacctattttgaaaattttttcaactttttttggtctaattttttttctttatttatttgcatataatgaatattaagcattaacaacacaattatggcgaataaaagtatattcacgattttttatcaaaaaaaaaaaaattccaaaacaaaagggtccccccctttggtttttgataaaattcaaaaatccaaagtctaaaaagtatctttttgaaatttttttcactttttttttcaattattaaataacggaaaatgcgtaccatatgttaaaaaacaatttacataaaaataaagagagaaaaaaatagaccaaaaaaagttgaaaaatttttcaaaataggtcacttttcactggcgccaaaattttcttacccaaattttaacataaaactcgcgaaaaaaatcgaaaacgtcatttcctaacaagaatttttttctagaatgaaatttttttcgaaaaaatggcaaacgttttcctgcgcagcacctatcggcaaaatggacgacaaaattccctcaaattttcaaatttttttttagtaatttgccttttatgtcccattctaaatgttaaaaaaatttcatttctctcaaccaatctattttttaaacaattttaggccctgcttgaccatgtcccgggaccaggagagtgacagcttttatatgttttgtatggcatcaatggccagtgctgtgctgtccgcgctgtacgttcgctggcgtcgtgaactgattgaacggcgtgcatttggctcttcggcacattcatacgcccgattggccaccgct

SEQ ID NO: 81032 - DNA, 2192 bp, Heterodera glycines
  Genomic contig location: Contig_ID=SeqID_16620; Location=685..2876; Strand=+
  SCN-specific regions: Sequence locations=1-510,558-573,595-668,690 -1066,1088-1286,1312-1785,1807-1865,1908-2192
aagagttacttcgtgaaccatataatgagctttcacttccaaaaaaagctccaaaagattacatcaaaaagctggattcggaaatcgaacatgtgccaaagttcaaattggtgaaaaacaaatcgcgttttattatcaaagacatccctgctgaccctgaggcactcctaatgggcgtcttccaacattgtatggatgaagcaattattgacagccgtcaaagtggagttgaaccgactcatctcggatgtattgtttctagccagaacctttcttccgacatttggatccccatttggcagcttactcctgacaccattaacacaatactaaatcgcttcaacgacgttgcacagagcaaaaaacaggatggtgtgacgctgtggggtgaaccatttactgttacagtaacaacacttaaccgtaatgctctaccggcgaagcgtcagctgaaagggggagcagcccggaaattagcaccagttcaccacaatattcatccaaattgtcttattaaagttaaaaatttataatgtcttaattaaaaataaattttagatccaaaattttgatgatgacaattactgtttattttacgctatccaagcaaccctggttcgatcaattggtgacttggatcgtcgtcgctttcatgattacgtcaatggaaacagtgaaatgagaggaaaacttaaaaatgatgctttggaaatgatgaatgctgttaacgcaccagctggtcaaccaaattacgatgcggaagtatatgtgccaagaattgtggactggtggaatggggaaaaattcgtgggccaatggaaattcaaaacatttctcttcggatcagcaggccattacaagcctttattcaaatatggaccagaggactatgttgtgccgatcatcctttacttcgaagagggacattttaatggtgtgcagaaaagtggcaatttgttcggcaaaccatattgtctaagttgtgaaaagacctacgatcggccaaaacgtcacattgtcaattgcaaagcccgctgcattaaatggtaataaacaattttaacaatgaattaattatttttaagctcccaaatgggtccaatatttccatgcaaaccaaataatggattccgacaaaaatgcaaagattgcaataaattattcttcaacaactcatgctatcagtatcatctttcatcggaattttgcaaaatgagcaaagaatgcaaatattgtggtgtggtttgggatttgcgtaataatacccaaaatggaagagaggttttaaataaaaactacatttctcaataatcaaattattatttagggtcacaaatgcaatgagcgatggtgcgaaaattgtcaaattttccacgaattcaaacgggggtgtttcattcgtccgctggagttaagcccaaagaacgaagcacggggatggagattagtcattttcgaccttgagacaatgcaacacgaaccagtggatccacaaatccctgagcgacggaaacaccaagtcaattttgtcaccgcaaaagttgcttgtcctgactgcatttcaaatggacaatggaaagaaagtttgctcggaaaaaaatgcaatatttgtggctaccatcggacgattacattcagccaaatgccatttaatgggacaactgtagatcgacaagtaattgaccgacatcccctggtctccttcgtcaaatggattctatacaatttgccaaaacaatacgacaccattgcatattcacattttggaggacgatttgacatggttttggttttccgagaattattcatggaagggctaaatccgtcaatgatcaaaaacggcaacagattactcgaaatgaaagtaataaaaatatttttaataatatttatttttataatttttaggtaaaaagtcggaagaaattaaatccaaatatatcattccgagattcttggaatttggttcctggcccattagcctcactggtcccaatgtttggcttggacgttcaagacaagccgttctttccacatttggcaaacaggccggaaaattacggctgtcaaatatttccgacgaaatcaaactatttggccggtgggatgaatcctgagaagcgtaaagaatttgacatttggtatgctcaaaaccaaaatcagccgtttctgcttgatgaagcattagccag

SEQ ID NO: 81033 - DNA, 1139 bp, Heterodera glycines
  Genomic contig location: Contig_ID=SeqID_16621; Location=46..1184; Strand=-
  SCN-specific regions: Sequence locations=1-174,200-306,328-580,603 -721,743-836,858-1094,1116-1139
atggccagacagcaacaatccacggcttcttcttgttcgtcatcatcgatgtgctgctgcaatgcgttggccaaaatgcatgaaagttttgtggccaaatttcgtgtcatccgaccgcaggccaatctgatcactttggacggggacaacaacaacgacatcattctccatgaagaagcagacgaagatgaagcaatagctcgtcagtggaatttttttgcaaaaaatggcattttggcgctagtgtaaaagttgtcctttttgaaaattttttcaacttttttttggtcaaaatttttttttgtttaaaaagtcctgaaaccaagtacccgggggttttaaaggtcgctgatcacgaatatggcaattatttgggcctgttaagcaaatttggcgctacttataaagtgatagattttgaattttatcaaaaaccataggggggaaccttttgttttgtaaaaatttttttggttaaaaatcgtgaatatactttttattcaccatgattgtgctattaatacttaatgttcatcattatgtgtaaaaacaaaaaaaaaattttgaccaaaaaaaagggaaaaaaaaaaattttttttttaggaccacatagattcgtttttattatctactaaaattaccttaaaattaaaaaaatcaaatcaaatggaatgtaattgccccaattttgacgaaatcataatttttctgcagccaaattaattaattttcaaattttgcatgctaattgaaaatatggccattcgctaaatttttatggttatgatttgaactggaatagtgccactttttttttgttgcaaaaattcgctgtctcaacatggaatttccttttttgagagccctgtacttcttccgccggacaacagccgaggccgattggtggtggtactgctgacgaactgcaacaggaggcggaggacaacgaaagtgttttgctgaacggcgccgaatcgccgacccccggcgccggcactttgggctacgaaattttggcggaggactccaaaacgcctgccccattctatgaaatgatgagcgaaagtgagctgaatgtacgcgacggacactcctcgttttgttttaaatataaattttgcgacaattttttggtttag

SEQ ID NO: 81034 - DNA, 888 bp, Heterodera glycines
  Genomic contig location: Contig_ID=SeqID_16624; Location=73..960; Strand=+
  SCN-specific regions: Sequence locations=1-33,56-574,597-863,885-888
atggaagcgcttggagcaattattttggactgtaagaaaccaccgaaaatactgcagaaagaagcggatgatgtaagttaataggacgacataatttagaaaggacttcagttgtcaaacaaattggaaatgcgacatttcccggccaaccctaaagaagtgcaaatggcgcgtaaacagataatgcatgaaatgttcgaagagaacccagcactgttgtaccaatgggaggacactaaacaacggcccaccctcagccgaatgtttgacaaagaggcacagaaacggttagcagcgactcgctacaattggaaaccgctcaaattcgacacaaaagaggcggccgttgtttatgcgctttcgcggttttttgttaacagagaaaggcatttataaatgtttttcatttactctagattcggtgggtattttgcagaaatgcggcgagtgttttcggaatttgatcggaatggatttgagcccgagacggtgctcgattatggcagtggaagtggggcagctttctgggcggcctttgaaagatggggtaaatcaaaaggctatgctcaatcacattaaaaaatcattttgcaggtaacaaagttcgtgaatattctctcatggaccaagactatgtgattcgacaattgtcaatggatttgcttagggtctaaaaaaaatttctctaaaatttctttgtccaattcagggaaagaattatacaggagcgggcgaaatgatcactcaaaatgtgttttttcgcaaggatctttttccctctccgcagcatacttatgacttggtcattttgcaccgaactctcatcgaaattcaatcggaagaggagcgaatggaattgatcgaaaagctttggaagagaacaaaaag

SEQ ID NO: 81035 - DNA, 1444 bp, Heterodera glycines
  Genomic contig location: Contig_ID=SeqID_16625; Location=30..1473; Strand=-
  SCN-specific regions: Sequence locations=1-405,462-933,996-1108,1177 -1177,1199-1240,1266-1305,1343-1444
atgaacacgtggtgtccgtgctcgtgccaatttgacggatgccaaccgcacccggacgagtggaaccaataccagcaagatccgacaggccaaagtcggtgctatagacagagtttttaatcttaaaacattggccatatataatttatgatctcgtacacccatttttggggttttgatttaggtcctaaaaaccctcttaaaaccagcacaaatttgtaaagccaatggttagttcctgttcccaattttattgcatgataaaaatttcttatattttgtcatctatttacgaaaattccatcctcgacattttttgaatttttaagcaatacctgacaaatttagttaggaatttttccccaataccggaaatttttgtcaactaaggccagggcagtgatctaaattatcaaattaaattaaaaatctgaattgttattattatgaaaatttatttacgaatacggatttgtgtttacattttaaaagaatttaaaaaagtttttagagtaaaagattaaatgccaaaaaataaaattcgagcatagaaaaaaatttcaatttatgaaaaaaactttttttatcacttaaatatatcaaaaaatgatttcaaaaattttgaattcgtttgaatatgttttttaaatttcagtttgcaaagatcggcattcgcaatgcgaacgttgggccaatttccataaaacccgtcatgcttctcatatttctgctcatcatatctttaatcgatggcattcatctaattacccacgaaacataatgccaaaatataatgtgtcatcaagcagtggcgaatgtgcacgcaacgcgcattggatggcacagaattgtgccaaatcatgcggacattgccgcgccgcaattggcacatcgcgcaaatgcaggttagttaacccgcaaattttgttatgcatttataaaaattattaaaaataaaattaattacaggttgttttaataaaatttaatttaaacccgacaaaaaacaatttatacattttttgaattttagcttgatgatgccaaaggactacgaaatgccaattattaactaattcatttccttcttttgaaaatgaaagaattaattttcaatatttatttatttgttgaaaatgttagatatttataaagaaaagaaaaacacaacaaacagttttcaaaagcatatgttatcgtgttgcgtcttttgcgcagcggacatttgcgccgtttagtcaaaaatatattttaaaatttttttaccaatttcaacgaattccactcaaattactaagcaaaaacaaaaaaaaaacaattaaaagaaattttaaaaaataatcataatgataggcatcggcggcgaaggaaactttgagggcgaggacgaaaataatgagatttaataagccacgtgggcggaggtagttttagtttaaataaa

SEQ ID NO: 81036 - DNA, 1703 bp, Heterodera glycines
  Genomic contig location: Contig_ID=SeqID_16626; Location=259..1961; Strand=-
  SCN-specific regions: Sequence locations=1-79,121-406,449-517,564 -739,795-800,822-857,879-897,946-1151,1174-1248,1270-1370,1424-1703
atgtggagcagtatgtttatgggcacaacaaacgattttggtcaaattgttaatggcgaatttgctaattggatcactgtaaaatttaaaattatgataatttattaactttaattatttgttttgtacacagattagtggaactttcatacaaaggacaccagatgcagatggtcaattattgaaagaagaagagttggttaattatatttcaaataatttaggccgtaaattaaattattgaaaaacgattttttttaacgcaacaaatattgacaaaataccaaaaaagtagaataaattgtcaaacttaataaaaattgaaatactccgatgcaaaaactctaaatttgtttatttagagggcgaaaataagataaccataaacaattttacttcctggatgaattataattaaagtataattaattttaaataatttttttttccaattttagtattgacgcattactctctaacccgaatttggagcatatattctcctttccagatagagttaaattattaatttaaaaactaaaaataaataaataatattttaagccaataaatggcggatgcacattgccaaatttaaacccagcgaacatgatcgaaatcattcacagtgatgttcacacttgggtgggtggggacatggtaagtcaaagcaacaatattgattaattaatttaaaatacaatcattatttagataaattgtcttgctgaaatctttttaattattcaaattttatctgctaaattttttaaaaaattattaaaaatttatttgttcgatttattaaaaattttgggttttagttggcattgaacactgcagcacaagatcctctcttttttcttcatcacagttttatggatttggtgggaacagtttttaattagataattattaaataataaattaaaacataattaaaatcccttcatttttaagatttgggaacaatggagactcaaatggcaaagccgagcgcagcgtgaaacgcaatttccacctgattcccaaattgtcccagtgagtttttaagtaactttaaaatttttctattcaacgctttaataaatgatcagcgatcagtgggaatttaggcgattaaaaatgattgggtaatagcgaaaagattttgattcaattttttgaaaaattttcgtgtaaggttctgtcgaatgaatctatcttgttttggtcctgaacccgaaatttttgatcggtgagcctaatatttcacttatgcatttatacgttgtttctcaaagtttcacattacagtgttctggctctgaaaattatcgtctaagtgcaataatgcgacccttccaggacccggttgttttaaacagaggtaaattaaaattagaaattaatttatcaaatttaaatgaaaaaaagtaattttcattttagatggtctaagcaatgcgtacacggacaatttgtacacttatgcgccaagaccatcatgcaatggagccggtcaatgtggatcaccgtaaaaacaattatacattttaatcccattgaactgtattcccagcagtaggtggcttaatttttttttaacttggtactgtgttagattgtttacagtcttagaaatttaaatgcactgatttgtaaaaaaaactactgaatttcaccataaattttgttaaaaacattaaaattttcctaataaa

SEQ ID NO: 81037 - DNA, 542 bp, Heterodera glycines
  Genomic contig location: Contig_ID=SeqID_16627; Location=322..863; Strand=-
  SCN-specific regions: Sequence locations=1-542
atgttcaatcaacttttgcctattccatttggtgcgcaacatgaaagcatgtcttaccgacgagcaaactcacgtaagaaatttttttattacttttgaaattctcaaatttagcgttcaaaactgacgcagcctttgcacaattcgccaaaatggtcacttcgctggcgtttgtgccgctttaggaccttacaccggcgctggcagccctagaagatcatctgccgggtgaacttgagggcgttctcgattggtttgttgagtttaattttttttcaatttcattattgactttaaaggtttgtaatcaactacgttgggcgacttcgcaacaatggcacacgcactcgtccattgtttcgtcctgaagaatggagtgtgtatgagcgcacaatgagcggcaccgaccgcacaaacaacttcgccgaagcgtaccatcgcatgttgcaacatgcgatcggacaaggacacccaacaatatggaaattcatcaatattttgcgtgagcaccagaaagtaatcgacgttgacttcgaaataaa

SEQ ID NO: 81038 - DNA, 1281 bp, Heterodera glycines
  Genomic contig location: Contig_ID=SeqID_16629; Location=857..2137; Strand=+
  SCN-specific regions: Sequence locations=1-1281
atggacgcacaacaacttcagcaaattttggacgcggctctaaaaaaatcagccgaagtttttgccgccgcactcaacattcaaaatcaaaacccaaacccagggtcatccacaacggcatcacttgcggcatcaatcaatgtccacctcgaaaaattcaattataatccagaggttggacagacttacgacgcttggctgaatcgatatggcaaaatcgttcaacaagacggcgcttcgctcccagagcagtccaaagtccaacttttggtcggaaaattagacgaggaggaatacaaacggtatgttgacagcattgcaccaaaagccacagaacaattcaactggctcgaaaccgtggcaaatctgaaaaagatttttggtgagacgaggtcgctcttcctccgccgtttcgattgttttcaaattcgccaatgccaaaaccaagacctttcgagtcttttggcactaatcaattcatcgtgtgaaaatgccgaattggatttgaagaaagaagagctaaagtgcatgattctcatcatctctttacgcgacgaattttcggatttgaaacagcgatgtctccagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaaagcagaccatccaaaatggtggaaaatactaatcaaagtgaatggcgcagattatccaatgcatgtcgattccggtgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatat

SEQ ID NO: 81039 - DNA, 1740 bp, Heterodera glycines
  Genomic contig location: Contig_ID=SeqID_2678; Location=42..1781; Strand=-
  SCN-specific regions: Sequence locations=1-159,181-698,720-1491,1513 -1740
atgcaacaattcgagttcgagaacggaagcgagagcaacatggacccagcgaatgagggccaccatcgcaacggcgcacagcacgacgaaaatgtgcaggacggggatggtcccgtcgcttcaacgaacgaagagcaacaaaaagttgccagagtaaacgaagcaacgagaggaagcaacatggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacctactgacagcgccactgccggcagcaacgaaagagttgcagttgcgaaaccatccaacaccagctgaactgcttcaaattgcggacgagcacatcggagacttaaggacgatgcgacaggcactcgaggatgaagaagaagcaatcgcgcggtctcgattgagcgggtcattcgggaccaacaacagccatccggtgggggacgacccacctccactggaaaatcggaacatggaagaatgggagagatccttccaaggggcggccaaacgatggcaaaacgacggacaaggtgtaccgcaacacaaccgaagaccaatgggacgggtcgcgacacccgtcatgtcgaatttggacgggatttttcagcggcgtgccaaagtaccatccgtcgccagcatgagagtgacgaacccagcgcgagaatggatcaatcgaaatcgagacgagatgggggcgtttcccccagcaacagcccatcggctggcactgatgcaaccaaaaatcgaaaagcagcagactcacgtgaacgacgactatcgggagcgtcagacatacccgattcgacggcatgctcgagacgagggagaacatgatcggaagcacgggagggacgaaatcacggaaatgacaacattcgagactgttcggctgcaaccgccgactttttccggaaagcccgaggattggacaacattttgggcctatttcaagcgagctgtggacgacaaacccattcccgggtttgaaaaacaattgcatcttctgcgctgcttaaaggagggatcgccagcccggcgggctgttgaagtctaccctccctccgacggcaactacccggtggtcgtgcacctgttaaaagagcgattcggcgacactgacgatttacagcgggcaattcgggcccggcttcttcacttgccaccggcaaaggacagcgtgaacagcctgacaacgatgatcgacgagtttgagcggtgcgtgtgccaactcgagcagcttggggcgaacgtggacgacgactcattcggcccattgctggaggcaaaattgccggtgcgagtgctcacggaattgcggatcagagaaagtatgatgggatcgaaatgggcagtgcgcgagttcaggagagcggtgtcggcgcaagtacggtgcatgcggtcagcagagtcagcattggcagcaatgaaagacccggaagagggcactgatcacaaaacagaacgtgatcagacgggttgg

SEQ ID NO: 81040 - DNA, 766 bp, Heterodera glycines
  Genomic contig location: Contig_ID=SeqID_2678; Location=3540..4305; Strand=+
  SCN-specific regions: Sequence locations=1-69,91-326,348-766
atgggacaaaggaacggacaaaatgtgaatggtacgaaatggagaaatgcatatgagaaattggatggaaaaggggcaaaaattaggaatgatcaattttgaatgaattgatgaatcgggactcgccccgatcttctccaagaacatccctcattctttttgcttcgattgagtcccgtcccgttcatttgtgcaataggcggggattgacccgccttctcgtcgccaatgaaaaaattggcgacaacttagttaaaataaacaaatcaaaaacctaacgctttatcaatatataaaaaaacaataaataaatgttaacaaaaaacaacaattttcaagggttcatttgataatggtgggaaatacctcgaagaaattccaaaatagtgtgaaatttttctcaggtgacaatccagcgatcgcagaattgtatttgtggtcggcaattttctgttcacgtcgaagaacatcagtgaaatgccacaattttagtgaaaattcaatcactcataattttacgagtagtgatcagaaatgcaccagattttgcagggtaacagctgagaagaatgcttattcatataattatttaactgtcccataatgtttctttaaaaattttaaacattgcaattttgcgtacttttccaattttttgcaaaattaattcatgaatattttttcagaaagtgctctgaaacgcaccaaattttatttacatgttaataaggccctcttatgattgcattctgaaaataggtgctga

SEQ ID NO: 81041 - DNA, 3332 bp, Heterodera glycines
  Genomic contig location: Contig_ID=SeqID_2679; Location=49..3380; Strand=-
  SCN-specific regions: Sequence locations=1-21,43-308,330-1391,1413 -3332
atggagaggggactccaggaagcaatccaaatttttcaaggacatttcgagattggaatggcagcaacgggagcagaacccgcaggtcaccaggacttcttctacgacatactgacagcgccactgccggcggcgacgaaagagttgcagttgcgaaaccatccaacaccagctgaactgcttcaaattgcggacgagcacatcggagacttaaggacgatgcgacaggcactcgagaatgaagaagaagcaatcgcgcggtctcgattgagcgggtcattcgggaccaacaacagccatccggtgggggacgacccacctccactggaaaatcggaacatggaagaatgggagagatccttccaagtggcggccaaacaatggcaaaacgacggacaaggtgtaccgcaacacaaccgaagaccaatgggacgagtcgcaacacccgtcatgtcgaatttggacgggatttttcagcggcgtgccaaagtaccatccgtcgccagcatgagagtgacgaacccagcgcgagaatggatcaatcgaaatcgagacgagatgggggcgtttcccacagcaacagcccatcggccggcactgatgcaaccaaaaatcgaaaagcagcaggctcacgtgaacgacgactatcgggagcgtcagacatacccgattcgacggcatgctcgagacgagggagaacatgatcggaagcacgggaaggacgaaatcacgggaatgacaacattcgagactgttcgactgcaaccgccgactttttccggaaagcccgaggattggacaacattttgggcctatttcaagcgagctgtggacgacaaacccattcccgggtttgaaaaacaattgcatcttctgcgctgcttaaaggagggatcaccagcccggcgggctgtcgaagtctaccctccctccgacggcaactacccggtggtcgtgcaacttttaaaagagcgattcggcgacacggacgatttacagcgggcaattcgggcccggcttcttcatttggcaccggcaaaggacaacgtgaacagcctgacgacgatgatcgacgaatttgagcggtgcgtatgccaactcgagcagctcggagcgaacgtggacgacgactcatttggcccattgctggaggcaaaattgccggtgcgagtgctcacggaattgcggatcagagaaagcatgatgggatcgaaatggtcagtgcgcgagttcaggagagcggtggcggcgcaagtacggtgcatgcggtcagcagagtcagcattggcagcaatgaaagacccggaagtacgcactgatcacaaaacagaacgtgatcagacgggactggaagttcaagcaggtcgggaaccgtttcaaagagcatttatggtacgggacagccaaccaacccgtgcacaatccaacggaacacgaagcgaggagaggtacgggacgaacgcccgtttcgccagacgatcgatcacacatgccaacgagaacgagagctcaggcgggaattggccccgtgtcgcatcaaacggaccaattgccacaacggagatatggaactgttcactatgcctaagaagtggacatcgaccaagcaaatgccaagcctatccgacagcacaggcacggaggaagagactcattgagcagaaacgatgcttgcgctgtatgagctccaatcacttattcaaacaatgccaacgagtaaaccggtgcaacgcatgccgaaaagacgaccatcattggcttctgtgctggaagagcatatcgggtggccaatcccgatccttcactgagcacgaacgaagggcaaagaaccatgcgacgctgatcagtgggatggatcgaccaactcacttcactgcagtacgagacgagcagaacaatcgagacgagttcgatatgaatgccggggaacaacgagcttttaccactttcggaagccgactcccggcccagcaaatgatatgcagagtgatcgcagctgcagaggaaggcgaagacgagtgccaaacaactttgttgcttgacccgggaagccatgtcgacggcgcagatacggagctaattcaacaactcggaccgcaacctatcgacaagcggccgcttacagttcaagtgttcggaggaaagaagcagcggattcggtcagcaacttatcgcctacgactcaaacggaccgacggcaaatgggagagcattgaggtgtccgaagtacctcagatctgtacgccaatcaaaacagaactcatcgagtcgggagcaacacccgatagcgaaccgcgaaccgtcacacagacaacgcaacctcaaataatgatcggcattcgaaagttctgggattacgtgatcggatttcggaaaattgagagtggcgcgcatgtgatcgacaccgtgtttggacaagttttgtgcggcgaaggcacacaagcgagcagcggggtaactcccgcggcatcaatcctaacaaccatgccatgcggaaatatccaccaaactcgaacaaataaacgacaacaaatcggagaagtacgtcgaaattggaagcgaaaacgaaagagtcggaaaaacaattcgcgagggattgttagccgagaccgccacaactcacctgcagagtttggtcccgatcggtcgggtgcgaacgaagttattacgtctcgagaggagccaattggggaaatggaccctaaacagcgaaagtggcccatcggacggatagtcgagacaaaaggagcgagcgaacataacagaaatgccatgatcagaatagccaacggacgaactcggagacgaccgatcaagaaaatttggccgctgaaagaagcgcggccaaaaacgggcgaaacggacgaccgagctgacgaagcagtacatgaacgacacgaagaagaaacgcgagcagccaagactcagagcgaaacgagggatcggaacaaaccctcggcaacaaggagggaggagagaaacgaaaccaagaggaacggaaaaagtgccgaaaagcgaggacgagaagttgaagatgtacagcctgacaaaaaggcaaatcgacaaattcgggacgacaattctcgagggaatggccctcactattcggacgagaaatatggcagcgcaacgacgacggagaaatcggcagttttcgaaaaagcggcagaagtgccttcggcggcacaatcaaaagcgggaaattcggcacgcccgcattcggctcagagacatgagaaaaaatatctgggagatagttcgatggccccaagtctcctcaatgttcctaccaagtttcagccgaattcgacgatatctgaaggaggagatag

SEQ ID NO: 81042 - DNA, 1710 bp, Heterodera glycines
  Genomic contig location: Contig_ID=SeqID_16630; Location=192..1901; Strand=+
  SCN-specific regions: Sequence locations=1-32,54-64,87-207,384-1710
  Gene Ontology: Mol. function=calcium-transporting ATPase activity; Cellular component=integral to plasma membrane; Biological process =hearing
ctcatccttttggcagcagctgtcatttcccttgtgctttccttttacaaaccgccgaatcgagaagaaatcaacgcaatttcatcttcgcacctcgcaacgacaacgccgaacagtgccgaggacgaacaaagcagcggaataacagaacaacacgcgggatggatcgaaggggcggccattctaatcgcagtcagtgggaaggacggcggagggggggggggacccggaaaggaatggaaaggcggaggaggggggaacgcggaagggcgcgggagagggcggaggggggggggggaccggaaaggaatggaaaggcggaaaggatggagggcgggggggggggaatttgtcatgacgggaagaggacgggaagagggaggcgacacgaagcggacggacataggctgatgaatggccaattcggcactttcgcatccgcccaatggccacggatactcattagagtaaataccgctgacttactcttttaggttattgtcgtcgttttggtcactgcgcttaatgactggagcaaagtaaggaacagaacattaattaaaaatgctttaggctttcttcccaatgctttcgttgttcaggagaagcagttccgcggtttgcagtccaaaatcgaaacggaacataaattctccgtaattcgcgacggaagggcgatggacattgtgatcagtgaggtagggaaggaaggacacagcagcgaaacgcattgtttgtctgttattcattttgttttcgattgtcgttggcgacatcgcccgggtgaaatacggcgaccttttgcccaccgatggcattttgctccaaagcaacgacctcaaaatcgacgagtccacgctgacgggcgagtcggatcacatccgaaaacaccccgagacggatccgatccttttgtccggtctgcggcgccctcccgcctttttgtcttacagtcaatttaggcactcatgcgatggaaggcagcggaaggatggtggtcacggcggtgggcatgcactcgcaaacgggcattataatgttggagatgggccatgggtttgcacttcaattcggtcttcaggagtctgttgggagtgactaaaagtggcacgacggaagcccaaacgagcaattcgagcggacagaacacgcaaaattcagtgtccagtgtcacgaaaagtgccaaccgaaacggacaacgtacggcaggcactttctttgcaatgccaacccctgactttcagctttgaacggcaatttgttgaagtgcgtcgccaatggccaaatgacttccgccgctttgtccgccgatgtgccgccgccaaacggcggggcgacgacggcacacgcggcggtggaggacaatttgaagagcaaatcggtgctgcagggaaaggcgagtcaccgcgccgcgctcccttcccccaccccccccccccgcccatcgtttagctgtccaatttggccgttcaaattggttacattcggttcggtggttgctgctgccaccgttttggtgctaattgtcaaattttcgcttcataaatacggcgagtgatttgttcacttttttaccgattcgcttctttttcagtgtggggccccgaggaaaaaaaacatttcgaggccaaagacattgccaacttcgtcgatttcatcatcatcggcgtcactgtgctggtgatcgccgtccccgagggattgcccttg

SEQ ID NO: 81043 - DNA, 1968 bp, Heterodera glycines
  Genomic contig location: Contig_ID=SeqID_16632; Location=146..2113; Strand=-
  SCN-specific regions: Sequence locations=1-121,192-201,365-366,477 -490,512-916,938-960,982-1568,1590-1968
atggatgaagagatattactattaaataatgccaaacaattagaagaagaagaaattcagcaacaatatgttgcccaattgaatgaaagaattgaacaattcagagcaacaaaacgaaaacttaaaatgtaaaatataaaaaatttattaaaaattatttaacttttaaaattctgtataaaaattaataacttatatgttaatagaacataatatttaattaaaataaaagaataattaattaataaaaaaaataatatttaattaaatattcgtataaaaatgcgaatattttcattaaatataataaagtaaaaaatttcgtaaaaaaaataaaataaaattatttaaaatgtagaataaatgtattaaaattatttaactttttaaaaatccaaaattttgtataaaaattaccaaatttatagcattttttttattactatataaataaatattaattaaaaaaattatttccaaatttaagtgaaatcaatcaactgatcaacaaggcggaaagcaacgagcccttcacatttgccgtttacattcacatcaaaatgaacgaacggcacaacccgcgggcgttgcacgagctgttgatcaattgggagaggacaaaacggtgcgaatggaactgtgatcagttgcgcctttgggtgagaaatcattcgacaaatgaggacaaaggcatcacaagtgagtgggaggaaaagcctaaaataggggatttggcattaatagggatacgatttttagggttttctagtgctcgacattttgaaaaaaacctcaaaactggacctggacctggattccatgttagatcaggatttccttgacaaaaacccaggaaaatcaaggtccatgaaagatccaggcactcgaggcctggatcccagcctggacgtggattttttgaaatttcttttaataaagcaaaccaatgtttgaaaatatcaatgaattgattgactgatttggcttaattttgttgctttttggataaaattttacgcttttacacccctaaattagaattttttggcacttattttccatttttagcacctatttttgggttttagaacctaaaaatcgtatcccttattcatcaaattgaagtcgaattaaaaaaaaaattatgggtttaaatggcattaaatttattcaaataaatggcatcaatcctcttcacccttcatatgaaaatcttagcaagcaaaaatagtaaaagaaacttcaaattctcattttgtctcgattcgttttattattccaacttgttttttttgaaaaaactacaaatcgagttcaaatcgatgaaaaaaattaatctgtttttaacttacaaattaacgtactaattaaaaaaaaaagtttatttgttgtcatccaaaatcacgaaaactgacataaaaactattcttaatcaaaaaacatcttaaattttagtgctttgactcgattataagtttttcaactaaaaaaacgaattgaaaactaagaatagttggccgagaacgagttgattgccttacaattagtatcaaatacagtagtccattaaagttgttcaaaaattaatttcgccggcgtttctaattagcatcatcgtgttatttattattttgccgacattgtaccgtaggaaaatatttgtaatattttcgagtgcgcgaaactcgacaaaacccacaaatttttcttgacaaaaaatttcgccattttcaagacttattcaatgaagtgcatccgctgcacattcatgccaaattgaatcacacaaatgaacagttggcccgtgacgtcaagcatttgctgatggtcgacgcggcatttgaccgcgaggcgcgcgacgaatgccaaaaaatggcatttgaagtgccgttgcgcaattgggcggcaattgcgcagcaaatggacgacgacgagatcaaagcatatgtggtccaaccattgaactcg

SEQ ID NO: 81044 - DNA, 1501 bp, Heterodera glycines
  Genomic contig location: Contig_ID=SeqID_16633; Location=220..1720; Strand=+
  SCN-specific regions: Sequence locations=1-205,262-276,319-694,716 -784,806-819,841-1211,1233-1344,1366-1501
atggaacaattggccgccttttgggctcagtcgctgaacagtcaatcaatggaagttgggcgaaatcaattcattttattccgccgtctgatagatttatggatgtttttttccaaatacgaaacccgcctttttcaagactgatcagcagcgaaacggatttggcgccatatcaaaacaatccgaataatgcaagaaatagaggaataataaaaattataagcgaaattaaataattattagtaaaattaaataaaaattcatcaaaaacgggttcattaaacaataccaaaataactgaaaaaattatttatagacaaaattgacgagaacaagatgcgatttgatgggaaaagaatgtgagccgactcgcgaactcttacggaagattcggaaaatttcgaagtgctgctccccgtctaatgctgctggcccatgcatttgtaaacttccgaaacccgatccggtaattcatcttttttgtactttattaatgatacaaattatatttctaattgcacttgtagagtgaattcgcggcacccccgcatcattataattggaatgaatctccttcgctcaaatacggtaacagccaatcggaggacccattggattggacgggcgatgttttatatacggaagagcaggcgcaacgtttgcatgacagatacaaaagcggtacttaccgtatcattaaaacaaaaaataccactttaattggctaattaactatttacgtcttttaaattaagcatgcgcacagtgttacccaccagaaaagaagaaatggagaaggaaaagacaggcccagccaaatttgagcaaatggaccaaatttccaattgctattcgtttcaacagaacatgtatgtatatcaaaaagaaaaatttacagaattagtttactaattttcagtgggcgagccgactccacctcaatttattgacgctgtcgaacaagggataaaattcatcatgttggtgaattttgcatgttaaagttaagtgataaaagtggcttctaagggacaagacttgcctaaaatttaccacggatctgagccatgggccggaggaaggcatcgaaattaacaacgaaactggtaactactgtggtctttcttggattggacgacgcacttgggaaaaatggcaaataatttccatttcatgtaccgatgttagtttgagttttttttcttgcttgtattttttaaatttattcattccagccaggaactgtttgccatgagtttttacatgcgattggcctcaatcatgagcaacagcgggatgatgcgcgtaaatacagcaaactgaatccagaagaacggaatgtagttttaaaaattattaatttatggacatataataattaaagcaatggaatgaggcatatgataaaacggataattatgaccttccctacgattttttctccataatgcattatcctgctacgaaaaaaaatgggttggtaaattttggttaatttgaa

SEQ ID NO: 81045 - DNA, 790 bp, Heterodera glycines
  Genomic contig location: Contig_ID=SeqID_16634; Location=1491..2280; Strand=+
  SCN-specific regions: Sequence locations=1-15,38-130,152-701,725-790
atgaaattgtgccaaatattcattttaattatatttttgatcgtcctaattaatattaattatgttggatcagaaaagaaaaaattgcgacaaaaaacatttgatgaaatatttggagaaaaatgggaagaaaaagaagaaaatcaacgaaatgaactcaaaaaacgagaaataattagaacattcaacaaaataaaagagaaaataaagcaaaaagggagaaaatattcaacaaaagaatgggctaaaattaactcaaaaatagcgaagaaattggggacaaatcgccaatatatttataaatggatcaaagaatttggtcttcaaaaaaagaaatgctacaaattaagaactgatgaagaaaaaactgaaattgtgcaaaaatttattgaaatgaaaaatagatataagcaaaaaagaaagttttcagaaaaagaatggaaacaaaattatgccgaaatttgtaagaaaattggagttggctatggcacaattaaaaaatggaagaaacaatttggaattcactgtataataacggagaaagaaaaaaatggaaaaaatgaatatttattggcaaacaaaaatagaaaatccgaaaatgagtgagaaagaaattgcaaagatgttgaaaattgatagaaatagtataagtaattggaagaaacaagttgagatggaataatggacgattattaattcggaaaaatttaaaaaaattttaataggcctatttccgataaagttactcacattttacaatttatatatgtcgatttgttagaaggttata

SEQ ID NO: 81046 - DNA, 980 bp, Heterodera glycines
  Genomic contig location: Contig_ID=SeqID_16636; Location=69..1048; Strand=+
  SCN-specific regions: Sequence locations=1-114,136-188,211-236,258 -446,468-980
gaagagcataaagaatttgcaaatgttacgaaaacttatttcgcttctcttcatgcatttgttcttttgacggacctaaattatgaagagttcgcccttaaattacatttccaaattcaaaacagccaagaaaagtttgctgaatattacacgtaaggcattgtttttgtgcccttttcaatggctttctcagaaacctaaaatcaaaatgtgacaattggaccatcgacaaatggcaaaataaaatggagagaattggcgaaaaaattgtggataaaagtagcaaagaaaaatgcagagaattcgctgtcaaattggacgaacaacggaatcggagccaaaacgaacagtcggaaaacatcgaaccgcccaaacaaagtttgttcacaaagagacgaattggtattaaaacgggacaaattttaatacggattgtaagagttggaaacagatttaacgatgactttttcagcgtcctttcatcgcacctcgtttaaacgatcggtaaaaacttccaaaatatttgctgatcagcgaatcctccgaaatcgcctcatcagcccactcgacgcccaattccgtgctgaactgttccaatttctggactcgcttttcctgcccaatttgttgccctttcccaataaattcgttgctggcccaggcgacttggcccttttggacccttctctgtccgtcgaattcgaccgttgtttttctgattgtgaacaatccgatgagattaaacaattggacattgtcaatgtctatcagttgctcgtctcccatgattccctttattacacttttcctctttcgactctccaagaagccttttgtctattggctaaaccaattgagggtttggagaaagaagcacgctttttgtctgcaattgctcaggcaattagagtttttaatctgcccaacaaatgccattttcagttggaacacatcggagttgtcaaatcgctgcccaatga

SEQ ID NO: 81047 - DNA, 391 bp, Heterodera glycines
  Genomic contig location: Contig_ID=SeqID_16638; Location=208..598; Strand=-
  SCN-specific regions: Sequence locations=1-391
atggccaaattgaactgccccattttaacagttgatagtgctgaaatggcttttctgctgaaccagcactgtccgtttcagtcccgtgccttttcaccgccgggaacggcgctcaaatgggcaacacaaattttgattgtggtggacaatgattattccgttaatgatgtacgcagcggcgccaccaacataaatgatgtgcacagcgagcgcatcgccaaaacacgacaacattaaatccaataattatttgggcggtgcgggggagggcaatgcgtgtaaaaattgggccaactttagacaattttaaatcggaaattgtttttaattagttaaatcaaaaaaatggaatttatttttgacaatgcatttaaaagggaagtaaaataaa

SEQ ID NO: 81048 - DNA, 1023 bp, Heterodera glycines
  Genomic contig location: Contig_ID=SeqID_16638; Location=2393..3415; Strand=+
  SCN-specific regions: Sequence locations=1-276,298-365,418-422,444 -517,566-641,694-829,852-1023
atgttaaaatttcaaaggtctgcatcaaaaaatacgaccaccgattccccgacaatttcacgtcgatcattgcccgaccgacggagttcatttgtgtcaagtcaggtaatgaaataataatgaattgcctaattaaaatactaattaattttgttttcccaataagcttggccacagccgtgccgttgttgtgattcggaaaatcagtgtcccattggcatggcctgtcgaagaatatttcagtgccagaagaggtgattgaaaataattgaatttaaatgtttaaacatgtttttatccttttaaaatccaaataaactcaaaatatgaaaaaaattgtaagaaaaattccataaacattttttaaaataaaaattaaatttaaaaataaaataaaaattaaatttaaaaataaaattatgaatttttagattggagagaattctccttgcaattggcattccgcacttcaaatggaaaggaatatttctcaaaatcaattgagaaaattaacccgtaattttaatttattaattttcaaataaatatttcttttttaaatttagcacttttactgacgtcaattttcccgatgaatttgttttcccaaaccaaggccatgactttgtcattgaagtgagttttaaattaaaaaaatataaatttatttaaataatttaaattaatttatttgcagttaaccgtttactgcaaaaggaccgacaaatcgaggccaaactcatcgctggtacacactttttcgcgctcacttggccgttcgcttggacagtcgtggaaaaagtattttatccgtatttccgaaaataaatccccagggggctttatttttcaacaaccctcagaaggatggttttatttcagcaggggtttagaggggggcattaatttaggggcgggaatgtgtttatttttcaaaccccctaaaaaggggggggggctctaatttagggtggtaaggcaataatttaggggatctatttttcaattcagaaatactgtata

SEQ ID NO: 81049 - DNA, 165 bp, Heterodera glycines
  Genomic contig location: Contig_ID=SeqID_16639; Location=540..704; Strand=-
  SCN-specific regions: Sequence locations=1-165
atggcttcggttactgatcgttttctgatgaattggaaggggattccgctgggttttggcctcgtcacttcgacaacatttcatatttttaacaatcggtggcttcgaaatcgtttcaatgccaacgcctttgaatcaaaagaaacaaaaattgcagaacaaatg

SEQ ID NO: 81050 - DNA, 1672 bp, Heterodera glycines
  Genomic contig location: Contig_ID=SeqID_16640; Location=97..1768; Strand=-
  SCN-specific regions: Sequence locations=1-807,829-1419,1441-1672
atgcccaccatcccattctctacgccaattcagtctttcttggactcaaattcgccgttcgatgaaattaccgtcgctggtcattaaaaagttcataaattgttacgttttggtatgttttttcagttccgtctgatcttcgaaagagcagttcagttgtggacccgttccgacgtaaagtgccgagtaatttgttctgcgctttcccttccgacccttttttgatgacttcccgtgccgtgtcatatttcgcggagaagtaaaaattacaaataaataattgcttaatgcaaagtttaaagttacaaaattgtcggaggcactgtcgaacaactctgtgaacacaatgccaaagttgctgagacgatcttccggtgtttcaatttgattaaactttgaaacggtttcgcattgtcagaagtcgccttgcttacacatggcgagtgatcgcccttctctgtgctcagaacgaatttgtcacagttcggccccatttttcatccgctgtcaaatcgtcgctgaaaagtgtcgccggcagtgcggccgcgaccgatcacttccatcgcttccgacggtcgttgtcgtctaattttttgcttggaaatggtaaaataatttaggaaagggaaaagcaaaagttgatttttacagatcatcaaaagggcggctaccatcggttcagtcatcggagtcgccttatgcacggcagcggacactctctgtcagccgatggccgaacggtcgccctgccattgttggacaaagtccgctcgccccttccatcccttggctttttgcttatcccaattttctgccagggttaccccaccgtccatcggccactgctcatttccgactccctttctgctgttgctcatcaacaccatggcaaagcccctgggttcggtgcctcaaatccttttttcggtgctgatgagcttaatttgggcggtatcactgagtttggcgatcagcaattggaaaaggatgcgacgcattccatcggtcggcggtacgttttcatatcactgttaattttggatttgtgtgtttattttgtgcagttcgattgtaagctccagcattgtggatttgtcgcagctgagagaggaggcttttgcacctcgctttcacggcacatctctcaaccgaagacgcaagttggtctccgatggaacattaacagcagaaacacttcgcatgcggcacaaacaaaggagcagaaaacgacgaaaccgtacaagcgacgatgtgctgaatgaaaatgacggggaaaaggacgagggaatgaccagcaaaagttcgggggtgagcagccaaaacccccaaatttttactgtccctcttttgaatggctctttcgcctcctcattgcccccttacgactcgtcgtcggccttcgaaagtgacggaactcaaagcagcaaagaaggaaatggggaaggagatgaggcggaagatgaaagtgaaggttctttggatgaggaacaactaagtgaaagtgatcggcagcaagcgatcggactgatttgactcgaaatttgcatttgcaggcgatcggatgggacggtcctccccgaagactttgcaaaagtgcagcagcgccgcactgctcttcttcgaccccatcccttctctaaaggcactgcttgaccactgttgcgcaatggtc

SEQ ID NO: 81051 - DNA, 251 bp, Heterodera glycines
  Genomic contig location: Contig_ID=SeqID_16641; Location=320..570; Strand=-
  SCN-specific regions: Sequence locations=1-17,160-251
  Gene Ontology: Mol. function=protein binding; Cellular component =axoneme; Biological process=eye photoreceptor cell development
atggaaaggaagataaaagaaagagaaagaggagaggaggatgatgaggaggaggagggaagagagaacaaaatgatatggagggaaaaggagacgaagaaagaggaagagaaggaggaaaaagaagaggggaaagagaggaagaggagcagggaggagaaaaaagttagaggaacagaacgagacgaggaagatgaacagcaggagagaagagtctgtgagaaggcgagagaaagaaaggagtggaagaa

SEQ ID NO: 81052 - DNA, 531 bp, Heterodera glycines
  Genomic contig location: Contig_ID=SeqID_16643; Location=420..950; Strand=-
  SCN-specific regions: Sequence locations=1-203,225-273,295-295,321 -369,392-531
atgttacaaaaagttcttggatatatttcaaaagttcgtgtgacttctacttacaatttttggtctcattcacaggaagtatttgtccacgtcacaaaagattttccattggttaattgggtaaatttttcatttgttttgaattttttgaggcaagtagttttttatcatatgatgtactttctatgtttaatcccaggattaaatcatttatttaaataaaagctttctcaaaaaagaaaatttagctgaaatattgcattacaaaattcacaacagataacactgtaagcactgataaaataataacaataaattttcgaactatttttatgaatgaaaatattaattacagccataattttgacattttatttttgcagttttatttggccttcaaagatgttaatcctagctggtcactaattggatgcgcactgatttatggaatcacgccacatttagagtcattttcaattcatctgtcattgttgtaacataagaacaaagtgtgaaattaatttaaataaa

SEQ ID NO: 81053 - DNA, 200 bp, Heterodera glycines
  Genomic contig location: Contig_ID=SeqID_16643; Location=1585..1784; Strand=+
  SCN-specific regions: Sequence locations=1-68,153-200
atgctcccagcccttcgccttcgaccagataatgtaaaaattggtaaaaaaataaagctgattgtttctttttaaatttcattaaaaattacatttatttttttgaataactttatttttcgattagttttatcaaaaaaatttattatattcaggataatccttataaggatatattttgattcaattttaatcaaaaa

SEQ ID NO: 81054 - DNA, 551 bp, Heterodera glycines
  Genomic contig location: Contig_ID=SeqID_16644; Location=1220..1770; Strand=-
  SCN-specific regions: Sequence locations=1-202,226-255,285-551
atgcggaatacagggtttgcattataaattaaaaatttatccgtttgtttaggcatgtacttcagtcgtaaaggggaatgttcttgcacggttgagaagaaggtgacatcttattttaaggtgtcagtggcgaatgatacagggcttttagaaaatgtggcattttttgtgtgtgtgggaagcagaacgggatggaaacgcaacttttttaaaaattcatatacttataatttatgatgaaaagaaaagcccgtcttatttattttttgaaaaaaaaatatttacagggaaaacgaaattcaaaaagcctcaaattttgtcactttatgataaaatttttttgctgtatatgaagaaattaatctgcaaattaaaaagataaaaaaaattcgatttaatgcaactttttagcacttaaaacaaaatgctgcattttctaaatttttctttaatgttaaaagttacatgaaatcgcaaaaatccgcaacccataatccataaaccgaatccgtaattacgcccagccctgcttacaataggtaacgaataaa

SEQ ID NO: 81055 - DNA, 2605 bp, Heterodera glycines
  Genomic contig location: Contig_ID=SeqID_2680; Location=154..2758; Strand=-
  SCN-specific regions: Sequence locations=1-1284,1307-1603,1687 -2099,2132-2193,2226-2605
  Gene Ontology: Mol. function=alpha-glucosidase activity; Cellular component=lysosome; Biological process=glycogen catabolism
atgccgcagtttccctttctcattttgtcctcatttttgtttcctctgcttttttgctccgttttttctgccattgggccaaatgctcgcgtggattgtgcccccaaattcggagagggcaaatccgactgtttggccaggggctgcctttgggatggtgcttatgacaaggtaccaatgcgtagtcattgcctgatcacttttttctttcattacagtaccacggtaccgttccgctgtgctatttcccaccggggacgggttatggtttggccggcaaaacgaatgaccaccatttcaatttgatacgcttaaacaatggggtagcaaatccctacggtaaagactttgccgcgttggaattggtcaccaagcagttcgggtccgctctccatgtcagcatttatgccgaaaatcggtaggaccaaaaagaaaatctctcaaatttaaatttttaaacagatttcgaccaccacttccgtttaatttcgaagcaccaattgagtcgacatatgaacagatttttgtcaatgtttatcctaaaaaaccaacacatgaccaaatgttttattttaccgttgagcgaagcgacggacaaaaaatttgggacacatccattggtaatgcagaaactttttgaaaattctttcaattattaacgataatttaggcggacttttgttcgccgaccaattcattcaaatcgccacttatttgcctactgatttggtctatggctttggcgaaaatgcgcaccagcagttgaagcacgacttcagcaagtacaccacgtggggaatgttcacgcgggacgaagcgccgaatccgttggtggaaaatgtcgagaatttatatggtacggtgaataatttgtataaattgcaaaaagtgacaaaaaaacaaacaaaattccattgctccaggcgttcatcccttttatttggccttggaaccgagcggaaaagcgcacggagttttgattctgaactcgaacccgcaggaaataacgacgggcccagcgccgcatttggtctatcggtcagtcaattcgattgatcggtcaatcagccgcccgattgggagaacccttgctgaactgttaagtaccgtaaggcgaggattgaaaagttaagagcggtgactaattcggtagatcattttcaaacgcaatgttttggtttgggtgattcgcgggattgaagacttacgcggggctaacattttgtcaatcgctttcgttaagttataattttcagtaccatcggtggtcagttggacctgttcttcttccccggcccctcccccgaactcgtcgttcgccaataccaccaattcatcggccggccctatttgcctccatattgggcattcggctaccaattttgccgatacggctacaaagacttgaacgatttgaaggcaacaattggaagaattcaggctgcagtaatcccattggatgttgtctttgtggacatcgatcacatggagcagtacatggacttcactgttggtcaacaggtgaagaaggactgtaatgtcagctgatcagcacagagagcagattctgatcaaattgatcagttcaatgatagcaaaacaaagaaagagaaagggacacagagatagagagagaaagcgtgagagagagagaggacgacagacagagagaggggagaagagagatgaaggaagtataaagaatgtaatgttaagcaaatatctcacaatcagtaaaatttgccaatttgtgttgttctacttaatttttgagaaatggggtgctcttggcgaatacgtggacgcgttgcaccggcagggccttaaatttgtaccaatcctcgacccggcaattcaagtcgattacgaagtgttccaacgtgccatccaagcggacgtttcctttgtggaatgggaacgatttgaccaagtgccgaaagatgtgcaaaatctttacccaatggccaaagaaacaaaggcaaaatgcaaattgatgggttcttaaatgggacgaatcctttgacagattatgctcagcgtcgtttggccgggacgccacgtggcctttcccgactttttggaccccgagaacaaaacccaaaaatggtacaatattttaatgttcaaatttatgtttttgttgctttaggtggtcagaggagctgcaaaactttcacaagaaagtgataattgtttaattttattattattaaaaaaatattttaggtcccttttgatggcatttggatcgacatgaacgagccgtcgtcgtttggcacaaatgaaaagccgtcggcccaaagtcacaaccttcagccgttacaatgtccactcagcgggacggattcccagtttgataagccaacttatgaggtgaatttatctgattaaataaccaattagcacatttaagaccataaatgtgtaccaatacgggtcggttttgagtgaaaaaacgctttgcatgtcggccatgacaatgcgaggccaacaacgaatgttcaacacgcacaatttgtacggatggtctcaaatggtggccacacgaaaagcactcggtgaaattggccaaaatatttgcgaaaaagtcaaatatgaaatttag

SEQ ID NO: 81056 - DNA, 1036 bp, Heterodera glycines
  Genomic contig location: Contig_ID=SeqID_2681; Location=88..1123; Strand=+
  SCN-specific regions: Sequence locations=1-33,55-546,571-761,786-1036
atggccataccagaaacgaaggcagcagcaacaggtgactggccttcctggtggaatgggccggcaaacgtgggttagctttttctttttttttgcgtgggctgaggggggggggggggcaaatcgcaaaaaaagcgatcggtcggttcactcactcccatccgttcatttcgcccattttcaatcagtgaattttaaaagcataaattcatttcgaaaatcaacgcaaatgagtggctacaaaatccaccgctcccgttcctcgccaatggtcgcgtgggcttcgaattcgtcggtctgtgtaaatcattttttcataatccccctttattcagttatctcgcacatattccgtctccgacatttcggcctatgcgagtgccacggattactttaaacaacggtggtccaccgcgtacaatccgtaccataacagcagaaaggcctattattggcctcaccatcggcacacgtcgttgttcccagtgggtgaaatcaatcaatcaatttatacgcaaaagcgtgacaccgacataaataacaatataaataaatttggtcactgaatgagatgaggtggtttcaaaagtaaagaatcaacatcataggtgtcaagaagtttagcaaagtcaatggaattaagtaacctcgcctctttaggcaaacacctatagaggcgagaggtacgaataaaaaacgaatgataccgaacattggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttgaagaagttcgttatacccgggtatatcatccttattattattacgtctaaaaacaatacgtaaaaatgttttttgaacattttcaagagcatcaatgtcttttttcatgtatggattaaaaatcggagaaccaaattccaaaatggatcgaca

SEQ ID NO: 81057 - DNA, 2905 bp, Heterodera glycines
  misc_feature (37)..(37): n is a, c, g, or t
  Genomic contig location: Contig_ID=SeqID_2681; Location=1..2905; Strand=-
  SCN-specific regions: Sequence locations=1-657,679-738,760-869,893 -968,990-1106,1128-1366,1388-1522,1544-1640,1683-2033,2058-2248,2273 -2764,2786-2905
gaacccaccagggaatgcaattttttggatttaattntaacaaataataaatttctcataaaagacatttcagttggtcccccattctcacttagtgatcacaacactgtaaaattcgacttaagactaaatgtttttccttgtagaaaatttaaacactttaactttaaaaaagctagttacttggaaataaatgccatactctcttctactgattgggttacctttttttcggactgtatagaaattgaccaaatttataacaaattcgcagcatttttgcattttttaatatcgaaatatgttccattaacagtatcaaattcaaaacataatttcccagaccatattaaaaaaattatgctttatcgtcgacaactttggaaagaccttaaaaaagaaaaaactagagaaaaatttatagaaacctctaaaaaacttgaatatgaaataaagaaataccttacaaatcgtgaaaataaatttttaagtggtttagaccctaaacaacgatttcgatatattggttcttttttaaaaactaaaaacacaaaaattccccctcttaaaaatagcgaaaacaaaattgccttttccgaaaaagctaaatccaatttattagccgaacaattttactcggtcttcactgaccaaaaaattcctgtttcatgtgaagtcacccctaaaaaaaatattgactttttcacaatgacacttaatgaaatttatttggctcttaataaactagaaaacaataataatacttccattgacagcatcccgaatatttttctcaaaaattgtaaagaaaatttggtttatccgctatttcatattttttgtttttcaatgatgactggccaagtcccaaacatttggaaaaaatcaattatttatccagtaccgaaaatacccaatccaataaatcctgttgattttcggccaatttcacttttatgctcaatttcaaaaattctagaagaaaatattacccagaaaatcactaattttgttgagacaaataatgtacttccgaattgccaacatggctttaggagaaaacactctgttacaactcaacttttggaagtcattgatgactttagtttagctttggaaaacaaaaaatcaattgatgttatatattttgatctagcaaaggcatttgatactgttccacacgaaagattagtttctaaactcaaaaatgttggtataaatggtactttgcttaaatggcttcaaaattatttacaaaatcgtacattttttgttcgagttggttctgcgttttctgatgaattcccttgcttaagtggtgttcctcagggatcaaatttgggaccacttttgtttttaatttatatttcagatcttcctaatttttgtaaaactgaaaacgttgaaattaagctttttgccgacgatcttaaggcctattctatactatcaaaaaatactatttctccactccattctttcattaataaatttcggaattattgtgaattaaatggccttaaaatcgctcctaataaatgcttagtttcacatcttgggcctaaaaaccctaatgaatgttacttaataaataatattccaattttaaaaaatgaagaaggtgaaccagttagagaccttggcatttatttttcaaataacttaaaatgggaaaaacatatagaatttattactaaaaaagcaataagaacatcttttgctttactcaagtcacttaaaactaaaagcccaaaaattctcataaatatattcaatgtttattgtcgatccattttggaatttggttctccgatttttaatccatacatgaaaaaagacattgatgctcttgaaaatgttcaaaaaacatttttacgtattgtttttagacgtaataataataaggatgatatacccgggtataacgaacttcttcaactctttaaacaagaatccctcttaaaacgcagaataaaaatagatttaaaactcttccatgatataattttggaaaagatccatattcagcataatgattccttttcaaaaacatattcagaactgaaaaatgattttattattaaaaccgcttattgttcaaccaatgttcggtatcattcgttttttattcgtacctctcgcctctataggtgtttgcctaaagaggcgaggttacttaattccattgactttgctaaacttcttgacacctatgatgttgattctttacttttgaaaccacctcatctcattcagtgaccaaatttatttatattgttatttatgtcggtgtcacgcttttgcgtataaattgattgattgatttcacccactgggaacaacgacgtgtgccgatggtgaggccaataataggcctttctgctgttatggtacggattgtacgcggtggaccaccgttgtttaaagtaatccgtggcactcgcataggccgaaatgtcggagacggaatatgtgcgagataactgaataaagggggattatgaaaaaatgatttacacagaccgacgaattcgaagcccacgcgaccattggcgaggaacgggagcggtggattttgtagccactcatttgcgttgattttcgaaatgaatttatgcttttaaaattcactgattgaaaatgggcgaaatgaacggatgggagtgagtgaaccgaccgatcgctttttttgcgatttgcccccccccccccctcagcccacgcaaaaaaaaagaaaaagctaacccacgtttgccggcccattccaccaggaaggccagtcacctgttgctgctgccttcgtttctggtatggccatttccatcaacacatgttggccaattaaaggaagtgttgtcctccaatttgagaaagttcaatctttggaattccttctgacggaagc

SEQ ID NO: 81058 - DNA, 778 bp, Heterodera glycines
  Genomic contig location: Contig_ID=SeqID_2681; Location=3338..4115; Strand=-
  SCN-specific regions: Sequence locations=1-23,45-676,698-778
atgagcaactgtaaggaaaattgaaaaaaatatataaaattaatcacaaatttctttagaaaattacctttagattttattttggcattttatgcacgaatttcaagaaaactaatttttaagcattgtcagcttcggatttgccaccaaagcccagcaaataccaatgccattggatggaacgattaagcgatgccgtggcacttgtgcagaaagaacgaaaacggagcctcgttttgatcggacttccggaggctgtggccgaaaagccatcagaacgcgccaaagaggacgcggaaacagttgcggaagtgttggacgctttggatgtggaggtttgcccacagatggtgtatagaatggggcggcggattgatgataagcgaaaggggccgcgtttggtcaaagttgtcttgccagcgacgacgttccaacgttttgcactggcacaatgggggcgcaaccggacggaactgaaacagcgtgtcggttggcagcgactgctcgtcaggccctccttgacgaaggaagaattggcggctgaacgggagacacgtgaacaaaggcggatgaattatgaagaaagcaaaaagaacgaaatggtgacgacgcggcgtggaggcacaatggaaaaaaacttttgaggtcacaaaactttctcaattgtttttactttaactcaagaagtttagtaaacaaaatggatgagtttaggcttttacttttagaaaataggtataaaattatcgcaataaccgaaagctggttgaacaataaa

SEQ ID NO: 81059 - DNA, 2003 bp, Heterodera glycines
  misc_feature (1996)..(1996): n is a, c, g, or t
  Genomic contig location: Contig_ID=SeqID_16645; Location=984..2986; Strand=+
  SCN-specific regions: Sequence locations=1-309,331-749,771-1167,1191 -1374,1396-1564,1587-2003
atggaaaaagttttgataagcaacccgctcgagctttcaagcgttcataactgtgcatgcgatttaaccccaaaagacctctttaggtctgttggtcccggcacgaatggtcagcgtgggaagggtgtcggtgaacatcggtgccccacaagtgactgtgctggtaaagacccccctcagcgggggttgcaaaaagggaacttaagctgtaaacgttggactcctagtgaagagaaggcagtctttgaagaatggtcgcggttggaggcacaaaccaggctcgatggtagtgcggcccggggtagctgcgccataaataaaagacagtttctcgttcactgggatggcgtgaaagagtcacggtcctcggcagaaggtgtgcctacttaccccgaaaggagtgagagggcatatttcgagaggatcagactcttgcgaaagaagcgcggatgggaatgggattgtgctaatgaccgaatagtcacaggccaacccgaagtaccaggccgcggatcgcgaacgcgagtgatagccgcgaaggctgatttgagtgtaaggagaaagctggtgaaggggaaatgcataaccccgccccaccgagatggtacggaagaccaggagagtgacgacgaggaggttgcaataaccgtacctgtcgacattatccaggtggaagaacccgagtgtacaggtgtaaccgagggccaaataccaggtgaccctacggggaacccggaaaaagaagccgcgggggagccagcacagaggagcgtaccaattagtgggataatcagcgatggtgaacggaagtacctgaaggtacgattttggagtgcctataaaaaggcccaggggtcagtgggaaacagacccgctctaaagatcgaaccgagtaaggtcaaccgtgcccagtgggaagtactggactcctgtgttgctgcggtactcaagaggagggaaacctccaaagggtgccggggttgtatcctccggacattgaacgtcgctgtatatgcggcgggacaagtgctggcggaaggcgaccgggaacgaaggcaagcgatcagacgtcagtcgatggaatggttgcttcgccaaaagtccgagatcagcaacatccgtagacacattggttggattactgatgagttaaaacggaggaggacaggaaagaacccaactttaaggcagttaaggaattttcagtggctccaaaggcgttaccaagtcttagggaaacccgtgagggagactagggacttggaaacccaacgggagaaacttgttgttcgtcttcatatggccctagacagagtgtcggtaactacgcgacgtagcgaacgaactcaacaacgattgttgcctatgcggagaaaactggaggaaccaatgggtgactcaaagttggatcctgcacaggcgcgagagttctgggctggtctaattggaaagcggaaggaattcgagagaattccagagcttgaagattgggcagaagaaacgaagagcaaggtcccaagtgatcaaactttggacgaagaccgaaaagacctatttgcctggaagaaaatactgggaaaagccagaccattgaaagcgccaggaccggatggtgtgcctaacttgctttggaaaaggctaccgtccgcaaaccaagcactttttaagtggttaatgggaattaagcgtaagcaattacgcgttcccaactggttcaccaggggaagggtggtactccttccgaaagggggagatccgatggacccggccaattaccgacccatagcgtgtttaaatacacaatataagctagtaactgggatggtaacggcatggatatcggaccacttgaccaagcactcaattttgccttcggaacagcgagctctggtggctggcacttggggttgtacccatgctatggtgatagacagagtaataacgtcgtatgcgaaggcatccgggatcccgctttatgtaggattcgtggactttngcaaagc

SEQ ID NO: 81060 - DNA, 573 bp, Heterodera glycines
  Genomic contig location: Contig_ID=SeqID_16646; Location=153..725; Strand=-
  SCN-specific regions: Sequence locations=1-153,185-284,315-345,391 -444,467-573
atgcgcggggcgcatgggtcggaactctttcgagcagcacacggtggctgggttactgtatcgtcgtcattatggttgttgaaggtgttcagttgggcaccaattcgtgaacaaatgccatctatttgcaacaattatatataatacaaagatatttttaattttgaacattttttgaataagtttgagaggtgaaaatttgtgaaaaaaaatttaattttcgaaagggcttgaaataattcccaaataaattaatccccattttcagaattatcttaaaagccaaaaatttatttttaatagttaattaatttgcatatttccgttatttgttaaaatgttgagattaattattattaaaataaaattttatttttattttttaatttacagacagattgtaaagagaacaaaacaatacaaaaccgacttggacagccaaagttgtactgctgctggtgctggtattggttgttgttgcctcttgacacaaatacgggctgaattggcaaaccgttgggcgggaattgcaacggggccggctgacgatgatgacctatttaaaaaattaaa

SEQ ID NO: 81061 - DNA, 832 bp, Heterodera glycines
  Genomic contig location: Contig_ID=SeqID_16646; Location=1042..1873; Strand=+
  SCN-specific regions: Sequence locations=1-129,167-229,251-284,307 -346,370-491,513-832
atgaaacgacggtcatgcaaaagtggtgttgatgaccaatgtgttgggccaccaattgaatcgcgtccatgtaatgatgaacaatgccctaccgtaagtgaacttctttgactgtgattacagtatgccataaaaaaaataaatcaattatacaataaattttatagctacaatatgtcatatgcattttcatttcaatttgtttatacataactaactaacaatgcattgtgatactgtatgcttttgtgtttatacgctctggttctttacagtacgcttaataattatattgtaatcaaaaatatggcaaaataatcactcaaaaaataccattggtttagagtttttctttaaaataaaaataattgagcaaataattaagtggtcaaattggggctcgtggactgagtgttcagcgacttgtggcactggcacacaacgaagtgaaattttatttagaatttggtcgagactctcgaacattgaagttcattaattaataaattaatgaaggagtgcgtgagtgcgagtctcctcggcacaatgccaatgctgcaatttgtccaattggctctggtgttgaacatcgtgaatgcgaattacgaagctgtcccgagtggtcccaatgggaaccatggtcggcatgttcaaagagttgcggtgccggtgaatcggtacaacatttattggacgattctgccttgctactcttaaacggcccaataagcttgacccgtcaaagcgtcgaaggctaaattttgaaaaaaaatttttgcaggatcgatcatttttaataggctaaattctcaaacattcaaagaaatataaa

SEQ ID NO: 81062 - DNA, 786 bp, Heterodera glycines
  Genomic contig location: Contig_ID=SeqID_16646; Location=2050..2835; Strand=+
  SCN-specific regions: Sequence locations=1-348,393-745,782-786
  Gene Ontology: Mol. function=ATP binding; Cellular component=integral to membrane; Biological process=regulation of protein activity, epigenetic
atgacggggggggggaatgaagttgcacccagttataatcaattatgtcacaaggttcgtcgtcgacagtgccgtaatgctgcgtcgaaggatgagtgccaaggcggcgacgtggagcgcttgctgtgcaacactcaattatgtccggcatggaccacatggacagagtggtcagcgtgctcaaacagttgtggcaccggtggcacacagtcgcgcaaacggtgggcacaaatgcctgttctgctgggggctcgaaaattttcaagaaacccggaattcaaatttcctgttaattaagataataatgtgaatttgtctcctccccccccttccgtcacccatttttcgaaaaattatttttattttatgtttttaagacaaaaaaaaaaattcttgaaaaatttgggtgtcgcaagaaagaatttctgatcaaaaaaattttccagagaatgtcgttatgctggagagttaagcaacgagtgcacaggcgcggccaaagatgaaaagcaatgcaaacagttggaagcatgtccaagctgggccgaatggggcgaatggtgtgcctatgacgtcactcaaaaaccacaaaaaaaaacaaatttgcctttgcttaaaagcaatcaaaattttaattctcgatatcattcaatagctctaagggttttctatagtcttgcaaaatttcattaagttttaaaaaagttatggcatgaaaacccatgtttatgtgtcctttgggttatacttttttttttttaatttttcgaaattttaaaatttagctga

SEQ ID NO: 81063 - DNA, 983 bp, Heterodera glycines
  Genomic contig location: Contig_ID=SeqID_16651; Location=226..1208; Strand=-
  SCN-specific regions: Sequence locations=1-33,55-153,176-411,433 -532,554-623,647-983
atgttggcacaacaaacacagaaaaggcatcatcagcagcaggtgcaacagcaaaagcaaggtgggaccaacaaacggtgattaattgatcaatacaaactgatcgaggaatcgatcaacgaacggtcgtggggcatttgggattcaattcttagtgctttcgcgcttgaggggttcggcggtgccaatgggcgcgattcattaaacatgatcattttgcctaattttatatgtgccaattttagcaattgtccccgacttttttgccacttcttcaggcggagacacaaaaacaaatatttcaatcttcatgaacaaaggagaaagaaaaaaacaaaaatatgcttggagagcccttgaagagctgcaccggatgcgagtgtcgccgttgctgtacgctcaacggttgctgtgcaaagacggaaaattgctaatcagaaaaaacgaaataaaatcaggaatactcactcccgtagacaaaccgttggatatatggggacaaacgtatattggataccgtacccaattaatatttatttttgggatgcgaattgttttgtgcgaaacagttatgaaaaagggtacgaaaaactgggaaaaccccactcagagactagctaaaggaaaataccagcagcaaattaaattacccaaccaattttgattgaattcatttttaaaaatgccaattttttgtgggtcttcgcccttattaattgtttctaatgcgtcaatcaattatttaccaattgctagggcttataattctctttttcttgcacaagaaacagcataaaatgcacaaaaaatctagaactcatttaatatgtatttgtccatatattggcatttttgagcatatttatttatgtaaattctattaaagggctatttttattaaaaccgcccttctgacccatgaggacggaaagattttcataaaaaatctgttttaggaaaaattttactataaaattaataaa

SEQ ID NO: 81064 - DNA, 537 bp, Heterodera glycines
  Genomic contig location: Contig_ID=SeqID_16652; Location=355..891; Strand=-
  SCN-specific regions: Sequence locations=1-65,87-203,225-537
aaacaaatttaaaaaacggtcgcgaagcgcccgcccaagcccaacaaaatttgaaaaaaaggcgtgaagcgcccgtctggccccaactaaattttaaaaactggcgcgaagcgcccgtcctgaggccgcgaagcggccgaatgttcttaataaaattaaaaacgggcgcgaagcgaccgtcttgaggccgcgaagcggccgaatgttcttaacaaaattaaaaactggcgcgaagcgcccgttatgagtccgcgaagcggccgaatgttcttaataaaattatgaaatgggcgcgaagcgctcgtcctgaggccgcgaagcggccgaatgttcttaaaaaacgggcgcgaagcgaccgtcatgaggccgcgaagcggccgaatgtccccaaaaaaattaaaaaacgggcgcgaagcgcccgtcctgaggcttaacagccggccgcgaagcggccgaatgatcccataaaattatgaaatgggcgcgaagcgctcgtcctgaggccgcgaagcggccgaatgatcccataaaattatg

SEQ ID NO: 81065 - DNA, 271 bp, Heterodera glycines
  Genomic contig location: Contig_ID=SeqID_16652; Location=1408..1678; Strand=-
  SCN-specific regions: Sequence locations=1-15,38-271
tacaaaaataaaagtgattttgggattcgggaccaaaggggggtgaccaggatttttgggtggaaaatttttttcaccaaaaatcttccaaaaacatgtcattagggctattttatgacgctgatcacgaatacgtgatcagattttacttttgacatcgtcaagacctcagaatccctgtgtgattggggattctgaggcatcattttgaggggggagggggcaggttcggatccggacggtgtaacattatttttctgtgtatttttac

SEQ ID NO: 81066 - DNA, 493 bp, Heterodera glycines
  Genomic contig location: Contig_ID=SeqID_16654; Location=1241..1733; Strand=+
  SCN-specific regions: Sequence locations=1-64,86-197,261-493
atgttgtccgaggatgatgaagacaaagtggaggatgaattggatgaagcaatatctgcacaacatcatcatcataatcagcagctaaatgcggcacaacaaaagcataacaatgggacaatgacgacggcggtggcgccaaagctgtcgcaatgccggcacgacggcacaaagctttttgttcaaaatcatcaggctaatactgttgaggacgaagatgactacgattatgatgatgatgacgacgaagattatgaggacagaataattgttgagccaatgttcaggtgctgtgttcaatgcatgaaactgatctgataggggagggggtcttcttcttggacctgttgacccgactaatgggcctcaataccaacatggcacaagggcgtaggcagggggagctgagggggctaaagcaccccccccccccgaaaaccaaaaaagtaaaaatttttttgaaattttaagcaattttcttaacataattgca

SEQ ID NO: 81067 - DNA, 3781 bp, Heterodera glycines
  Genomic contig location: Contig_ID=SeqID_16660; Location=1368..5148; Strand=+
  SCN-specific regions: Sequence locations=1-51,74-141,167-186,208 -222,244-416,467-507,533-610,638-728,752-1051,1095-1121,1155 -1161,1339-1363,1390-1390,1684-1718,1740-1976,2005-2149,2212 -2346,2504-3104,3297-3329,3351-3357,...
  SCN-specific regions: Sequence locations=...3379-3424,3486-3530,3552 -3583,3612-3661,3683-3739,3771-3781
  Gene Ontology: Mol. function=betaine/GABA:sodium symporter activity; Cellular component=integral to membrane; Biological process=transport
tttaaaaataatttcggcggcaatttttggtattttgccctaaattaattcaattttttcttctcttaggttccaaaggccaagaaacggctcagtgtccattcaattttggtcgaacgcgacgaatggtcatcctgggccgacttcatcatgtcctgtgttggatatgtacgttgaaaaatttgggaaaaattcatttaaaaatttgtggtaattagggctgaaaatttaaaataaatgttttacccatatttttttctggatttaaaaaaatattttcaacttttaattactattttacaaatggcatttagcatttgtttaacccatatttcgcaatttttcaggctatttaagcgaataaaacaaaaaaaaaaccaaattttttttttcgaaaattgactcctaagaaatggatttttttttaaaaataattaataaaataatttttttttacatattttatgtacattttgccattttcttacatacaattcaaagccctagtaaaaaatttaataattttttttatgaaggcaattggacttggcaatgtgtggcgttttccgtacctttgctaccaaaacggaggcggcgcatttttggtgggtttttaaaaaaataaaaaatttttaatcaaacgcctccttcattctctaaaaatttctatggcacttaaattttcgaaaatttttccagattttttttaaatgaattttaatttggcatccttttcaaaatttttaattttccaagggccctaattgtttttttttacaaattttccgaggccttcccgcaaatttttccaatttttccaaattttccgattccctacatcattgccattttgttctgcggtgttccgctgttcattctggaaacttcttggggacagctcgtctccgtcggcggattgggaatgtcctggaaaattttccagttttttttggtttttataaaaattttcaggttcaaaatttgcccaattttcaagggggttggcattgcggcggttgtgatggcattttggtcagagaatttgttttggttaattatttaattaaaattaatttttcaacaatattttaaatctttttgaccattcttcaggcttgaatataaataagtaaataaatatatatatatataaaatggtggaaaaataataataaaaataaaaataatttttaattaaaaaaatttatttaaatttgtttaaaaatgtttgtattcattattaaaacaaaattttaagaaattaaaatattattttataaaatttatttcaatatttaaataaaattatatttaattcatttttattcttttatatttctttttagctaaaaatttaagtattcattctttattaaaacaaaactttaagaaattaagtatatatatttttaaattttttatttaatttaaattacataattttcaattatttaaataattttaatttaaacattattttccaccaaatttataaagaattttaatcattttttattctttatattctatttttatttaaaattttaatatacaagaactaaaatattattttaatatttatttaacataaaattacatttttttaaattattaaattattttattttattttaaattttcatcaaattaatttttattccataaaaaatcaaaaaaaaaattgtttaggctcaacatttattacattgttgtgctcagctgggccatgtcctaccttttccattccctacggatggactcaaatgtgccgtggcgaacatgcgacaattagtaaaatcaaaaattaaactatgggataaaattaattcaaaaatagcgcaaaaattagagacaaatcgtaaaaaaaaaatttatgaatggattaacgaatttggtggtcttcaaggaaaatattcaaccaaagaatggaatcaaaattatgaagaaatttgcaagaaaattggagttggcaatttcataattaataaatggaagaaacaatttgtgaagttagcaagaaaataataacgaaagaagaaaaaatagtaaaattgaaaataattttaaatcattttgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacaatttaaaaatcagttggaattcccctcggtgccgatcagaatatgacccccgtgttgtgtgaatcgaatcggacaattgctggctattttatgttaaggtgaaggcatgaatgaaaaatatttattttattaaaaataatttaaaaatttacaattttaatttaaaataattaaaatttatattttctaatttttatttttatttccaatatttaatttggtcattaaatatttttatcaatttatttttttcattattaattttcatttaaactccttgtggacctctggatccaggcctccgttttcctgtccaggcccagctttttttggcaacctagtttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagtttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcccaaaatttcaaatcgctaattattttaaaaaaaattatttgccctttttaataacatattttttaaagtaagtttcttttaaaatattttaaaatggtttatcttaaatttatttcttttccatttgaaattaaaaatttttgttttcaattaaaaatatcatttttttcatttttaaatataaattaaaatttttcaattaaaatttctcagattttgacggacgaccatctgaatgagtacagaaaacagttcttcatcggcccaaaagtgaacttcaccatttgcaccgaagctgacctcagcgtccgttcgccggtcaaagaattttgggagtaatttaatttttaattaattaattatttttaaataataattttatacatttttattaatagtcatcgcgtattgggcatcagtgaaggcattgaacatgtgggttttaaaaaattcaatgtttattctaaaaaaagaattttctgtatttttttttgctaaaaattttttttttttttttttaaatccaaaagaaatttttttacaaaattttcattttgaaaaatccaatttccgaaaatttttattaaaaattttcatttgaatttaatgggactgtctttttttgaaaaatattttctttaaattctcctagggggttttgttttttcaaaatcttttgaaaattattccgaa

SEQ ID NO: 81068 - DNA, 323 bp, Heterodera glycines
  Genomic contig location: Contig_ID=SeqID_16661; Location=154..476; Strand=+
  SCN-specific regions: Sequence locations=1-178,208-257,290-323
atgagttatagtaaaaaaaatccatacttttttccagatattttttggaaccagtgggttcgggttcaatgttttgaatagtgaaaactgagaagaaaaattaaaaactgtaaatacttaacagtttctcgaatattatatttggtggtttttttagaattaatgtgttaattaatgattttgagttttgaatatttgctactttcattcctttttaaaggttttgtaaaatttttatcttctaactctcctggaccattttccttaaaattttaaaaaattaacccaagaattctgaagtgtttacacatttcaatttgtta

SEQ ID NO: 81069 - DNA, 557 bp, Heterodera glycines
  Genomic contig location: Contig_ID=SeqID_16661; Location=2676..3232; Strand=+
  SCN-specific regions: Sequence locations=1-223,246-493,515-557
atgaagcgatcttcaaatacccaagcttcttcctcattcaaaaaatctcaaaccaataaatgtattcgtaaaattgaccaatttacttccaaaagtattaaacatcatttcatccgctcaaaatcaaaatttgttattgatgaaattgataaatgtaccgaccccgctgcggagctccgttcatgtgtgcaccattcgatcgaggaagcaattttagatggacaaaacatccttggaggagcaaataaggtaggtatcataatttcctcggaacttttagaccagggtgatatcatactgccaataactccgattacgtcaaatgtcgtcgacgcagtgtttaatcaattttgtaaagtggagcagagcaaggccaaatacgtcagcctttacggtgccccttttgttgtaaccgtcactgtcctgaatactgatggtttaccccgccgacgaacgaccaaaggaaatgcccctccaattcactcttcacaatcccacatcttcaaaattaacaacaatgacaactactgtcttttttatgccttggaactgatgcg

SEQ ID NO: 81070 - DNA, 82 bp, Heterodera glycines
  Genomic contig location: Contig_ID=SeqID_16663; Location=784..865; Strand=-
  SCN-specific regions: Sequence locations=1-82
tatagcacggtaagacttccggtttccgacatttttggggtcggaattccgacttccgaaatttttgatgaaaagtcggaaa

SEQ ID NO: 81071 - DNA, 624 bp, Heterodera glycines
  Genomic contig location: Contig_ID=SeqID_16665; Location=621..1244; Strand=+
  SCN-specific regions: Sequence locations=1-321,343-398,420-489,511-624
atgaccttgaaaagaggcgcagagtgcgaaataaaacaaataatagcaaaaatatgggggagagacacattcaaagcaacgccccaattggcattggagaaaagccgggtcagaattagggtcaaatggggcaaccgagaaaaagcggccagcaacagggaaaatgccgcaacacgacaatgccaccaaatcatatcaagtggataactttaaactgaaaaataatatacatcgcatggcattatgaaaaaggagagatagtgagggctaaagcacagagaaaagaaaattaagactcactagtgattaattgaattcgccggaaaaatttttgaaaaattttatgcaatttgctataagattttgtctaaaaatgactaagattttggagctaatatttaaaaataattagcaatttttggggcgggcggtgccgataagcgccgccgaggaaaattttttttcttcagaattttaacgaattttgttaaaaaatagccaaatttttagcatttcctcttttcccctttgctagcctcccccgcccctttatgaatgttaatatgtaatactacaaattaccaagaataagtcagattaaatcgaaatatgggtagcctttta

SEQ ID NO: 81072 - DNA, 64 bp, Heterodera glycines
  Genomic contig location: Contig_ID=SeqID_16668; Location=1787..1850; Strand=+
  SCN-specific regions: Sequence locations=1-64
aattactggagttagcatcatagcagtgcttttccttgtctttttgatgccctcgcaaaatctg

SEQ ID NO: 81073 - DNA, 117 bp, Heterodera glycines
  Genomic contig location: Contig_ID=SeqID_16670; Location=204..320; Strand=-
  SCN-specific regions: Sequence locations=1-117
aaatttcccggttggtcccggtcccgaacaaaaatcgaggtcccggtcccggcttctcaggtcccggcaagtcccggtcctggttttgcccaaaattcccggtcccggcgcactcta

SEQ ID NO: 81074 - DNA, 955 bp, Heterodera glycines
  Genomic contig location: Contig_ID=SeqID_16674; Location=328..1282; Strand=-
  SCN-specific regions: Sequence locations=1-68,108-108,131-212,237 -243,281-328,363-363,408-414,440-461,484-560,588-955
  Gene Ontology: Mol. function=integrin binding; Cellular component =cytosol; Biological process=cell motility
atgaaattgctaattgtgttgttgtgtgtcagcgcaatttacgcgagaagctgtacgaaaatcttagcaaattttaatttttttttaaatattttaattttaattaagtgcaaaagcgcggacaaaacagctatggcgatgaggcaggcgccaaggctggtggtgccgaaggagcagctggcgctgccggaggcgaagctgcagcgcctgccccatctggtggaggaggcatgcttttcaaacaaatttaaattaacagtatttaaataaaatttaaattcctttctcagaagctgcgcccgcggctgaggcggcagcgcctgcgcccgcaccagcggagcaacccgcggcggaacaaccggcgccagcgccggcggccgagcccgcgaaacagcaagcgtccggttaccgacgaaagcgcaaccaaaacagctatggcgatgaagccaaggccgctggtggtggcgctgaaggaggcgcagcagctggcggaggtggcacgaatcgaatttgaaattttagccttttttttccagaggctgccgctccggctcccgcagcaggcggtggtggtggtggtgaagcggctgctgcacctgcggctgaggcggcagcgcctgcgccagctgagcaacccgcggccgagcaaccggcgccagcgccggcagccgagcccgctaagcagcaagcatctggctactgatcacttcgtcaatgatgggatgtgcccggctgatcacggcgctgatcagtttcttctattttgattgatcagcaccaactttcattcaaacacttttcaccaccatcttgccggtgtttttttctttcaaacttttgctgtcttccaaatgattttcattgtgtcagtgtgtcttagacaacataaaattttgatcaaacaattttttttcatttcgcttgatgatgatgtcaactacaatgattgattaaa

SEQ ID NO: 81075 - DNA, 2100 bp, Heterodera glycines
  Genomic contig location: Contig_ID=SeqID_16676; Location=539..2638; Strand=-
  SCN-specific regions: Sequence locations=1-1722,1745-2100
atggacgcgcaacagcttcaacaattgctaaatgctctccagcaaatggtcacaaatgccgcaccgcaaaacgccacaccggcaaatttgagcaatgccaatttggcaagctccatcgatgctcgcctttcaacgttccattacaatccggaggtcggcacaacttttgaatgctggttcaaacggtacggaaaattgatcgaggacgacggaagcactctgcctgaggcctcaaaagtgcgactccttctcggcaaacttggagaggaggagtacaacaaataccgggacacgatcagccccacacagccggaccaagtgaattggaatgacaccatttcgcacctcaaaagcctttttgctgaaacccgctcgctgttcgtccgtcgctacgagtgtttcaaaattcgacagcaacaagggcaagacatctcatcactaattgcgcagatcaacgcattatgtgaaaatgccgacctgagtctgacaaaggagcagctcaagtgcattattttggtcatcgcactcaacgatgaacaccatgatttgcgacaaaaggcattgaaaatgttggaggacgcgcagaaaaacggcaccaacatttcgctcaagaaaattgaggaggaacttcggacaattcagcttgtcaaggagagcgccctttcgctggtcaacccaccaattgccacaaacgccattcgcacaaggccacggcaatggaccgacccagcgcaaagacaaagcggcggctccaatcaaaggcaaactccaaatgccaattcaagcggaaagccaacgcgtggtcaaccaacgcttccgtgtggatcatgtggcaaaaccgaccactggcgctccgactgcacattcaagggtgccacttgctttaagtgcaacaaaaaagggcacatttcaacaatttgccggtcaaagaagacaaaggcaccaccgaacaaccacaggtcattccacactgtcaaagtcgacgcaaattgcctgcatgtcggcacgactcaaggacgatggtggaaattgtgcattttgattaatggaaggcaaacttccatgaatggcgacaccggcgctcaagccacaattatttctttgcaaacgtggcaggagttaggaagcccggatctgtctccagctgacatcgatgccaaaaactgcaatgaccagccattcgctttgctcggcaaattcatattcactgtccaattctccgacaaaccaccgcaaactctcatcgcctatgtgagcggagaagtcggacacaatttgctgggattgccgtggatcgaagctttggaggtcatcccccgccaaattttatttccgtccagcaaatcggctgatcaggcgacaaaagtgattgacaatttttcggcagtgaagccgccaaacaaatcgatcaatgatgtgtcaacgcttaaagcggcactccaaaacgatttcccggaagtctttgaagaaggactgggacactgctcaaaggcaaaggcgcatctcattttgcggtctgatgcaaagcctgtattttgccgagctcgccccattccacacggcgccatggaagctgtgaatgccgaattggaccgtcttcttcaaattggcgcaattaagccgattgattgcatcgacttctcgaccggcctcaacaatgcattggaattgaaccgccacccactgccaaggccagacgacatttacgcctcactgaatggcgcaaaatttttctcaaatttggatttacgcgatgcgtatttgcaaatggaaatggatgaagaatccaagcaattgtgtgcgatcaacacacatcgagggcttttccaatgccaacgcctgccgttcggagtcaaatcggcaccggcaatatttcagcatttgatggaccaaatttgtgctggcatccctggtgttttcgcgtatcttgacgatggattgatcgcaacgaaaaccctggaccaacacatttccgcactttatactttttgggcgcataaaagagtacggtcttcgcatccaactggacaaatgcaaatttttgcagcccgaacttttgttccttgggcatattgtgtcagcaaacggcattcgtcctga

SEQ ID NO: 81076 - DNA, 1707 bp, Heterodera glycines
  Genomic contig location: Contig_ID=SeqID_2684; Location=694..2400; Strand=+
  SCN-specific regions: Sequence locations=1-622,685-1683,1705-1707
atgtcagatttaagaatggaggtaaaaataaatgatttcctttcatttattcctttcatcttaaggccagcaatgatgtgatcattcccgtcaatgttgcaattcgcatattcagttttgtcagtagagatgatttggaaaattgcaaactcacctgcaaatcatggaaagacgtgtaaggcattgaattttgttttttgcaataaaacattggcaaataaaaccgattattttaagaattgattacgcagacaaccgaaagaactcggagttgcaactgaggcacattgacgccatttgtctctcaaccaattctgaattttctatcaaaatttactacaaccaaactattcgcgagttttactacaaaaaatatttcgctgataggttaggcctttttttaaataaaatagaaacattttatcttcagggaaattgatgaaattgaagtgaaaaaagtcaggcatttaacgagtcaatttgacgagaaaaaatacgttttcccatgtggagagcatttgccaattcggcaaagtcattcctttgtttttccagcggttgatatttttcaccaacacaggtgtaaaagtaggtaattctttgggttaagggcagttcgtacaatttttttttttaattttcattaaaaccgaattttttatcaaatgatttttttaaatttttgcgacacttttgctgtttaattttttgggtggtttcgagtctctgaattctaaagaactgcgatgacatcaattcttttgattaatttgtaagctaaaaataatttcaattttttcagtggtgaggccaaccgtttaccaggaccatgtcaattacacgcgaaaactcttcacacctccgctcagtttttatgaacgccttcaacgaatgctcaaaaaatgtaaaattcgtctggtgattttccacgcgttcactttcactgatttctttgttgaaaaaatgcgtgaatttgcgtccgatgcgttttcgagggtcgtttttctttcccttcactgtaagtccaatttttcgttaattggttcattttcttccaccttcttttctcaggttgcaatctccgctgcgttagtccgaattctttccacgaatttctctcttctgtttatgctgctcattttcttttggatcgccttaggaattgtgtgccgaatcattttaacgctcttttgctgagcaaaccctccattcaaatgtaagtgcattcattgtccatcttttcgttgatagtttttaaaaatttttcaaacaaattgctaatttttgtgaactctatagggcgcgtacgttttacgttggcttttgtatcggaagacgacacacaaacagtggtgcccttcccgatcgacgacgacgacttcataaaatatgtgaaactgctcggtgccgctaaacgacgagatttttttggcattgctctctgtcgagtgacacaacaatttcgaccattttatgaaaaggcaaggaataccgtaattataagtaaattgcaatgtataaatttttagataattaccagcaacaaataccgccggttgaatttatatactcacgtattatttggggacgttcgctatttatctaatgaattcggatttacaaattcacattcagtccaacaataatgtcaatgcttttgttttgttgattgaattgtatatgaaaataattgaggattttcagtaa

SEQ ID NO: 81077 - DNA, 322 bp, Heterodera glycines
  Genomic contig location: Contig_ID=SeqID_2684; Location=5422..5743; Strand=-
  SCN-specific regions: Sequence locations=1-322
  Gene Ontology: Cellular component=extracellular space
catttcctttgcggtgtcctttttggccgggggtttggccattggctatttgctcggctggcgaaccgcggcttcaaaattggcccgatgcaacacgcgagtgcagttgagcaaggacaaagtggtggacactgtcgaattggaggacattggcgagaaaaaggcatattgtcgctgttggcaatccaaaaaagtaaaacgaaataaaacccaaataaattattagaatttcctttgagtttcctttgtgtgacgggtcccacaatgagcacaacaaaaagacgggggacaatgttggcccattgattgtacagaaggcgaa

SEQ ID NO: 81078 - DNA, 1206 bp, Heterodera glycines
  Genomic contig location: Contig_ID=SeqID_2684; Location=3960..5165; Strand=-
  SCN-specific regions: Sequence locations=1-296,334-718,741-1206
  Gene Ontology: Biological process=DNA damage response, signal transduction resulting in cell cycle arrest
atgcgtttcgttgcggtgattggcgatgggaaagcagtggatattttcgtcagtatgttttaggtgttaaaattcttctaattttatttgttaagaagtggcagcggtcgtttcaaaattgtgtcggaagagagcggtcgtccgaatcacgccgaatgagttcagttttgtcaatgtgtacaatgtccgtgagggaatgcacgtcgacttccgcattcacaaggtgttcaatgggaagtgattcattatttgccactttgtatgaattcatttgctatcgaatggaaatgaccgcccaacattttctttcatttttcaggataatttatttaattcatggagctttgacggcctttccctggacaacaacgcgattttcttcgaattgtccaccgacgacttcgtccgttcgctgcattcgcgtgccactcaaatcaaattgaaaatgaccaaaaaggacggggtgccgcaccttcgcgtggagctcagtgccaattccctggtcaacgaaattcccattgttttggttgttctacgacaatggcccgacttcaacccaccaaacatgggcatttctcagttggcagttgcacttccaaacgtcaaaacattggtcagttactattggatgaaaatgaacaaatgggcccatatttacctacaattagaaatggatcacaattttaaagtggggctgcccaaatttattgtcttgtccgctttctttcattttctttactcttttagacaaaaattgtctcgggtgtgaaggacattggcggaaggcatttggtaaatcagtttattaaacgaaaaatattgtgattgaatttcttaagatatttcgcgcaaacaatcgtggagagttcaacatcattggttatgccgaccaggcaaaagtcgctgtctatgctcaagggcttcacaatcagagcatcagcggagctgagggtatgactcattatttagctttccgagattcaaaaatttttttttcaaatggtttatgccatgtttaaaaaataatggtcccagtggccaagttatgtaaatgtttcaatagcctaaattcctttcctttgttcaggtctttcgcaaactgcaccacagcccgagcatttttttaacgttacgttggacatcaggaattttcatgcctttcttagtgcactccatgcacttgcctccagattaacaatgagttaa

SEQ ID NO: 81079 - DNA, 2422 bp, Heterodera glycines
  Genomic contig location: Contig_ID=SeqID_2685; Location=324..2745; Strand=-
  SCN-specific regions: Sequence locations=1-220,245-349,371-419,441 -520,542-2422
  Gene Ontology: Mol. function=tRNA (guanine-N7-)-methyltransferase activity; Cellular component=mitochondrion; Biological process=tRNA modification
atggactggaacgaattgtttgggcccagtgccgaagggcattcccctgagtttgctgacatcggttgtggctatggcggattggtaagaaaactcccagaatattcaatctaaaatttacttatttgttagttggtaaaattggctccgatgtttccagacgtaacaatggttggtatggaaattcgggtgaaggtctgtttgaaatacgactaatccgtttttttatttaaaaatttatttaggtagccgatttcgtgcaggaaagagtgaaggcactccgtgcacaaaaccctggtcgttacgacaacatttgttgcatgcgaagcaatgcgatgaaaaacttacccaattttttccgcaaaagtcaactgagcaaaatgttctttctttttcccgacccacacttcaaaaagacaaagcataaatggaggattatttcaacaaatttgcttgctgaatatgcttatgttctgatgccgggcggtgagtggattttgaacttgccaaagttgtctttttaaacatagatgtatttgaaatcataaagatgaattttgctaattttgtactatgaatattgttgtttcattcgattaaatatgttttattttaggccgtatttacacaataacggatgttgaagagttgcaccattggatggtcaatcacctgcaaggatttccattgttccgacgacttactgacaaagaatatgccgacgatgttgttgtgccattgctatttgaaagcaccgaagagggacaaaaagtgacgcggaacagcggaaataaatgggcggcggtgtttcagcgcctcgaaaatccgccattcgaagatacaaatgagcaattaataaatactaacaaaaattgctaataataaattgttattgggtagaaatgtctgatgcatctttggtgtctgatccatccttatcttttctttgttatcatttttgctttacactccgtttaagaatttataatccagcaaattgaaatgccggaacagagcagcggtgccgatgagtacgaatcgttggctcccacttattcgctttgggttcatttggcggcgggcgcagcggcgggaatggctgagcattgtgtgatgttcccattggacagtgtcaaaacgcgtctccagtcgctgtgcccttgtcccgagtccacgtgtccgactcctatccatggcgttgcttcaatggtccgcagggagggattttggcggacgtttcgcggagtcaatgcggtcgctgtcggctcagtgccagcccacgccctttacttcacggtctacgaaaagttcaaggtgttttcggttcaaaaatataaggaaggtgtaaaatttgatttcgtttttagtcttcactgactggcaacactcatggccattcgaattcgttttcgtacgcattggccggcatggcggcaacagtggtccacgatttggtgatgaacccggccgaggtggtcaaacagcgcatgcaaatgctgtacagtccgtacggcggttcgttggaatgtgtgcgttgcatctttcggaacgagggaatggccgctttctatcgctcttactccacccaattgtttatgaacgttccgttccaagccgtccatttcgtatgctatgaattctggcaagaggtcgtctatctcgccgtatattgtttttttaattgacctttgctttagcaatttaaccgggaacgtaaatacgacccaacttcgcatttggtttcgggaggacttgccggtggacttgcggccgctgttacaaacccacttgactgcgtcaaaaccgtataatattaagtggtttcttccaaaaattacttttttttaacaacgcccaatgtaatattaggggataggtgtctcacaattagaaattaggcgttctaatgggcgctgtgccttcaaactcaaaatgcccaaatctcattactgttcgattggctaattcatcttctctggcgcttaagccatcgaatatcttaaaaaatcaattaactcatccacaaattcataagaccacattttcaggttttaaacacccaacaatcccctcaaccggttatcgacaaacggagtctcctttatctcaaaggctcgtacaatggtcaatatttacattttattttcctcttatagtataaattttaggcattctcgatgcaatttcctccatttattcaacccgtggcttcgctggctttttagttggtcttcatgctcgggtgctttaccaaatgccgtccgctgcactcagttggagtgtctacgaacttttcaaatatttgttgggggaacagaacaccataacttcgagcaggtcaaagtgttgtccgcattgttgtgtttaaatatcccatgttatgctcactgttttgttttttttttaatattaaatgaataaa

SEQ ID NO: 81080 - DNA, 885 bp, Heterodera glycines
  Genomic contig location: Contig_ID=SeqID_2686; Location=932..1816; Strand=-
  SCN-specific regions: Sequence locations=1-132,155-233,255-653,676-885
  Gene Ontology: Mol. function=zinc ion binding; Cellular component =integral to membrane; Biological process=body morphogenesis (sensu Nematoda)
ataattaacaaaaatataacaaaattagttgctattccactgttggccaattgcgcgacggacacccccaaaaagtgtccattgggccgcgttgtgacaatcctttcgttgtgtcccatgaaatcggtgggcaaattaaaatttattttttaatccggcaattctttctcagctcattctctcggtatttccatgaacagtcgcgctttgaccgtgataaattcgtccaaattcagcccaaaaacattcagctcggcttccttaaccaattcactcgcttttcccaatcccaagagaccacctttgacgtttcggtcagtcatttggcaaaaaattcgcgaaccgatcgaattcggaaataatctatcagtcgctaagaacccttaatcatgcgcttcttccttacagtatgactttggttcggtgatgcattacgatgcttttgtgcgtgtctttcccttgcctttctttgcgcgtgcgtttatgacaatgtttaggcattttccagcaggggactctcctccatccaaacggtgaacccaaattaccaaaacaccatcggacaacgcttccaattgtccttcaacgacgtcaaaaagatgaacttggcatactgtcacagtacgcctttaattcgacgatgttccctcccccttttttcgcctcttttccctctaaggcatttgtccgttcgaattgtcctgccaacgttcggggtacaccgacccaaaggtcattcttctgtcggtgcttctctaattattcaatttgtcagttgtttaggcatgcgatcgttgtcgctgtcccaatggtttggccggacgattctgtgaccgagtggaagcaacagacaatcattgcggggaagtgcttctgcaagcaatc

SEQ ID NO: 81081 - DNA, 737 bp, Heterodera glycines
  Genomic contig location: Contig_ID=SeqID_16680; Location=3115..3851; Strand=-
  SCN-specific regions: Sequence locations=1-565,588-607,629-737
atgacaaacgacttgctcacaccgcacgacctggaaagacagaggagtttcgtcatcggaggagtgcctgaaagcaatgcgacaaaaccaagtgcccgggcccaggagacaatgcaatggtcgaacaggttttggatgagctgggcatccaagtttcctcggtaactgtatatgaatgggaaactctttcaaaaacccagcacaaacggtgctgcaatcgattcttaaaagtgatgcttcccgctcgtcatttccagcgcgatgtactcacaaagtggaaaaagcatgtcacgacagttcggcgtacgtttgcaaaccaagaatgaacgcatgaatgttcgcccgtcgttgtccctcgaggaactttcgttcggcaaagcatgttctgcatgaggaatgcaagaggaaacgaaatgaaacgatctacgcttcgaaagtgattctccgaaatgatgccaacagtgccaaaaacaatcgctctttcttcccaactacacctagcctgctctcataaaacgcctaatttccaacacctgtaacgaggtttaggggcgtgatttcaattcattttcacctaacaaaaatttattgctttcccttaaacttccacctgtcattgtttcctctgactctaaacaaatgacaaatacctcctttcaaaacttttcttatgccaatataaataatcctaattctgtaacgggttgcttatcaatgcccgctcgagtaaaaataaa

SEQ ID NO: 81082 - DNA, 188 bp, Heterodera glycines
  Genomic contig location: Contig_ID=SeqID_16680; Location=110..297; Strand=-
  SCN-specific regions: Sequence locations=1-10,45-188
atgccgtcgcgaaatttgtcagcaaagaaaaaacaacagaattcgttagttcgggatgagtcgacctcttcacccagcagaacgcccaaatcggtgtcgaaagcgagtaacagcaacagtagccaacagaaacttcagaagaagcataattcatcagaactgtccacgattagcagtgaaagtgtcga

SEQ ID NO: 81083 - DNA, 1578 bp, Heterodera glycines
  Genomic contig location: Contig_ID=SeqID_16680; Location=552..2129; Strand=-
  SCN-specific regions: Sequence locations=1-140,162-223,245-247,270 -619,662-897,920-1016,1038-1416,1438-1553
cctcttctcctcacccaggaggggatcaatttcaagtttgtcgctctgatataacttttgatgtttctgatatttttgaaaaacttaatcgtttgtatggaaaaaataatacggctcctgattttattaacaatcaaatacttaaaatctcttttcttcctcttgttggcctataactgatctttcaaaactatcttttaacaccggtaaattactaaaaatttggaaacattctattatccttcctgtacataaaaaggaaaataaaagccatgttaaaaattatagactatttcacttactttttctttatgcaaaatttttgaaaaaatcttagttgaccgaatttatgtatttttgactgaaaataatttaatttctgaatttcaatttggctttgtaaataaaagatctactatcactaatcttatttctacccttgaagactggtatgatggtatcagggatagaaaaaacattgatgcgttatatctagatttgcaaaaagcctttgataaagtccctcataatctacttttatataaacttcaccgaattggaattaggggaaaagttttaaattggattaaagattttctaacagaaagaacttttcaagttaaaattaatgaaaaatattctaaaatttttaaaataaattctggtgttccccaaggctctgttcttggtccactcctgtttttgatttatattaatgatttaccgtcttacattccgtctaaaattggaattaagctttttgcggatgataccaaaatatatgttatttataaatcggatactgaaagaaaaattatggacctggcacttatcaatgttttaaagtggtctgaagaatggggtattaaattttcaatagataaaacatatgttctttatttggggactaataaccccaagtgtccctacaaaattggaaattttacaattagtgaagccaagtcagtgcgtgacctaggagtcattattgataatgaacttaaattcaccgaacatattacatatttaataaaaaatacctttttccgtataaaattctctttaaattaattaaatccaaaacaataagaatatggtcattggtttataaaacatatattagatccttattagaatatgccactgaaatttggaatcctaagtcagtaaatgcacttaacagaattgaaagatgtcaaaaatattttaccaggatagctcttaaaaaatgtaatcttccatacatctcatataataaaagactagaactttttaaacttgacagacttgaaacccgtagaaaagttattgatcttaccactgcttttaaaataatcaactgtcatactcatttagaccctcaaaaactttacactttctcaaaaagattaagatttaattgtattagattaatatctaaacacaaaaccaacaaaaccgaaaactcatttattaatagaacaataaaacaatggaacaatcttgattctaaaattacggcatcatcttccatatgtagttttaaaaacaaagtcataaaatgggttaaagcccctaaatacaataaaaatatttaca

SEQ ID NO: 81084 - DNA, 802 bp, Heterodera glycines
  Genomic contig location: Contig_ID=SeqID_16684; Location=845..1646; Strand=+
  SCN-specific regions: Sequence locations=1-140,213-321,344-621,647 -668,690-802
atggcgctttttcaggccctccgccccggtctgccgcctccgctcgccgtcgccgcttcttctgacagcgacggggaagacgcggcgagtgagcgcaggcgcgtcgtccgtttcagcggcgacgagcgcatgcaacagaaaagacgacgagaaaaagatggagacgcagagggagacgacgacgaagaggcggccgaggaggaggaggaggactacgcaccggtggagagtgagtcaacgggggccaccattcacttttttgagtcccggcaaaaaatatgccattttcagtccccgacagcatgctgtctaccgacacgatgcccccgccccaacatcagccggtgtacgccagggcagcgccgccggtgatgccgccgccatcctcccaaatgccgtcgatgggcgctggtggagttgggcgggcaccgctaccgcccggcatggcaccgccgcctcccggttaccccccaggtaaatggtgttggctaaatcgaattaatccgcgcaaatgctactttccccattaggttactacgcgtcgaatgtgccgccggaagtgcatgcgcaagcgatgcgcacggggcgaatgccaccgccgcccaattcgtcgttttcgatggccgcgcaacagcagcagcaacagtccaagactgggctcatctcctacacacacgctgaaccgcacccctccgctgtcatttcagccgccccacaggtgaaaaacgcaggatttatcggaacccgtcagttgggccccggcacgtttgggcccagcggttttttggctataactttttga

SEQ ID NO: 81085 - DNA, 752 bp, Heterodera glycines
  Genomic contig location: Contig_ID=SeqID_16688; Location=118..869; Strand=+
  SCN-specific regions: Sequence locations=1-45,68-752
atggcaaagcgaatggcaaatttttctcctcctaacaacactgcccccaaaaaatttctgtctgaccttgaccaactacaaatccccaaagaaattgacactgacaactccattcccgactacgccaagttgcttattaagcagcttcactcccttttaagcaccgcctcggccctaattcattgtcaggttgcggctgtggacgcggtcgaagaggaaagacgactgagaactgtcgttgtgacaaatgtgcccgaaagtaaatcggacaaagcggcggagagagcccgggaggaccatgccattgtggaccacatgttgaatgccacggacgtcgaccaggcaccaattgtcttccgtgtcggcaaaaggatggacggtagaccgcgccctctcaaaatggaattccccagcaaacatgcagcgagacatatcatccgcatgcgtggaaaggtgcaagccttgaatggtctccacaatgtccgcatccgcgaaagcatgaccaaagaacaactgtctgagcggcggaaattgatcgaagaatgcgggaagaaaaggcaggcggacaatggtgattgggtgatatatgccaatcaagttgtgctgagacaagacattgaccaaattcgaaaaaatttttaaattgtccaaccaaatcacttcaaattacccataattattacacaaaggtacaaaaatttttccggtcagtaaaaaatttttacaaaaaaattaatcatccaaatttttta

SEQ ID NO: 81086 - DNA, 812 bp, Heterodera glycines
  Genomic contig location: Contig_ID=SeqID_16688; Location=2013..2824; Strand=-
  SCN-specific regions: Sequence locations=1-244,267-276,298-751,773-812
gaccgacgctttcatccggcggaattgagtcaattggcggccgacactcttttgctggcggcttcactaaactctccgacgaacttttcgcaaatggacgaggcgcgagacgcaatttcactccttttgagtgccttttcatttcagtgcgatgcttttttcggatgctcgcaatcggctggcaaaagcggcgaactttcgtccgtcgcccattctctgcactctctgctcaacgataactttgtttgcaaaattgttcaaatttcttcccaaatcgtttttattttaggcaaaaacccttctgatcgtcgacggagtgcaaatggccgatagtgtcaaattcttcgatcaaatcaaagtgagttgaacggttttgttgcgtttccaatggttaaccaatttagggaaaaatgtgcaaaattttggccaccagcaccagcagaacactttttaatgggttggagaatatacaaacatttgaagtgccgtccgacaattgctccggcgaagagttggcacagatggcgctgaattacggcattaaagtgccaagacattgttgtaatgtcaaaaaagaaaccactcatttttaggagacattttcggccgaacggataaatgccattctttgtgagacgggcggaaatttcgcacttttggagaaaatgttcgtgatggcacggggctgtcccgcaatgttcgtctccttcgccccttcccccccccccaccgcccctttcagtttcgactctctcctcgcccaacttcgccattcgcccctcagtttggtcagctgtcacagtgcctattac

SEQ ID NO: 81087 - DNA, 2416 bp, Heterodera glycines
  Genomic contig location: Contig_ID=SeqID_2688; Location=35..2450; Strand=+
  SCN-specific regions: Sequence locations=1-443,465-702,725-1013,1045 -1547,1569-1601,1623-1896,1918-1988,2011-2148,2184-2381,2404-2416
atggcttcggctgatgtgtcaattgaagttgcacagttgaaaaacaacgacggtggtcaaatgggcacaaatgcccctgcggttattattaagccggaacgcaatggccatttctgtcgaatgttcgcacccggcaaatacaccgctcgtgtcagtgtggccaacatgtgtttttttacattttaaggcttatttttaggggtttctgtcaaaaatgcttatttctgtcaaatttttgcattttgggtatttaaacggtctattaaaaatttgataaattgcaaaaaattttattggggtggaccatttaattgggccagttttctttttcgaactcgttgtcctgacttttcctctgtttcagatcatttctccaacggcatacacaccgaaacaacaattggtcgatttgacggaaaagcctttggtcggcgtgcaattcacacaatttttgggcaaaatttccggatggattgaatgcattggtgccaaataaatgcacttatttacatatttattaggtggtattggtcacaaaacactaaattaactatttaagggacttgtgatggcatttccttggaattgtcgtcgcacggcgggggtcactcaccggcagttgttgccaacataaagccaaatgaaagcgacgggacgtttcaatttgcggagatttccccttccatttacaaaggtgacaacatttaattgggtgcaaaaataaggaatttcataaaatttcgaaaaattgctaaatttcatgaattatatttttttaaacaattccatgaaatttcaatttttttctcgagttatgctaataaaccttttttatgtgaattatgttacagtgcgcgttgtgagcagcgaaaatgtttggtgggattcaaccgaacaatcggttcatgtggtggaaaaggacgtggacggagttcactttgtacagaagggcttcagaatggacatacaaagcacacatcccgcaaaaatggtaatttaagtgttggaatgtctatttattataatttttatacaaaattaaatgccaatcagaaaatcactgttcttccattctttttccaggaatatgcgccgatcgttcaacacaaaaagccctccactgatgccgttcagcagctcaaaatggtgcatttggtttccggcctcaacactttgttcttcccgatgccatcgtcgccaaccgaaaagagtgccgccaaaggcaaatgccaaaatcaccgcacaccgccgcaaccgttcaaatttgcgctttcctcatgccacgactttgacattgttgttgccgatggcgacggaaaagcggcggaaaatgcttttaatgaccaacaaaaggacgacaacaacagcggcaagttcactgtgcctggcacaaaacgtgttgaacttgtcgccaaagcgacacgattgcctatcagaattgagttggatggcgacagtacggggcgtgacgagttgaacttggtggacatgaagctgacttggtaaagatatgcctctttattcagaaaaaccgttagaatcacacgaagaattatttatttttccttcgccgtaaaaaaatagacctactatcttttccgggtttttaagggaaaaaagtcgcaaatattttttgtggaatatgactcatttatttttgcttttttcattgcctttttccagtgacggatgttcttcggaggaggcaaaatcgtcgcccatttccgactcgatcaatggcaccgttaggacattcgttttccgcttggaacagcagaaagttggcattaaatttgttgcgacggcatactcggctcttcacctgttcatcccggaaaccatcgcaatcaaattcaatggtgcagataatggagttttaaaaatgcaagatttaaattattaattgcattttgtaaaggtgattgtcaggaggagccgattgttttccgagcgcatttgggcaaattcatcgagggccatgtacgtccggccatttctgaagtgagtgtcaccgcaaaacgccgaaagaccatcggcgacgggaaagggacagatttgcgcacgcagacggatgccgatggaaaattcaggtggcgaagggacccaatataaaaggatttttgcggctgggagtgtgtactttttgggttttttaaatttaattttaagataaatttaaaattgtgtcaatcctctcatttttaggtttggtccggtttgggatgagcaggactttgagctgatgctggaaaaggatggcttcgagttcaagccgtacacaccaactgccgatggtataaagatacggaaggcgggtggttggggagagggactccgtttggttaacagtaaattaataactgacaatgagattcaatttggattgaatttttgtttctgggtcgcataccgttga

SEQ ID NO: 81088 - DNA, 475 bp, Heterodera glycines
  Genomic contig location: Contig_ID=SeqID_2688; Location=3459..3933; Strand=-
  SCN-specific regions: Sequence locations=1-141,166-419,457-475
attgattacctgacaaaagtgaaaagagagtcggcgaagaattcttcagaaatgggctcaattttcagcttttttgcctcactccgaccaatttcaatggcataatgctatgagcaataaagaatgaaattaggtaattaatttaataaaattccacctttttataggcgggtaatgtgaaaaagaatacggtgcccggcacattttgttcctgaattattttgccggtggcactgtccttcaaaagcacacgaaaagtgctgctgctgacgcccccgccaatggtggcatttgccggaagttccaattcgctgacaaccgtcgccgcgggcaattcgttggggaacacgacaaagtgcacgtcacgcctgtcctcattgcccgtcttgacaatgacagaattcaattgaaaatgtcggtaataaataattaattaattgtctttatataatttttgatttgcccccgtccacct

SEQ ID NO: 81089 - DNA, 1167 bp, Heterodera glycines
  Genomic contig location: Contig_ID=SeqID_2689; Location=351..1517; Strand=-
  SCN-specific regions: Sequence locations=1-46,73-242,272-843,865 -867,891-1167
atgccgtccttcgtccaccatcacttaacgcttctgtgcctcttcctcggcgccctttgcgccttcggtgccgtcccttcgctgtgccatcttttgggcgcccctggcggatgttccccaatcgccgttatcagcgcggcgcaacagccaaacggcggcggcgccgcggcacagtttcagcagccctttgggccggcttttggctgcccgctgaatccgctgggtgcttttgggcgcccatttcccccaccgccgccgcccccaccgccgggcatcggaggccaatttccatcgatgcaaggccagaccggtaatcaatctcaattaattaataattatttgtttggcatttgctgattgccaaaggcctttttgaccattttcattgattagagagtgtaggaaaaagtaaaattgatcagagataaaacaaatgataccactctgacctatggattcaacgcaaagttattttggttttttgatcgattgctatcatttgtgtcttgaaatcactcggaatggactaattaggggacatcgacggcatcggaacatccgttacgttcctcgtggttttttggcaccaattaaggccgccagccgatcaaaactggtcgcttcctctttgagcgggttgcttgctcattattcaattaacgctaattagatactttttgcaatggctaattagggtcccctgacgagcaattttcaatctttttttcaattctttcagtgaatcttagcccaaatttcatgggcggaggccaacagcagcagcaaaatggggggaatgccttcggcacaatgggcggcggcggcaattgcaattgtggcacgtgttgtcagcagcagcaggagacgaacggcaacagcaacaacaacaattttattggcatgccaacagccaacgaatttaccggcttcaacaacggcaacaataatttgatgaatggcattgccaatggcggtgccattgacatggccaacagcggcggtatgggcgtgttcggacgacgccgaaggcgatgaaattcaaaattggtggcataaaaaaaaatgccaagaaaagaatttttgtgcccaattctttttgcaaaatttgtttaatcatccaatttacaatgtgtaatttcaatttgaaagcattttttgaataataaa

SEQ ID NO: 81090 - DNA, 740 bp, Heterodera glycines
  Genomic contig location: Contig_ID=SeqID_16693; Location=1..740; Strand=-
  SCN-specific regions: Sequence locations=1-672,694-740
atagaaaaggtgttagaacggctctaaaatgacccaaaatcccctgctgcgtttgccggtgtcgaccgattgtggttggaagccaaaaaggaacttggaaataaaattcgtaaaaatgatgtaaaacattatctggaggggcatcgcacctacacattgatgcgtccaagacgcatcaattttccgcgcgctagaacaacggctgccggttttatgaccgactgtcaggtcgatttggctgactttcaaaccctttctcgacacaacaggggaaatcggtatttaatggtggtaattgatattctttcgaagcggatttttgtgacacctcttcgtaccaagaaggctgatgacatggtagacggctttaaagaagtgttttcaacgatgccaatgaaaccacacagaattttctccgacaagggtacagaattcagaaatcagcagctgaaaaaacttttcgatgaagaggaagttgagaaatatgagagcacacattctgagaagaaagcagcattagccgagcgcgcaatacgacaaatcaaaaatcgggtgtatcgctactttgcccaaacaaaaaccctaaattgggtggacgtaattgatcaaattgttaatggtattaataaatcaccgagccgggtgcatggaatgcgacctattgacgtgaactttaaaaattcacaacaaatatgggaaaaagtgtttggagatgatcagcatatggctcttttggaaag

SEQ ID NO: 81091 - DNA, 1095 bp, Heterodera glycines
  Genomic contig location: Contig_ID=SeqID_16694; Location=1569..2663; Strand=-
  SCN-specific regions: Sequence locations=1-280,302-541,563-723,745 -1011,1061-1095
atgagtattaattataacgataaaatttatcatggacaacattttgccggctgtagagatcagtcatacgaccaatggcattacactgatcagcgagaggattgcggtgctagaacaattccatttgacatcgttggcaagtatcgagaatgcaaggccactgagtgcgagacggaatggtgcatttcaaaagaaggagtaacaatttggtgtactcgtttcaaaattagtcctcgattcgtgccatttgactatgtttatgagttgccgggctatacatttttcaaggttttaaaatattatatgtcttttctttaaaataatattcatattcgtaacaaaggtcgagtttttaatgtcgaccacggtttccgctccaatgtttgtactcagaccgagactcccgtctacaatttaccgcccccaccgcctccgcctcaactaaagccaaaggaaaaggatggagaaacagaagaccaaactacacaacagttttttgagtctatcacggcagctattacaggattggatgtttctcaaaagaagcacggagaagccaaggaattttttgatgctctttcggtggcaaccgcggggatggaagtcgacgaaaacaaagagaaaaaagcgcttccacaaccgcagactaatgcctccgatttcttttctccgattgcagcagctactatgggaattgttggtgatcacctcaagcccaaaccgaaaccaaaacaacaccaaccaagggcctccgatttcttttcaccgatttctgcatccacaatggggatgagtgacgaacagaacaaacatgaacctaactcaaaacaaccaaagaaagattcttcaaaatttgcttcggctatttctgccgctaccatggggatgagcaataacgaacaaaagcagcaaattcctattgaaaaagataagcagcaaacggacaaagaaattcttgacgaatttcttgaaagtgtctccgctgccacaacatgcttggacatttcacataagaagaagccgaagaaaaaggggaagaaggaagcagaagatgaagaagcagcagccattgcgtcaattagtcgtaaagaataa

SEQ ID NO: 81092 - DNA, 627 bp, Heterodera glycines
  Genomic contig location: Contig_ID=SeqID_16695; Location=2146..2772; Strand=+
  SCN-specific regions: Sequence locations=1-597,619-627
atgattaagctatgccctgtcggaatgcagccggagccttcagcgattggctacgtgccgtgcgatttacttgcgcccggccaatgcagcgaagggtaagcacggggaatgattccagattttccggaagcccaaaaaattagaatttttcacaaattcccacaacttttgactcaaatttgccaaaaaaaaataaatagtctctgatcactttttaaacatttccgatcactgtaaaatgccaaccgccacaggtatcagtgcgtgcattcgcgtgacgatccggagatgagcatttgttgcagtcggttgcgcaaccaaccgccatctgctgcggcagcgcccatctgccccaatcaggcaaaattttcagtccctttctccatcgcgttcagttggcccatttctgacgggacagaattttttttttttcaataaaccgaagttggcaattttttcagcaaattttattgcgagacgggtcaagcccgcgctactgctccccacggcagggcatcagcgcgtgtccaaatgggtaccaatgcgatgagtcaattggccaaccgaatgtgtaaattcaaaaaaacaaaattggcattttaatacagtatgtgccaaatttgaaaa

SEQ ID NO: 81093 - DNA, 788 bp, Heterodera glycines
  Genomic contig location: Contig_ID=SeqID_16696; Location=895..1682; Strand=-
  SCN-specific regions: Sequence locations=1-229,251-256,332-519,559-788
atgagtgccatatttggatttataatcaacctattctgttggttcacgtgcggttttggcattttgtttaatggcattttgattcgtttaatttatcggcatactccaaagccaatgcttatttatagcaaagtgattttactatttataaatattaacttttattggtcaataattccaataaatatttaggttctattgcaaacatgtttgattgatattttattgcttataatgacatttttattcatcccggtatattattatttttttatttttttcaattaattttttataattatttccattttaatattaaaaatgtattattcttagtacaattttgtgtcggaacggggcgaaacggaagtaattgtgtacggattgatcaccataaaaggggtgcaaaatcgaatttggaatttattggcattcgtttgctgggttttcctggtctatgtgtcaatgtttggctatgtgtcgcaatttatttttcgttatttggtcattatccggtacattaattaattattatttttaaattaatttataaaataagaaatttgcactttcaagggataaaaatgtttcgtccaccaaatatttttgcctcctttttctgatgcttttgtttccatttgcgcattgcgccaatttgtgcatcagctattttccgcctgtagaacacgcaacaatggacgagaaatccgtcgcggaaattctcggcattaatctcgacgacgatcaaattattttagccggatattcgtttaatgtaaaaaaataaa

SEQ ID NO: 81094 - DNA, 555 bp, Heterodera glycines
  Genomic contig location: Contig_ID=SeqID_16697; Location=26..580; Strand=-
  SCN-specific regions: Sequence locations=1-229,251-256,328-515
atgagtgccatatttggatttataatcaacctattctgttggttcacgtgcggttttggcattttgtttaatggcattttgattcgtttaatttatcggcacactccaaagccaatgcttatttatagcaaagtgattttactatttataaatattaacttttattggtcaataattccaataaatatttaggttctattgcaaacatgtttgattgatattttattgcttataatgacatttttattcatcccggtatattttttttttatttttttcaattaattttttataatttttccattttaatattaaaaatgtattattcttagtacaattttgtgtcggaacggggcgaaacggaagtaattgtgtacggattgatcaccataaaaggggtgcaaaatcgaatttggaatttattggcattcgtttgctgggttttcctggtctatgtgtcaatgtttggctatgtgtcgcaatttatttttcgttatttggtcattatccggtacattaattaattattatttttaaaataatttataaaataaa

SEQ ID NO: 81095 - DNA, 498 bp, Heterodera glycines
  Genomic contig location: Contig_ID=SeqID_16698; Location=118..615; Strand=-
  SCN-specific regions: Sequence locations=1-101,142-381,411-498
atgacaaaaacaaagaacggacgagagacagaaacacagaaccttatgatgtaagtgaacaaattgttccaaaagaatgagtcaatttcagcgatgagaacggggaggacgaggaagaagaagttgcacagcaaaaggagcaaatctgaaaaggaatctttgcacggcaatttcaattggcacaacaattgattaattagggaataataattaatcacttccaccacttaattgacctgacacagacaaagcgagcaaaaagtggttgacgagttgttgtcgcatttcgcaatcgcagaaaatggcaatgttaaacaaattggacaaaatgccgaaaaagctgattgtgagggatgggaagggaaagaagcggtgatatggataaattttaatatttcattttaatttaagtcaaagccccccccccctctccccctaagggttaccttatcggcgcattggcatacactctgtaggcacgttgctcttctgaataaa

SEQ ID NO: 81096 - DNA, 2691 bp, Heterodera glycines
  Genomic contig location: Contig_ID=SeqID_16698; Location=1..2691; Strand=+
  SCN-specific regions: Sequence locations=1-205,235-474,515-798,825 -1164,1187-1367,1402-1513,1535-1666,1689-1794,1817-1937,1964-2691
atattatcaaaaaaatattttaatctctgcagagatctttatgctctgagatgaattccatcgcttcctcctccgatttgtccactgaaagtgatttctctcactgccccgagggcatttattcagaagagcaacgtgcctacagagtgtatgccaatgcgccgataaggtaacccttagggggagagggggggggggctttgacttaaattaaaatgaaatattaaaatttatccatatcaccgcttctttcccttcccatccctcacaatcagctttttcggcattttgtccaatttgtttaacattgccattttctgcgattgcgaaatgcgacaacaactcgtcaaccactttttgctcgctttgtctgtgtcaggtcaattaagtggtggaagtgattaattattattccctaattaatcaattgttgtgccaattgaaattgccgtgcaaagattccttttcagatttgctccttttgctgtgcaacttcttcttcctcgtcctccccgttctcatcgctgaaattgactcattcttttggaacaatttgttcacttacatcataaggttctgtgtttctgtctctcgtccgttctttgtttttgtcatttcttttctgaattgtccattttccttaaggtattcctaccctctcgcgcttaccgttcagacgagtggtacggtatccctcccccaaggcattaattaccgtatttgattttttttaaggcgtttatttgactgttctggtcagtgttcatcgctttctcggtgtttgtcatcccttcaaagtttttaataataaaaaaataaataaacaaattctaaaaatgtaaaaaggctaagcgttgggtgtcacggaaggccgtcgaatgggccatcgtcggctccgtgctgttcagcttttccgtgaacattccgacttggctcgagttgggcgtggtcccgtgttattccacccgtttcaacagaacgtccaggcaaaaaacagcaataaatgcccaagtaatgaatgcctttccccgcctgccattcagccaaattcaattggctcctttccacgacatctcttacattctgatcaaaaagtgcctggtctacacccttctgatgttcatcgtgccgttctccactctgatcacagtcaattggaaaatggtcggatttctttcctctacttttttaaatttatgaatttcaaatcatcgttaggtctgtgcgcttaggtccagcactcggctgaggaccaaacacaccctttcgtccagcaaaccgtcgaacagcgagtggttgggacgaccaaacgcttttaatttgcaaatgtttcagcaacatcgcaaggcaactccatctgctgaagagcacgaggtgaaatgaatgaatggtgaatgaatggattgatgtgaacattctccacactttcgcagatattccgaagtgttcaaagtgatcagcaaaattaattactcgaggtaaacggacaaacaattattaaattgtaatttacaaataagaaacatttgtttatttaaagtaattactaatatttaaatcttcctatcggagggtttgccgttctcaaaactccaaaatattggcgccatctgtggtgtccttactttagggccaccgaaactaaaatggaggggaggaaaattccgaaaaggaccccaaaagggcggtaaaaatggctccatgttggtttgggtcataaattgaaccattcgcccatttcgttcagtttgctgaggccttcttcggaattgttcaagtcgcgcttcacgaactccaccagagaccgttccatcactctgatgcttttggccatcgtcggcctttttttggtgtgcaacggattggcctttctgaacagcattgtcgagtcgatgattctgttcgccgatgacacaaaagtaaaaacaattgacttgttttataaaaaataataattaattatcataattgtactgtactcttagcaatctctgcaaaatacggtggaattgttgaggaattcaagcgaaggagctgaggagcagaaatttgtgcagaatgatgcgaaggaagagatgtggtggatggaactgatggtcaaatggttcgaatgttcggtggaggtaaccccaaaaagcgaagaatgtccgccgatcactgatcagtccacccgtcactttgaggtgtccaatgtgctgatcactttgaattcctccacctcgactttgatatatttggtgttcagttcgaaataccgaatgattgttaaatcaatcgttggcctccaaaagcgggacagagtgggcatattcgatttaagaatatccaaatttatttgaaattgctattttcagtttaatcggatcgcttttaccaccgctctcgctgcccgacgagcgatggaactttcactgattcctgaggtattcgatgtgcctcttaaagagactaattccaaaatcaggaggtcgaaaaccggagccggcaaagtcgaaagcgtacgaccacactgacatcgacggtaaccgcggcacggacccgcgaagggtcgacagcagcgagtttaaaatcgaaccggcacgattcaatgcactcgcagttgcagtacaggctagtgacagagggggagcagttcaaatgagaggaagggaaacggaagagacaaaaatattcgattttcccggaaatgtt

SEQ ID NO: 81097 - DNA, 391 bp, Heterodera glycines
  Genomic contig location: Contig_ID=SeqID_16698; Location=2780..3170; Strand=+
  SCN-specific regions: Sequence locations=1-341,378-391
atgatgagcttttgtagtgggcttcagctgtcgtctattggcgatgccaatagcgcaaattcggcgacggccgtgccaatgtcagcagcgagtcacagacgaacgatgtttaaagggcttcaaaaggggtccaaggagcttttccggtcacagggaacactgaacagatcgatgacaaattcagaatcgaatttgaggtgaaagagaaattttgaaaaaatgggaaaaaatttcagattaatggacgagcaggaaaagcccgagaagagttcagcagaagatgagaggaaaaagaaaatcggggaaacgatggaaatggcggaggcaccgcggcaaaattgttataatttatagtttttatttgttttaaattttatgctttcaatgctta

SEQ ID NO: 81098 - DNA, 537 bp, Heterodera glycines
  Genomic contig location: Contig_ID=SeqID_16700; Location=1371..1907; Strand=+
  SCN-specific regions: Sequence locations=1-156,182-537
gtcgaaactgaaagtgctctcctcctccgccgacttttcttcgttcctttttttggcccttctcttcggtttgatttttaaatattacaaatttcgttgtgtgacatggtgttccgtattctttttcagatttctccttctctcagcccaccattcaacaaaaatccatccaggaattgttgaacacgccgacgttcttaccaactgccgagaaacacgactacttcgtcgccccttttctacaacagcagaaacaacgttggctgtccgtccgacccttccaagaattcagaagaagtccccaaacggccgaccttggactcctgttgcaatatttggacaacaaacggaatgctccgtcgctaatggaagatgagggaaatgggagacacggcataagcgggtcccctctgggcacaatgcgattcggcaagcgaacgttcaactcgccattgggcacaatgcgattcggcaagagggaatacaacaaatctccgcttggcacaatgcgatttgggtgagaaaagtgacgacaga

SEQ ID NO: 81099 - DNA, 3076 bp, Heterodera glycines
  Genomic contig location: Contig_ID=SeqID_16700; Location=1..3076; Strand=-
  SCN-specific regions: Sequence locations=1-75,97-101,123-846,868 -1083,1105-1138,1179-1525,1551-1894,1916-2421,2443-2835,2858 -2965,2987-3076
  Gene Ontology: Biological process=glutamate metabolism
ttcagcaggctttgtcctgctacgtcgtctcaatgtccgcttcgacgatcgtttcaaagtcacaaaacggagggggacaagaaaacaaaacactgcggagactcaccaaaattgactttttatcattttatcttattctaataacgtaattttcagggccaatttacctcccatcagctctttcgctactttgccgacctgagcaaccccgactttgtcacccatttggccatggtccattcccgcttctccacaaatacttaccccagttggagcagggcccaaccgaacagaatggtggcgcacaatggtgaaatcaacacactgagaggtgggcacggcacaaaggaaaattcagcaaattcttttaaaattgccatattctttacattcctcttcccatatcattgtatttgtaacagctttatttacactgatttcaggaaacatcaactttatgaaggccagggaggggacaatgcgaagcagggagtacaaggaggaattgaacaagttataccctgtggtggaaaatgaaatgaccgattcgggtgaggagccattcattggctgtgacttcaatgaattggcctctcacgatggaattgtttagggtgttttgacaatgtgctcgaatttctcgtcagagcaggcaatcggacgttgcccgaagctgcgatgacgatggtgccggaggcatgggagaaagacgaggacatgaggtgggcaattggttgaccaatggacacactcattcctactttagtcatgaaaaacgcatcttctaccggtgggcagcaatgcaaatggagccttgggatggcccgggtgcgttctccaacgcccttttttgtttaatggaaatcactacgaattttcagcacttttggcctttagcgatggccgtttcattggtgccattttggacagaaacggacttcgtcctgcccgttattgtgtgactgcggacgagcacatttatttggccagtgaggtcggcgttaatgacttgcccgtggaaggagtcgtcaaacgcgtgagttgcctcttttctattaaacgtggtgaaactttcttgttgcaaatggtgttcaaatacacattatcatcgttggttattgcattcgttctgcggttggtcctttctctctcttttcttcttcccccattctgtcgtcacttttctcacccaaatcgcattgtgccaagcggagatttgttgtattccctcttgccgaatcgcattgtgcccaatggcgagttgaacgttcgcttgccgaatcgcattgtgcccagaggggacccgcttatgccgtgtctcccatttccctcatcttccattagcgacggagcattccgtttgttgtccaaatattgcaacaggagtccaaggtcggccgtttggggacttcttctgaattcttggaagggtcggacggacagccaacgttgtttctgctgttgtagaaaaggggcgacgaagtagtcgtgtttctcggcagttggtaagaacgtcggcgtgttcaacaattcctggatggatttttgttgaatggtgggctgagagaaggagaaatctgaaaaagaatacggaacaccatgtcacacaacgaaatttgtaatatttaaaaatcaaaccgaagagaagggccaaaaaaaggaacgaagaaaagtcggcggaggaggagagcactttcagtttcgacataacaaatgtttgcattgggaattgagtggcgagttttcttcttgactggcacttttaaatgcagccactcaaattgcgccttctcggacataatgcacttaaatcggctaatgttcgccaaattgacataatatacagcggccgtttctgaccgcccattcgaattttcccttccagcgattcgggtcgtatgctcagttgcactttctaatctgacatggcatttggtgatggtggaaaatatttactcagtgatgtgtgaaattggtaatcccaaaagtgttttgactgcaagaaatgggaaccaccgctgcttcattgtcatctcaacttccacaggaatttgaatttgtcactcctccaagtccattaggaaggaatccaggggatggcggaccactggagaggaaatatgccaaataaacgaatttattaagggattttcacgacgtgccaaaaagggaacaaaatgaaacggtctacaattgctcattatcagcattttcactagaacgtcgttggtttttggttgtggaattttattccttcgtttttcatttttcaaatggattttcgcttcggtatgcttcgtagagaaacgggttgatcaaaaatcctccgccgccatttgatccgccagaaaaacgtttgccgaatcgaagaggctcacgaaagtatggccgtttggccattgggtatgatccaagagtgagttcattttcagttgtttttgaacgatggggaacaccgctaaccatggactggtggaaaagcatggcacactgggaaattataataaatcagaaaataaagataaaaaccatacttgcacaattaacagcaaaatggccaaagtggtattgttggacggcagcatggatttagtcaattaagaaattggagatgaaaaatatgttatcggtggaccaaccttgagatatttagaaaggaatgtgaaagaaagtaaattaacggtaacctgagtgaaaatgcgtggcaaattatgggctctacgaaaacaccaaacaataattggttgagggcttttactacttatttacgatgggaagaaaaggtcaccgggcaatataattagcctccaggggatcattttctgttaattacaactttttcgtgcccaaaattttgaatttgtgtactttgagtttttgtaaatttaatgaatgacttccctcgggaagatttggcattgtttttacgttgaagtcaatcactgccaaacagaatgcgaagcacaaagaagaaaatggcaaaaatgtgttgatgcattgttaaattgagttaattggggcgggacggaatgcaaatgtccgcctcgttggggcaaatctttaacacttttaacga

SEQ ID NO: 81100 - DNA, 154 bp, Heterodera glycines
  Genomic contig location: Contig_ID=SeqID_16702; Location=724..877; Strand=-
  SCN-specific regions: Sequence locations=1-39
atggactttgacggtggcgatggacaacggacggagacggaagaggagaaacgaaagacattggaagcagcaaagcctagagaaaatggaaagggaggaaaagagaaaaaagaaggaaaagagagggaaagggaaaggaggaaaagaagggaag

SEQ ID NO: 81101 - DNA, 372 bp, Heterodera glycines
  Genomic contig location: Contig_ID=SeqID_16702; Location=1..372; Strand=-
  SCN-specific regions: Sequence locations=1-74,96-176,198-372
  Gene Ontology: Mol. function=isovaleryl-CoA dehydrogenase activity; Cellular component=mitochondrial matrix
ggcattttggctgatcaccgctttttccttacattattatgcgctgcttcttcccccgtgtcgtccgaagtgttttcccctcgcccctttccttcgtccgttcctctctctccactttttatcccatcgatgaccaattgttcggtttggacgaggaacaacgacaggtgttcggacttttttctgatagtttctccattccttccgttagcttcgtcaattggtctttcgactcgctcaaaaggaattggccccttttgctgatgaaattgaccgtcaaaatgaattcacaaagcttcgcgatttttggcgattgcttggtcaacaaggcaggaggggggtcacagtgccagcggagtatggcgggtcgga

SEQ ID NO: 81102 - DNA, 646 bp, Heterodera glycines
  Genomic contig location: Contig_ID=SeqID_16702; Location=1067..1712; Strand=+
  SCN-specific regions: Sequence locations=1-77,100-586,608-646
atgcctttccttctcctccctctgaccccatttgaattgccttggcattatttcccttcaggcgccgtcctcgccgagtctgtccacgccctggcgcccgtcccgcccttcagagcatcggtcaaagatggatacgctgtgatcggtcggtttagcagcagcacaattaaacccatgtcgattaagcctatgatggggtgggagcacggcgagttatcgcagcacacacagccaaaatatcagaaggacgctcggcagagaatgcaattggcacgggcgaatgcgtacgaataaccaccggggcaatgggtctgcgcggggctcacttttaatggccttcattaacaaattagtcgctttaagtgcctcggggagctgatgcgattgtgcaagtggaggacacgcgcgtgttgcagcacaatgtgagggcgaattttccaaaaaaattagcgaattgcccaattaattacggaacagaagcgcaccctttaggaagaggaagagctgacggtggacataatgaaggagcctcgggaaggacaggacattcggtgagaaagggaagcaccgatcgggcgaatcgaagtgccacagagagaggggaagcgacgtggcggagggccaacttctgctcggacacggcacg

SEQ ID NO: 81103 - DNA, 1731 bp, Heterodera glycines; identical to SEQ ID NO: 16703
  Genomic contig location: Contig_ID=SeqID_16703; Location=1..1731; Strand=+
  SCN-specific regions: Sequence locations=1-73,95-154,177-656,678 -1346,1368-1731
  Gene Ontology: Biological process=establishment of synaptic specificity at neuromuscular junction

SEQ ID NO: 81104 - DNA, 1595 bp, Heterodera glycines
  Genomic contig location: Contig_ID=SeqID_16704; Location=345..1939; Strand=-
  SCN-specific regions: Sequence locations=1-71,93-136,158-160,195 -351,373-530,555-674,701-927,952-1064,1103-1172,1236-1274,1317 -1427,1468-1595
  Gene Ontology: Mol. function=extracellular matrix structural constituent; Cellular component=membrane; Biological process =skeletal development
ttcccaggatatgtgaataattttgattgatttttattttatttattttccttataatttctctataactaaatgaaaactttttgtttaagctcgtgtaaaaagtattaagccgatctttaaagttataacgagtttaaaaatctctaattttttggggattaaattataatttcattaattatatataaattctgaccaaatataagagattttattcaaaaaactaatttaaaaaattagtaagagaaaggattttgtaaaaaaaaattgatactttgacgggtatgtgatcaaacaatatatcttctccctatttttgggtggtcatatttatggtggtgattatggaattttaaaaattttatatttcagggtgaacccggcgctaccggcctacccggtgtacctggccaagatggtctccctggcgtgccgggtgaaagtggcgagcccgggtacggcttcccgggccagcctggcgtgccgggagaaaagggcgatgccggactccatggaatgcctgggctaaagggggaaaaggggtctcctggtgagacagtggcctgtgatgcagcagattttttttaaaatttcaaacaatttaggaccattgccacttgtggcaccacctggacgacctggccaagacggtctcccagggcttcccggtgccaagggagagcctggtcttccaggatttccaggcatggattttctggaattttcaataaaaaaacaattaatttttttaaaccaattaaggcaatgatggcttatccggcatgccagggctaaaaggacaaaagggcgagcatggatttccgggacagaatggcctcgaaggaccgccaggaatggaaggacaacaaggatttccaggtaatttttttttgaaaattctagaaatgagaattcatccataggtttaattggtccaattaaaaaatccaccaatttactcttattggctaattaaggaaaacaattcatacatattttagttgcttagaaatagactaatttaataagattttccatatatttcacatgagaaaattaatagatatttagaaaatttgtttggtccatttaaaaaagtccgtcaattttctcttaatttagctaattattaagagaaagttatggactttccattctctatgattaacaataataatacattatttatttgtttctttttgaaaattaaaattaagatttaaatttattttccaggaaatcccggtccgcctggaatgccaggctccaagggcgaggcagggtggcctggcgcgcccggcctcaccgggccaaagggtgaggctggcatcgcattcaacgggccaccggggtctcccggcttccctggcataaaaggagaagctggctttccgggaacgcctggactgcccgggctggacgggtaattaaaaaaattatttgaaatttaaaataattaaaaatggatttaattaggcaacctggccagcctggttccccaggagaaaagggtgttggtggcctaccgggtttacctggtgcacctggcttcctcggtgtgaaaggcgagccaggctttggcggaataccag

SEQ ID NO: 81105 - DNA, 1528 bp, Heterodera glycines
  misc_feature (68)..(68): n is a, c, g, or t
  misc_feature (94)..(94): n is a, c, g, or t
  Genomic contig location: Contig_ID=SeqID_16705; Location=1..1528; Strand=-
  SCN-specific regions: Sequence locations=1-120,154-211,234-572,594 -612,634-640,662-708,731-927,955-1285,1308-1422,1475-1528
  Gene Ontology: Mol. function=extracellular matrix structural constituent; Cellular component=extracellular space; Biological process=skeletal development
gcccggccctggtcggctccaaaggagagcctgggccaaggggtaagtcccaaaatttttataaattntaaacgaggcttccctcccctacttntaggcattcctggcatcagcataccaggccttcaaggcagagatggacagcctggaattgacggtattcctggacgaaagggcgaatcaggcttggccggactaagaggcaaagcaaaagcaaaatttaattttaaaaacattgactttgaaaaaacaattaattacctaattaaggacctccgggcgattcgttgaacggtttgcccggcccgccaggcatttctgggccacaagggccaaaggtgtgaacatgtaaaaattcaataattttttcatttttataatgaaacaaattttgcagggttatgacggcagggatggtgcgcccggtttgcctggcattcctggcaccaagggcgatcggggcggtggatgttcaatttgcgcaccgggtgctaagggcgagaagggcaatgccggcttccctggctttcccggccctcaaggtcaattaatattgaatttaagaattatttaaattttgcatgaaaattcttggcataaggagaaaagtgggctattcccccaaataaattttcagctggttttttctcccaaatattttatggaaaatatatttggtaattaagacggatgtccgcccaaaagaccaacaaattaaattattaaaaaaggcttcaacttcaaaccaaagctgagagaaaaatgtttattacaaaaaaaaatttcaaaataggattaaaattcaaaatctttgtttttttccgaaaaatcccaatttcgtctcaatctcgattgaaaatatgaaactttatttatcactgcacaaattagctttgctacactttttgcaaaattataaaattctcgaaaaaaaattattattattttttttttgtattttccaaggttgaaactataaaccctaagggggcggggtattgagaaatcatgcaattttcaaccgagttacttatatatctgaccatctttggccctacaaattttaaattgtgctaattaaggcgatcgtggccatcccggcatggctggcccagctggcgaccctggcgatgacggattgcctggaccaattgggccgcccgggccacccggcgcaccgggctttgacggcattcccgggctgcctggcacaaagtgccattcttttttcaaaattaaaatttttttaatgccaatctttcaggggtgaaccgactcagctggtgctgcgacctggccctcctggataccctggccccaagggtgaggccggcttccctggtttgcctggacttcaaggcccacctggcaaagaaggactgcctggccttcctggtacacctggacaactaggaaaacatgtaaaaatttaaaaaattttatccatctaaaaaatgaaatttaaattattaatcgtttatctatgaaaataattagggtatgaatgggcttgcagtttcgtaaaaca

SEQ ID NO: 81106 - DNA, 580 bp, Heterodera glycines
  Genomic contig location: Contig_ID=SeqID_16706; Location=554..1133; Strand=-
  SCN-specific regions: Sequence locations=1-381,403-471,493-580
gaggccattacggtggttacagtttcgagcaaccaagcattgagcgtgccgaaactgatcaaattgacagcgacaaagacaccagcagcgaggaagcagttatcaatggctccaccacttccacctttggctcatcatcatcaccggctttattctttttttgcattttttataactatcattagttggatttgcgtctttaatgggtgtgaatgtgttgtaaatggtgatggacaatatgaagaagttgagattgagactacttttgatgggatcgatggattaatagatcttccaaatcttgacacattcaactcaaaaaacggtaacaaattacataaaattttatagattagaataaaaagcatacattggaagttaatcaacaaacaaatttaaatttccaaattatgcattttattttaaaattaatgcgatttgttttaaacaatttatctttaatggtttttgagttaagtcctagcatctattcaaatgctgataattttaaggacaaccatttgatggtggaaatgaattagtgtatcacgacgaacaaatggaattggaaccatcattc

SEQ ID NO: 81107 - DNA, 1278 bp, Heterodera glycines; identical to SEQ ID NO: 16707
  misc_feature (1173)..(1173): n is a, c, g, or t
  Genomic contig location: Contig_ID=SeqID_16707; Location=1..1278; Strand=+
  SCN-specific regions: Sequence locations=1-105,133-168,190-302,347 -630,652-820,842-942,972-1034,1078-1091,1114-1278

SEQ ID NO: 81108 - DNA, 924 bp, Heterodera glycines
  Genomic contig location: Contig_ID=SeqID_16708; Location=212..1135; Strand=+
  SCN-specific regions: Sequence locations=1-112,134-264,330-437,519-924
  Gene Ontology: Mol. function=delayed rectifier potassium channel activity; Cellular component=voltage-gated potassium channel complex; Biological process=potassium ion transport
aaaaataaaacaatttccgatgggcctttctcaccgttcgccttttgcgcgttcttcgggtggtacgaattgcaaaattgggccgattcagtccaggtttaaagcatcataaattttaaaatcaaaacataaaaagttggcaaaatgtcttttagggctcgcaaattttgccctgacattgcgcaaaagcaaaaaacagatgcaaatggtcgccattgtgcttctcacgggtaacgaaagtgctcaaaataaaagacaaaaaagtaaatattaaaattaaatttatttttaattaaataaaattaaaaatatttttcaaaatttattttcagtgatcgttttcttttcaactttggtctattttctggagaaggacgagcccaacacaacattcacttcaattcccgccgcattttggtggtcagtggtggcggcacattttaaaattgaaaattttgaaaataattttcatttttcgaattgaaaaatgaaaaataatattttttaataaattaaaagaagagatttatttttgttgctgtgccattccacaattttcctgtcctttttcaggtgtttgttctcccaaacgaaatgggtgccgcagacggcgggtgaatttttgtgccaaaaaaggacttttcttattaattgaaacaattttcagccggcaaaattgttggaggcggcgctatcacttgcggggtgctcgtattggcactgccaattgcgattttggtacagagaaattgaaaacgaagactaaaattgggggggggggggtaattttggataattaccctccaaaagagttaattgcttgtactattaatgatgatgtgggcacaggtgaacaacttcatgcaagtggtccgtttgcgggaggaaaaggtgctcaagcagtacgcgtcaattgccaccgcc

SEQ ID NO: 81109 - DNA, 2410 bp, Heterodera glycines
  Genomic contig location: Contig_ID=SeqID_2692; Location=1674..4083; Strand=+
  SCN-specific regions: Sequence locations=1-483,505-1316,1338 -2007,2031-2260,2282-2382,2404-2410
atggcgggcagaaatcaaggtttaaatgtggggcaaaatcagggaggacgaccaccagaagatggaaggtacaatttgcgggcaagacaaaaccggcgaaattgggctgagttcgaagcagagtacgacgcggaaattgatcgtgagctgcgaattttggaaagaaaccgctcagaaaatttggctgaacaagcaccgaatcagcaaaattcaaggaatttgcggttgaatcagaacagaacgtacgttctggcggcaagaccgccagaggatggaaatcaaggacgtgaagttgccttatggaatcgttttcaattcgaaggagtgcaaaatgagaatgcaaatttggggaggccggtagcgcaatccagttcaatttcggggaatgcaggggtacaaaatcgaattgtaatggatgaaagcccacacatttcgtatgagcataatcctagaaaccgggctggacaagcacatgaaatgagagagagacaaaatatactatacgaagaattactggaaactttggaaagacaagttctaagaaatgaaaatgaatttttgggaggacgagaagtgccggtagagcagcgaaatgagcagagaaatggacgacatgttgaaaacctgcattggtatcatagggcacaggaaaatgagcacgatggccgccacttcgaaagaaacaatcaaatttataagccgcggtatgaaatgaactggagacaagaacagtacacgaattctgaacaagggagaaaccgcagggcatatgatcgatttcaaagtcatgaagaaaattttcccaggccaaaccagtttgagagaaatcttttaatgaatcccatggtaccggtcgagaccaatccaagagctatggataatttggcttttcaaatgtaccgtatgactctggcaacacagtatgcaagtgttctcagggaaataccgacaattgaaggcaccgaagggcgagataagattcaagatttctttttaaccgtggagacgttgttaagtgactgggaacctgacaagcaaattaatgtccttaaaacgagactacgggggaaagcattgaaggcattaaatatggcacttataaaatttggtcccgttcccccctttaatatcctaaaaacggaaataatgtcaactttgagagaaactgactgcagggaggcttcagcttttactgagctcactcaattcgccaaaagaacaatgaatgaggatttaatgagttttggtgaaaaaatctatcgtttggtcaaatgctcatactcgggattaaatgcaactcaaattgacgaaatcgcaaaaaagtttttcattatgaacataaacgacggggaactggcgagatttttggagtgccaaaataaaccggagcaaacatttgatgagattttgatgctggcaaaccgcatacatttggcagaccccgaaaaagtcaaagagagaattgagtctaggatgagaaacgaacaacaaaccagaccatttcagagcagatcaaattggaacagtagaactgagtggaatcctgaccgaaatcgaccaccgaataccggaaacttttggggaaataggaggaatgaatttcgtcgagacaatcaaaatcagaattggagaatccatcaaacgaatcagttctcagggtctaatgccacgccattaaattctgtccaaccgaataggcaaactgctgaaagagctaacccgagaagcacaaactcgatttttcttagacaagaagaaaaacaggtaaaagaagcaacagaagtgaatattggccgtcttggagtatcggagcatgaaaaatttttcgattctctgatccttcatacaaaagcattcccggctgagaacccggccattccccaaatttcggaatgcttaactttgcatttgtctgtgattggagtcacatcgaaggcgcttaccgattccggtgccgaaactgcaattgttaatccgattttcttgcacactttggcgaaggagaaaggtgtaaatttgttggattgtgggtttaacccaaattcgggaaacagcaagttgccatttgaagtttcatcgttcactgacacaaaaattaatgtaattggagtgatcaatgtcccggtacaaatgaaatcggttgagtgtcaaattccttgcctcataacacgtgaaccatttgcctatgaccttattttgggcactacagctctacacaaccttggattttacattggaaatacattatccggggaaatttttaattttccctcacaaaaaacggataaaaaatacggtcaaatgcatgaagttaaagtgcttaattctcattacattccgcctttctcctcccattttgttagtgcttacataaacaattttcattgtttagaaaaagaaaattttctaa

SEQ ID NO: 81110 - DNA, 4253 bp, Heterodera glycines
  Genomic contig location: Contig_ID=SeqID_2692; Location=4163..8415; Strand=+
  SCN-specific regions: Sequence locations=1-48,70-223,245-627,649 -938,960-1985,2007-2350,2372-2468,2490-3191,3215-3372,3394-4253
atgagcggagaggaagagcagttggctttggagaaattgggcgtggtcgaaagtggagacaaagaaaatgctggacggacggacaaaagtgacaaaattgtggtggagactggagtcgtggaggccggggagaaaggtttgttgcacattttggtacataataaatcctctaatacattgatgttggagagtggcgataaaattggtacggcagaagtggttgaaaaaattttcaaacctggaactgaaatcatttctaatgaatttgatggtatttttcggtcaaaaattttgacagtaaacacgaatcaaaaaggaaacaatgaaaaattttctgaattattgtcagtcttgaagcatgatgttggtccgcttaaagaaaatgaacaggagttaattgagaaattttggtcccaattttgtgacgttttggttttgagtgaagcggaattaacccagactgagttagccgagcataaaattgacacgggtgatgcatccccaataaaatgttccccccgcccaattccatttggaattcgtactaaagttactgaaatgttggaggattatttgagtaaaggggtcataaggccgtcaaatagtccttgggctgctccagtggtattggtaaataaaaaagatggaagtctgagaatgtgtgtggactaccgaaaattaaactcggttacccgaaaggacagctatccaattccaaacattgaagaaatgttaatgtatcttggcgagagaaaaattttttcatgccttgatttaatcagtggttactggcaaatcaaagttcaccctgaagacattccaaaaacagcatttgctgtccaaaacggcttgtttgaatttgttgtgatgccatttgggttaagcaatgctcccgcaacctttcaaagagtaatgaacaaagtactggagggtttaataaacaaaagcgtttttgtttatctcgatgacattttggtggccagctcaacattcgaagaacacattcaagatttgagtcaagtttttgaacgaatcagacagtatgggttgaaagtcaaagcaaaaaagtgcaagtttgcgcaactaactgtaccatttttagggcatattctcacaagcgaaggccttaaaaaggaccccgagaaattcatgccaattttggatttcccaagaccaattaccctaaaggaactacagagattccttggcatgctgaattggcaccgaaaatttattaaggattttgccaaaattgcaggaccactaacccgacttatgaaaaaatcggaggatcacaaaaaattgggatggaatgagccagctgaaaacgcatttcaaaccgtgaaaaaactaattgttgaagacgtcgtcctaaaatatccgaatttcgaaatggcagagaaaaacctggattttcgttttcacatttatacagatgcaagtgcaactggactcggcgcagtccattgtcaaaaagacaattccgaaaaaatgcgcccaatttgttatgcatcgcgtcgttgtagtgatgctgagaagaaatacggtccgacagtgcttgaatgtcttggaataaaatttgctgtttcaaaatttaaacattatattgcttggctgcctactgttgtcataactgatcataaagcacttcccgcgatgtttaggtcaaaaaaatcagtagggaatgcaagggttgatcggtggattatggaattgggggcaccattcgaattggaagtgatttattcccccggaaaatttaattatgttgcggatgccctttcacgggcttatcaccctgaaaatgaccaagaaatggacacgaagaagaatcgattaagatttcaaatgtaaatgtccaagagaaacgcccaaaacttccaaacagtgtcactctcgaagaatggattagtgctactgaaaaatcagaattatctttcattatggaatttctttcgaaaagaaaaattccagaagacacaaaactaaaagaaaaattgatcaaatcattggcgaacttcatgctgatggatggagtgctttatcggttaaatggaaaaggggagcccgaaatttttgtaccagaacaatttcgaaaacaattgttcaaagaacatcacatcggaatttgtgcctcgcatcagagcggaaagaaagtttatgggcgtttaaaatcccttggatttttctggcctaatcttctcggagattgtatgcattggacccgttcttgccgtgtttgtgcgcacaaccgaattccaacacggaatcatccaggcttgaaccctatagtcacaattcgtccaaatgaattgttgtgcatggacattttgaaattagggccaacccgaaatggaaataaatatacattaacaatgatagaccattttactcggtttgcggaagcaatcccgattccggacaaaaaagcagaaacagttgcacaaaatctcattgagaaatggatcttaaaatttggggccccggaacggattcacacagatttgggtaccgaattcgtgaacgaaactttaaaagaaatttcagaaaaaatgttaattgctcggtccacaacatcaggttatgatcccgcatgtaacggaatgtgtgaacgtttgaacagatcaattgttgagatgatgagaaaatgcataacatcgccctgggaatgggacacacgaattggatttattgtcttttcatacaatattactccaaatgagtccactgggtttcctccttttactctcttttttgggagaacagccaacttcccgacgaacctcacagtaccaaaacgaccaaatccggtttatttggttgatcacgatgattatcttcagcattttcgagaaaattttgaaaatatcctaaatgaggcaaaacaaaatatggttaaggctcgggagtcccaaaaaacccaatttaatgaaaaatcgcacgtgcgtttgaataagtatgctttgggagagaaagttatggtgttttttcgaccacgagcgcagggtgaacacaaaaaactgtaatggcgttattttggaccatttattatcacacaaatctctcccacttccgcctgggttgtgccaatcgataaaagacacgttgaaccaatgaaagtgccattggaacatttaactcatgtgccaaaagaaatccccgacaaagtgtttttacccaggcaacagcgcaaaaaactcttagaaaacccattttctgatttagtgatcaatgaccagcataacaatcgaattcggattaatccgatcagtttaaaaaattgttataattcagagccgacgccaaacagtgccatttcatggtcgaccgaatgcaacggagaaggacacgccaattgctgccggattacgcttggcaaaatttttaaggatttgccaagcaatgaccctctgcgtcggttgccaatttcaaagctcagcgagctcatctgccttcactttgcctccgatgtcctccatggccaattaagggaatgggcatccaaaaaagacagagaccctacggcactgattcgattcgtctcagagccgcagaggaaaattcgtggaattgaagaaaccatggaaaaatggctgaataactgcagcaaagcttttccagaactgaaggcatcgaaattcaagccgatcattttcgaaattccaccagggccattggaaaaatttggcaccgaaattgcgaaggcattcgagaatatccgcgccgtaaaaattcacggattacaccgaacgatccgaactccgcacatcatcgcaggggacagaacagccgaagaaattggaaagagatgtgaagcggaaataatcctggctgaaaactgcattggattaagtgatttattgggaaagacggcctttggacgggaagtgaaagaagtgattgtatgtgttggcacttccgacttggacattgacactccattggaatggtgtgaaaaggctgtcaaaaaactgctcactcaccttggacaatttgccataaaaatttgggtcgttccgcccccattttatcggcaaaaggctgttaagcatgaagaattcctaaaaatgctggtggagacggtaccaaaagaagacctttgcttaatgaagggatttcggtcaatcattgaagtcacgatgtggggaaatcaagaggagaagcgatatgtggatgagcggggccgattgaaattctcaggtgtcactgcaacacttaagcatttaaaagaagtgttcggtctggaagttccg

SEQ ID NO: 81111 - DNA, 808 bp, Heterodera glycines
  Genomic contig location: Contig_ID=SeqID_16709; Location=779..1586; Strand=+
  SCN-specific regions: Sequence locations=1-808
atgcaatttcttcgtcaacacaaaatttcgcccgaggaaaattggaaagacaatcgcaactttttggtttcattacaaaatggtggatgcgaaagtgagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgcaaagtaagtggaaaggcggaacgtgctttcagcgccgctgcagtgaatcggccggcgaaatttgatgcaatacgaagcgaaatggagtcacttttggacgaatgggattgtaccgcaattcaagcattcaacgaattgtgggatggaccaaaacggcgaccaggcgaaaatctggaagaatttgcagaacgtgtttaccaacttgtgctttgtgcatatccaggtttgccattggatttgtacaacgattatgcggcaaaacacttcattcgtgctttggaaaatgccaaagtttcgattgcattggaaatggctcgtcgtccgggtttgagctacgacagcttggtcgcgttggctgtgcgtgcggaaatagcgcaaaaagccgcaaatttaattgcagaggatgaaaacgcacacatagcacgcagctttaaaccaaataaggcggaaaagacgaccaccgattgggaaaaattttacgtccgaccgacaaataaaaacgtctgttataactgccgtaaaattggccacatcgcgcgaaatt

SEQ ID NO: 81112 - DNA, 372 bp, Heterodera glycines
  Genomic contig location: Contig_ID=SeqID_16711; Location=552..923; Strand=-
  SCN-specific regions: Sequence locations=1-372
gaacgggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaaaaacttcgaaaattctgccttttttgcggttttcaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccg

SEQ ID NO: 81113 - DNA, 248 bp, Heterodera glycines
  Genomic contig location: Contig_ID=SeqID_16712; Location=41..288; Strand=-
  SCN-specific regions: Sequence locations=1-248
atggccgacgtggagcagtcctacatgaccgaggcggaccgccgggcgttggagcgctttcggcgcgctgaacggcgcctgttttccaccgagattgagctggacaaggtgctgttcaccttccaacagtacgacatgctcagacgccgctgggccatggagcaggcacggcaaatgccgcacggcagacggaaaaggaacaagcggcggcggcagctgtggcggcgacaacggcacagtcaccaaac

SEQ ID NO: 81114 - DNA, 2736 bp, Heterodera glycines
  Genomic contig location: Contig_ID=SeqID_16713; Location=196..2931; Strand=+
  SCN-specific regions: Sequence locations=1-89,112-157,179-203,226 -238,260-361,383-552,574-710,784-854,887-1057,1079-1089,1111 -1151,1188-1464,1486-1535,1557-1686,1708-1770,1806-1862,1889 -2120,2142-2215,2238-2252,2279-2297,2334-2584,2674-2736
tttgcactgatcattttgaaccgattttggcacggattggccaattggagaaatgtcgacagaagcaaaatgcacattttgatcaactgaacacctcccaaaaggatcagtgtgaaaaatgggccaaaatggagaacgaaattggtgtgcaatgaatttgcaaataactataaataattatgcgtaataattggcctaattatatgtttaaaagtaaaaataattgctacaaaagtggtaatattttaataataattttgggtttctctcagctgaacacctttcacaactaagaaatgaccacgcgcagcagcaaaaggagttttgttccaaaattgatgaggtgatttttaacacatgcaattaaataataaattaaacagttcgcagccaaagcggatttgaacacaaacccttgtaaaaaaccaaataattgatttcaatcaatgatattacaaactcggattcgtgaatcaactcattttttacccttgaaaaaaatgcgagaatttaactgtttttttctgtttgggcactaattccgaaggattttatttaattatgtattttgttgaaaaatgggttctcgaatttttgtaggaattatttggatttttcgtcgaaacgcgggtaattcagggtgcggatctgttcttatttgtaagaactgttctgattttgggctattgtttttattttgttcttatttcttaaaattattcataaatttagaaatttatagcataaatgttcatattttacaaataaatttttaaaaattttccctgtaagggaaaatgggcaatgattactgtacctaccgtaaccacatttattaggttttaaaaaagatcaatattttttaaaataattcatttattttttagatggtgaggaacggctctcacaattacaaaatgaccataagaaacttccaaaaaatcagtgaattggaaaatcagcaaaaagaacgttcaaaaggcgaggagaaattaaaacctaaacctaattagtttacattaaaattgattgatttttaagccactgcggatcaattttcaaaaattgtggaaaaagtctgtgatttggagaaagaacagaaacagagaatggtaaattaagggtaattttcattaattgagtatttaggcaattttattttaaatttatataaattattattatttcaggcacttttaaatttccgacaaaattgtttggatgtcaaagtttgtcataataatctccaaatcattggcgacaaaaatctcattagtcccccgcctatataggactcttaagaaccaataattaaacttatatagcaagcaggctattctaaatatagggttttgcctaatttattgataaatggggttttactttttgtacgaattcaggtcggtggttttgaattggtcgaagtggggtaatttggtgatcatgaactatttttacgatacctaaattttaattttttttaatgggattacttccgacactaatgaccatatacagtttcgaatattgtaaatattttaactctcctctctttatttctgatcctggattaagaatagttcaaaatgaatgcactataattagcgaccccaaaaatcctccagcatagatgtggcgggcgcttcatggattccaaaaaccccatcgcaaatgtacacgcctaatttttgtcataaaaatattaaacttggaaaatttgtttttttgttacttttctttttttcaaaggcccaagatgagaatcggaagctgaaaaatgaacaaaagaaaatggaggagaaggtggacaaattggaggagcaattgaaaaaaaaatggaggcggtgggatcaatcacttgcaaaaattcaaaaataaaatttttgccacaatattttaatgctttagaataacacttttttataataaaaaaatcctttaatttcagcaaaaggcattccaaaaagaatttaagaaaatggtcatggaacgaattgtaacagttcaaacgaaggttgaagcaatggaaaaggaacatcaacagcaaaatggtaatggaacttatttgttagcaacgattactgtacctgccgtaacattattattactacggtcaactatttttaattgagtttgttttaattttagcaacttcggaccaattttcacaaatgcaaaatgatcaaaagattctattggaaaaaatcagtgaattggagaaagaacagaagcagagaaaggtgaattgggggtaaaaatatttattttataataatatcgttaattgggtcttaaacattttattttaaataattttatatgaattattttaaggcacttttaaattttcggcgaaattattgggatgccaatatttgtcatgagaatctccaaatcattggcaacaaaagtctaactgtgcatttataagggaaattattcaggcattttttatatcaatttactacatgatttcacctaaaaaggtttataaaattccgtctttgctgaacatccgattctgctgaaccaggattcattaaacattttttactatgaaatttcagtcaaaaaattggttaggtataaattttttcaatatcaaattatcataataaatataaaattaaattttgttaaaattgttattcctttattattaattttatttttcagtttgttcaactttggattcgcaatcaaacaacagacaaaattggatggactaatttatga

SEQ ID NO: 81115 - DNA, 70 bp, Heterodera glycines
  Genomic contig location: Contig_ID=SeqID_16714; Location=420..489; Strand=+
  SCN-specific regions: Sequence locations=1-70
attattttcatcttcgcattggttagcatcgattgacacattttaatttgaataaagcttggtttggatt

SEQ ID NO: 81116 - DNA, 1063 bp, Heterodera glycines
  Genomic contig location: Contig_ID=SeqID_16715; Location=61..1123; Strand=+
  SCN-specific regions: Sequence locations=1-672,694-945,967-1001,1023 -1063
atggacaaaacgccaaaaaagcaaaaaacagagtgccaaaaaggcaaaaaagacaatgaccatcaaagggatggaagcgaattcggtggagcagctgaaaagcataatacggaagagaacagcggacggacaaagggagcggaggaggggacgaagtgccaaaacagcactgatggaaaacattgccaagctgcgcaggatccaacacttcttcgagatggtcgaacactgcaaccgccacttgggccgaatgggcgaggccaactcagagtgagtccgacgccgatcaaatcgatctacagatgctttcactttcccctgctgttcagttttatctcccaattgcctgctaatggtgccggtgatccatcggctgatctctcagtccaatcagttcgctttttgtcccatccctcccaattggactctctggcggatgaattgcagcgcatcctccacaatttcaccttccaatctttgcccatcctttctccacgtattctctcacttctccccgaggccaaaacggcggacgacggaccaaaactgttgtcgccgacgctgttcagctttcacaacgagggcattttctcattgccctctctttttggggtgggcaaagataattaggctaattgatcaatcagcaattccctatcaaatcgaatttaaagattttaataattgtcatgaatgctgagctaacacacaaatcttgtccattcagttgatctctacaaatgagtccgatttggttgagcttttggatttgatcatggatttggccggtgcctcgcgagtgttggacaaaatcgaggctcaaattgcccctcgacagtccattgttgagaaagagctttacccgaatgttttaaaactcgaaaagatggaacggaaatggcaaatggtcagcaaaacgttttcggaagaacaaaaaaggcatttgagagagtttgggtacactctgatgagggacagccaattccgaagtttatacggacgtacgaagaaaggtgaaacaaaaagggagaaccttttgggaaggaaatccgaacagatttaa

SEQ ID NO: 81117 - DNA, 1515 bp, Heterodera glycines
  Genomic contig location: Contig_ID=SeqID_16716; Location=584..2098; Strand=-
  SCN-specific regions: Sequence locations=1-269,344-360,395-425,447 -485,544-715,803-1192,1214-1339,1361-1386,1415-1515
atgccactcatcagacggaaaatcaatgctgcggtgaaaaagtaaattcaataataccgtatcactaggtttggtacggtcattcaagaaacgatttaagtgccaatatatgtcaaaatgttcaaattcaagatggcctacacgatgaaactgaatgagtcgtgtgcaattcttggcaaaaagttcgattgttcatttgcgtggcttttggagcggtacaaactgtcggacaaatacgcaatcaaagcgaacaatcaggtaaaatacacaattaaattttaataattcatcaaaataataaaaatacttctctttaattgtaatatttatttaatttaataatccatttcaacagttatcatttctaataacttttttcttttcattttcaattactattccattttgagtgttttgtgcaaaaacctttctttttatttttcattaattattgcaaatgcaattagtaataaaacgaatcattcattttttaatatttaataattaagaaaaattataaaaataattttatttgtaaaaattcaggtcaaattccccggacatccaaaatgtgtctttttgacagccgccagtgccaattatttcccatctcttcggatgctaatcgcgaacataaaagagcattttggatgcaaccaaaaaataattgcttacgatttgggaaatgtgacgaaaaacagcgaatgggtaaaagaaattttaattaattttatatttttttataaggtaattttttattcataaattatgcaaaaaaattaattgaagattaattttaattggtttgaagatggctgagttgaattcggtgtgcaatttggaattgcgaaacttcgatttttcccaaatggttgctggccgagtgcgccacataaaaagtttcgcatggaaaatttttgtcatggcggtaattttaaaagaaaactgcaaagtttctaacaaatattttaggatgttttgttggaatatgacactgtcatttgggtggacacgtcaattttctttggcagtgacaatttggcaacaattttgaagccgcttcaaaatgggaaaattggcccagtccaattaatgagcagtaagtttaaatggacaatttttaattgtttattttttgaaaaattgttttttaagatactggtcacggcaaaaacattgcgacgcacccgggtaattattaaaattattttaagttcaaaagcataactaatcacaatttgccagggatgtaccaatatttgccaatggcggcaaattttttgcccaacaaaacatacggattgttagggaatgatccgcaacaattcgaggccggctttgttattctgcagaaaatggaacagacgcggcaactgatgaaatggcataatttaaattactaatttaaaaaaatgaaaatgccattattataaaaatgaattttaccccgagtcggtgccgggattggtcggggtttaaagctgcgggtgtccctgttctgcttttcaaattaaa

SEQ ID NO: 81118 - DNA, 539 bp, Heterodera glycines
  misc_feature (437)..(437): n is a, c, g, or t
  misc_feature (489)..(489): n is a, c, g, or t
  Genomic contig location: Contig_ID=SeqID_16716; Location=3440..3978; Strand=+
  SCN-specific regions: Sequence locations=1-278,339-399,422-539
atgacatttcgagtcgataaaaagtgagatcctacgaattaaaaatgccaactatgaatttttaattatgtctatttttgcatatctcacgcgaaaggacattgtgcgcctgtacaacagggctggacgtaactggattttcaattacggaatacgtcattcgtaattacgtccagccctgctttacaagtgcttccatcagttggactcgcggcgcatggggctgacaaatatgcaatgtgcggacaaacccaaacggtagataggtacaatgtttcttaataatattctttaaaattttttactcgtttaattttcaatttattaaattttataatcttgatattattcgatatccctaagtgttttttatttaatggcctgcaactgggcatcttaaacaaaatatataaattccaaatatacggaaattttanacaattatcattacgcttgcgtaaaaattaaatcctaaataatagtaaattncgaaatgttttacttttacattaccgattgatcgttatagaaaactctaa

SEQ ID NO: 81119 - DNA, 1595 bp, Heterodera glycines
  Genomic contig location: Contig_ID=SeqID_16717; Location=574..2168; Strand=-
  SCN-specific regions: Sequence locations=1-200,225-338,389-940,962 -1486,1509-1595
atgtcttcagaaattctgtacgtttagagtgtttctgttcttttttctgattttccaaatttcttttgctcaatttttgaccagcagaattgggagaaaaaaaaattcaaaaccaattttcaaggcttagagagcttcatctacctcaaaaaagatttttaaaaaaagctaaaattcacttttggattccctcgctttgcttttccctttcattcattcatttacccaatttatttttcagttggcgtgccgtgcttctgctgttggttgattgtgccagcattctttggttctttttggaccatgtcaaaaaacgacgacgccctcgcaaagaaatgtaaaaaattattttaaaaaatttgagaattttataaaatctttaatttttcagctttatctctgccgattgttggcttttggtgttcgatttccttgcgccttctcaacttggccttggaattgcacttatcagccgtcgatttgacctcagagtggacgaacatttcaaaacgcgcaaatggaaattgaacaaacaattgctaattcactcgaaaatcgtaggaaatggcaccaagcaaatgcaaattgtcaattccgatggaaatccattgccaatcccgcgaaatccgttgccgaaaaaagtcatcggattcaccggatgcattcagatcatgtaaaaatagatgaaattggaatttgattcgtgtgaccatcatattttctgcacttttcagttacatcgatcaaaatgttgtcgcatttctccaccgttttcgccgtcttttgggcatttgtggaatctatttggacattagcacgggcaatgatcgcattttggactactttttgctccaaatttggccaatgttccgcgattccatgcatctgatgcttttggacaccatcacttttcgccgtttccgtcaattggccccgtcaatgctcagcaattgtctgtctcttcgctatgtcgtttttaatgacgaaattgtgctcgcttttccgcccgatgacagtgccatggcgtcggatggccaagcggtggccaaatggttgtacacgcctcttccgaacggggtgccgaagtggctcaaatgctatgttaaatcatcggtggatcaatggtcgtcaacgatggaacagctgaaaaaggtggattatccccccccccctttttaatggctttttccatatatgtttttattcggcccatttttaggcattttccaatgcttcttcgccagtgactttccgcattcgcttgaaatcttcaactgtaattgactccgttgttccatttgatcggatcaacgaagtgactggggagcaattgacacttgaacaatatgcaaatggtttttggctcagccgttgtccaattgaatgggatgagaggaactggcacaatgtgcagcatgaactgcttaatccgccgaatccaattcactttctgatcagagacggcggatttgatgacgggtgaacaattttattatttttgtttgtttccaattagacgttgagtccaactaactataattacggtttattttgatttgatttgagaaaattatggtacgaaaaaaattattaaa

SEQ ID NO: 81120 - DNA, 961 bp, Heterodera glycines
  misc_feature (932)..(932): n is a, c, g, or t
  Genomic contig location: Contig_ID=SeqID_16720; Location=78..1038; Strand=-
  SCN-specific regions: Sequence locations=1-961
atggccttcgttgagttgggcgtgcgccttttcctctgcggcgatgtgatggccggcagaggcgtcgatcagatccttccccacccatcggagtcgcatttgtacgagggatttgtgaacgatgccaacgattacgtgcggttggccgaacgccactcggggccaatgccacaaaagtgggcattctaaagctaatggatgaaaattaagcgaccgttcgatgagttaacgatcaaaagactgaattgcaattgctaatgactaaatatgcggacatcttagtgaatttctgttcttccgttgcagaagggacttcgactacccctggggcgatgccttgccaattttggacgaatggaagccgctcgtccgaatcatcaatttggagacatcagtgaccaccagcgaagacaagtgattgattttgagtgttcttcgtccattgcccttttttgctttgtcagttggccccgcaaaggcattaattaccgaatgcatccggacaatgtgccctttttgaccagtgctcgcatcgattgctgcgtgttggccaataaccacgtgctcgactggggccacaaaggtgggcgcgagtcggtcgtggaattattggcattttcttgtttttatttgactgtcatccatttaaaatccctcaggtcttgccgaaactgtttccgttctgcgccaagtcggcattcgaactgtcggcgccggacgcaatgaattggagacggacgcgcccgcagcgattgaaattgggcaagggcgacgcgtgttggtgttcgcctggggcgacgacagcagcggtgtgccttcgtcgtgggcggccgctgggactcgcggaggggtcaactttctacacgacggaatttcgacaaaaagtgcggaagaaatcgcacgaaaaattggaaaagtaagggcgaaaaggngacggaggagaagccatttaccaaataaa

SEQ ID NO: 81121 - DNA, 123 bp, Heterodera glycines
  Genomic contig location: Contig_ID=SeqID_16723; Location=8..130; Strand=-
  SCN-specific regions: Sequence locations=1-123
atgagaatgtcattttttaaacaattctacgagacaaatactggcctcctatcagttagacaaaatatgaacgtttgttgtccaattgagagcgctttcggaaatgataattgcttgaaccag

SEQ ID NO: 81122 - DNA, 799 bp, Heterodera glycines
  Genomic contig location: Contig_ID=SeqID_16723; Location=1638..2436; Strand=+
  SCN-specific regions: Sequence locations=1-29,127-138,169-262,336 -369,460-539,561-755,777-799
  Gene Ontology: Biological process=N-linked glycosylation
atgaatgcacgagagattggaaaacaacagaaaatgtacaaagaaaggtgaaaaatttaaaattatttatgaaataatttaaacgattcgaaataataattttataaataattgaattaataattagaaagcaaagttaaaaagaatttttcctttttcaaaatatttgaggtgtattcagttgactttaatttcatttttttcagtctgtcaaagttcgcatttgagccaatttgcccaattatttgcgatggcaccgatggaaaagagaaagaaaaaaaggaaacgaaagaaacggaaaaagaggaaaaagaagaaaaaagagagaaaaagaatgaacaatcggaggagaagcagaaaaattcaaccgaaaggcaaaacgaaggacaaaaggaagagacggacagagagaaaaaagcggagaaagaaaaggcaaaaaagggaaaagagaaaaagaaaccccagaggggagggagcaattaaagcaacaaaaaacaatcaaatgacggaatccattttctgggacaagcgagcgacctaagaatttttcatgaatttgaatcagtgaagagagggaatcccattcactcgctttaccgattgaaatattacatttattcttaacacctatatataagcatgcttatgttgatgtgaagtaagaagtgtttttttgacaaatgccaatggttcaggacgtggaaaagcaaagaattgccaaaattttttggacactttgatggaggcactggcgggaatggaaaatggcaaaaattcaatcaaattgccgaagaaagta

SEQ ID NO: 81123 - DNA, 1366 bp, Heterodera glycines
  Genomic contig location: Contig_ID=SeqID_2694; Location=785..2150; Strand=+
  SCN-specific regions: Sequence locations=1-739,761-1036,1058 -1307,1331-1333,1364-1366
atgacttggcccaactttttgctgcccgtctttctctcctccgttttaatgtgcgcatgttgggccgtcggccatttccaattgtccttcctttggattgtcctcttcaccgttctttatgtggtcggttttgtcgtttttcgtctcgtcacttttttccccacttattttgccccgacggattttcccttttttcgttttgtttttgacttatttattttgaaagaatcgattttcgcgtgctgctgcaaatatttcccctcgcattttcccctctgtcactaattaatattgatgcgatttttaggttttaactaaattttttgctcaattgatttgaagaaaggagctaaaaaaacgcatttctgcattaaaaattttcgattctgatgtcactatcggtcactagaaatcgctattttgggggtcggggccattttggcgcagacaagtttaaagattcataacttcgaccaaataaaataatgttgatattaatcaataggtctaaatgttccttattagtctgcaaaatttcaaaaaattatattgggttttaaaaaagatatggcgcgctgcgccaaaatggccaggaaaatgcaattttttgaggttttttggccataacttttttgtttctcagctaaattttttgaaactttgcaggttaataggcactatcagtagttaaccccccgggaccgtaacaagcttggttgaccatccctttgaagcatgcgccgcggtgggaggggtggggctaattaaaatattaattgaggtaattaattagtgaaggcagattggggacagtaagtagatagttttagtggaggcagagtgagagaggaggcatcgatttgaaaatagtgtttgaactattgatgagttaagtattgatcgctctgttattgctgagattttgacttgcagtgctatttaattaaccattggacagtggagatgaatgaatggcaaatcagcataacatagaagaaatttttagtcaatcccaaagagtctgttctaattttttgtcattattaattttattatagctcttatcgtaaggagattgttcaaattttcttgctaattggactaggtctcagattacgaggtgtatgggtgcttctcactcaaattgttatccctattgagatctggagtagaattattaatatcaagcatagaatggcaactcatacataattttacagtataaactaagccaatgcccaaggaagcataatcctaggccaaagctttagccattaccaccacaatcgaaagcttgcaatcaatgtttaaaaagggtgttggtttgtttcagttttataaaatcaatattttattattattacta

SEQ ID NO: 81124 - DNA, 4292 bp, Heterodera glycines
  Genomic contig location: Contig_ID=SeqID_2695; Location=1305..5596; Strand=+
  SCN-specific regions: Sequence locations=1-207,229-332,354-426,449 -1038,1060-1246,1268-1756,1779-2446,2468-2751,2774-3174,3196 -3249,3271-3738,3761-3987,4009-4109,4131-4266,4288-4292
atggaaagccactcaactaaacactcttctaactcccctattgaccatattctccccaaaaagccacgacaagggatcgttcaacaaggagaaggagggacagaatcttcaaaaagagatgcagaagcttacgtgaagaagttatacagctccattgaacatgtggtcaaataccattacgccaaagtcaaatcgcagttcagcattgaggatgtccccgctgatcccgagggtcttttggttggaatatttcaatattgcatagataacggaataaaggatagccgtgagcgtgggattgagcctactcatgttggatgtgtgataagcagctctctgttggatggtggagacatcccaattcccttacggaaaatcaacgacaacacaataaactccatccttaatctgtttctcaaggtggcacaaagtaaacaacagcaaaaagttacgctatggggtgagcctttcatggtgactataacaacagttgatcgttatgggcttccatctaaacgacatgtcaaagggggccaacgacggaagctcgcgactgtgcgacatcaaattaacgatcaatgcttgataaaaataagtaatccagatgacttaaactactgtttgttttacgctctccaagcaacaatggttgctaaaacgcgaggatggccccgaatgaagtttcaccgctatttgaataacaaacacggacaaaagggacaacttcaatgtgacacggttcaactcatgcaacaaattgaagccccaatgaatttggagggttatgatgcagagactttcgttccacgtgttgtgaatcattggaaccaggcacaacagcagcatcgttttgcagtgttcatcttcggctcttcgggacagtacaaaccactctacaaatacattgacaacagctacgatacaccactcctcttgtactacagcaataaccattttgatggtgtccagaagcagggtggattgttcgggaaaccatattgcttggagtgtgaacgaccatatgataaagcatcggaacacagcaaatcttgtaaagcccgctgcgtgttgtgctcaaggatgggtcctgaatttccatgttcttcgactcccggattctataaggaatgctccggctgttataaaagattccgaaacaacgattgttaccattaccatcttcattcaaacttctgcatgcggtcaaagaagtgcaaaaactgtggtgttatctgggacgttttggacaacaacaagaaagggagaaaaggacatcaatgtggcgaaaacttctgtcgtctttgcaataattatcacaacaccgaaagaggctgctttattcaaccgtttgagcctaaacaacagaacgttccctatcgcatcgttgcgttcgacctggaaacgatgcagcaccaagcgatggacccccgtcagccagagaagaaacaacatcagcctaacttcatcgcagcgagagttgcgtgccccgattgcatagacaatggcaaaagaaataaggcgacagcggtctgccagatctgcggaccatatcgtaccgtcgccttctgccaacgccgattcatggacacacaagtgaataaacaagtggtgacagagaacccactgaaggcatttgtggactggctagtctttcaacttccaaagaaatacgacacctatgcctattcacattttggaggacgcttcgatatggtgcttgtcttccgcgagctcttccggattggctttaacccaaacatgctaagaaaaggaaacaagctttatgagatgaaggtgcaccagaagaaaaatagtaaccccaacataatttttcgcgactcgtataatttgatgccctgctcattgggtgagcttataccatcatacggtttggatgtcgacgacaagccgttcttcccacatttggctaacagacccgaaaactatggccgtgagatatttccaactcccaatgactacttggctagcggaatgatgccagagaagagaaaaaagtttgatgaatggtacgccgagcaccgccacgagccatttcttttggatgaagcgctagcaagctattgtaccaacgacgttgaaattttaatggcagctctggtggcatttcgacgcgaattcttcgaagtgtcacgaagaaatgaaggaattgtcgcgaaacgcgctgcttcagatgagcatcacaatggtatcgacgttctgagagagtgtatgacaattgctggagcctgtatgcgtcacttccgcatgaatcatcttccttccgggcacttggcaattgttccagaacggggatatgacaatgcacaaaatcaaagcgagctctctcggcgtttcttacattggtacatggaacaacacaaagtccaagtgcgaatggccaactcacctggcggagagaaaagaattggacaatactttgtcgatggatgggtggaggcagagagaagagcaatcgaagtaaatggatgtgtatggcatgcatgcacagcttgttatcccgacgatgagatgctgatgccaaacggaaagacagccggagcagtgagggagcgcaatgtcaaaaggatggaattcatacggaaccaagttgacaaattggatgtgtattgggaatgcgagattgagcgcatgttggcgaaagataaacaaatgaagatgagatttgaagaatacccagatgatggaccgctgagaattcgcgacgcttttatgggaggaagaacgggaccattgaaactacttcataatgtgggcgcggatgaaaaaatttcttactttgacttcacttctctctacccttacatcaactgcactactcgttacccggtgggtcatcccaaagtgcacgtgctcaattttgaagtggagtggagaagtgccgcggacaacccatacccattggcgctgctcaaagtgtgggtcgtgccgccacgacaaatcgatgtgcccgttctaccggtgaaagtggatgaccgactgtgctttcctctgtgcatcgcctgtgccaaagaatatccaactggaggcgtggacaacgactaccactgtcagcacactgatcaacaacgcggatgggtcagcacctgcacatcgattgagctcaacgtcgcgctcgacgagggttaccgcgtcacgagggtgttccgcgttctggagtacgaacagagcgacgacaagctattccgcccctacattgcggaattcatggctcaaaaaatccaggctagcggctttgacagcagcatcagagggaatgcggagaaggaacaacagtttgtccgagagtgtgccgaacagttcgacatcacgatcgatccaacaaaaatggccgccaataagggaaagcgatcgatagcaaagctttgtcttaacaatttgtggggccgattttctttgcgcaattacggcttgtcgcaaacattaataacggatgacccagctgttctaggagactttttggataatcgctcaatcgacgtcatgactatagatgaactcgaagaagaacatattttgatcacctacgaaaaaaagaaggagtgggtgactgagcatggatgctcaaatattgttatttcgttgtggacaacttcggctgcgcgtttattgttgctcaaggctatgcagaaagtagtgagatcgtggggatgtcaacttctctacaccgacaccgacagtcttgttttatcacatccacttgatttttgccctctcaagacgggacaacaccttggcgaattcaccgatgagtaccccgaccatgaaatacgtgagttctgcagtggtggagccaaacaatatggattagtgcttcggcgcaaaaacacttcatctgatgcagaattggaatatgtactgaaagtccgaggaatgacgctgaattacgacgtcattaacaatcaaggtctccgctatgagacgttcaaacaacaggtgatgcgttatgcgagaactggagagattgagcagataaggatcgaatacccaaactttcttcaaccaaatattcgaagtggtggatcagtgacatcgactcaaatgcaaaaatgttaccgtccatatgttgggaagggaattataggcaacgatttcaatgtgaagaattttggccacactttgtaatgtttttgttttctgatgtatctctctttctcatcaatacaccataaattgtctctctttctctctttgtttctctcacacgtacacacatgtgctcttttatctaaattatgtaatttatcatattttgttattttgtttaatattaa

SEQ ID NO: 81125 - DNA, 684 bp, Heterodera glycines
  Genomic contig location: Contig_ID=SeqID_16724; Location=7..690; Strand=+
  SCN-specific regions: Sequence locations=1-232,254-451,481-643,675-684
atgattttgtggcatttcttaatttttatatttttcattgcttttgaaattgaatccggcataatccgaccaaattttgatgagatattcggcaacgaatgggacaaaaatcaaaatgaagggaaagtgatcagaattgagcaaaatgaacgaaacgagaacttacaatcagcagcagttgatcaaattggtgaagaaatggggacagacccaattgatcaaatgagtgaatattccaatcaaaatgttatgaagaaaagtgatcaaaatacgaaaatgaaaccaaatgatcaacagaaaagagaaacaattcaaagatatgaagcaattaaagaaaagttgaagcaaaaaggaaaattacaaaacaaagacagagtaaaaattgaaaggaaaattggaaaattattaggcgcaagtcgcgacaaaatatataaatggaaaaaaagaaatgaatttaaataaaaaacaaattaaaatattgaaaagaagttttatgaacagaaaaagaaagaattcaatgaacgatttgatgaatttaaaagtttatatggccaaggcaaacagaaagcatttgtgaaggaattgggcattgataaaaagacatttataaattggaaaaaggaattgctgccaaattatcataaaactaagagattttttaaaaaataaaggaatattttgaaa

SEQ ID NO: 81126 - DNA, 208 bp, Heterodera glycines
  Genomic contig location: Contig_ID=SeqID_16724; Location=1716..1923; Strand=+
  SCN-specific regions: Sequence locations=1-208
atgcgcaagggcgaggcgatgaccatgtcatgcgtgtcggggtgagtaattaggagaatttaattgaataattcaaacatttcacagtgtttcttcgcccgcttcggtggtcacttggcaattgaacggttcgccaacaaaaattcaaccgcaggagcaaaaaaagcaattgcaggtgtctgacatttacaaatatttgtggatataa

SEQ ID NO: 81127 - DNA, 282 bp, Heterodera glycines
  Genomic contig location: Contig_ID=SeqID_16725; Location=1497..1778; Strand=-
  SCN-specific regions: Sequence locations=1-18,40-47,72-172,195-282
atggaaaacacgtggggattcccaaatttcatttcttttgcggtgagtaattaattataatttaaataaatgcattttgaatttaattttaagcatttgatggacccggacaaaggcttttacaacaaagaagaggacaaaattgctttggccattgatttaacagtgacagaagaaaaaacggaaaacccataaacaatcgagaaattttcggaatgaaaccacttttacgtactctattttatctttttggcacaaattcagatttttgtacatattaaa

SEQ ID NO: 81128 - DNA, 903 bp, Heterodera glycines
  Genomic contig location: Contig_ID=SeqID_16726; Location=921..1823; Strand=+
  SCN-specific regions: Sequence locations=1-703,736-903
atggccaccgtttggagcaaattcgcttctcagctcagtaagtgcctttccttctctcttctgttggcttttatttttgtttttttgccatcacttttcgcccttttcaccttttaaaggttcttggctgtcggaaatgccttcggaaaagcgaaggggtcgcgccgagacgaggccaaacggtggggacggagttgcgggggtgcgcaattcgcggtcacttagcgcactcagccgacggcacaatttggtcagaacgtcaaaaagctcggagaatttgcaccgaatcagcctattgtcgacagcgacgacaattggcaatggacaacagagacaaaaggtcgaaaaatggaaggaaaatgaacgaaaatgagaaccaatggacagcgcaaatcatcaaaagataacaatttgtgtttcagccatttttggcacaattcggactcaatgggccaaatgcccattccgaggaggggtcggtgccgtgccaaaacagccgaaagggatcggtcgaaggccaccaaagtccattaacaccggcaaggacgaagacgaggcgatttccattttttggcaaagaaaacgaaacgacggcagcgccggggggagagggcgaaagcggatattcaagcggaagttcgtcgagaaggtgtgcctagtccaaattatgctctgatttgccaataatcactattaccctcctattttctcctctgactgtttcctcaccaatccatactaattgactccccaccatccaattatcgtcctctctattaactaattgcttcaggaaaaagtccaacggtcgcttcgttccttgcgcttcgtcttcctcggcatttttcctcaatttaaacgcgcggcacaaaagcaatgagcggcaaaggcaacaaaattcaa

SEQ ID NO: 81129 - DNA, 2321 bp, Heterodera glycines
  Genomic contig location: Contig_ID=SeqID_16727; Location=64..2384; Strand=-
  SCN-specific regions: Sequence locations=1-399,421-642,664-1362,1385 -2321
atggcactcaaatcaatcaacagtgcttctcttataaagataaaagtcctgctgaacggaaggatcgtgaagtttattctcgactccggggcagagatcaatgtcatcgatgaggaaacttatcgactgatcggacagccaaaaatttgggaatgtgccgaaagaggcagaatgttcgacgggacagaaaaatcttttatcggaaagggagaaggacacttcgaattccaaggcgtaaaagttaaagaaaatttttatgtcgccgagaagggatcgatgaatctgttgagtgtccaaacaatggatgcatttggactgttggatggcattaaagccaaaatcaactctccgataaatctttgcagcgcagggaaagaatcgagaggcaaaaatgccccgatcaaatccaacaaagctgacggcacgccaaataaggacgccgaaaaacaaatcagtcagctaaagcaggagtacaccaatgtctttaaaaatgaattgggactctgcacaaaggtcaaagcgcatttagaattgaaacccgacgcacagccaatatacagaaaggctcgtccggtcccgtacaacgccaaaaatgcagttgacggagaattggatcgttgggagaaaatgggagtcatcggcaaagttgagcacacagaatgggcagcaccgattttggtcgtcaaaaaggccgatggtaacgctcgactgtgcatcgactattcaaccggactcaacaatgcgctaaaagaccaccagcacccgttaccattaccggaagacatttttgccaccttaaatggaggccagtacttttcacaaattgatctccgggatgcgtatcttcaagtggagctggacgaagcatcgaaaaagctgtgtgccattgccacccatagaggaaattatgaagtcaaaagacttccctttggcatcaaaacagctcctggcattttccagtcgataatggaccaaatgttggcagattttgacttcgcgacagcctacctagacgacatcatcatcgtcagcaaggaccaaaaaaaacattctgaacatttgaaaaagatgttctcgcgatttcaagaatggggatttcgcgtcaaacgagaaaaatgttcgtttttccaagatgaaattaaatatctcggacaaataatcgacaaaaacggacgcagacccgaccccagcaaaatcaccgccatcaatgagatgccagaaccgacggatgtctcttcacttcgatcatatttgggaatggtaaaccattaccaacaattcatcaaaaacatgcgcttcgtcagaaagccgcttgatgatttgctaaaaaaggacaccgaatggaattggagcgacaaatgcaaaaaggcatttgacaaaatcaaagaaattttgtcatccaaattgctgctcacgcactatgaccctcaaaaagagatcgtagtagcagcagatgcttctgatcagggaattggagcagtgatttcgcacaaattcccggacggaacgatgaaagccattgcgcatgtatcttccgctttaactcctgccgagaagaactactcacaaattgagaaggaagcactagcaataatttttgcagtgcagaaatttcacaaaatgatctatggacgtaaatttacgctcctaactgatcataagcctcttctcgccatcttcggcaacaaaaaaggagtgcggcaatgcagtgccaatcggctgctccgatggtcactcattctcttggcatacgactttaacattgagtatgtcaataccaacgacttcggccaagctgatgcactttcacggctaattgccaaaggaaaagatgcggaagaccgcgtcatcgcaaatacttcggtcgattcggaggtagaatcgattttcattggaaccgtcgagaagcttcccatcaaattcgatgacattgtccagtcgtcgaaaagtgatcagaacatcaaaaaggtcatgaaattcattagaaatggctggccacaaaatattggcaacgaaaatgtggaaatcagaattttccaccaaaggaaggaacaactcagcatcaccaaagattgtttgatgtatgctgaaagagttgtgattccaacgcaacaccgagccaaaattctgcaactgctccacaaaggacatcctggaatgaaaaggatgaagcagttggctcgtgaatatgcatactggccgaaaatggaccaggaaattgaacaatttgttgaaaattgtcaaccatgccaaaatgaggcaaaggcgccaaccaaaacgaatttgcaatcttggccaagacaaatggaccgtggcagaga

SEQ ID NO: 81130 - DNA, 888 bp, Heterodera glycines
  Genomic contig location: Contig_ID=SeqID_16730; Location=415..1302; Strand=-
  SCN-specific regions: Sequence locations=1-124,146-190,222-888
tccgtcttcaacatcgtcgtatgcattgtctcttacgccattcccttcgccggctttctttattggtactcttccgtccctttttttctgtggcgaaaaaaggagcatctgatggcgagtcagcagagcagcagcaccacagggacatcgagaaggtgagagagcggcaagagaagcaaagaaaagggaaagaaagacagacggacagacagacagagagagggcaattagcggggcggaaaagcccttccgggtacaattaattgccatttacacaatgggagggcggcaaacggcacgaaactatgcccggggcaatgcttgagacaatgtttcaaatccaattcggaatgaatacgaaagattcgaatatttttcagccaacaatcgtcgaccgctgtcatccgaagggttcgatagatttgtttttgcctttcccttcgatcgctcaaaagtcaagtcacccttcttaaggttgtgctcacagttttggtgttggctttggtttatttggtctgttggacgccctattgggtgggcattttcggccgacgactgctcaatttgcggctgagtccaaagcaaagtgtgtgttgggtgccgttttgctcactttaaaatgccaatgcaattggccaattgtctctctaattgatcgctcatttggctaatgccattccttttgattttctgctttctcccctcaatcggatccattcactttgtacccctccccagttcaggtgtcatcaccatgtacttcgtccatttgatgccctacgtcagttgcgccgcttaccccgccattttcacgcttctcaatcgaccgatccgttccgcccattcgcattggaaacgctcaatgcaccgacgcattcagcaaagctc

SEQ ID NO: 81131 - DNA, 807 bp, Heterodera glycines
  Genomic contig location: Contig_ID=SeqID_16731; Location=302..1108; Strand=-
  SCN-specific regions: Sequence locations=1-285,308-742,764-807
tcctcctccgccggcccttcgctttccgttgccaattttaccctcgtcgaaatggcacttcccctgcggggctttcgtcagtacgtcgctttgacttacctcggctgcaacctcatcggcctgttcgccaattcgtgggtccttttcgtggtcggccccctcctgtggctgcacaatgtccgcgtcccaaaatccattcttttccacattttggcactttgcgtgtccgatttggccacaatgtgtggtcagtttctttctccccatgtgtcaattcggcatcaaattgctgctttttgcctttctttcagcgatggttttgctcaatttggaaattttctgcggcacttggcgcctcggctcgatggcatgcactgcctatttgctgttcgattccatgaacaaattctctgctcctattatcggtagatcgatcgatcggatgttaaatgatagccggggggcataaattgttgcgaccttcggactaattgctttaatgaatcctttgtcggcttaaaatgttcttccccccccccctcttcagtgttgctaatctctcgcacctgttactccactgtttgcttagacaaacgtcggcagcaaagcgcggcgagtttaaaggtcacacaaaatgccaaagggcgaagaaaacatccggaggattatgacgacaattcattcaaaaagtgatttgacaattcgaattttgcttttcccctcagatggcctttctccatgtttctgtctctctctgtttggtgctcgtcctcctttggccacttttcgcttattctgaggtcacca

SEQ ID NO: 81132 - DNA, 292 bp, Heterodera glycines
  Genomic contig location: Contig_ID=SeqID_16731; Location=842..1133; Strand=+
  SCN-specific regions: Sequence locations=1-292
atggggagaaagaaactgaccacacattgtggccaaatcggacacgcaaagtgccaaaatgtggaaaagaatggattttgggacgcggacattgtgcagccacaggagggggccgaccacgaaaaggacccacgaattggcgaacaggccgatgaggttgcagccgaggtaagtcaaagcgacgtactgacgaaagccccgcaggggaagtgccatttcgacgagggtaaaattggcaacggaaagcgaagggccggcggaggaggagtccaagccgaacttcatcattggg

SEQ ID NO: 81133 - DNA, 662 bp, Heterodera glycines
  Genomic contig location: Contig_ID=SeqID_16734; Location=392..1053; Strand=+
  SCN-specific regions: Sequence locations=1-40,78-100,202-253,287 -355,377-414,470-572,614-662
atggagtccgcttcggttgcgagttcggaagtgttcgaacaaaatggaaatggtaggaaaaatatttttattttccagaagaaagaaggggacaaagtccataatttatgaaaattttaattagaatctttaattttttcaaatttaatatataaataaaaaaaatttttccattaatatatttttaaatatcatttaaatcgacagaacaacacgggatggtttacaaaagtgatgactgttgcaatattggaaataatttaaattaaattaaatttgaaaaatacagcagaaaaattgttgggatggcaccgcttgccccagtgaattggaaatcattggtgccaaacgtttgatggtccaatacaaagggaatcgcttaatatgtgtggtaattagcaaaaattaacaatgaatttaaacatttaatttatagaaattttaataacaaaaattaaatattttaattgaaggaagtcactcaatgttcacaaaacgctgcattctgagcacaagttcgtccatttcttacgtcgaagaaatgcatcagtatgaaaatgtaaattatggacaaaaataaaaatatttttctaattattatattaatttttaagtgctcaacgattggacttgcgatcaaagaaatgccattgtacggaagg

SEQ ID NO: 81134 - DNA, 887 bp, Heterodera glycines
  Genomic contig location: Contig_ID=SeqID_16736; Location=250..1136; Strand=-
  SCN-specific regions: Sequence locations=1-227,282-536,561-615,637 -760,782-887
atgccgtgcccgggggtgggggaaatggtggcaacttttgggtgtgtggccggccaactctcccaacagggttggccaacttctgctgctgctggggccacacgaattcgcatagacaaaataatgcaaaaatgcaggtgggatatatgaggataaaaattaaattttaagagttgaaaatataaatagcaaaaaaaaaaaaggtttttactgggacaaaatgtgcctaataaaaattatttacattgaaaaattatttacattataatatgtaattaatagagggagctgttctaattagagatcggaccggtttcggtttttaaccgaaaaaatcgactgagaaatttttgagtttttcggtttcggtttttttcggtttttaaaccgaaaccgattgaccgaatttatcaaaaaaccgaaacaaccgatcgacttttttaatgcgatttgttaacagattttgtccaacatgaccaaatttttgcaattttgagccatttttttaagaaaattaaggatttttagttttggtaaacttatatttttataaattttgggtcatttgttgttcaattccgtttcatatgcgtgttccagtgggttgtgctcttggttctgtttctaatttttgcttgattttctcctaatttgtaaaaattattccttttttcgatggggattcaatcacaattttataattaaaaccatataaaatattgtcaattttggactaaatctgtcaacaaagcgcactaaaaatttcaaaatttttcccggcggcgcccaaaacgcattttgtctttaaaacagaagaagcaaaaaaattcctttacatctcccaaaaattcaatataaatattaaagagcatttttctgttaataaa

SEQ ID NO: 81135 - DNA, 339 bp, Heterodera glycines
  Genomic contig location: Contig_ID=SeqID_16737; Location=81..419; Strand=+
  SCN-specific regions: Sequence locations=1-136,158-339
atggcgttggcgaagaagaaccgcgtggtaaaggcggccgaagaagttgacctgaacgtgtccatcgcctcgtcgttcttcgaacgcgggttcgaaccctcgcgtctcgtcacttccacgccacggcccagccaacagcgggaggagacaccgcaggaaggtgaatcaattcaatgagaatacattttgtgatttgacatggtggaattggtcttttcagcaagaagcatcgaagacgtgacggaagcagactttgacagtccgtgaatgtgttttgtgccgaaaatgttcattttgttgggatttgcttttcattttatcacattgtaatatatttaa

SEQ ID NO: 81136 - DNA, 526 bp, Heterodera glycines
  Genomic contig location: Contig_ID=SeqID_16738; Location=866..1391; Strand=+
  SCN-specific regions: Sequence locations=1-12,36-338,361-386,409-526
  Gene Ontology: Mol. function=aldehyde dehydrogenase (NAD+) activity; Biological process=aldehyde metabolism
tcttcggcttatctgatcaaccagcccaaatacgcattccttgccgaattgggcatccaacagcaaaacgatggagtatttgacggcacatggaatgcgtcggggaaggaagtcgactcattgtgtccggcgacgaacacaccaattgcgaaagtgcgatttggaacggcggaggtgcccaaacattcaatcccacttgaataagcacgccccttttaggattatgaacgtgtgatcgaagcatcgcgtgccgccagtgccatttggatggaaatgccggcgccaactcggggcgaaattgtgcgccaaattggcgattctcttcgcaaaaacattgacaatttgggcaaattggttggttttccgtacccttcctaaatttcaatccttttttcttccttttccatgcgtttattatgcgtttcttttgaggtttcactcgaaatgggcaaaattttgtcagaaggccgtggcgaagtgcaggagtttgttgacatcgccgattacgcaactggtctttcccgta

SEQ ID NO: 81137 - DNA, 738 bp, Heterodera glycines
  Genomic contig location: Contig_ID=SeqID_16739; Location=2065..2802; Strand=+
  SCN-specific regions: Sequence locations=1-175,197-381,404-710,732-738
atggttctccgcccattctcttcgcatttctccttccccagtgatcagtcagtcagtagtgatggaacagacttcaatgattattccgatttgaacgaatgaataaatacatcttaacagtcaatgagtcgtttgggggttcggggcttggtcaaaggcgccttggcctttccccattccctcccaaactccatccgggataaacggtgcatagttggtctgggggcacagtgcgcatccctcactatgtccactattcaattgtccggttctgtccaaccaaatgtcctggagcccaataataataactggaatagtttatggatcattttcagatgtttttcctcatccgtgcaacgaaattttcaattcaacaccgaaatttggtcctccttttcatgataacaatggctcaacagcagaaagcgcatttcacgacttttatggaaagcgtagttttgggaataatatatgcaaatgacagtgtcaaaacggcggagacacagagatgaaatatttttgtgtttaatttttttttttctatttttttgacctaaatttatatatcgtggaatttgccataaattggaatttcactaattttttttttgtgacacaatatgtttaaaaggaagaatacggagtttctgatagttggatttaaaaaaacggcattttggacaccgaaggaaaactggacaccaaattcctaaaataagccaggaattaggttgaaaa

SEQ ID NO: 81138 - DNA, 1325 bp, Heterodera glycines
  Genomic contig location: Contig_ID=SeqID_284; Location=140..1464; Strand=+
  SCN-specific regions: Sequence locations=1-424,446-550,572-756,779 -854,876-1263,1286-1304
atgggactcaaatctccggcattccaaacactgggattcaacccaccaactttcaatgacattccaatcgctgggactcaacccaccagcatttcaatctctgagactcaatctccggcattccaaacactgggactcaacccaccaactttcaatgacattccaatctctgggactcaatctccggcattccaaacaatgggactcaaatctccggcattccaaacactgggattcaacccaccaactttcaatgacattccaatcgctgggactcaacccaccagcatttcaatctctcggactcaatctccggcattccaaacactgggactcaacccaccaacatttcaatcaatgggactcaacccaacagcattctaatcactgggactcaacccaccagtcggactcataacaaacgaaaatatcactgtatctctctctatatgccagtgatcactgatcagctgacaaataattaggtattaagaaaataacgtaagcataaaacgggaaaaagcgtatggtttgaaaggcaccgacgcataaaaaagaaagaatttatttgataaaagctcgaatgacacattatgcatattttacaggattatgaatgcatatgaaattgaaatcacaaattaaaatgcaagagatttagataaaaagttaaggcaagaaaaaaagaaatgaactcgttatgatgggattggatgggggagatttgtgttaatgatttagagataacgaagcaaaatggacaggaagttctgaactcgtcgatttaaatggcaatctttcaatttcctttccaatttttttggtgtttttctcttttgttccttccgtccgtccgtctcatttcttcttcttcagtttgatgttggagatgcgttcgcccacgtcgttgaagaaattgcccacgtcgtccaccactttgtccaatccgtgcttcttggccagtcggcccaccttctctttgaccatctcccacaagtgtttgacgtactcgcgcaactcgcgactgcgtcggttcgccacgcattcgaagtcgcaatccttcgaaattcgaatggctttttgtggccaaatctgtcctcgaaattacctcatttggctgtgtgtccgtcggcagtttggcccggtcggcctccaattgttcgggagtctttccgcaatcgctcatcaccatcaatgtccggtaatggtcgagcgtggaacagtcgaatgttcattcccttcgacgtcaacggccttaacggaaaaactgcggagttctgatggaatattaccaattaaaattgaaactgtcatcaaatttaata

SEQ ID NO: 81139 - DNA, 949 bp, Heterodera glycines
  Genomic contig location: Contig_ID=SeqID_284; Location=692..1640; Strand=-
  SCN-specific regions: Sequence locations=1-159,187-216,239-626,648 -723,746-949
aggccatccattgtcacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaaggctttcctttaaattttattttattattaaatttgatgacagtttcaattttaattggtaatattccatcagaactccgcagtttttccgttaaggccgttgacgtcgaagggaatgaacattcgactgttccacgctcgaccattaccggacattgatggtgatgagcgattgcggaaagactcccgaacaattggaggccgaccgggccaaactgccgacggacacacagccaaatgaggtaatttcgaggacagatttggccacaaaaagccattcgaatttcgaaggattgcgacttcgaatgcgtggcgaaccgacgcagtcgcgagttgcgcgagtacgtcaaacacttgtgggagatggtcaaagagaaggtgggccgactggccaagaagcacggattggacaaagtggtggacgacgtgggcaatttcttcaacgacgtgggcgaacgcatctccaacatcaaactgaagaagaagaaatgagacggacggacggaaggaacaaaagagaaaaacaccaaaaaaattggaaaggaaattgaaagattgccatttaaatcgacgagttcagaacttcctgtccattttgcttcgttatctctaaatcattaacacaaatctcccccatccaatcccatcataacgagttcatttctttttttcttgccttaactttttatctaaatctcttgcattttaatttgtgatttcaatttcatatgcattcataatcctgtaaaatatgcataatgtgtcattcgagcttttatcaaataaattctttctttt

SEQ ID NO: 81140 - DNA, 1091 bp, Heterodera glycines
  Genomic contig location: Contig_ID=SeqID_284; Location=2109..3199; Strand=+
  SCN-specific regions: Sequence locations=1-681,703-749,771-793,816 -1033,1085-1091
ttcatgttgtggttatcgaacgcatgagaaatgcattgacaaagtgcggcgcgtttgtccgagtttggccctggcgagaacggaattctctctccaattcgatttgtgccccgagaaatcgctgcttgaacaaaattatcagtgcgccgaatgtttttcgcccatcggattcggtaataattattttttggcacgttccttgagatacgttttgggattataaattttcaaatgccgcattttgtcaaaattttgttgaatttttccgttttgatttaagacgacgactctgaaaaactgcctcggatttgcgatttcaccggccttttctgttgtcggcgctgtcattggaacgacgaaatgattgttcctgcgagaattgtcaagaattgggacttcgaggcgtgcaattttgctgggttttgtaagaaattgaaatttgctcattaagaaaagagccgtgtgccgagcgacaaaacaaatgttaaccaccgcaatgaaacggccactgataaacttcgaaaaggagaacccgacactgttcaaatttgtacacaaattggacaaaatccaaaagatgcggacaaatattatgctgatgaagtgctattttgtatatgcaaggtaaaaaagggggaaaataaaaaaatatggaaagaaaaagttatggctttttcagttgcaaatttattttcattttttcgctttcagtttgcccgcaaaatgcgtattctccagcatttgagtcgtttccaacactttgtggagaatgacacaatgttcaccatggacgaccttctccaactcgccaatggccgcttattggcggacatcgaagcaattgtcaggattttcactgcccatatcaccgaagagtgcgaaatatgtcggggaaatgctttcttcttcagcgcatctatccgttcagcgaaaacgcggccatttgcaagagttgctgtgctgtctgtctatcaccgctcgtgctttgaccgtgccagcaaacggtgtccgcgatgtttacgcagaaaggcgagaagaaaagcgggatggaagagaatgagggggacgaggaggaagaagaggacggacaa

SEQ ID NO: 81141 - DNA, 812 bp, Heterodera glycines
  Genomic contig location: Contig_ID=SeqID_285; Location=32..843; Strand=-
  SCN-specific regions: Sequence locations=1-339,361-366,400-613,689-812
atggaccgaagagcctataaaagaaaggacggtcttcgatgttcttcaccttcaccggcctcttcgcttttctctgccgattatcttgaaaaaattttcgacttccctaaggtattggattcaaatgtgatatttgattttgcttttaagccattttttctttatcttttttaaaatttttttgggggtagggagaattacactcattttaagcacaaaaaaagagcgttttccgcttggtttgggttgtctatgatgactttataggtccaagctgctgctgaacgccgcccaacatgtccaatcagtcgcctgccggtccttcgccgtcctcaacaaccaccactgaacaggtagagaatattcaaaattaacaattaaattaaaatattattaaaacggagggcttgctttaactttctttttaaaaaacaaaattaaattagagcaaaaaattaatttaaaaaaacaatttctgattattgcatttttagcgctgaacacgtcaagccggcagctgtcaatggccaaccgcctgcattgaatggcatcgaggtgatttttctttacaaaatttttgatacggtaaccatacccccccccacctcgctggtaaatttttatgaaattattttttttatatgcattttaaaaattatcattttttgtattaataaaataaaataatggaaattaaacaagataaatgtcagaatctactgcaatgcttggaaaatgtggcatttgagctgacggagcatgtgtgccaactccaactgccggatgtgccgtcatcgtcttcggtggaaaag

SEQ ID NO: 81142 - DNA, 297 bp, Heterodera glycines
  Genomic contig location: Contig_ID=SeqID_285; Location=1377..1673; Strand=-
  SCN-specific regions: Sequence locations=1-162,187-297
atgtcaaaagtgtgtgctcgagaaaagtgtgtgggtattgaacgatttttgaatgaacagacagcagagagagagcaacagcagcaggtgttgtgagattataatcataattatgatttattgatattgcctagagctatttaaacagaaccataatttcgaaatgaaaaatttcagatttttagaatggatttttccaaatgtacactaggttccgataaaattaaggatctttatagcgataaaaaaattagataataatattctgctcattattagtttggtcggtgtaataaa

SEQ ID NO: 81143 - DNA, 1374 bp, Heterodera glycines
  Genomic contig location: Contig_ID=SeqID_276; Location=146..1519; Strand=+
  SCN-specific regions: Sequence locations=1-835,866-959,982-1218,1257 -1374
  Gene Ontology: Cellular component=membrane
gcacgtgccagctccctccaagcattatctcctaattttaacattatcggccttctccgaacgggccttgagcaatcggtgccaccaaatgcgcgtgagtgtgccaaaggcattcatttcgccgctttttaatcctttttagacattttatgcactggccgtttgtttatctcagaccactcgtgcccgagactacaaaaatgtgattatttccgagtttgacagcagagaagagcttatccaggtgagttccaagagagggactctgttgggaaaggggaaatgtcccttttgttcccacgggcattgacctttgtccattgcttttcctttaggccatcatttgctcctgcttcatccccttttactgtggactgagtgcgccctgttaccgtggcgagcagtacatcgacgggggcttctcggacaatcagccggccgggcaaattcgaccacggcaccatcacagtcagtccgttcagcggcgagtctgacatttgccccagcgatgacgacagtgccaggtcagacagactgccgtgccatttggttgccccccggcgatcgcttgctttagcatgttcggcttcgacttttacggcacgcccattcaattcaccactcagaatttgttccgaatggtcgtcactctttttccgccttcgcccgaaatttgctcccgaatttgtcgccagcagggctttgaggacactcttcgttttctgaccaaaaattgtaatatttttcaaaatgtttcctcctccaatgactttgccaaggcatggctccgtgtgtgaaatgtttgacggtccaatcgaatgtcatcccagtgacacagcatcagcagcagcaaaaggaggaggaaaagccgatcagaagcagagcaattcgggagaacaaatggcagacggaggaggaaaagcggtggcgaaagacggcgtcagtgagcagaatgagcaatttgtgagaaggggaaaagcaaatgatcaacaaaagtcaattagggacaatttgcaagggaaaggcaacggcgaaatgtaattcaaaattatcgcttaattaccccccacaatcaggcggaatgagtgcaatcgctgctttgaacatgtcgaccgtgccggtccgccccgtttctcctcagttccgttgccgaacaccattcttaaatgtgagactaattgaacacggggcgaaaaatggacaaatttaaattgggccaattaatgtataattattattaattactttttattttagcgctttccgaaatggaagaacgaaattgcacttggatgaattatttgcgtcgccaacgcatcttccgctggtggtaccgtcttctgatccccgttattttgccctgtgaaatggtgc

SEQ ID NO: 81144 - DNA, 204 bp, Heterodera glycines
  Genomic contig location: Contig_ID=SeqID_279; Location=138..341; Strand=+
  SCN-specific regions: Sequence locations=1-204
gtcctattacattgctttttccccattcagatggaacgtgccaagcgctacattgtcgaccaggagaacagaacggagaaggacgcacgtcgcacactgctcaaattggctgaaatgttcgagtcgcccattcccacaacatcgaatgtggcccgtttacgcaaacagtttgacgacgacgacaacgatgctgatgacaattag

SEQ ID NO: 81145 - DNA, 3697 bp, Heterodera glycines
  Genomic contig location: Contig_ID=SeqID_280; Location=1..3697; Strand=+
  SCN-specific regions: Sequence locations=1-651,680-690,713-1102,1124 -1654,1676-1759,1781-1810,1832-3576,3598-3697
  Gene Ontology: Mol. function=3-phosphoinositide-dependent protein kinase activity; Cellular component=plasma membrane; Biological process=signal transduction
gggatgaatctcagcttaaaacatcgggcagacgagactctcgagggttgctcatcggatcagtgcactctcacgcccctttcctttcatcggccgttctcttcagcacaatttccattctatttatttcctttttattatcgtacttcttctgcacgccgacatttttttttttgatggacggatctttcgaccgaaaacattgcctaaggcgcaacgaatcggcggcagaaaatgcaaatgcgacgcaacggagaagccccggggggaggaagggaagccgagcattggacggtgggcaaattaagggaaatgattaaatgtgttgttttcgtataaatctcacaaaattggggagggaaaggaatttggggattattatttatctgctgtttactgagggggccgtgaatccacgcactctccggcggacaacgcacacacaaacaaaaacacccccccccccccctgcgcacgccccaatttgaaattggagcaattgccgggggcatcgaaaggcgacaacgccccgggcaattttcaaaagcattacagaaagcgaattccgcgctgcgatcaaacacattctcgagacgggtgacatagaaggggaggacgcgaaaggaacgaaggaatacgaacagagacagcagcggaaggaggaggaggagggggagacggactcctccgcatcgtccatgtccagtcacaccgaaacgatgaaaagcagcaggtccaaaactgactgatcgctgctatttgttggcactttccccaccgttggtgccatcctttagcattgattctggcactaatcatttgccatgttaaaactgacaccaatgaatccgattttcgctgattacccatttgctttgcagcaacggctccgattggcctttctgctccgatcggatgaaaatgatgcagaagctggccaaactgaacctgaacgaggcgggccccgcccctccgagcccgtgctcagtgaagacaccgcttgagggcgtatcgacggaggacactttgcaaagactgaggccgaaggaggaccaagcggaacaaagccccacggggacactcgcgacacggacaccgaaggactttttcttcataaaagtgctcggcgaggggtcattttcgacggtgggagaagcaaaagtgggaagtgaagactaagaagagaccgttaaaggtgtattttgcgaaagaagtgaccacgggggacgaatatgcgataaaagtgctgctgaaaagcgaaatccgacgggaggcaaaagtgcgctatgttctccgcgagaaggacattatggccgcgctcacttacgtccacgggggtcacccttttgtcattcgcctttattgcacctttcaagacaacgaccgactttgtgagttgggaggggcaccaattctgatcagtggatcatttcgatcattttggattgacattgatcacaattccctcggcctcgggctgattgtctttttttgcacagactttgccttggcatatgccaaacatggcgagctgttggattggctgcgccggctcggctcattcgacgaagctggcacccttttctacgcttccgaaatcctttgtgctttggaatttctgcaccggtgcaaagtgatccatcgcgatttgaagccggagaacattttggtgggcgccgattggcacattatgctctctgactttggcactgcgaaaataatcgatgagcaaacggacacaatgggtaaggaaggcaccaacaaatattttcccctttttctcgagaacccatcactattaataatttagcttgttcctcctcgtccgcctatgtttctcccatcgaacgtctccccccgggcgaagtgccgggcattgtcccgtcggtggcagtcaaaccgaccaaacgaagcgtgcggagttcctttgtcggcacggcccattacatcaggtgtccgtgtttgttagcttttcctacgctttcttcgtttgtttttcagcccggaagtgctcaagtcggaggatgttgggcccgagtgcgactattgggccctgggcgcgatcattttccaaatgatttctggccagccgtaagtcatttattggctaatcggcagccaatggcccattaacattttgaaggcctttccgcgcggtcaatgagtacaaaatcctgaagaagatcctcagcctggacttccacttcccggatggctttcccgaggtcgcccgtcacctcgtcagccgactgctcgtttataagcccagcgaacgcctcggcagctcccaaaagggaggcattgaagcactgatgaggcactccttttttaaggtaggcaatggacaatgaatgacgaaatcactcaatccgttgtttataaaggacgtcgaatggtcgtctctgttcacccggaaaccgcccgaattgaagccgtacctcccggcaagcagcggagagccggaattctatggggagtacagtccgcagccggcttatgggccaatggactttgagcccggactgaacgaagcggcgttataccggctgatgggcctcggcagtttgggcggaggcggctctgacgaattcagcgaaatcgaattcaatcgggaaggtcggagaaaggagacgggcgggaggggcatatagaacttccatttgaatcaggcatttctcgagattcgccctcctccccttcccaaaagtttattccgttgccccgggcgtcgtttgtttatttggcaataaaaagcagcaaaaacacactgactgtgaaaaatgggcttcattccctctcttattgatcattttgactgctcattctcaagtcagtcttcttttttgcggctttcggtggaaaaaatgcttttggttcgtccaattccaatcgaaatccaagctgcccaattgaagaccgacttggcattgtgccaattcaatcgcacaaatggccaaattccgctcgaattcccatttatttcggccaatttggtcttttttttaactgtgccaaattattttttaacgttgtatatttcaaaaatgttcagacattcgtctcgacgatgcttcttcctccccgtccgttagcttatccgtcgccccatcggttgaacaaagcgaacagaggcgccaaaatcgactggaaaaacaacggagagagaacaaataccaccgatttgtggaggacaatttgatactgaagtcgggactaatcgacaaaaagaagggacttttcgcacggcggagaatggtaaagaaaagaggaaaagccaaaaaagaataagggaaaagcctaagaataggggaaaagccaagagaaataaaattaacgatgagaaagcagccaaaccgatttatcattgagacattttgaatcaaatgacatcattgccattgactcatcccaatgttcgtcaatttcagtttctgctaacagaagggccgcgtttgtattacgtggaccccgtcacaatgcatttgaaaggcgaagtgcccttctcggagcaaatgcgcaccgaagcaaagaatttccgcacatttttcgttcatacggtaatttggttaaagtttcgcatttttaaaaaatatttaagccaaaaagaacgtattatttatttgaccccgaacggcacgccaaagattggtgcgatgcgatcgattgggcacgggagaaatatttgcgcagggatcag

SEQ ID NO: 81146 - DNA, 57 bp, Heterodera glycines
  Genomic contig location: Contig_ID=SeqID_2696; Location=789..845; Strand=+
  SCN-specific regions: Sequence locations=1-57
ttatccggggttttaaaggtcgctaatcacgaatctgacatgtattttgactaattt

SEQ ID NO: 81147 - DNA, 812 bp, Heterodera glycines
  Genomic contig location: Contig_ID=SeqID_2697; Location=352..1163; Strand=+
  SCN-specific regions: Sequence locations=1-250,272-812
atgcttcacaatacactgagttgcaaggccaaaatctcagtagacaccataatatctattgaaaaatttctcaatcgagatataactactcgaaattcagcgcagaaaaaaggtgagcacagtttatacataattttctttattgcagtttttgcttcttattatagataagcacatgaataccttagtaacagaattcaattttgttttcgaattaggcaaaaaagagttattcaattgttcaatttttattttggaataattcagatgatcaacgaaagaacctcaacgaatcattgttatattcaccggaagacttgaatgagtacagttttgagacagaggacgaagacgaaagagaaggcgaaggaagcgcaagtgtggaactgctcaattgggtagataaatacgaaccgataaatattgttactataatacaaattaagggtaatttcgctgatgaattcgaagggacaaattttgagatggtacggaaacgatggctacgcaaatcgctgatctccatgagcatgaacatggacattctggtgatttgcactgcgcaaaagttcgtgatattggaatgctccaaacggccaaccgatgggttaaattcgatggaaatggctgcgagggttgagattgaacgtgtcgatgaccggtctttcattttgtcattagccgtctttggagtacagccgcctcagtccaactcctccagccaatcattgacgacagattggacttgcatttgcattgtatataatcattccgccaaatactaccaaaatgtgagacatttgcttctctaa

SEQ ID NO: 81148 - DNA, 1628 bp, Heterodera glycines
  misc_feature (17)..(17): n is a, c, g, or t
  Genomic contig location: Contig_ID=SeqID_2698; Location=131..1758; Strand=+
  SCN-specific regions: Sequence locations=1-131,154-481,503-807,848 -900,934-1004,1026-1394,1417-1628
  Gene Ontology: Mol. function=GTPase activator activity; Cellular component=synaptic vesicle; Biological process=synaptic vesicle fusion
atcaccaacaatattcncttcttttggcttccgttctttcactggtattggcacttctcgtaaggaccgttatgtcaagaaatctgctgccgatgtgcgtacaaattgggtgccgattaagagtattctcagggatggaaaaagaagtgccgatcggacatttattgcgccaactcccgggtggccatttgtcgctgtttccgataactatggacggattgtgctcatcaatacgcgcactagacgtatcattcgaatttggaaagggtacgactgccaagagggtagcagcccttgtcttacaattagggaggggttcgaaatttttaaatgcgctattcaacaaaacaaaaaaacatcgaaagtctggtgtggtgggtacccgcagagaaagaaaactttccatgttttgttaaaaacgtctccgaggaggggggggggggttacacccctcattgtttgtttatcctggcctacgcctatgcccttgacgatgtgcttccttcgtttcctattttcacgatttgtttttcagttaccgtcaagcgaggtgcgcatggattgagacagtcagcacttcacgaacgacgccaatgaaaaaagctctttttctagcaatttttgctccaaaaagagggcttttggaaatatggtcgatgctggtgagggttttttacaccgtttcaaacaaggcgaccagactatggtttcagaggagcccaaattcctaattagtgaggggaactcgcagcgtagcaggacagaacgtcgccggaacaaaacagcgccgggacataacgtcgctacaaaaaataaatatattagaaaaattcaaaaaaaaaattaagaaacaaacgttctcatggattttttttggttttctggcaatttattgttagcaatttattatataatatctaattttaaatatttcaaatgttttggttttttgcgccgctttatgtctcggtggccggcgatgtttttgggggcactggaatccgaaaatttattaatttatcttcgtctcaaaagtttattttctagaatggaccacgcgttttggcttttcaagttgaggagggcagtcggttgctctcattgcctgttgttcacggtggcattttatttgggggctctgatgttcgtgagactgaatcgcaggaagcgggtggtcgagcgggggccgtttttctgacgcctgacggactcctttatgtgatgaaaatttatttgtgaatctgaattcattttttacagtccgtcgatgtgcccttttatctctccgcactttcgacgagtgcgacatcgatttatgacgaacatttgataaaagatgttgggtttcattttcctaattaattaaaatgtatcatttcagttcagtctcgaacattttatgattaaaactgagaatgctgacaatgaatcggacgttgacttagaaaaactggctgaatttgcgcttcgaattaaaaccaacctggcaagacaaagatttctggaagctttaattgtttcatcgagggggacttcgaccaaaaagagcgatgccgggaataagaaattgcgaactttgatatcagttcgatcgttgcgcgaacttgtgaaccgaatggttggaaaat

SEQ ID NO: 81149 - DNA, 1584 bp, Heterodera glycines
  Genomic contig location: Contig_ID=SeqID_2699; Location=109..1692; Strand=+
  SCN-specific regions: Sequence locations=1-116,138-268,290-545,582 -717,739-1053,1076-1084,1115-1584
cgtgtgtgaagcatctgtctcaaattcaatgtgatcgtactaatccgttgttggcaaaggctttgtcaatactcgaattcgtctatgacaataggtgggtttcttctaattttccgaagcattgcttttcaattttaagcggttcttcggccattgcttcatctctattaaatatcgccaagtgtcgtttggaattaaacgatttcgttggctttttcaatttgaatctgtatcaaacttttgacaataatgctcaagttggaacgccaataactgccaaatatgatgaaaataatttatcgacaaaaattcccacaaaccttttggcaaaattgggtgcaactttatttgctccgttcctcgtgaattctttttcggacttcgaaccatttctgaagagtctgacatcaaaatttcggctgagaaaggtagggttgtgttgccatcaaatttactctatatcaaaattgctgattgaatttgcttaacttttaggatttcttcgtcacttctctctgcgctttttggctttacccgccgtgtaactttaaattggactgtttttcggctcattttgctgaatttatgctcggtcttttcaatttgctcgtcgaagactctgacaacagcaattggaccacatcctttaaagaaacactcaaaacaattgaacaaatggtaattgaaaggtacacagtttcgttaaatttatgtataaagcttttcttttattttgtaatttcgtggaaactgagaaaagcctttcaattcttggatttgatttggaatttctaattcagcactaatgtgccggctgctctgatggtcgctgtgcaaatgggcgatttgtgtcaaaaaatgtcagttacgctcaatgaaagaaaggccagtcgaggaagcggtgattttttaaattaggttcggttgtaatttcacacaattttatccaatttagaacagaaaactccaacggaagatggcgatgcttttattgttttcgataaacccgaattggagctttattcggagctgtgcaacgaattgccatccttttgggcacttttgtcattgcatttgagcgttttacaccttttgcaatggctttcacagcaaatgacagatgaatcgctttcgtcgcaattgtcgacatcaaatttctccgttgccaaactcctccaaaagggtgttagtttctatcgggaacaggttggttggtcggttgtcgttgttttcaacccattcttttagttgggtctttgggtttctaatctcccgactttttctgcccatggcattgtgtcgcttttttcttcgaatgtccacattgaaaaaaataccgatgagattcattttaacgcaaaaaccttccacgctcttcggttgctttgcaaagggacacttccgcacaatttgcgattggaattgatactttgcgactgcgtctgggaatgcgccagtgcttggtacaaggacgaatcgcgaagagtcacaaaactgaaggttgttttttggcgttgcattcattgcttctcatttcggccaattccctcgtcagcgttctatcgacctgctccaattccttag

SEQ ID NO: 81150 - DNA, 1526 bp, Heterodera glycines
  Genomic contig location: Contig_ID=SeqID_2699; Location=4997..6522; Strand=+
  SCN-specific regions: Sequence locations=1-759,781-961,1117-1318,1340- 1353,1375-1526
atggcaccgcaaaaagcaaatggaacggacatggcgaaaccacggggatatgtacaacagcagcagcccaaacaagccgaacgtgacgaacagaagcccagcatttgttcgatgtgccaatcggccgacccgagcccggcgcaccgggcttctctgctcgtccaatgttccgcttgtcaacaccaaatgcattcgttggtcacttccccaacaattgttcaatttccctttgtttaagctcgtgcattgacatgccgttgaacatggtcgaagtgatccgcaaatacgattggctgtgcattgaatgcaaacggtgctcagtgtgtgagcagcccgaccaggaggtgaccgggggggcggaataagcaaaatgtgggcacctccctccctctccaggcggcgatgatgtgctgcgacgcgtgcgaccgcggctaccacaccttttgcatcggccttgaaatgccgccgaatgggacttggcactgtcccaagtgcaaaggttgctgatactgctcactcactgtccaccgcccgttcggccgaccttccgtcgctgcttaattaatgtttataaggcctcactgaattccttcctatccctttttttgcgttcattaggggggggggggcggaggtgcggcaattgaccgatggtcggtcgctcttcccaaattacgccatggagtgaattaggttcgcaacatttccaactgtttaaggcactgtcatggacgaacaattgaagaaacggtatctgagtgtaaaggaacccgaaacaccgaccgaaggacaacaaaagatggtgtacatggacttgggaagcaaaagtcagggagaaattgacggagcatttgaaatgcctccaaagaggcggaaaggaaggccaccgaacaaaaaggcataggaaagttcagtcgaattgtacaattgttggtccgaatctgacaacgataatcccatcttttacatttgtttttttgtccatttttctattccaaatttttgttcgatttttttgaatgttaaattgctttttattctccatttttaaatgtaattttaattgaattgatttgcttttacttttatctttcacttcaccttttttctgttgttcgtccctctcgaacgatgtcgagcatttccagcggcgtcgacttaaccacaaaataccagcgactcgccgttgaatatgttaaggtgtcagtcaaaccgttcacctaaacatgcaaaggggctttgaacagttaaggtgcggaaccaagtggcggtgcttaagtcggctttggtggaagaacagtcgaaaagggccgatttgggcaaggaaatggcacagagagagacgaaactgttcaaattggagggcgaaagggactcgctgctattccgcaacgaacagttgctgaaacgggtggagggactgcaggagagcatggacgcccaacaagcgacctttggcatggccaaaggtaaaaaggtgggaaaagggcgaacggacggactgtcgaatggcaaaaatcgaaaaa

SEQ ID NO: 81151 - DNA, 87 bp, Heterodera glycines
  Genomic contig location: Contig_ID=SeqID_16740; Location=881..967; Strand=-
  SCN-specific regions: Sequence locations=1-87
atgcgaaaagcgaaatgcgaaacgccaaaaaatgcgaataatgcgaaaggcgaaatgcgaaaagcgaaacctcggcccatccctgct

SEQ ID NO: 81152 - DNA, 755 bp, Heterodera glycines
  Genomic contig location: Contig_ID=SeqID_16741; Location=312..1066; Strand=-
  SCN-specific regions: Sequence locations=1-687,730-755
atgacccgtacaaaatactccaacttgacgtggtttgtcctttcatttaacataaaagaggcatttcaatttgcgtccgaatataaaattgcatttttgggactagaaaaaaagtcattttacccaaattaatagcatttttctgagaaccttgggatgccctgtgttttgatggtgccggtgcctattggaacaattttgcgagccattatcaaaattcaccattttcattgactggaagtacccaaattgattgacaaccggaacaacaattcaggacgcggatgttggcgagatcaaaaagaagtaccgcgagctgagcaagcagcaccacccggacaagggcggcgacccggtgacctttgacggcattgtcaaggcgtacaaagcattgacggatgaggagtcgcgcgagaactggcgcctctacggcaacccggacggacccaaaggtgacgactttgaccgatggtgattggcattttgaatttgatttttaattttttaccccctcctaaattgccgttttttgagggcatgtacaaatatattggtaatagtttcggtcggtcaattccaatgaattgaaggatcgttaaacagttttgaatcggtctgcctattagttcctaaatgacaaaacgcaaatttttccttcgaccgattccatatttaaccgaataaatgaaattattcaaatatgttttttcagccacaacctttggcattgctttgcccaagtggattgtcagtga

SEQ ID NO: 81153 - DNA, 1406 bp, Heterodera glycines
  Genomic contig location: Contig_ID=SeqID_16742; Location=26..1431; Strand=-
  SCN-specific regions: Sequence locations=1-120,143-281,304-422,445 -669,702-1406
  Gene Ontology: Mol. function=protein transporter activity; Cellular component=signal recognition particle; Biological process =intracellular protein transport
atgggccgtgctcagttcgaatacgacgaagtcggcaacacattttattatgtgattgtgtccttttttgctgtcatccttttcccgctcacccattttctgtggccatcgctgcgtacgttcttttaaaatacattttttatggcatacaatttttttttaaatgtaaaaatttgggacagacttattgaaaatggcctggacctaattttcggttgacctgtgggccttattttctgggcacaaaccagggctattaacaggttttttgatccgggtggaaaattagaaaattgcaaaaatcttaactctcaaatttatacaccaaattcaaaagttcaaacagtacgcatgcaaaagttccaaattttggcacttttttagacaaaaatccaggaaaaaaggtcttggagtaacacaaagttttcaaatttcagcaaagaggacggaggtgctgaagaggggctgccgttgcgagggcgacctggtcaagcggtttcgcaaagagcaaataaagccgtgggagaaggcgaaatgcgtgatcaaaggttgtttcatactattggcattcatttgctttttaatacttaaaaatgatttattggaccattttgtttttgcatccaaattttaacccgtaaatttgtgcatttcgaagctatatcctttcaaattttgaaaaaacaaaggtccccccaccctttgattttaatcgggcactcaaaaagacaatttatggactggaattttaaattgagttgaaaatgtgttagtttttctaaaatctaatcatttaagggtttgttctgctcattctgtgggcactgttcattctgttggcctacaaagtttcacaattggaacagacatttgaggagttcgttcatccaattcgttaatattttcctaattttattcacttttcaggtatgacccgtacaaaatactccaacttgacgtggtttgtcctttcatttaacaaaaagaggcatttcaatttgcgtccgaacataaaattgcattttttgggattagaaaaaaaaaatcattttacccaaattaatagcatttttctgagaaccttgaggtgccctgtgttttgatggtgccggtgcctattggaacaattttgcgagccattatcaaaattcaccattttcattgactggaagtacccaaattaaatgacaaccggaacaataattcaggacgcggatgttggcgagatcaaaaagaagtaccgcgagctgagcaagcagcaccacccggacaagggcggcgacccggtgacctttgacggcattgtcaaggcgtacaaagcattgacggatgaggagtcgcgcgagaactggcgcctctacggcaacccggacggacccaaaggtgacgactttgacgtgcaatga

SEQ ID NO: 81154 - DNA, 488 bp, Heterodera glycines
  Genomic contig location: Contig_ID=SeqID_16743; Location=281..768; Strand=+
  SCN-specific regions: Sequence locations=1-488
atgaacacaatccgcgacattaagaatattgaattggtttgtggtagtcgaatttttgtggttcgtgctaaaattgcaagtgttgtgtctacggaatacaatgtaaataaaaccaaatagaaaacatatcttgatttttaggcttgcatctcttgtcgtaaggggaagtgtaactgtggtatggagaaggtaaagtcttcatttttgagattgtcgctcttggatgatacagacgttttggggggtgttgcttttttcggcgtgaaaaatgtagaaaagggtgacggaatggtatgaaaaatgtttaaacacgaaaatttattttttttaggaaaaggttaaaaacttggttgggaccatttgtactttgaaggttaatgtgagtgtgaaagaatatggtggtaagaagggaatttattatgctttgattgatatttatgaaatttgatttgttttgtctataaatgaaatgttaattttttatttaa

SEQ ID NO: 81155 - DNA, 456 bp, Heterodera glycines
  Genomic contig location: Contig_ID=SeqID_16746; Location=752..1207; Strand=+
  SCN-specific regions: Sequence locations=1-248,272-393,418-456
atggctctcataaacgctttgttcaaatcagaaatggcgaatcgaacgcgccggtgcccacgcttatgccgccctcgtccaccttctccaatttggtgcgcataaagtgcccactttgcacattgtccagcacgtggttgccattcgcgtcacccaacagccaaccgatgatactcagttcggaagtcattcggccgtactgagtctttgtttgttgcgaacggaccatgaaattctattgaaacagcaattaattaattagtcaattaataaaaacataaaacaaatccagcagaattgcttcaattaaataatatgcgtatctcaattcgcacattgtttcataagattttctgtttttcaaaaaccctaattacaaaaaacgtttatttcgactttttcttaattaaaaataagcatttaatgcccaaggaatattcccatcaaaaacaccaa

SEQ ID NO: 81156 - DNA, 1584 bp, Heterodera glycines
  Genomic contig location: Contig_ID=SeqID_16748; Location=1401..2984; Strand=-
  SCN-specific regions: Sequence locations=1-92,114-243,273-462,484 -710,735-1044,1071-1584
  Gene Ontology: Mol. function=protein binding
gctctgctttttgaattggaggtgagaaagacaaattgatttgtaacattattttttttagggttttgcccacaaatgccttcgttacatttgccaaaatgctgccaaattattcagatcaattgactttttgcaaattgatcagaatgtgttgtgcaatcttctcgagagtgatcgtttgttactaagcaatgaatttgaaatttggaaagctgtaaattttgattaatattttgcacttgctttttttaaattttttttttaaatttaaaggcaattcgttgggccgataaaaaatgtcgtcagaatggcatgaaatggtcagcggaaaatcggcgttccgtacttggtccggcactgttcaaaattcgttttccaaatatccatgaggagaattttgcaaaatccgtcggtatgaccttaaaataaaaattttatttgtgatggatataaatattttagcccaaaatgatataaaatttttattaagggaaatttaacaaattttgagatttatagttccatccggtgtgttaacaatggaagaagtgatcggtgtgtatcagttcaattcccatccatatctgtgtcatccgtttcgctatccttatggagtgcccgggctgtacgcgttgaaattcccaagccatggacgaatttctgattggaacaaagccaagtgcagcattaaacgaagagggacacttgcgttggaaattaaaaatttgtcaaaatttgcgcaagaaaacattgggagtgaacgtataagcaaaactgtgttcatcaaagaatttccttggaaaatacgggcatatattagaacaaaaaaagaggctcccgaacattccgacagtggagaatccgacagcgaggacaatccgacagaggtggacaattggacagaggtggacaattggacagaggtggacaattggacagtaaaatacacaaaaagattaaaaaaaaatgccgtcgccgaagggaccaattgtggcatagcaagaaaaaagaaaaatatgcaaataaattgatgagtgtttttggcaataacccaaaaaaccaaaagatttctttttttttcttgtaatggtacagtcaatcggtccctttcggcgacggcattttcttagattgaaaagaaaaatggaagcactgacaatgaaaaatggttggccatttaccttgtgtgcgatgctccaaaagaaggtgcaaattaaatgatattaattgacaataatattgtttcatttatttatagatgaaggttggatttgccaatgttcgtcaactgttcgaattgtctcgcaaaagagcggcgtgagagattatatgaggggagaatttacggaagaagatactttttacaacgaatcgaacagttgtggatatgccaatttcatttcatttgcagtgagtgccaattaaaacaaataatccccaattaaattttaaatgaccataattaaggaactgatggatcagagcagaggattgtatgacaaaaatgaggacaaagtgacagttgccattgatcttactatgaaagacgaaaaaacggaggaaaatcataaataccccaatgtt

SEQ ID NO: 81157 - DNA, 808 bp, Heterodera glycines
  Genomic contig location: Contig_ID=SeqID_16750; Location=98..905; Strand=-
  SCN-specific regions: Sequence locations=1-461,483-808
atgtcttggatttttggcatcaaacctcagccatcgtcgattcctgcgcctccggacgaccccaacagtgcgttttgaataaacaattcagttaaaactgcactaaaaccgaaaactgcctggattatggcttattttgtttttttttcaaattctaggaaaccctcccacgcccgccgatgagaagcagcagaaaattggggcacagagtgcctacacatttgactcaactgcgctggaacgggcggcacatgcagcaaaaacgctggaaaagtcgaccaatgcgaagcaggtcgggcaaattttaataggaatttttcaaggccgatgcctactttttgcgctacaaaattctctgcattttttactatttttattatggcatgcattcggagagtttttcaagtgtatcaattttttccctgcttaaaattaagtggagaggcgtctaatgatagaggaatcaacacagaaaatctagaattttcgacaaaaattcctacaattttggttaggtttgggtttccctgcctcttttgattcctattccttgtgtaatttttcactctttcaaggcacttgagctcagccgattgcaagaactcaccaagcagaaggagtacgatttgcagcagaaggtcagtcgcaatatcactgaaaaatgcacccgtccaaaaattcagaatttccatttatttttttccagcaattggaggctcgaattgcggccatgcaatcggagaatgtgcgcgttgcggaggaagaaaggcgcaaaacgttaattgaggagacaaaacatgcgcgcgca

SEQ ID NO: 81158 - DNA, 201 bp, Heterodera glycines
  Genomic contig location: Contig_ID=SeqID_16751; Location=882..1082; Strand=-
  SCN-specific regions: Sequence locations=1-201
ccggcaaaaatttgcttgaattcaatgttttgacaaaatggggatgtaccgacaaggcgcctgaggaatttcagctagatcccgaacaattgatcatcaactcaaatgaatctaaacagattatcaggaaagaatgcagttataaattggggaaaattggtgtgctaatggccaatgctgccattaagcttccaattcccg

SEQ ID NO: 81159 - DNA, 749 bp, Heterodera glycines
  Genomic contig location: Contig_ID=SeqID_16752; Location=891..1639; Strand=-
  SCN-specific regions: Sequence locations=1-389,418-422,444-560,619-749
gaaatagaatttaaaaaaagacaaaataaatcctttgatgattctgcatttgtggctgaagaaatgaaaaagaaaaaaatttgtgcaccggaaattgaatgccagcattgtggtggtgtttttggctgtattccggacgaacattggtggcagtcagaaggaaacggatgttgtccaccaactcaaaaggctgtctgttgtttaacagtaagaaatatctgtttttaaattatggctgggtttagggttgataatttagagacaaaaccatcaaaataaattgaatttcgtaccaatagatttatgagaaattttttaggtctgtatataaaataatgcattacaaagtaactttatttggtgaaatttattactaaatgatgctaaatacaaaaaataaagtatttattatttttggaccgaaaaattaataaaaataatttgcttggaaaataattgaagttaaaaattgttttcgattttttttttgtagaaactgccggaggccccgcttacaattagcttattctttatcttgactgtctctgttctttagacctcaacgacaagcacaacctcaacaacaacgaccacgccaaccacgacgacgacggacgaatttctcagatgcaaaaaggcacggttcgagtcgcaccccgtaagggacatttacaaagaggacaaggacaaggcatgccaacacaatgagcaccactgttacgtgctgaactgcacgacaggtaaataaa

SEQ ID NO: 81160 - DNA, 2335 bp, Heterodera glycines
  Genomic contig location: Contig_ID=SeqID_16755; Location=816..3150; Strand=+
  SCN-specific regions: Sequence locations=1-108,130-272,294-448,474 -565,601-670,711-798,827-930,960-1014,1044-1819,1906-1975,1997 -2020,2088-2335
atgagcgagggcagtgttccctttctgtcaagaaaaacggggttccatgatttggctacggtactttcagaattatttgaatttttgccaaataataattgcctatactaaatttgtttcatgtaatttcattaattttgttaattatgtaagtttggtcgccagcaattctttgcacttgtctatcgtgacacgggcgttgacattctgcgcactaatggcatggtcttacatttgttcataaaattcaaaactttcttgaaaatataaaaaatttacatcaagattttggccataaatgacttattggactaaaatttcttcggattgtccttgaaatcatgcataaaaattttagaaatctgaataattttaaggcttgatttgagcatttaacagaaaagcgcatttctttgaacggtgctgggtcgtttgtaagggtatttggtaaagtgttaattttacagatttttcgagaagaactagtacaactttaagcaaaacaattaaatatcctaaattaagttttcttggaatgaataaataactttgtgttctctataagaatattattaattttaaaagtttaacaaaaataaactaaagtttatggtcaagaaagtacaaaaaagcttgatgagtagaatgttttcgttctaacttttctctattattttaaaatttcttgagtttcaaaattttcttgaaagcttacaaattttaaaaatcaaatttttggcggaaagtttttaattatgccaaaatttcaacggtattttctttaaaatactgcataaaattttacttttgttttttgaaagaagaataattctgaagcttttgagcacatatgagaaaaaaatgggcgctttgtaaaaattttacagatttttcgagaagaactcgtactaacttttcttaaacgtaaccaaattaaatattcttaaattaatttaaaactaagtttatggtcaccaaagtaaaaaaaagtttgatgagtcagaatgttttgactataatttttctttattattttaaaatttcagcaaatttcattgggattcaaaaaaattaaaatgatatagaaatattaatttagttgatgagccaattcattttcgtaccccttgccggattcaactaacaaacattgtggcggaagttaactaacgcactagcatcgaaattttcaaaaattaccttattttttgaaatcaagaaattttctgaaattttaatggtttttagcacttatttgtttttgtttaagctggttcttagtttttgttttgttttttaaatgaatgatctaccaatatttcgcaattgactcacttacaaaaaataaaagaaatttcgttttttttttaaattttacactatctttcttcacaaattaatgccaaaatttccagcccccttccgaatggcagctgcaaattcagcggaggaaaaatgcccgtactaatagcaatgccaacgatggcggtaagagaagagtgccatgtgactgtgattttttcttttagaaaaaccgggaaagggaccagaaaagcaagggacgagacttagatttgcaatcgggaactaggacaaacaaaaaaaaagcgattttataaatttaagcgatttaaaattgaaaatttaacttatctcttatacaataagaatagaacattgaacacattgttggcaatttggaagtacaaaaagccaactaattacagtacccactcctaccgtcattttgcgagttgatttgacaagtcaacagactcaagagcggattgtctatgatcggagtgagtgacaatggatgtttttaattattaaatttattaatcagcaaaaaaataataattagataatatcttaattgaaaatcttttaaaatatttattaaaagacaaaaaaaaacgattctttttatggtaaagaagcatttttatcattagcaaatcctcggaacaaaaagcctttcatgaattaaaattctctgtgaaataataagacgaaaatgataaaaatttattaaatattttgagaaaaattatttaagataatatattatttaataaataaaaaatgtaattgaaattgcagccctaataacagcacaagcttatgctttagccgcgacgaattcgtccgcggtggcgccctcggcgcatgggacttcggccgatttgttggcggtgctcgcgcctccccctccaccgccactaaaagcggcaaaacaagaagtggatgtgctaggagggattagagctcgtgaacaaaatactttgtaaagttttttcctattttctccttaaaaatttgtagaattaaatta

SEQ ID NO: 81161 - DNA, 165 bp, Heterodera glycines
  Genomic contig location: Contig_ID=SeqID_16755; Location=3634..3798; Strand=+
  SCN-specific regions: Sequence locations=1-165
aaaaattgcggtgcaccccaaaacgtcgtcggccgaaacgtcgtcggaagactttttgaaccataactttgttcactgtaaatcaaattaagaattgttggtgttgttcgatagctctatgtgtttattattaatttgcaaaatctcaaaaattttcgttaagtt

SEQ ID NO: 81162 - DNA, 732 bp, Heterodera glycines
  misc_feature (195)..(195): n is a, c, g, or t
  Genomic contig location: Contig_ID=SeqID_2701; Location=768..1499; Strand=+
  SCN-specific regions: Sequence locations=1-208,231-298,338-408,430 -480,524-732
atgaccactgtattgtatgactgaaaaaaagtttaaggatttttaatggtgaaaaatcccaaaaataattaactaaattggcaaaatatagtgtcgttacaaatgaccagtttttgtgctttgtatgaaactaaactgtaaagaaaatgctaaaaaaaattaaccgacaaaaaagcgcaaaaataaaaggatttncggttctttgacgaaagtacctctaaattttagaaaaatttcggtgcttgtctctttgaaaaattcatagaaaaaaacaaccgatttgaataaaagatttccctactgcattgcttttaataaaatttttgtttttccctttgatctccttgggaatcgacatgtttctttggaatctacatgtctttttagaaacggtactcagccgatgagaactttatattgtaatataaactttttaaatttcagtcaattaaatgttttttccacttactgcaattgttgttaaatattattgaaaaatttgttaaaatattttaaaattaatgaaaatcattggtgacccattggtccaaattttttatgtttcacagttggagcccatatggggcatcgccgtttagtgcaaaagctccgaaatgcgcacactaattaatttttgtgcattttaggggttgacttacgacgatgaacaatctttttctcgttgtaggataattaattatcacgagacgaaaaaccttttaggaatcgaga

SEQ ID NO: 81163 - DNA, 1099 bp, Heterodera glycines
  Genomic contig location: Contig_ID=SeqID_2701; Location=2487..3585; Strand=+
  SCN-specific regions: Sequence locations=1-69,101-178,216-401,448 -558,580-671,707-734,757-1044,1066-1099
atgtctgacaatatattcgccatgttggatgattttgacatcgaaaacagtaattaaaaaacaaatcattacatatacatatacatttataaatatatattatattattttttagtcgacccgactctaaatttttcaaatgatgcgtggatggaggaagtcggtgaaaccgtcacggtaaataattgtttaaaaatgtttaaataaattaaatacaaacaaatgattttgttctaatttttcttcagaaggcattttttgattcatttttttgattacttatttagaaggtctgaaaaaaacttaaaaattctaaaaaagttttcactgaatagttatgtttactaatttacttattttgcgagattttattacttagggtgtaacataagttttgaacctattttttataaaatttttattttaaaatgtaaaaaataaaataaagatacgataatacattccattattatctataatgagttgccatttttttggcaagagagtaatcccaccggcattaaattagaagttataaatctaaaaaccaaaaattgtcatttttcagtacatattttttgagggtgaggttctcggtcatatggaaaaatttaatgataacctaaatatgtattgatagaggacagttaatactacaaatgccatctgagaaatattttttgtacataattataaaaatttttaaggagtcgagttttaaaatggcacaagaagttgaccattttttaagaccacatttggtacaatttttctattaagtggttttgtattgacccaaaatctatttaaaacatagcaaatttgaaattctgaatccgaatctggcctctgattcgaaccttgacttctcattggtctctgtactgcttgaactttgtgcacggagttgaagcagtacaagcaattatagaaaaaatagacaaaaactaaaaccagattcagattctatggactgatttggtcttaaaatatatggataatagggatttgtgaaggttttgtgttagttagtctaagtgtacaattaatgtgttgatgtacatttttggcatggttaggaaaggagcaggaaaaacca

SEQ ID NO: 81164 - DNA, 559 bp, Heterodera glycines
  Genomic contig location: Contig_ID=SeqID_2702; Location=169..727; Strand=+
  SCN-specific regions: Sequence locations=1-52,76-140,217-533,555-559
atgcgaagagaggaaagccatgttagtttttttactctataacctaaaacaaatttgaaatttccaggaatggttgcaagaaaaagttatcaacatcgaaaaaacacaatttgaaatggagaaacaactccaaatgttaaaacaacaacaacaacaacaacagcaccaacaacaacagcaccaaccgcaacaacaacaacaacaaccacaacagcagaatgctgagatatttgaagtggaacgcatcgttgacgtccgaaaagcacgagatgggaaatcagagtataaggtattaaaaaatgtttttaaacaatcataaattagcaattttaaggtaatttggacgggctacacggagtcgtcctgggagcctctatcaaacctttggggcgccacagaagaactctacaatttaaactgtttcattgttgcggaattattgagttaataaatgataataatctccgatttacaatttcctttagcaaatgtaggcagacatatttagaggaaaatgagctgaaattgtgaaaatttcacaaaaataatcatgaaaata

SEQ ID NO: 81165 - DNA, 901 bp, Heterodera glycines
  Genomic contig location: Contig_ID=SeqID_2702; Location=1061..1961; Strand=-
  SCN-specific regions: Sequence locations=1-206,228-345,367-426,449 -469,492-507,529-880
atggcatccatttcacccaattccgaacccctgatccgaattcgaacaaaaatcgaaaactcaaatttttcgaaattcacatttatccaacataatcgctccaaaagtgaggaggtgcatgaggaaggatacacggtgatttggtttaagcgtttccgatctattatttacatgagtatcgtggtgagtgtttcacaatttcagctcagttttctctaaatatgtctgcctacatttgctaaaggaaattgtaaatcggagattagtatcatttattaactcaataattccgcaacaatgaaacagtttatttgaagaggataaggagctaaaagtgcaagaattatacaaagccataaaaataaatagtaaattgatggttattggcgcttatcaactcaatccttctgcaacgacgagacaacctatatttacagtatatatttatgaaattacaagaatttcaaaaattgttcttgaaaatagtagatagagaatctcacaatttcagcgacttaatctctaaatataaactgcatcagtgttgtagacggatcgtgttaataatattctccgatttattattttcacgatcacccttgttaaatcctcaaaatttcagctcattatcctctaaatataaactgtaacagtgttgtggaaatatcgagttgatagcgctaataatctccgatttattattttcatgattatctttgtgaaattttcacaatttcagctcattttcctctaaatatgtctgcctacatttgcgaaaggaaattgtaaatcggagattattatcgtttattaactcaatccttccgcaacactgaaacagtttatttgaagaggataaggagctgaaagtgcaagaattatacaaagccataaaaataaa

SEQ ID NO: 81166 - DNA, 548 bp, Heterodera glycines
  Genomic contig location: Contig_ID=SeqID_16757; Location=40..587; Strand=-
  SCN-specific regions: Sequence locations=1-34,57-96,164-272,294 -335,400-548
atggtcaaaaatgatgtgtttccgtgtttcgggtaaataataattacataattaaaagtgacaccataaaccatcaccatttacgaatttcagttgaataaataaaaatttcataaaatgattttattgaaacaatttttttttgttgtaataaaatttaattgcgtatttaagcgtgaaaaaatagtgaacaaatatcattcattaaaacaccatcgataataaattaaataatcctctaatatttccaccaataaaccaaattaaattcattccaatatgaaatatttcaattcgaaaggcgttttctgcttgcttttagcagcattcatcggtaatttaatttaatttttgaaacttttaactattaaaatatacattaaaattttaaaaattattcgagaaattcattagctatcccatgcttcgttttggcactgtctgatgacagccgcgggtttgatgctcgagtgtcacaacaattaccgctcacaactggcccaaggaactgcggcaaatttgaccggcacaatgccggctggcagtaa

SEQ ID NO: 81167 - DNA, 922 bp, Heterodera glycines
  Genomic contig location: Contig_ID=SeqID_16758; Location=963..1884; Strand=+
  SCN-specific regions: Sequence locations=1-266,301-392,414-616,638 -877,902-922
atgtccaatggaaacgatcaaaatgaccaagagaatgtgctgcaggtattcgtcattaattgtttcatttcattgggacaaaggcaaatttattttttgaaattgccaaattgaagtgatgcccattaattgggcaaaagggctacgaaatggcactgttcattacgctcaataaatcgtaatttgctcaattttctaattggctaatttcccatggcatcggattaatttattattatatttgagacctggatttatggatttacccaatttcaaaataaaacaattaaaaggaaaatatgcccaaagtgtttcagatacttttcgatgctgaccaaatattggccaccagcaaacgaagcggcgaaagtgcgcagagagtggccaatgccattggggccaaaatttttgccacgtcgcacagttttggcgagaattgtgccgttagaattgcgactttgcgaattttgtcgcatttgtgcgccgccggcgaaaaatgggcggtgaaaatgttgcagcagaacatcgaccttaatttgctgaggtacagaaaagaattgtctgcagcctatatgacgaaatttcggaattgtttccaaattttcgctttcattccgggaggggaaattaagcaattgaccgaagttttcaggccttgatttttacttattctttaaatcattggttctcttattttctaacaaaaaatatttccatatttttgcattatgtccatattttaggtccatattttgacattttccaaaaagtctctattagaacggcctccatcagataactttgcgctttaaccactaaaaacgtaaatttttcgaaaaatatttctcagcgaattttctagagagttttacttaaatttattattttctaaaaattgtgtcaaacctttttcctaaaaata

SEQ ID NO: 81168 - DNA, 78 bp, Heterodera glycines
  Genomic contig location: Contig_ID=SeqID_16758; Location=752..829; Strand=+
  SCN-specific regions: Sequence locations=1-5,37-78
aatgtttattattgaataaatacacaaaaaacaaaatatgcaaaatttgtcaagaataaatccgaggggcttaaaaga

SEQ ID NO: 81169 - DNA, 372 bp, Heterodera glycines
  Genomic contig location: Contig_ID=SeqID_16758; Location=1966..2337; Strand=-
  SCN-specific regions: Sequence locations=1-177,201-241,263-342
atgccttctccgatcgctgccgcaccgatcaaaaagtgcagcgcattgttggcaaacagccgaaagcgccaccagccgactaagatggaaacggaccgcgcggaaagtgccgaaaacattgcgccaatcaaatggagcgactcgtgccgttcgactggcgaaacttcccgcacgtggagagccctaaaagggaaagaggaccagagaaaggcgaatcactgctgaatgaggagtttggcactatttattagaatattgttattgttagggctcggaaatatgtggatataaaaacgcgaaaatttggacataatttttttttcaaattgaggggtaaccttcaaaaatttgaatttattaaattttaataaa

SEQ ID NO: 81170 - DNA, 239 bp, Heterodera glycines
  Genomic contig location: Contig_ID=SeqID_16758; Location=2478..2716; Strand=+
  SCN-specific regions: Sequence locations=1-239
atgcctttcagcagaaaatactttgccattgcatcgaccattttgttggagcttttggcccgtttcccccaaatgttcttcgtcttgggcatcggcctcggttggctcagtcggctaatgcacaaatgttttgagacgaacaatgtccaaattggcgcgcatcggagcgcaattattacccaatttgatggactgtccgggggtcataagggagggcgaattgcattttgttggcccag

SEQ ID NO: 81171 - DNA, 1161 bp, Heterodera glycines
  Genomic contig location: Contig_ID=SeqID_16759; Location=1381..2541; Strand=+
  SCN-specific regions: Sequence locations=1-668,690-963,988-1140
atggcagtgcacagttactacggacagctgaaggagcgcgatttgatgtttgccattctgaacgcgatcaaattggtccgagagggcaccattccgccgattttcatcgaaaaactctctgccgttgtccatgacaaatttgtggcggtcgacgcttcgttggcgttccaacagagcgaagaatggagccgcgacgtgctgaacatttcgaatgccagcccatccccggaggggacaaaacgacttacactcagggaacacaaaacaccgcactgttcaggggaacagatcaacacgggccacaacaacagcagattcccacgggaagaaagggtcggttgtttgaggggggagaggcacctgttgctgagagagtggaaaataggcaaacaacattgttttgtggtttacatttggtttacaatcttatcaccgtttacttgggagcagttccttctaattttcgaggtttttcactgggaaaatattggaatttttcaaagaatttaatattttcttgttttatgcctaggaataccaacgttgtgagatggtgttcttcgtcaaccgaaattggtcaagggaacaccgacaacttttcgttgcttaccaattcgcccgttggttttcccgcggtttgatttggtcggtcctccttttcttcttcaatttattagcgttttctcttccagttttcccgacttggtgagaattgcggacgaacttgacgacattctcattgaccatatgctctgttcggtgccccggccgttctctccctacaaaacttcggctcggaccgccccgcccgactccgttgcgttcatctccggcttacgccggagtttgtacgaccccgactcggtcaaagacccacaaacccacaaattcaacaacatttacgtggaagttgtgctcagtaaaaagctcttacaaaagaagctggtgagttttcggagatggaaaatcatttttcgtttattttaaatatttaaacctttcctttaggacaaattcaaccagctcagagagggcgaccccgtagaacttccgcaaaatgttgatccgctgtgtgcctcggccactttctacgacttgaacctgcggcgactcgacgcgatggaagcggtgcttttgggagagcggagagtgcgcgattgg

SEQ ID NO: 81172 - DNA, 994 bp, Heterodera glycines
  Genomic contig location: Contig_ID=SeqID_16761; Location=420..1413; Strand=+
  SCN-specific regions: Sequence locations=1-67,89-823,845-943,965-994
  Gene Ontology: Mol. function=sodium/potassium-exchanging ATPase activity; Cellular component=sodium/potassium-exchanging ATPase complex; Biological process=neurotransmitter uptake
atggccggctttttctcttacttttgggtgatggccgataacggatggatgccaatgcgacgtaagcattattttattttaaaaaattcaaaagtggttttttagtgttctttctacgaaaagaatgggactccgttggcgtaaacaatttggaagacagttatggccaagaatgggtaagacatggccaagtgggtaattaatggccaaggatgggtaagtcatggccaagaatggataagacatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagaatggataagacatggccaagtgggtaattaatggccaaggatgcgtaagtcatggccaagaatggataagacatggccaagtacgggtaatcaatggccaagaggggtaattaatggccaagaatggatactttttaattcgcttctttgtcccatgccattttcagacttacgaccagcgcaaagtgctggaggcgacctgccagacagccttcttcatcgccattgtggtcactcagtgggccgaccttctggtcgtgaagacccgtcgcaactctttggtccagcagggcatggacaattggccgctgaacttcgcgctgctcattgagacggccatcgccgtgttcctcgcctatacgccgggc

SEQ ID NO: 81173 - DNA, 1520 bp, Heterodera glycines
  Genomic contig location: Contig_ID=SeqID_16764; Location=389..1908; Strand=+
  SCN-specific regions: Sequence locations=1-233,275-640,662-852,876 -878,900-912,942-1057,1080-1095,1129-1183,1205-1520
  Gene Ontology: Mol. function=metallopeptidase activity; Cellular component=extracellular; Biological process=skeletal development
cttaatgcatccaccgtggcaatgtttatccgaggcgcaccgcccgaaggcgaaaagggcggcggtaacgacatcaatcagctaaacgcaattcgcgaccggcgacaattgtggcgcaacgcgcgcattccgtacgcattgagcagccaatacagcagctacaggcaaaagcacaaatcaaaatgatggaacaattgagaaattatgcgatgaattttaagcaaaaagaaaacaaaataaaataattattaattaattacatatttttaatttagtcgttcagtgatcgcatcagcaatgcaggaatacggtaatagtgcaaattaatcggaaagctgcttttcctatgtatcgaacttaagcaatgaccccaaagagcacaaaaaaaagaaatttcattagtattattttttgttggttaattgaattcaatgtttgaaatgtgtaaaatttaaaaaaaattgtttcaaagtgatttagcaaaaaacacgtgcatccaatggacgccgaggacagcagtggacaacgattatgtgtacattgtgccggagaggggctgctattcgatggtgccaattgttaaaagtgtcacataatttgaaaaaaatttttgaaaaggtcggaaggaccggcggacggcaaattctttcactgggcaatggatgcattcaaaaaggtgaacggagtgtgccatggcatgctattcatttgctaaattcaaatgcccaatattaaaataatacggcattctttgcggatccattggagcaaaagccaacatcgatttgcttagcatacaccgaagaagggggaattgatttatcatcgatgcttaattaacttaaaccaatctttttaaattttttaattattaactaatgcaaaaagagaagagctgtcgctgacgcatagaaaattttattaaattattatgattttttcggaattgatcaaaaagtaaaaagcattttgtctcattgtcagggataatcatccacgagatgatgcacgccaccggctttttccatgaacagtcgcgcaccgaccgggacaatttcatcaccatcctttggcacaacattctgccgggcatgcaaggtgaattggggaaaagggaaaacaaacgggagctgaattcaaataggcaaaataaaaacgatgtttttttaaggaattcacttctttaaatgattttttaaaatttttaccgtaaagtattgccaatttctgtgaaaattccaaatgaattgaaggacagttcgagaagtacagcgcggccaccattcaaacgttgggcagtgactacgacttcggctcaatgttcggattggcattttaaaagcaaagacaaattgggcgaaaaactctccaattaaaattaattgcaattatttcttgccctcaaatccgtgctgttttttcagcatgcattatggccccaacgcgttcacgcgcaacggactgccgacgattggccacggagaagagcgacgattggccaacggagcggatttagcaaa

SEQ ID NO: 81174 - DNA, 292 bp, Heterodera glycines
  Genomic contig location: Contig_ID=SeqID_16765; Location=241..532; Strand=-
  SCN-specific regions: Sequence locations=1-42,64-267,289-292
atgaaaggattatctgttgaggtggtttcgaacggagttctgaatgggccacagcagcagccgttggcctcttcgatggcatcttttccttctcttagcagtcttcatcaccaccaattcgcagcccaccagctaaaaccctccgaatcggcgggcactgtcacagattttgctgcgcgattcatcgccaacggaacaacagggcctccattgcaatcgtatttatcaccaaatacaacagttgcatctggcggaatcggcaaaacgaagggattgggcaccggcggaaaca

SEQ ID NO: 81175 - DNA, 754 bp, Heterodera glycines
  Genomic contig location: Contig_ID=SeqID_16768; Location=82..835; Strand=+
  SCN-specific regions: Sequence locations=1-151,196-417,514-577,599-754
atgagtgcccctctcttcacattgttcacctgttttttgttcgtcctctgctatttggtcccattgtttttggtcacatttttctacaccaaactgctctcaaaactgtaccaacatgcgcgacaatttaaagtgaaaaaatttgggggagaattttttaatttttaatgaattaattaaaaaatattttattttgggcactatttaaaaattaaaaagcaatggggtgaccctattgatttgcaaaaaagccgaaaattaagaattttttattttatgattttttttgcccaaattaggttgggaaaaaatcagaattgattcaaatttatgccagatttgtgatcagggaccccaaaatccaccagtgaacagattttcatttctaaatctaatcaaaagagtgtcccccctttgttttttttaatataattaaaacattaatcactttataagtagcgcctttatttttttttaattggaaatatttaaaaataaattaaaaataatattcctttaatttatcagaccacaaaattccgttcccaaatcccactgatgaggatttcgttgtacaccttggcggtcgcctgtttctacttcatttgctggaccccgtaatagaaaaaaaatcgcttttaattttaatttcccaatttttagcttttgggtggccacggcatttgccgtttatctggaatatgccggtgaacacaatggtgccgtgccaccaatattcgtctattgcatgtga

SEQ ID NO: 81176 - DNA, 1523 bp, Heterodera glycines
  Genomic contig location: Contig_ID=SeqID_16769; Location=163..1685; Strand=+
  SCN-specific regions: Sequence locations=1-136,166-193,240-334,400 -416,438-572,594-939,961-1113,1137-1484,1506-1523
atgaatgtgctgaactcgttgaactcctcaactgctgttgatctcgagggtggtggtggtggtggatcaattaaagctgcttatgacttgacacaagaagttctggaaaaagtatcagctgctgtagttgctgaaaaggagcaacaccaacaacagcagcaacaagttgaaggagtacaaagtgaacttaatgaacaacagcaaaaacaacaacaacaacaccaccaacagcagcagcatgaggacacgtcacaggtgttaaattaatttaattaagaggtgggattatccccgttttcagcgtcctcgacaattttcagtttcatattgagggtatatttttcaaaaaaattcataaatttaagctaaaaactaattactaaatttattaatttttaagaaaattgagtacagactttaaaatttccttttagacttaattttagaataaatttccacttttcagaaagctaaaaaattgcttttaaaatttatcggtccttagaagtcaaatgacctctttaatagaggggtccttttttagtggggtttcaaaaaagcaaaattagcgcgtaaaatatgcaaataaatttctttttttttaaatttcagctcccaaattgggccacatcatcgtcagctgaaacagaagccaataatgatcactttccgggtgatgccgatgaggacgaagctgcgattgtacatgagcaaacactgttgctgcacagctcggactcgatggacctgttgttgcgcatcgattgcgaatcgaccacatatctttgaacacattacaaaattgttgcttgtgcagttcgagaatctcatcattttcgagttatgatgatccaagaaaaaaattctgacatttgggagtctcgagcatcactaatttcaaatacatcagcaggcagcaaagggtggcgaaagacgaggcccgaaaaccgaccccccaaaaatatcggaattccgtgccaccatccccatccctggatggcaccttctgtacatatatagttgggaaaacaaaattttggaaagaattggcaaaatttcgacgaatttctttcttcgttttttttttgttgaaaattctaaaataggacagcctccaaaaatatgtcaatgcccatatgtgtaattattagggttataagttgtatgcttttgcatattttttctgcgcatatgctatgaagaaaggggctcaaaaatagcatttctgcattaaaattttttgatttggtgaaggtttttagtgcatataaaagcatattttgggggtttttgagaataagtgcatattttgccatttttacgtttttagagcatatttcggtcatttttgggaaattttcacaagaaaaatgcgaaaaaaacgaaaaatacacccctaaggatcgactttttggaatttaaaaaaaaatacacccttaaaaatcgaaaaaattttttattttgtaagactttggaaaaaaaaatttatgtatatgtaaaatgtaatgttgttttagcatata

SEQ ID NO: 81177 - DNA, 1164 bp, Heterodera glycines
  misc_feature (20)..(20): n is a, c, g, or t
  misc_feature (36)..(36): n is a, c, g, or t
  misc_feature (82)..(82): n is a, c, g, or t
  misc_feature (86)..(86): n is a, c, g, or t
  misc_feature (97)..(97): n is a, c, g, or t
  Genomic contig location: Contig_ID=SeqID_16769; Location=2000..3163; Strand=-
  SCN-specific regions: Sequence locations=1-189,211-392,415-617,661 -1045,1067-1128
aaaaaaacgaagatacaaancgattgggatgtttgntcgctgaaatatggccatttttgcgacaacatttcgccattggctnttcncaatgtcgacnatttggacaatttgcgtcgactcatttcgccaacaattctatccgatcttgatcagttgaattcaatcctacctggtgatctgttgcccgatgtgcttgctgataatgattttggtggaccaaatgcgacttctgccggccaaacgttgtccaaatggttgcacaatccgagaaaagatggccaaccaaagtcattgcattgcttgaactttacgacatcagcacccacaaactttgaatggctcaccaatttcaaggaggtcggtttgtcgtcacatttcatatttgacattgtacatatatttttatttaggtttttgtccgtgcccgcacttctgtcagttacagcgtctgcttaacttttttcgtgacgacgatgccaattgaaccatttgaattggtgaacgaacagactaaagaaaagctgacattgaagaaagaatcggatattggctcttctcgttgttggctgttgaagcgatgtccaattactattgttggggagacggcggagacggttcagaaacaacagcagcagcagaagaaaaaagatggaaattctgcgaacaaattgaacaatgtctattttcatcttagtgaaggcaaaaattgcattgggtgagcaacaaaaccatagaaaatctaccaggctgggggttggaagggttcaattaaatagaaagattatcgtttttttatcccacaaaatataattttcgtaaaaattttacccaataacatttttgtttttcgtatcaaaaaaaaaattttttttttcaattttgttctaacccccctcctcttgtccatttattttaacagattttcctttttgttttgaaaataattaaatttcattgaatttttaggcctctttctccaccggcggaagcagcaaaagaagcgagtcaaagcagcgaaaatgacgtctaattatgtggaaatgaatttttagcatttggaaaatgtgagaattgtccgatcatttttgagttttatgcgatgaattgtgttgattagatatttgattgtttaaaaaatttaatttattcatatacaaaaataaa

SEQ ID NO: 81178 - DNA, 1870 bp, Heterodera glycines
  Genomic contig location: Contig_ID=SeqID_16770; Location=9..1878; Strand=+
  SCN-specific regions: Sequence locations=1-1446,1468-1706,1735 -1805,1835-1870
  Gene Ontology: Mol. function=chaperone activity; Cellular component =nucleolus; Biological process=nucleocytoplasmic transport
atggaggagcagagaagtgatcagaactcatgcaagtcggctgagcacaaaagtgatcaaagcaaaagcaaggagcagagaagtgatcagaactcaaggaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcagaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagagaagtgatcagaactcaaggaagtcggctgagcacaaaagtgatcaaagcaaaagcaaggagcagagaagtgatcagaacgcaagcaagtcggctgagcacaaaagtgatcaaagcaaaagcaaaatggaggagcagcgaagtgatcagaactcaagcatgtcagctgagcatcgaagtgatcaaagcaaaattgaagaaatgtggagtgatcaacgcaataatcaatttgaagataaacgaaaagatcaaagccatgaggaggagatctattatgagaatcatgactatcggcagtcctatgacgatgaatttgaagaagaaattgacgactacgcgcacaaatcaaatgattacaattttgagccatttgatcagcaggtatttcaatggctatttggtagagactgagccgggccctgtacagatttttaccggaacctgtaaatcggtccggtgattttcgggaaaattccccaatccagtccgactgatttgaaaatattggactcttttttatctggcttgaagcatgatcaatcagttttctacatcttcagaatgaacaaaccgattggtggagtaagcaatgggaaactgatcaaggaggatcggtggactttcaaaatgcatttttgggtcataaatcgcaaaatttcggccttttttggtgtgtctgtgatgccaattgtccatttgcttttgtgtgtacgccaaatggatgccgtaaatcaaaaaaaaatcttttccaattaattaattgaattttattccagaaaattcttcaactttactcaatgtggatggcaaaattggctttgtccactacaaatacggtggacaaaatggagaacattcatcgaattccatgtacctttagcggtttatagaacccatacttttgtaaaaatccggtaccggaattcaggattggcatcaggccagggtaggattaccgcgatttgaatcccgacaccgggactcaattccgattttgccgggacccagatccccggcccttttttcaaaaaagcctcgatcgggaccgagaaaattccggcgggatgccgatccctttcgggctttagcagtttatgtgccaaaaagacttaattttcaaaaataattttttaaattagttttaggtatatcctaaaatgggcaattaatttga

SEQ ID NO: 81179 - DNA, 488 bp, Heterodera glycines
  Genomic contig location: Contig_ID=SeqID_16772; Location=279..766; Strand=-
  SCN-specific regions: Sequence locations=1-156,184-268,290-488
atgcttcgttttgtcctattgtttctgctgttcgtcgtcggcttggcgttggccaaaaaggtttttttttgagaaattctcattaaattttccgttaaattttccaggccgatctcgaagaacttgagagcattttggatgagttggacgaaagtcgcaccgccggcaccggcgccggcggcgccgaaccgcgccaagagcgcgaccaacagcagttggatcagctacggggtaaattttcaaaaattatttcgaaaatttttaaattttcagcctccgagccaaacccgtgtgatcagcacgtgtgcggatggggcaaggagtgcgtggtggacaagaaggggcgcccggtgtgcgagtgcatcaccaagtgcccggagctggacaatgacccgcttgaccaggcacggcatttttgggggacggggagaaagaaattttatttacaaagcctagagggagagaaaatggcaaatttatgtatataa

SEQ ID NO: 81180 - DNA, 1128 bp, Heterodera glycines
  Genomic contig location: Contig_ID=SeqID_16773; Location=53..1180; Strand=+
  SCN-specific regions: Sequence locations=1-76,102-381,404-406,428 -802,824-1128
atgaccaggtatgtaggtatcagcagatgtcaaaacaaacgccatattgatgatgatcagtgaccttgaaaagcccaaaaatattaatttttaaaatttttcgaggggggggggtagcaaaacaaggagtaccacactgggttaggttcaaggatatattttgtcatccctaaaatttcttgttatcacagtttaacacacttccagaactcaacattagccaagtgtcagaaataacccacaaataaccaccaaaacacgggggaggttaaaggttattctcatgatcgaaccaatttctaaaacaaattaatcggcctacgaatcagaaagttaactatgtattagactagtgtttttcaaatagattatgtatctatgtatataatttttaatattttttccctttaaaattctttattttatttcagtgacgaaacgttcggccaccaactcgtaaagctcttttttcaaaaaatcaacaaattttctcaaaaagcagcaaatcagcatctcatcaaataatcagttttgaccagggctcgcagatgaaaattttcaaaagcctcattcggcaagcaaaaaagcctcattttgggtcaaaaagcctcatttttacaaatttattcaaaacacgtttaaaatgttgtatttttgactgtccgtgactaatttgagcaatttttttatttgaaattagcattttgtgaaaatctgagtatgaaaaatcgaaattgatttttttttttcagcgcttttgccaaaaacttttagggaacaagggggtccggcggcgcctaactttcttttttgaaatgcaataaaattttcttgcattttaaaggctattgaatgataccaagaatgtttttaatttggtcgaccttaacaaaagttatgacatttttttttagtcgaaaaacagtacgagttggagcagtacgagttggagcagtacgagttggagcagtacgagttgaagctgtacgagttggagcagtacgagttggagcagtacgagttgaatttctcagggaatttcggcaaatttcaaacaatcgtattgaaaatagggcttatatttttagggttttgccctatttttttcatgagctcccagtgcaatga

SEQ ID NO: 81181 - DNA, 53 bp, Heterodera glycines; identical to SEQ ID NO: 80673
  Genomic contig location: Contig_ID=SeqID_16773; Location=589..641; Strand=-
  SCN-specific regions: Sequence locations=1-53

SEQ ID NO: 81182 - DNA, 739 bp, Heterodera glycines
  Genomic contig location: Contig_ID=SeqID_16773; Location=1280..2018; Strand=-
  SCN-specific regions: Sequence locations=1-161,183-378,406-541,564-739
atggacaaccaaagcgattgcattgcaaagacattcaagaacaaacgaacactgattggatcaacaatttcaaggaggtgtggtcagggggggggggcaaaatcaaaatttcggaaatccgaattctgtgccatccctgctggtgtggctccacatttttggcaaatgactgatttttgttttccaaattgtttagcattttctccgtgccaatgccatttcttccgtcagttaccaaattcatttttctgttcctgcgctgtcaatgcaaatggtgccatttgaatttcttaacgaatggacaaaggaaaagctgacattggccaaagcaaatgaatgggacatcgattggataatgaaacgatgcaaaattattggggagaaagaggagaagcagcagaaagatgataattgggacaatgtgttcatttggcttttcggtaccactaatagcattgggtgagcaattaaaaaaagcatttgatttttatccgaatttgaattttgcgcttaatttaggccattgtctccgccaccggaagaagttgaagaagacgaagcgggacaaagcatcacaaaagggacgtcttctgctgacaaatgagtgacggacaaaagaacaaaatcaatgagcagacgcagaagaaatgaatattaattgaaaatgaccggacgatcataattcatcagtgatcaagtgcattttatgaagaaaaacctctcaatttcggtaaataaa

SEQ ID NO: 81183 - DNA, 378 bp, Heterodera glycines
  Genomic contig location: Contig_ID=SeqID_2704; Location=1033..1410; Strand=-
  SCN-specific regions: Sequence locations=1-316,341-378
atggtttgtcattgtacattagcaaaaacaaaaaaaaggctagtaataatgcttaaagtctcggtttcatctaatgagaaacttggtttttttggagtcgcagtctcaagtttcagcaggagccaagtctcggttttggtctcgactttcgggggagggggttagtctcgagtagcttttgatttttcgggcgattaaactccccattttggtctcgagattatcaggtctggtctcatttaaatgaggggtcagtctcagtttaagtttttcaggtgtcaagtctcggtttaggtcgtctcaactctcgggggcacagggcaagccttgagcccaggggttaaaatctcggtgtattagggacattttgccaataaa

SEQ ID NO: 81184 - DNA, 215 bp, Heterodera glycines
  Genomic contig location: Contig_ID=SeqID_2705; Location=996..1210; Strand=-
  SCN-specific regions: Sequence locations=1-102,173-215
attataatacgtattatgtgatattattatctcccggcagatcaatgggtgagaccaatgcgatgggaagaataacacaacattaaccccggcgggggtgagaataaatttaaaaagagaaaagaaaaaataattattgttaatttatgattttaaaaataattttatttttcaaaacatggcaggtaaaacggattttctgtaatagctctgtt

SEQ ID NO: 81185 - DNA, 62 bp, Heterodera glycines
  Genomic contig location: Contig_ID=SeqID_2706; Location=3718..3779; Strand=-
  SCN-specific regions: Sequence locations=1-62
cgaaacgggagcgccgaaacgcgagcgccgaaacgggagcgccgaaacgcgtgggtccctaa

SEQ ID NO: 81186 - DNA, 249 bp, Heterodera glycines
  Genomic contig location: Contig_ID=SeqID_2707; Location=1274..1522; Strand=+
  SCN-specific regions: Sequence locations=1-169,191-212,234-249
atggaggacaaatggccccaaatggaacaaatgagcacccgaagttgggcaacgggacacatgatcactccaaagtggtgtaattcatcacccaaacagtgcaaccgatcacccgcaagggataattgatcaatttttattgatcaagctcggagagttttattttcagttgaaggaactcatccagttcagcgctggctcgtcctcttcaacctctctgattgctgctggacgccattttggcactga

SEQ ID NO: 81187 - DNA, 273 bp, Heterodera glycines
  Genomic contig location: Contig_ID=SeqID_2708; Location=544..816; Strand=+
  SCN-specific regions: Sequence locations=1-273
atgctgttctgtggagctgtcgccggcaaaagtgatgattccgccgtcgcgcttggcgcgtacaaaggtcgccggaaaaaaaatccccaaaaattttaaaatttaccgaaaattttttcaggaaatgcccaatatcatggacattgatgacaacgaatacatttcttgaaggactttgaattaatttattttgttggagcaattttttaggcggatcgttcgcggatttattgaggctcaacggacggacaaacgaaaaatccgttttttaaa

SEQ ID NO: 81188 - DNA, 492 bp, Heterodera glycines
  Genomic contig location: Contig_ID=SeqID_2708; Location=1814..2305; Strand=+
  SCN-specific regions: Sequence locations=1-492
atgtatgccaattttccgggcacttgccgtgccgcttcatcatcattttcggcacaccgccttcgtctgctgctgattgtggtgatttttgttgtgctatcagtggtagctgatgttgcccatgcgatgggaagtatgttctcaaaaaatcaatccgacgtgatgatcggaagagatttatccgatgtggtgatcgggcacgctatgtggcaactttgtatgaaccaatgcggaaaacacaatgccaatttggctctgtgcgaagcgggcttcggctttattataaacaggaagatatgcagatgcaaaatactggaggaaaaatgcgttccattttcatttggtgaaccattgccggatgtaccagtggatgatgacgatgaatatatcaattgttttcgcaactcataaaaaggaattgtggttgttgcatttattattgctttatttagatagaaatatatatttgctatccgttcattaaaatgtaga

SEQ ID NO: 81189 - DNA, 1933 bp, Heterodera glycines
  Genomic contig location: Contig_ID=SeqID_16774; Location=188..2120; Strand=-
  SCN-specific regions: Sequence locations=1-15,37-140,162-509,531 -894,917-1078,1100-1680,1710-1807,1829-1933
atggtacttacacgtaataaaactgaaaaattcaaggaaatgagaagttctagcaccgaagcaaatcgaaaacggaaggaatggcgcagggaaagtggaagaaaaggcggctcgacgccaaaaagtgacgaaaattgaccaaaattaattttattttaaaacactgcatttttcagcgctaaagcagaccgaagccgagacaacagcagacggagagggtacattgacccaagccgccgaaagtggaccatcaacgtcaactttggaccttcgtaagtcaataaaaaacaatattttagaagcaaaactttaattaaggcccgcgttcaagcccaaggccattgtcagcgactccggtcaggcaccatgtgcgtgtccgtccagaaactaccgacaaagcaacaaacatggactttacaactaccgacaatgcaacaaacatggatttgacaacgatggacaaggcaactgacgtggacttggcatatgaggacgccgcgacacaaaccgagcagttggacaaacagctggaggagcaggaacaaacgatcagctttctacgactgcaggtccgcaacagagacgcaatgatcgctgatctgcgccgtcaattggaggaaaagatggcaccaccgatggagacaccgaccaccagcaaaagtgagtgaaactaaaatcccctttttatctttttcaaataattttctcttttttaattttagcaactccaacaggacgaccaaagatgaatgtcgatcatttgcagcgcacctcacgtcgcaaattggctgatgaaatcgcggctgtaataaaacgggacagatcacgctcagccagccgggcgtccctcgaacggatcagtcgggaagttcggcacaaatttgctcattacacgccacagaagaagaaacaacaactgccaagataaaacaagtcagttgatccagaggatgctcttctgatcctcaggattgtcggtacacagaaggcttacagacgactaaaaaacactattcgcctgatcaatgccaaatttgatgtgttcccgccactcgaaaaagtaaaaacaaattttagcatttatatttatttaaaaattcaattgaatattgttagctgcttgacatcaaacgccgcatctgtgggtcattgcaatacgcaccaattgagactagtgcaggtgttggatttgtgtgcactgatgttgaggcagctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttccctacaaaggatagccgcgaaaacttggagcgctatggaagcacactttgggaacaaattgacggaataggcacattggcgggcaaacgagtcaagtggtaaattttaaaatttgtttttttccatttttctgaattaaaaggtttatgggcggagacgtcagttttatttggtcaatgatcgggcattgtggttctgcagtgacaacatttccgtctccaatttgcagttgcagaagtgatcatttggtgcaggagggcgaaatttgtgaactccggacaattgatcaaactgttgttttatttaaaaatttatatataataattcagagacgaagtgatcagagggaagagcatgatgagttcgatcaaccggaagaagaaactgacgaaatttcgcttatcaatgtcattgattgatggtgatttagcaagaagaaattggtggtcgacgggagacggacgaagaaaacaatggagaagaagaacaattcgattttgaatagacacagttcgataaaaggtttttcttcgtttttacaggaaataaa

SEQ ID NO: 81190 - DNA, 1490 bp, Heterodera glycines
  Genomic contig location: Contig_ID=SeqID_16774; Location=2539..4028; Strand=+
  SCN-specific regions: Sequence locations=1-286,309-343,365-388,411 -588,610-1490
atggcttttggtgggcacattgcaaatattgctcgtgagggtatttgggcttctttgactggtggatggtattacgaacctgcgaattctttattttgcaacacacttcatctgtacatttggtcgcttttattcgtccttccgattctgttcggtctttctatcaacgggtccaacgaacagcacaattacggtcatgccatcatttatttgtctctcctcggcttcctttttgtgttcatcaaaatgtccgttgcttttctccatcacatatttgacacagttcagcccatcaaatataaatcaaaaaagaacaccgacggattgcaagacgaatcccaggtttgtatttattttctaataacttgtttgtttcttcataatttcattaaattttttacagaaatttgcccgtgggactcgcctttctggctcttcgatcagcgccactcgtccaattggaagtagtaacgcattggaagcaattgaaatggtcgacattcgcaggaacattaaccgtttgaggaacgaagctgacacagtgaataacgaacagagtgatgggtgtaaaacaaaaatggacgatgaaaacactgagagagaaagaaaagggtgtgaattgattgattcattagaaccgaaaagactaataaataaatgggtctaatgcactttatgagtccaatcgacttttatgagtccaatcaattgttagaaccaaatagactcacttgaaaacggattttgtttaggaatcgggaagcttattaccattcgttgccttccttcggtcattcaaatagaaactccccgtcaaaaaataaagttgacaacaatcaaaatgacgatgcttgctcctcgaggtcctcaacctcggcttccgaattatgttcagacaatttcctgcccaacccaacgaacagaagacgaaaaggcagacattcggttggagttgaattcgcaaacactgctgacagttttggtattttatcaaaggacagttttggtattttatcaaaggtactgattggtgaaaaaacattatgaaatacgcttttagaataatccaccatttccacaacaaaaacaacgcaaattttctgaaccaattgggacgaacagagctaacgccacacttaaaaaacactcgccaggcgaatggcacgaaacatttggacagaattggcaaagtgaaagacgaaaaaatattcagaaagcgaatgaaagatcgacacttctgaggaataattcgacgaagaacccaaaagaactgagaaggaatacgatcagggaagatgaggttggaaggactcaaaaaaaacaattcaaactttaattgtaagataaaacgccgtgcaaccaatttggccttgggagtttttgttgacggaatcgaaatggataacacaccgaaccaaagaagggaacgtgaatatttgttaagagatatctttatgagtggcgctgaaatgaatccgtcgtcgggtttt

SEQ ID NO: 81191 - DNA, 1191 bp, Heterodera glycines
  Genomic contig location: Contig_ID=SeqID_16775; Location=824..2014; Strand=+
  SCN-specific regions: Sequence locations=1-184,207-318,340-835,857 -1111,1134-1191
atgcattttctaattctcgtgcaaatatttttaatttgctttacaaatacctcgttgaatttgacattgtcaaatctctttgaatcatgcggaaaatatacagtggactcgctgcaaatgaagctccgctacaactcacataatcggagcagtccattagaaatttggatcagcagtgaagatgattttcctggcccacttggaatggtacaattaaaattttaaaatttagtggtatatttttcgaaatttggaagataaatccgttgggataaactttaaatttatttttttacagaaaattaacattataaatccaaaaaatgcaataaactaaaatccaccctataaattccataattcacatattcagacatcgattggtttttttgtggacaatgatggcgtcgtaaaatgtgcggctgtcaacttttttaaaggctacgaagggagaagaattatgacaaaaacccgaaatgttatggaacaaattcaagcaagattgccaagattccaacggcaacacatcatcgaactttatgatacgtaagtattttcgaaatcgcataaaaattgatacaaaattcctaaattttaaaaaattcggagggcggaaagctctttcctaggtctcaaaaaaaatcggaatcagaatgattacacggtgactcattaaatgatcggaattaaaaactgaatatggatctcatctcaagggatacatttttagcacaaaaaatcgcgaaataggacctaaaaaggaagaaaaaaaacaaatatattttcggatcaattttcggtaaaatttttcaattagcgtgttttttctgtaaattttcgggtaatttcttaagggtgtattttcgttttttttgcatttcgggtaatttcttaagggtgtatttttcgttttttttttgcatttttgttaaggatttttccgaaaaccctgaaaataggcgccaaaaattgcgaaataagcacaaataggcgcctaatctctgatttagaggcaatgctttgcgttttaatgaagaaattttgatcatggagttgagcattgaaacttttcatgatcgactgtacaagcgcattgattcctataagaatgaccaagaaatgcagaaatatatccggcaattaacacaaccaatcatggaattgcatcagggcacatattatgctaattaa

SEQ ID NO: 81192 - DNA, 228 bp, Heterodera glycines
  Genomic contig location: Contig_ID=SeqID_16776; Location=531..758; Strand=+
  SCN-specific regions: Sequence locations=1-48,70-228
atgaaaatcactccatcaaattacatgtacgtttctgtgaatgacgaacaaatattgaaaattaaaaattttgaaagtgcaaaaataattgattcgggcgacaaaaatgaaagttatctgtttgaaattgacgcagtcgaatcattcacatcattcaactcagaatatatgggcccagagaattatgcacaaacgaaagaagttcgtttccattttagtatatcctga

SEQ ID NO: 81193 - DNA, 695 bp, Heterodera glycines
  Genomic contig location: Contig_ID=SeqID_16776; Location=1041..1735; Strand=+
  SCN-specific regions: Sequence locations=1-363,385-590,619-669
atgtttctgattgaccaaaatgctcttattaagatttcaacaaaatttgacatctggtctcttggaatgattattattgagattcacgtagaccaacttcggttcgcagaaggaaagaattcgttaaatgaggtcatttattttcatgtgattagagtttggcctggatctggatcctgccgggccttgattcttcctggatcaagatccagaccgtttttcggcaacctggattttccctggacctgttttcctggaattttagcaagaaacaggttcaagtccaacatggaatcaatgtcaaggatccaggtcaaggatcaaggtccaggattttccatgtcgaactcagcgtatgattaaaaaccttaaaattatttttaataggcaaatcgaagagtttaccttcgcgaaatcggttatttgtaccaaggatttgaacgaaacccaacattggactccattggcttaaataaaaatgaagaaattttcaataatagcgcttggataaagcaataccacaaagcaattagcattgtcttacaattatggcgcaattttcccaaaacggcacatcttgtcactgtttgttaaaataataatttaaaatgttttaatcgcctctttatttaaaaaaaattctgtcagttttaattaaggcttcaaatgaaaaataattaattaaatattaaaaa

SEQ ID NO: 81194 - DNA, 2110 bp, Heterodera glycines
  misc_feature (2100)..(2100): n is a, c, g, or t
  Genomic contig location: Contig_ID=SeqID_16777; Location=7..2116; Strand=-
  SCN-specific regions: Sequence locations=1-644,668-1069,1091 -1128,1172-2110
atgacgaagaaaattgtgagcccgttcaattcaaacgtggagaaacaatccggggagctctttgtctttggtatcaaggtgttaatagtttttttttttattatttctttatttccaggctttcgatttatcaaaaacagaaaagatggtagctggttcaggtgcgaacagcgcaattgtccagcgacagccaaattggacgacaacgatttgatgacaggcattctgggcgcaaaaggacatcaccatggttgcgcaccatcgcgttatgatgcagagacgaaacgaaatcagatgaagcgcctgatcaaggaggagccaaaaatgaaaccatgtcaaatccgcgctcaaattcggactgacatcgacgatgaagtcttcgaattgctcggcaccaatgaagcgctcgaccaaatggcgaacaggtagacaaacttcagagaaaataatgatgcaatatttagaacaaagaacaaattcgttggtggtgtcaactgtgccgacccactgaacatacaaattccgcctggtcttttgataaagaatgatgagtccgtcctcatttatgacagccgtgaagtgaggactggacaatctgatgttgtcctgattttcagtcatagcaaggcaagtcaacctatacttatgtcattttttaaattagtttaatttcagctgttgtcagtgctcaaacagaatcgtcggtggagcctcgacggcacattccgcagtgcgccaaagccgtggatgcaagtgttcgtcatcggttgttatgtcaacaaccgaatggtggttgcagcgcaagccttgctacctggtaaagcctcgaagtattacacagaagtccttcaacagttgaagcgtgccgttgaacccatccttcccataaaaggcaaaaaaacagcagattatcttcattaataattattttaagtgatgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacgacgaagcaccggttcaaaggaaatccgttcacaaaacattcaggtgtctttcattagcttatgtgtatttatttgttttttcaaaatcagatctgttctctctttggcactcattccgccactttacgttcggcgcgctttttcaactattgtcagcgcggcaccgcttggagttcaaggatggctggcgtattttgccaaaacctacattggcaccactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgcttcccatctcgttttggaatgtgtacaccagggctcaaatggcaattgagcgaacgaacaacggcatggaagccgcgcatggacaatttgcagtaaaaatttgtccgttggaagacacttttttgttaatttagcgtgaactcaatcatcatccgtcactgagtgatttcatcgctgcattcatcaaggacatcgacaaacaactggacattggacgagcagaacgtctccagaaaagcacaaaacgacgacaacggtacatcatcaaagaacaaaatgtggtgcgtatccttgacgaggctgactttgaatcgcaagaaggattgacaaacgccttgaatctgatcggacttgtaatgcaaggctttgttgagggacttcacatccgtggaaatgaagacagtgaggaagaaactgatgataccgatggaaattgaatttatgattttaacaatttttacttttatgatttttaacattttactttttttttcttcggangtttaataaa

SEQ ID NO: 81195 - DNA, 726 bp, Heterodera glycines
  Genomic contig location: Contig_ID=SeqID_16778; Location=450..1175; Strand=-
  SCN-specific regions: Sequence locations=1-45,235-547,569-726
atggatacatcagcaatgcaaagtgcagagagaatacagaaaaatgagagagtggaagaaaaagggaaaagatgcaaaggagtagagagaatacagaaaaatgagagagtggaagaaaaagggaaaagatgcaaaggagtagagagaatacagaaaaatgagagagtggaagaaaaagggaaaagatgcaaaggagtagagagaatacagaaaaatgagagagtggaagaaaaagggaaaagatgcaaaggagtagagagaatacagaaaaatgagagagtggaagaaaaagggaaaagatgcaaaggagtagagagaatacagaaaaatgagagagtggaagaaaaagggaaaagatgcaaatggccgtcgcggaggggtgggaaaaggaatggacggacggattgggccaaggaaaatgttattgaaaaacctgcgttaatcggcaaaactcctaatttttcgtattaacaaaatttgaactttaaattttgaagttttttcgagaaaaatgaagcagggccctagcatgttttcgaactataacttttttctttgccaaccaaatccaacattgttggtatcattcgaaagcttaacgtgtttagaagcaatttttaggtaaaagctaaaaatccgagccctagtcaaaacaaatttttgtaaccgaatgaatggattttaggagagaattgcgaaattgacaaaaacagtcgtggtaataaa

SEQ ID NO: 81196 - DNA, 171 bp, Heterodera glycines
  Genomic contig location: Contig_ID=SeqID_16779; Location=677..847; Strand=-
  SCN-specific regions: Sequence locations=1-171
atggaccgaattcgccgtgtcgcctcgaatttgtcgctgactgcgaagggacaaagagaacggcgacaaaatttggcattactttggggaagaggagaagcgaagaaagcgaaaaatggagaacaaaaggaaaggacgaaggaggagggggcattgagcaaattgtgtaag

SEQ ID NO: 81197 - DNA, 711 bp, Heterodera glycines
  Genomic contig location: Contig_ID=SeqID_16781; Location=385..1095; Strand=-
  SCN-specific regions: Sequence locations=1-299,322-377,399-711
atgtcagacaatccgaaggaagctgagagagaaatggaaaaagcgatgtaaacaattagctacttaattacctaatctaaatttgaacttccatgataatcaatctgtttttttcagcttcatctctgccgactgttggctggaagtgttcgatttgctgcccatttaccagcttggccatggaattgcactgatcagtcaccgatttgaccgccgcgttgatgaacacttcaaaacgcgcaaatggacgttggacaaattggaaattcgatgcaaaattggaacaaatgaaatggaaattatcaattcaaaaggaaaagcattgccaatccctcaaaatccgttgccgaacaaagtcatcggattcagaagcattgagattttgtaagaaaatgaaattttcaaatgatctgtgacctcaatcaatcatactttctgatttgcagcttcatcgactacaatgtgctcacttttctccaccattttcatcgttttttcgccgtcatttcgacgaaatggtacattaccactgaaaatgttcgcattttggagtttattgtgctcaccatttggccaatgttcaagcacccaattcacgaaatgattttgagccccgtcatttttcgccgaatgcgtcaatttgccccgtcccattctgtgcaattgtccgtgcctccaaactgtctctctcttttccgacattttgcttga

SEQ ID NO: 81198 - DNA, 1130 bp, Heterodera glycines
  Genomic contig location: Contig_ID=SeqID_16781; Location=2778..3907; Strand=+
  SCN-specific regions: Sequence locations=1-1130
atgcaaattgtcaattccgatggaaatccattgccaatcccgcaaaatccgttgcccaacaaagtcatcggattcagacacattcagatcatgtaaaaattgattagatttttcatgccatcacattttctgcttttcagttacatcgatcaaaatgtcatcacttttctccgccgttttcaccgttttttcgccttttgttcaatttacttggacattcgcactgaaaatgttcgcattttggattttgttttgctcaacgttttgccaatgctccgcgactccattcgtcttatgcttttgaataccatcgcttttcgccgtttgcgccaattggccccgtcattgctcaacaattgtccattccttcgcgctgtcgtgtttgaagacgccattttccccgcttttccgcccgatgacagtgccaatgcgtcggatggccaagcggtgaccaaatggttgttcacgcctcgtccggatggtgtgccgaagtggctcacaatcagatcctttgtggattcaccggatcaatggtcgtcaacgatggaacagctcaaagcggtgattatccctatttaattggcttttctatgattttttgtccgctttttaggcattttccaatgcttcttctccggtttctttttgtattcactttctgatgtcttctccgcttgacttcattgttccatttgatctgatcaacgaagtgactggggagaaattgtttcttctacaatctgaaaatgatttttggctcatccgttttcaaattggatgggatgagcgaaaatgggacaatgtgaaggataaactgaaaaatcgaacgaacccaattgtcattcggatcaaagatggcggattcgacgacgggtgaacaatttaaaatgcttaatcattttatgagtccaatcgtcgacctttgcttaaactttttgctttcaaatcgtatccaaaaaggtacggtttgttttgaaatggacagaattatggtacaaaaaaatcaaggatagtcagttggttggactcataaaatgccaatgtcttttaatttgcaatggaataatcatcgttttttcagtcttctcgacgacgcttctcccgggccgaatgatcagcagcagaaatga

SEQ ID NO: 81199 - DNA, 1516 bp, Heterodera glycines
  Genomic contig location: Contig_ID=SeqID_16782; Location=772..2287; Strand=-
  SCN-specific regions: Sequence locations=1-2,24-61,84-132,154-219,243- 306,330-418,442-1487,1509-1516
  Gene Ontology: Mol. function=ATP dependent RNA helicase activity; Cellular component=nucleus; Biological process=RNA localization
atgagaagaaccgcaaattgttggacttgttggatgctttggagttcaaccaggttttacccagtgtatttacacatattaatcggtacaaatgctaaggtcgtcatttttcttcgttcggtcagccgttgtcgtgcattgaatcagctgttgatcgagcagaacttcccctccatcgccattcatcgtgcaatggcacaggaagaacgtttggcgcgctaccagcaattcaaggacttccaaaaacgcattcttgtcgctaccaacttatttggtcgtggaatggacatagagcgcgtgaatatcgtgtttaattacgacatgccagaggatactgacacgtacctccacagagtaagcaacaagcaaaggaatggctaagtcgtccaaattaaattaggttgctcgagctggccgttttggcaccaagggattggccataactttcgtctctgatgaaacggatgctcaaacgttgaacagtgtgcaagatcgttttgacgttactatttctgaactccctgatcagattgacgtcggaagttacagtaagatctaccaaatagttaaattgtacacttcgagttaagtcgaaacacgaaccggcaacaatgctgcagccgaatgatgagaattaagatggatgatcagtttattttggatttatattgttttgtgctgtcaatctacatcattttcattttacaccgattttgtttaaccaatttaaatcggtcgagtaaatttggtatcattggcatatttttaatggttgcatattgttttcccgggccggtcccctaaaaatttctaagatttggatacaactgaccagacttgagtaaaaagaattgtttttgttctgttgcagatcggatttcggttcctaattttaacctttttttgtcctggactcaaaaacatgttagggtttttgaaggttcttactacgaatctgaacgcggacttgcccaattcagttctcgaagcccggggttcgaaatggatgccggacgtgtagaatccttatggatttttcgcccttggggcatgaaaatttgtttaaacactatagccagagaagcctatgacttgtccttttttaatgaattgtcctgactttagctatgttgcagaatagtggtccctaaaaattcgattgtgatgatcacgaatctgacaaaaattactttcagcacttttatagattatgtagggtcgacaaaaccaaagagtgtacccttttaaaactgcgatgctcaactatataatgagtagggccgcaacttttagtgaaaaaactttttttttgctcaattgttttgaagaaaggagcttaaaaaacgcatttctgcattaaaaattttcgattctgatgtcatcatcggtcactagaaatcactattttggcgacttcgtcactaaaatagtgaaaattcactattttggcgttttgtcactattttttcactatttcgacattttttggaaaattccttaacaaaaatgcaataaa

SEQ ID NO: 81200 - DNA, 1388 bp, Heterodera glycines
  Genomic contig location: Contig_ID=SeqID_16783; Location=3..1390; Strand=-
  SCN-specific regions: Sequence locations=1-25,47-94,116-644,666 -967,991-1234,1261-1362,1384-1388
  Gene Ontology: Mol. function=ATP dependent RNA helicase activity; Cellular component=nucleus; Biological process=RNA localization
atggacgaggaacaacttttggattatgaggaagaacaagaagagactcaggaacaacaatcaaaaaatgatgcagcaacaaacggagatgcaacaaagaaaattaaagtaaaaagtaactgactcaaaaattcatcaaaccttttagggtaattatgcgagcattcacagcagcggattccgagatttgatgctccgtccggagttacttcgtgcgataattgattgtggatttgagcacccttctgaaggttgattacataagaaaaagctttttgtctggaacgggcccagagggaacacacgaaggagcattaataattgttaatcgaattccagtgcagcatgagtgtattccacaagctattcttggaatggacattgtctgtcaggcgaaatcgggaatgggtaaaactgcagtgtttgtgcttgccactttgcaacaactgacaccgactgatggcacgggtaggacatttcaatttaagctccttttaagcagcacattttagtctctgttctcgtcatgtgtcacactcgtgaactcgcctttcaaatttcgaaagaatatgagcggttcagcaagtacatgccaggagtgaaggtttttactaaattatgttacagccttcatgccccgggttaaggtttctgtgttttttggtggtatgccgattaagaaagatgaggaggtcctggccaaaaacactccgcacattgttgttgggacgccgggtcgccttttagcactgggacgcactggacatctgaagcttaaaggagtcaaattcttcgtgctggatgagtgtgacaaaatgattggggatgctggtacgacttttccaactttctttcctatcctgcaatttaagacatgcgtcacgacgtacaagaaatcttcaaaatgacgccgcaggagaagcaagttatgatgttcagtgcaactttgcctcgggagctgcgcgttgtctgcaagaagttcatgcaggaagtgagtagttcggttccttctttgctgcggttagcctcttcgaatcggcggtgttcggataggccttgtttttgcataaattcttctcaacaattgcccgttcgttgtctattcaatgagccatgaaaactgacgacacggggagggagctcaacgtcaatttgagtctctcgaaccatcagcataccaatctgtccggtttgaatggtgctgatgatagaagcggagtaattgttacgaggttttgttatttttctcttgtttcctttattgttatttctagaaatcgtgcgattgctcggcgaaatgggtgcctcaaatggctattctaactcaaagagagagagacggacgttgtgcttcacaattgagtgtggggagaaaaaggatcagatga

SEQ ID NO: 81201 - DNA, 2695 bp, Heterodera glycines
  misc_feature (2684)..(2684): n is a, c, g, or t
  misc_feature (2692)..(2692): n is a, c, g, or t
  Genomic contig location: Contig_ID=SeqID_16785; Location=68..2762; Strand=+
  SCN-specific regions: Sequence locations=1-628,650-1116,1138 -2594,2616-2623,2646-2662,2684-2695
atggaattggacgaaaaatcgaaaccgctctgcacaatcaacacccactgcggcctatttcagtgccaacgtctcccagttggcgttaaatcggcaccatccattttccagcacttgatggaccaaatctgcgcaggaattccaggggtcttctcttatttggatgattgcctaatcgcctcaaagaccctggaagaccacgtcaatgcgcttcacacgctttttcaacgcatcaaggactttggcctacgaattcaactcgaaaaatgcaaattcctccaaaaagaattactttttctcggccacatcgtttcctccaacggcatacgccccgacccagcgcgctcagaggcaatccagaaaatgcctgcgccgcatgacaaaacgaccatccgttcatttttgggagcgctcaattattacggacgttttgttaaaccaatgcgagaaattagggcgccattggaccaactcctccgaaaggatgaatcctggagttggggagatgaccaacagtccgcgttcgagcaagcaaaggcaattatggtttcagaacttctgctgacccactacgaccccacacttccgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaaggcatccccatttatgccgccagccgactccaaagatgggccctaatcatggccaattacgattttgaaatacggtacatcaacaccgcatcatttggccaggctgacgtcctctcgcgcctcatcgccaattatccccgaccagaggaggatattttgatcgccaacatctgcaccgaaaccgagtgctacatcagcaccattctgcaaaccaaaaccgaacaacttcccgtcactgcagacgaaatcgcagaggcgacaccgaaagatgagattttaaagaaaattttggcattcaccaaatcgaattggccaaagaaaagcagcgacccggacatcgcaccgtattttccgaaaagggaaaacattttggaaattgaggactgtttgctcttccaaaaccgcgtcatcgtcccccaatcgcttcgcaaccgaatgctgaagtccctgcacatggcacatcccggaattgtgcgcatgaaagcactcgcccgccaacatgtgtattggcccggcatggactcggaaattgaacggattgtccgtcagtgtgaagaatgccaaaaggctcaaaaatcaccgatcaaggcaccgcttgccccttggactccaaccgacaaggtgttccaacgggtacacatcgattttgcgggaccatgccaagacggtcacgtctatttcattttggtggactcattctccaaatggccggaggtctaccaaatgaattcaatgacggccgcggcaaccgtcttcacactccgttcaatcatccaccgactcggtattcctgaagaaattgtttcggataacggaactcaatttcgttcgtcagaatttgcggcactctgtaaggagttcggaataaagcacacttttacgccgccattccatcctcaatccaacggacaagtcgaacgtttcgttgacactttcaaaagggcgatgatgaagtgcaaaggcgacaagaacagccttgaaaaagtgctgctctcctacagatcaacaccaaattctgccatcgacggatattcgccagatcaattgttccttggacggaaactgcgcaccaaattggcactcgtccacccaaaaggacaaattgatcagtcggagaaatttgaaaaaggtaagttcaaacagcaccaaaaggactattcaaccaaaatggcacagcaattcgatcggaacaatggcacaaaagctattgagttcctcccaacggattccgtcctgctcttgaattatcgccttggaaaaagccattggctacagggcacaattgtaaaaaggttcaacaattcgccaacataccgtgtccacgtcccaactctcggccgaattgtccatcggcatgccaaccagcttcggcgccgattggattttgaggacaattcaaattgggaaccccccattcaggaacaaatggccattgatccaaatcaaaggacaccgccacgccaacacgcagccatcgatcagcgaactccacctgttgttgatcaggctaggcaaaaggctaaaagcccaattggcgtccgacgttcccaacgcgtgccgaagccggtcaaacgcttcacgccaggttgaaacgaggatgtttcaatctcgagaagggaggtgttggagaaaaagcaaatgtactttgctcatgttcaattatcgattattgatctttacatttgtccattctctcgtccgttccttccccctcacattgtctatttaaaggctggactcttcccccatgttcacttcttctcctgccttcaatttattatttttattcattattctctccacaccgaccccattcgccatttttattatttattattatntctcttcntaa

SEQ ID NO: 81202 - DNA, 574 bp, Heterodera glycines
  Genomic contig location: Contig_ID=SeqID_16786; Location=171..744; Strand=+
  SCN-specific regions: Sequence locations=1-467,489-574
atttttacctcctcccctcaattgaaaaaagttttgatcacttataaccagatcgatactgatcacttcactgaaaactcagtgcttcgcctcagggaaaattgatcaatcactttgcccattcattcttcacattcggctgatcacaacggtgaaaagcgaacatttcccagcagattgtaatcattaaaaaacagctttataagcttcaaatgcctccccttcggaagcggcggaggaggaaaagccctggctttgatgctcttcggctttatccacctcttgtgccttacctttatcctccctctttgcggcttagttagccttatcccctgtgttgtggcttaggttttatccccacttgtggcttagctttatcccgtccccctcctttatggcttacaattagctgtatcctccccgccccttcccactcatctccgtgtctaatgtccattaaacgatcaccccccccccccgcccgcccctcggctgtgggctcggctcggcttttccaatccaatatttacccaccacttggggcttcttcgtcgcctcgggggaggggtggggg

SEQ ID NO: 81203 - DNA, 1060 bp, Heterodera glycines
  Genomic contig location: Contig_ID=SeqID_16787; Location=1036..2095; Strand=+
  SCN-specific regions: Sequence locations=1-131,155-388,410-578,860 -917,992-1060
atgagtcatccgcctccaattgatgctttgtccacctcaaccgccgcttcatcttcattggcatccacaggcgctgcgcggttagcgccggcgttgttccacgccggcagcgccaagacaaattggacggcgatggactgtgtgtggctggaggaagtgcacaacatacaggcaagaacggaagattacggtaatcgtataccataccgatagtttacggtagaattacgataatcgtataccaattgactacggtggaattacgatactcgcataccgatcaaactcctaaaaatgtctggttttttttttctatgccaaatggccatccctgttattactatttattttgaattatacaaaacgtgccctctctttaagtttctacagtatgcataaaatacagtataacttccccgttttactgttgcagaaccatttgtactggcgccagaacagtcccgtgttgttgctgagcttgtacgcggttgtgtgcacgttcggcacggtggtcaatttgtttgtgctgttgtcatttgctcgggtttcacaggtgggcaaaatgaccgattttttggattttttatttttaaaaatttaaaaaattattgcaaaattatttggcacaatttgtttttttatttaaaaatgtttttctccaaatttcaaataattaaattaattttttaataaataaattctaatattttattgaaattaaaaatgaaatattttaaaataattaaccaatttaaaataaaattttcttctaaaatataaaattattaatatttctcaataaattgtcattttataaatatctgattattcaaattaatctatttaaaatatttttatagtttcataatccgcaaaataacaaaattcatgcttttcttgtaaaaatttgcgaaatgaaaatattttaaatttttttttaatatttttaaaacaaaaatttacaaataaaaaaatatttttaatttttttagcttcgcaatttgcacaattatttcatcgcaaatttggccgtggcaggacctgcttctgtgcacagtga

SEQ ID NO: 81204 - DNA, 208 bp, Heterodera glycines
  Genomic contig location: Contig_ID=SeqID_16788; Location=1..208; Strand=+
  SCN-specific regions: Sequence locations=1-39,66-85,109-208
gtccaagccacgaaatgtccaaaagagtagaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacattttgtgg

SEQ ID NO: 81205 - DNA, 757 bp, Heterodera glycines
  Genomic contig location: Contig_ID=SeqID_2709; Location=22..778; Strand=-
  SCN-specific regions: Sequence locations=1-734,756-757
  Gene Ontology: Biological process=growth
atgtgccggtgtcgccaaggcttcctggacatttcgccaaacatcacgataaagccgggccggttgtgcaaatcgttggagaacgaatgcgtaaaggggtcgcacgactgtgcgcgagacggcggaatttgcgaggacacacccggtgagtgcctgtggacgacattagcatcttgctcgactgtaatcggcttcaaataacacaaaaattggagaattgaagcgctttgggaagggatgggatatattcaggaatgacgaagtgatcatagaaatccgagaatggcttaactgtcttacagattcgtacacgtgtcgctgtgcggccaacttccttgacgtgtcgctggaccgaaagaatcggccgggccgcaactgcaagcggctgatcgacgagtgtgcgtccggccagaacgactgttttccgggcgcactgtgcaccgacacggaggactcgtacacgtgcgcgtgtccgcccaaccatttggacgtgtcgccggactcggccaagcggccgggccggcgctgtctgttgcgcgtcaacgagtgtaacgtgcaggggctgagcgactgttcgccgaacgccaactgtcaggacacggacgaagtcggcatggggttaaaaaaatttcgagaaacatggcaattttttttttaaattcaacggcacacgcatgcaaaattacagggctacaactgcacatgcgcggatggctttgtggacgaaagtccagacaaaaggaaacggccgggccgc

SEQ ID NO: 81206 - DNA, 1594 bp, Heterodera glycines
  Genomic contig location: Contig_ID=SeqID_2710; Location=213..1806; Strand=-
  SCN-specific regions: Sequence locations=1-412,449-500,525-628,650 -921,957-1092,1116-1443,1510-1594
  Gene Ontology: Biological process=growth
atgcgactgcgttccattgtccaaaagctgacctgcccgcagccgccgcgtccgcccccttcgcccggcggttgttccgtgcagtcgcagatcggctgtgaccggacgcgtaacgagcactgcgagttggtcaacggcaagccgacctgccgctgtccgggcccattcgcacgccatccgcagaccggcgtctgcggcggcgacctgtgcaacccggaattgccaacctcatgcccgcatcccgaactgtgcgccaagacgccattcagtacgcgagcgtaacaatttgttactactgtattgggatgattaccgtatggcacacccaaaagggcaaatcaaaaaaattaattaatgatgaatgatcaaaaacaattcagaagggagaacaattgttttccctaatgaaatgaatatttattttttaagaaaatttgattaaaaaaatggagttgggagcagcttatcccccccccccctccccccgatttctttaaaattttcaaacagaagtttttccaaaaaatcttcgaaaatttttatatgaaaatttgaaaaaaatacattcctattctagtgatttttcaaatttttcatgaattattaaacaataagtatttcaaaaaaattttccaaaaaatagctgaaagtgttatctttttttttggaattttctttctggttgggcagaaacgatagaaacgataagggagaaagcataatgcactcccaaaattttaaccattaaaattgatattgtagatacattattaaatctgctaaaaatgcaattttctcccgctgcgtaaaatcttgaaaaataccagaaataaaaaataaaatctttcaggcaatttccgttgcgtgtgccccgcgcagcacagccgtgaccaccaactgggcatctgtttgagcagtgtccaacaacgacaaaaccaacaacatcaacaacagcagtcgaacttctcgaactcctcgaccaatgccaactttggcacaacttttgtcagcggtggcaccaatcagaaaccggcaccccaacagcaccacgtgtccactcaatcgaccgccggtggcggcaccaacaacagcgccggcaacggcggcaaattcccgccatgtgcggccggcactgtgccgaacccgcggaccggcaaatgcgcggtgcccggctcgtgcgacccagcggaggagcagccgtgcgatgtgcgcaagcgtgagaagtgtttgctgcactcgaccggccagttccacgcgtgccaatgcttgcatggcgagaagcggcacccagcgacggaaatatgccgtaagttttcaatgttttgtacgacgcgtggcgtgccttttggatttgattttttggcaatcacaacattgcaaatttgagctaaactaagctcatatgtataagatatgcacttcatttacccagcgacttttccctttaaatttttttttaatttttaaattagaaatttttcaaaaaaaaaagaatttttttctaaaaaacatatttcttagtgcgcaacgaatgcttggacaaacgagaaaacgattgtgaccgatcagcaaaatgcattgacacagatgaatc

SEQ ID NO: 81207 - DNA, 1276 bp, Heterodera glycines
  Genomic contig location: Contig_ID=SeqID_2711; Location=348..1623; Strand=-
  SCN-specific regions: Sequence locations=1-146,168-539,561-1276
  Gene Ontology: Mol. function=calcium ion binding; Cellular component =extracellular space; Biological process=growth
atgccatttgcgtcaacgtgttcgactcgttccggtgccaatgcaaacccggctattgggacatgtcgcccgacccggagacaaagcctggccgagcgtgcaaagaatgtgcgtttttaatgatcgttgaaattcttgatgaattattacatattttactaaaatttgcagtgatcaacgaatgcgcaaccgattcgcacgactgttcgccatttgccgaatgtgttgatgcaacggtaagcgatcaaacagacagacattggcattcgcattttggcaagtgattggacaaattggcaaaatctgattacgggcaattacatccggtatgtattttccacaggatggctacgcgtgtgtttgtcgtgatggctttgtcgattcgtcgtcgcagtacgaattgctgccgggcagaaaatgttcaaacggtaatttaaaaaaaagtttaattgacgcttttggtaatggaaagccataacttccaatcaccaccgccataaataaaaaaatggcattcggatgggtgtggccaaaatgggcttaaccatataattaaatgggctgggatggccgtctcggagttggcacgtgtccacatccccccaatcagcgagcaacgaatgcactgatcggtcgctgaatacgtgcgatgagaatgccgactgtgtggacacgccggccggctacagctgcaaatgcatccccggctacgtggacgtgtcctccagcgccaatttgccgccgggccgagtgtgtacggttgtgaccacgtgccccaaacagaagactgacctgatgttcctcatcgacggatccggctccattgggtcggccgtgttccgcaacgaggtccgtttcatgggattcatttgatcagctatatttataactgatcggagcaatttgtctgatcattttttacccataattttgtcacaaagtggataaaagaatgaaacgtcgaacataatttatgtgaaaatttattggcattgatcgaataatgactaattaattactactgatcagaaaaactaaacttaggtgccactggtcaaatataatgcgagaatagagcaaataccgagcaaaaataggtccttcgatttgtgcgcgactttgtggaactgttcgatatcggtctggagaacacccgcgttgggctgatccaatactcggaccaaatccggcacgaatttgacctcaaccagtacgtggacaaaccgtcactgctgcaggccatcgcgcaaacacagtacttgaccggattgaccag

SEQ ID NO: 81208 - DNA, 3794 bp, Heterodera glycines
  Genomic contig location: Contig_ID=SeqID_2712; Location=1..3794; Strand=-
  SCN-specific regions: Sequence locations=1-501,524-574,660-669,692 -919,992-1405,1429-2449,2471-2771,2799-3794
  Gene Ontology: Mol. function=transmembrane receptor activity; Cellular component=plasma membrane; Biological process=growth
ttgattatggtcaaaatgccccagaaaaatttgttttatcgaaaaatccgctatttatttttttcatttccgtttaacccctgtgcccaaatcaaatttggaaaaattcataattttcatatataaaatccgttttgcccacgcaaaaatgccataaaaatgtatggctatagcttccctagattagcgctgggttactacgtcatagccttgttcgacctgcacttagctatttagcgcctagcccaactgtcgccccaattttgtgaaattaattgcctctaatgaatgctgcacacttacggggccgctgcgggggggggtgatcgaaatgatcaaaagaaattaatgattgaaaatcgggaacaccaaattcagttatacagtaaatttaaggttctgtagcacaaatatcatttattagtgatgggatttttaggcacaaaaaattgcaaaataggcattaaaacctacgaatagacactaaaataagcaaataagatttttttaatttaaatttttaggtagcaaaaaatataaaactttactttcgttataatttaatttgaacatcaaattattaaatatttaaagtttttttcaaataaggacaatttttaaaacaaaaatttttatcagtaaaaaaaaaatttattttaggaatgaatttttggttggaatttttcaattcttaagggtgtattttctgaaactttcgggtcatttcttaggggtgtatttttcgttatttaatgcatttttaaaggattttataggcaattaggcattgtaaaattgatcctaaagcctcaaattaagtgtgttatttttttatgcttttctcaccgttacatttgcacacaaaaatttaggcatttgcctaaaaatccaatccctagtcattatggtccaaaaggacaaaattaaacaaaatttgattttttttttacaattttttaattcaatcttttgaaaaattgaaaaattttatgggattttcaacaattattcaatttctaaacaaagattgtaattggattgatgaaagcttgtttccataccgatccatgctttgctgcttatcacatcatcaccgtctcaactccactaaggtgagcagtgccgaaatgcgaactgtgcgccggaggcggaatgcaacgaagggccgcagggcccagtgtgtcggtgtttggccggtttcttggatgtttcggcacaacacgggaagggcccgggcaaagtgtgccgattaattcaaaacgaatgcaatgccggaaaacagtcagtttatcccatttaagattttgatcgaagtaactgatcgacccaggaccgtatccaaggggcgcggggagagcatatcccccaccgaaagaaaaaataataatccgcctgtcggcatggcacaattgattaaattatttaattcgaaaattagtccaaatttacgttatttttctattcggttgataattatgtatttgaatttagcgattgttcacgggacgccaattgcattgacaccgctgacgcattcacatgtcgctgcaaagagtaaaatttaagcttttcgagaatttgaggccaataatttgaattgcttatgtttaaaatcgcccaattaacaaatgatcaggttttatccccactattttctgttcagaggctttcgcgacgacagtccaagccgggagaagccgggaagggtgtgcactcgaagtaattaggcgctaattaaacagcggcaagattatggagaaatttagtttcataatttaattcagcggaagtgcccgactcgccggaatgcgacgtgaacgacccgatgagttgtgacaagggaaaacacgaggtgataaacagtgtgcagaaatggcatgaatgataaataatggaaaagtgatgaaatgattagcatgactttaaatgggaaagaatgattgattgatcaacaattactagtggatgatttaaaatgatcaggatggtaaaacccagagtttggacacttagatgaccaaaagcataaaaaaggattaaagtgtattcagcagattataaaaaagattttcaatgatcggatgatttagtaagcgtgacttcagttaggggattttgattgtttggtttgccaaaaatgctttatcaaatcaaggcgtgtttgttcatcagcggctcttatcactgctcatgtcccatgggctacgggcgcctgccggacggacgctgcttggccatcaacgaatgtgaagacgcacgactcaacgagtgttcagaggacgcggaatgcattgatcaggtgatcagcaacggcacacacactgaaaatgctcacccattggggggggggggctaatcggaaaattcaatcattaattgactgatgagcaaattggcaataaatcataggaaatgactcaatgatctgtactagaaccatcaaaatttgattaaaaatgaactaataaaataactgctgatctgttcagatttcggtccatttaaaattgatttggctatgtatataaaattcgatttttcaaattatcaactgctgatcatggattggtcttagcttaggacactaattacttttgatcactttacaactatttttgtccaattaaggccgaagcatacacatgcaagtgcaaaagcggcttcgccgacatctcgccgcagggcaaaccgggcacattgtgccgacaacgcatcaacgaatgtgctcaacctcaggcttttgacgtggactgtgacgcgaatgcggtaagtgttcaaaaattattttgaacatgaaatttgattatcttttgagggtaaaattttggaaatccaattgtttggccaatattatcaatttgttgatttaatctgtcggattttggacttgatcggagtttttaaaaatggcattgataaattagtttctcgaactgatctgtttaatgattcccaagatttgcattgacacggaggagtccttctcgtgccgttgtcggcccggctttgccgacatttccgagcagttcaacaaattgccgggccgtcgctgtgtggaggcggtcaatgagtgtctggaccggaagttgaatgactgttccgataatgcgcagtgcgaggactccaaggaggggtatacgtgtaaatgccgggccggcttcttggatgcttcggaaaatgccggaaaagtgagtaatcgactaagattttttatgagaatgaagccaaaaattagaaatgaaaagcaacaatgtcgagctcgtttttttgagactccgacatttacccattatgaggagccgagaaattggggtcatcccgaaaccgaaacctcgtaagtcgaagattcttagtccggaactcgaggattgacgttttgccatcgagaacagtcagagagtcgaagttcgaacccgaaccaaaattaaatatatacaacccaaaatatgaccattctctcggtttccaaattgactgcaaaagcaagcacaaaatttggcattttgccaaaaaccatcatagactcaaaacttggggttggcattttcagtacccaggccgcgtgtgcatcaaatccgatcgcaatttgtcgggcggcagcgcgtcgtccgccttcgagttcgcgcacgacacgtgcgaccccaaactgaaagcgtcggcgtgcaaaggcggcttacagtgcaccgaccgaatgcaaccgggcactttcgtgtgcgcatgtcccgagggccaattcctgtacacggacggcacctgtcgcctggcgacggcatgcgtcagcgcgaatgcgacaa

SEQ ID NO: 81209 - DNA, 917 bp, Heterodera glycines
  Genomic contig location: Contig_ID=SeqID_16790; Location=982..1898; Strand=-
  SCN-specific regions: Sequence locations=1-179,203-265,287-354,408 -458,485-566,685-768,792-823,845-872,895-917
atggccaaagcattggcggtgcccaaaacggtgttggacatgtggatgaacaaagacttgccgagtttgagggaattggtgcccgcattggttcaattgttgcgcgacaatttcaaacacgagtccatcatgtgccaaattcgtaagtggtaaacttgataatgaaataacgaaattcggttttgaaatttcaaaaaatgtgccgtgaaaatagaacatggaaaagtgccgaaaatggcgggacagtgccggcaggcgacgtcgcgagaaaatttttaaaattttgtgctaaattttaaaactttagcaaccatataaacaaaaatgaatttttttagttcattttagcctaggaatatataaattaattttttaaaattgcattttgaaaatataatttttttttactatttgtcggtattttttttattaggccttttggtggcggcaaaaatgccaaaaaaaaaaaaaaaattttttttttgatggtttacatttaaaacagttattttatcatattgttaggcatgcttttttaaaagtttattacatatttttacacgttgattttttatatttattaataagggtagtagaataaaaaattaattttttttttaaatcgattaatttcaatttatttctactctttttaatttatttaatattattattttttttaaagattacaacgggtgtatcgtcattctcaacaaatgtgatgctcttttgaatattttgatcgcctccttccccaagtgatcggcctttgttttgttttttcaatgaaacgcatttcaaatattttcaccttgccaaacattcaatttgtttttgattttttggatcagtaaattttttgaaaaaaagactcgtctttaatccaacaaaatgaaacccctaaagccatgaataaa

SEQ ID NO: 81210 - DNA, 247 bp, Heterodera glycines
  Genomic contig location: Contig_ID=SeqID_16791; Location=1704..1950; Strand=-
  SCN-specific regions: Sequence locations=1-102,126-247
aggcacccccacaaagtgtccaagccacgaaatgtccaaaagagtaaaaacacacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagc

SEQ ID NO: 81211 - DNA, 1618 bp, Heterodera glycines
  Genomic contig location: Contig_ID=SeqID_16792; Location=1..1618; Strand=-
  SCN-specific regions: Sequence locations=1-192,215-384,406-1383,1405 -1618
  Gene Ontology: Mol. function=alpha,alpha-trehalose-phosphate synthase (UDP-forming) activity; Cellular component=alpha, alpha-trehalose -phosphate synthase complex (UDP-forming); Biological process=protein modification
gcacgcctcgcacaattcgctgtcccccgcttcctccaccgcagcaatggccaacggaggcggcgctggcagtcaacaccaaattcacgagttactcgccgcattggacgccaaggcaatcacaaatggcacagcacaacagcagacaggccaacggccgagcttcaatctgtcagacgacgacgcggaggcgcaccagcaccaacagcagcacaacaataaccacggtgggggcagttaaaatactgactcaaaaaacagtggatttgccattcctcactaaactttatgacggaataaatacgaaaacgactcacattttacatctaacaatccgtgttaattaattgttggttcctccttcgttagatgttcgtcgaggcagtgacaagcgcatgtccatcagtgcggtgtccaccacttcggacgcgcaacattcgaccggcactgacggcacagagctgtgcggtgggctagtgaacacgcagcacttccagcagcgtgtgatcaacgtgtccaacgcgccgccggtggcgctcaaacagtcggagtcgggcgagtgggaaatcaagcaaggctcgggcggactcgtctcgtgcgtggacccggtgatgtcggtgagtgatttgtgtaattggccaaaactgcgctgaaatggcatttattgctcaaattattacccaggtgaacccggaaaacatgtggctggccaaccttggcatgaacatcgacaagttcaaaatcacctccactgaatacctcgagaaaatgggccgagacccgaacattggcgaacggatggacccggcacacatcgcagcgccagcgacaaacactttgggtcttcctctgatgaaacaggtgggcaaatcgggtcggaaactttgaaaaccatggtttttttgtccaggcattggcagacgttctgttccatgtcattgcgaacgacgagcaaaaggaggacgacgaatcggcggtcaaaaagcaaatcagagaggaaatgtcactgctcggcgtgctgaacaactacaaccgtggcaactacaagctgaacccggtgagcggcgaggaagtgcaattggtccacatggaaaggactgggcataataaacggcaatgattgtttagacgatcatacagctctccccaataaaatgtattcatctatgtaatcttttggcctttccaggttatcgtccaggagcaggactacaacgtttactacggggggatcagcaacggacttttgtggcccgcactgcacaatctcccggaatacattctgcccgaatacagtgactcgaaggtgctcaacgaacattggttctcttatgttcgcgtcaattaccaggtgaatgggggaggcactcacaaattagtcattttattttaatttttcagtttgccatcgatgcggtgcgaaattcacgtccccaagacttcatttggatccacgactaccacctgatgttgaccggcatgatcatgcagtcactggagcgcaacttggagatcggcttcttcctgcacatcccattccaagtaattttggaatgccaaagattattaattataggagtcaccggggagaaaaggaattagtaacaaattgtttaag

SEQ ID NO: 81212 - DNA, 701 bp, Heterodera glycines
  Genomic contig location: Contig_ID=SeqID_16793; Location=545..1245; Strand=-
  SCN-specific regions: Sequence locations=1-39,62-146,170-491,513-701
atgcaaagcatttgcagcatttttgagcttaagcttacctttcccctctcttctcttttatggtcatcggtagagctcgaagcgggacgggatcccgagggatccaagttgcattttttgaaaatttcaaaaacagcatgccaaccaaatatttttaataaatttataacaaattcaattaggtatgtaagttcactatgggtacgccccatgtcagacaaaattgctcataacgccaaatagcgcatttggcgtaaatttttgcccgctatttcaaaatttacactgaaaaatgccttttttgtattttttattttgatctgccataactcgcttcattcccaagtaaactgaacaaatttggtatctaaaaaaagattttgaaaaggggaatctttttctaagcgaatgctaagcaatttgacatcccagaaaaaagttgtgatactttcaaatttttatcacgttataactcaagtcctaaactgctgttttcagcaaaaatgctaaaactattaatttctttattgattctaaatgtccaaagtgattttgtacccttataaccaaaattattagaattttcgaatttgatgttttttgtgtgctagagatgtgaaaatagtacgccaaaaggagaggaaaagaaattattaattttgtttgagttaaaattttggatcggagcgtaaaaaaataaa

SEQ ID NO: 81213 - DNA, 477 bp, Heterodera glycines
  Genomic contig location: Contig_ID=SeqID_16795; Location=318..794; Strand=+
  SCN-specific regions: Sequence locations=1-477
atgagagtgcctattaaggtgcccgattactacgattacattcccttccccgtcgacttgggctcaattgccgagcgcctgaagttgggctattacactcatgtaacttatcatatattaaatgggcaatccaagcgaactctgagatattactgtgctcataattcttatcaggagcgaatgtttgtcgccgacattcgccggatgttcgacaattgttacaaatttaactcacccgagagccaatattattaccacggctacaaactgaatgaactttttgatcggctcacccgccaacattttgctcattgcaaattgcaggcgccgctgcccgcggtgaagccggagtatgtgccaaacgccggcggaggagggagaaaatgaaagggatttttgtggcattttgtaaatttgtgacggaatttacatcgatctcttgtattttttgttattcttaagtgcctatttacccca

SEQ ID NO: 81214 - DNA, 960 bp, Heterodera glycines
  Genomic contig location: Contig_ID=SeqID_16796; Location=110..1069; Strand=-
  SCN-specific regions: Sequence locations=1-171,204-338,362-631,654 -799,821-960
  Gene Ontology: Mol. function=transcriptional activator activity; Cellular component=nucleus; Biological process=regulation of transcription, DNA-dependent
tcagaatttcattcgttcgtttcgtgaacaccacgttgacccgacagcgatcactcggcatgattttgtggaagtgaatggggacaattttatgctgtgcatccccaaattgggacacatcgcttggcaacactggacgagtgagccgagggagttggagcaacacttgccgatccattggttttggtttttatgcggcttttacgtggcattgaccaatcaggtgccattctttggctgtgccattctttggctgtgccattctttggctgtgccattctttggctgtgccattctttctttggctatgccattctttgtccattgccattgcttttcagattcacaaatggtctcacacttacttcaatcttcccggatgggttattttacttcaacaatgtcacctcatcctccctcgccaacaccataaactccatcacatttcgcctcacgcgtgtcgctattggtcagtcagaagccattccctcctcttcacattcaaaccttacaaattagcttaagtcgaattgggccgaactctttaaaattttctttgaaacaaaagattaaacattcttacaattaattagtatctttcgatagcccaagcaaaatttcaaaaaatggccaaaataatatgaaaacagaaattttttttttcgcaggttaatagagaaaatttgggctatcgaatgataccaagtgtgtttaatacgattgtttccaagaaagtttaaagcgttaaactgctccgcactaaaacgagccccgcccagcttaagcgttacctctcgcctattatttttattattaattaccattttcagcatcacaactggatggttaaatccggcattggatgccattggattctggcggaaaatggaatttttggtcagtgtaattactggctggaagccaagagacgacgacttgaaatgggctacaaaattggag

SEQ ID NO: 81215 - DNA, 270 bp, Heterodera glycines
  Genomic contig location: Contig_ID=SeqID_16797; Location=102..371; Strand=-
  SCN-specific regions: Sequence locations=1-270
atgggtttttttaaggtgcctgaggaaagtccgaatggaaatgccaacgtttgcatgggcgaggcaaagccccgctgggggccgacccatgccggggccaaacagttggcatcgatgtacggcaaaggcaagcctggcatggggcttaagctgtcatccacccaatctcagggaaacgactccaagaagtcacttgcatttgcgttgcgtcagccctttttctgtcggtcggctgctccctcctttaccactttcggcttgtccccgtcg

SEQ ID NO: 81216 - DNA, 716 bp, Heterodera glycines
  Genomic contig location: Contig_ID=SeqID_16800; Location=180..895; Strand=-
  SCN-specific regions: Sequence locations=1-389,411-716
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggttttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggcttttgaaataaa

SEQ ID NO: 81217 - DNA, 391 bp, Heterodera glycines
  Genomic contig location: Contig_ID=SeqID_16800; Location=567..957; Strand=+
  SCN-specific regions: Sequence locations=1-391
gcttaaaagcattgtacagcataattaaaaccgaaaataattttcgtatatttttcacaatttatttcaaaaaaccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaaccgaaaataattttcgtatatttttcacaatttatttcaaaaagacaaaaaaaa

SEQ ID NO: 81218 - DNA, 229 bp, Heterodera glycines
  Genomic contig location: Contig_ID=SeqID_16802; Location=393..621; Strand=-
  SCN-specific regions: Sequence locations=1-81,108-229
cagataagccgagctgatccacagctttcgaatgtgaaagatgaagacgatcagccggactatgatgagccacaaaatgatgagccagaaaatgaagaaaattcattttgaaatagattgataaattggatctttttggtaagcaaaaatggctttatttaagtgctgggtcgtttcataaatttcgccaaggggtaggaaaacaaaaaatgtaagactataaattaaa

SEQ ID NO: 81219 - DNA, 1057 bp, Heterodera glycines
  Genomic contig location: Contig_ID=SeqID_16803; Location=1941..2997; Strand=+
  SCN-specific regions: Sequence locations=1-150,178-626,658-779,801 -1057
atggcaaaaaggaaaattgtgtgcaagcttaatgcaattaaatcggcacaaaaacgggtgcaaaatcgagaggagcgacaagagaagttggagagggcgagacaagccaaatccgcaaagaaaagtgagtttttcaccaatttttaactcaaaaatatatattttttttaaattttagccgctctacagccgaatcccaatgccgaaacgccacagcaagacgaagcaggaccgtcaacatctgctgcatccgccgaagaagcgatggaaccgccgccaccaactccaggaccagtgccgacgcccgaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacaactggagaagcagctcaaggaccgggacgacaccatcaaatttctgcgcgagcaggtgctcaatcgagaagcgctgatcagtgatctgcgtcggcagctggacgagcacatggtaccaccgatggcaccaccaacgaccagcaaaagtgagtgaaaattttccttttttaatttcataaaatctgatcatttttcaattttagcgccaccaaacagaggaagaccgaagaaaagactggatgaactgcagcgcagcgccaggcgcgacatcgtcgacaaaattgtgggcgtcatcgatcgtaatcgctcgcgttccgcgagccgcgcatctctggaccggatccaccgagaaatccgccacaaattctcgcactacacgccaaagaagggccaaagctgcaggagggaatggaagcggaggatggacttctgctgcttgcccagctcgggacgcagatggcttacaaacggatgaaggcgactctaaggctgatcgacaggcgctttgacacttttccaccactgagaaaggtgcagtttttcattgatttttttgttttaccaactttttttgggtcgtcgaa

SEQ ID NO: 81220 - DNA, 118 bp, Heterodera glycines
  Genomic contig location: Contig_ID=SeqID_16807; Location=1468..1585; Strand=+
  SCN-specific regions: Sequence locations=1-118
atgaaatgggtggaagaaataaataatggtgaataaaatgaatggaagtgaaaggaaaatggtaaattaaataaattcttcagatgtaacggaagtgaaaggaatttaaaaatgttga

SEQ ID NO: 81221 - DNA, 157 bp, Heterodera glycines
  Genomic contig location: Contig_ID=SeqID_16807; Location=820..976; Strand=+
  SCN-specific regions: Sequence locations=1-157
taggctaatagagcctgtgaagagctttcgaatgatatcaagattgtttgattcggtcaataacttcaagaattatattgactcaaatttggctcagacggagttggccagacggagttggcccgttccgccggtagctgcttctgcacgaagataa

SEQ ID NO: 81222 - DNA, 354 bp, Heterodera glycines
  Genomic contig location: Contig_ID=SeqID_2714; Location=1061..1414; Strand=-
  SCN-specific regions: Sequence locations=1-84,106-354
atgagtgttaaagtaaaagaacagatgaaagtgtccggcaataaagcattttttgtgcttttggttcaaatgattggagtcgttttgggtgggtaaaaataaaaatcatttagcatttgatgaattgaaaaacatttttttcattttcttccatttttttaggcgtgctcattgctgccgcgaccggatttttcaatgaataatgttttgctgtgttgtttttttaattcaattttattcactcattttaaatttatgatcaaattttaccattctatgaatttcatttatttattcatttattttcctatttttcaaaaggttatttgtaatcaattatcaaatctcattaaa

SEQ ID NO: 81223 - DNA, 590 bp, Heterodera glycines
  Genomic contig location: Contig_ID=SeqID_2715; Location=5..594; Strand=-
  SCN-specific regions: Sequence locations=1-132,154-214,237-413,442-590
atggacagcgatgtctttaattgtgattgagacttattattttcgtgggaaaattatatgtaaataaaaagcacttattgttagtaaaaaatctgatttttttattcatttcgttgttgtcagaattaactaaaattttcaaggaaaatcgttagcataagctaatctcctgcaaaattgtaaaagagactctttctttttaattattcattgttaaaaattttgaatattaaattcttagattgttagcccttatacatattaaatgctttcctgcaaagtttcaagtcatctgaaaaaatcagcttttcaacttcatgatttttttacatataattcctattcttacttattatttagtataattgggttttgtcaaaacaaaaacataagtacccttagctctatccttatttattcttaatattttaactttacagatttgatatacaaaacgtcatatcgtgccaagagagacgaggaagacaacaacggtgacggcgattgattggttttggaagcgatcgattttttcttttgttaaaatattgaagagtttatgattatgaatttaccgttttcccattaaa

SEQ ID NO: 81224 - DNA, 771 bp, Heterodera glycines
  Genomic contig location: Contig_ID=SeqID_2715; Location=1974..2744; Strand=-
  SCN-specific regions: Sequence locations=1-84,107-166,190-404,426 -542,600-731,753-771
gcaccacaaccaacaacatcaacaaaaacagccggtaatgggttaaaacgacaaaaaaaatttcaaaataggtaaaaaaaacgcaaaaaaaaaaaaaaaaattttacccacatttttcatgctctaaataagaggaaagacaattaatttttgttaaaagacttgagttaaaaattttttaattttacagcgcctgagtggaatgtcgctccgagtgccgccaaaatggacgattgttttgaagatgaagaagaaaagcgaaaatcttcttcatcaacgactggaaatgccgttaaaattttggcaattgctgcaggagcagcttgggccttcgcactggcagtttggcgcatgcctgaggtcagtctaataacatgcttacattgagtaaattaaaaatatgaggggcattaattctggcaaatataatcgaccaattcctttttggacgtccccgtttctggataacaaattccatattttcttaaaatgcattaaagaccaccactaagttgttatttctgtttttttttgcattttggaatatttaaaaataaaacaatttttaaattttaatattttctttgttttttttaattcagtcagtaaaacgacataatttttttttccacgctatcaaaaaatgatagacttttggaccctagtcaaatgtgctgtgattttaaggttgatgacgaaaacgaagaacctgaaccgcctgcacagcgctttgaaaatgttgaagaagaaaagccagcagcagatgaagag

SEQ ID NO: 81225 - DNA, 1464 bp, Heterodera glycines
  Genomic contig location: Contig_ID=SeqID_2716; Location=311..1774; Strand=-
  SCN-specific regions: Sequence locations=1-209,232-264,304-415,443 -630,654-933,956-1040,1064-1221,1243-1464
atgtacgaatttcgcattgttgccgcaaacgatgagggcacaagtgtgccagttattgttctgcaggagacaacggacaattgggtgccaccaattccgttcggccaatatgtcattgcgctgacaagcactggtgagttgtcattgttttttaaaattgcttctcagtgattaatttttgatataaaaaatgtgattctaagcctattttgatcatttttatggcattttgtgcctatttaacactaccaagaatttttttccaaaaaataatcattaaaaaaattttatttacatattatagtacatatttggggatttttgtacatatttttagaattttttatacattttatttacatatttcgcgatttttcttacataaaaatggaatccctattcatgcatatttgtcattttttataatatttaaaatttttttgcatattttgccatttttcattaaatattttccgatttggaaatcccttagcaaaaaaaattagcttatgccaaaaactaaattcaaatttgaatgggtgcgcgagtgggtcaacagcgagctttactgccgaaaaccttgagaattttaaacttgcattgcaaaaacagcatataaaatttatagggataatttttttttttattaatttgcacccctaatttcacgctttctgcatatttggtgcatatttcacgactttatttgcatatttatatgcatattttggccatttttcgtgcatatttttgactgccccgatcattagtctttctatgtattctaaacattttcagtgctcgcactgcttatttccgctctgaagaagtgtttgcgccatcggttctccgacttcatgttcagttttgcacttggttctttgtctggctccgccaccttccatctgctgccaaaagtgtggcatcattttcctaccctttgtggagggaggggtggggtggtaatttaaaaaaatctaaaaatttcctaacgaattttgcctttttggatgtgcttcttaccaacagagggaattcataaatgaaaaaagcttagaaaaaactactgtaaattgtactaattttataaatggagagaataattaattaagtggttaatgctaagtcgggaattggaagtcaagaaaagagatgagcgaggaaggtatgagtcacatcaatcgagtccctgagagaatcatcccgagtggggaaatttcctttaaattatggctctaaattttgaaataatttggctttttatgtacgtaaatggattaatgcatttgccttcctttttaggcattttccatttgcaatcccaattttggtctgtcgcttttcgtcatcgccaccatttacgtgtcctttttttctgccaatgccatcaaaattgcgctcaaaatgcgcaaaaacgacgaagaaacagcaggcaatgagatggacgaacaacaggaggaagct

SEQ ID NO: 81226 - DNA, 668 bp, Heterodera glycines
  Genomic contig location: Contig_ID=SeqID_2716; Location=2215..2882; Strand=-
  SCN-specific regions: Sequence locations=1-162,184-188,220-440,462-668
atgaggtacattttctttcaatatttcttagcaaaattgagcaagaaaagtcaagaatagtggcgaaacgccaaaatattggcaaaaaactaatttagtcgccaacttccaaaatttttttagctaattcaaaagatatttattggtcaaagttgaaaatattcaataatttacagtaaaatagttagtattttatttaataaaattttatcaattaaagtggtcgtaaaatatgcaaatgtctgtgtttacatataaaattaatcgttaagttcgagctttgttaagagtgctaatttgtctggaatgggctcttcattccgtaattcaaatttcgcgccattcaaaatgagcatcatactgtactgctgctgtgcaagtgcagagaaaggcgcataaataccgacaaattccctcacaaaagcacttccccccattcattctgtttctgtttccaccacctgccttcgttcaagtagaaatgcgcgaaaatcttcgtcttatcgccccttttaaatcttcgaatccctattttcgcatttttatatatttcttaccaaaatgcaattaaaaatgcacccataaataccgacctcttgaaagcttttcgaaaatttggaaaaaagtatcaaaatttctttaaaatttttggagaaaaaacaaataaa

SEQ ID NO: 81227 - DNA, 858 bp, Heterodera glycines
  Genomic contig location: Contig_ID=SeqID_2716; Location=3547..4404; Strand=-
  SCN-specific regions: Sequence locations=1-84,106-382,407-858
atgagtgttaaagtaaaagaacagatgaaagtgtccggcaataaagcattttttgtgcttttggttcaaatgattggagtcgttttgggtgggtaaaaataaaaatcatttagcatttgatgaattgaaaaacatttttttcattttcttccatttttttaggcgtgctcattgctgccgcgaccggatttttcaatgaataatgttttgctgtgttgtttttttaattcaattttattcactcattttaaattttgatcaaattttaccattgtatgaatttcatttattatttattcatttattttcctatttttcaaaaggttatttgtaatcaattatcaaatctcattaaaacaagtattttctcaaacctcgcctgttttaactgctgaaccatcttccacagaatcttaaaaaattgatattctttattttaagaaaatttatgcgtatttaactaaaatagtgagtaaaaatgccaaaataatgacaaaatagtggcaaaaagtgtccaaaaattgatcaaaaataattttcattccataattgaagttgggtgtttttttcgtttttactgcatttttattgagaaattttttccaaaaaaaaaaattgaaatagtgtaaaaatagtgacaaaatgtcaaagtgaattttcactattttagtgaagaagcgccaaaataatgatttctagtgacgaaaaatgtcatcagaatcgaaaatttttaatgcagaaatgcgttttttgaactcctttctttaatcaattgagcaaaaaaatatattttttcactaaaatcacggccccagtaataacttttttatttgaagatatgtagaaaattctaataaa

SEQ ID NO: 81228 - DNA, 1943 bp, Heterodera glycines
  Genomic contig location: Contig_ID=SeqID_2716; Location=4459..6401; Strand=-
  SCN-specific regions: Sequence locations=1-257,279-481,518-527,549 -564,586-612,634-643,710-1152,1174-1272,1294-1343,1365-1422,1444 -1755,1777-1943
atgaatagagctttgagcataaaagtgagttttgaaaatattgggttttcgaatttttgttccaattcagatccggtgattcgaaataagccgaaataaatcacatattcgtgatcagcgaccccaaaaacctttagaagcatgttttcaatgctttgtaaaaatttctgccaaaagggggagggcatcatcggtagtattgccaaaattgtatgtgttttcccctgaatacaaccgcacccaaaaaaataaaaaattgtattttaattcagtcatttagcaattattctaacggaaatgggccattggaattatgaaaaataattgatttaattttatgcgatttatgttttattatgactaatttttttgcgcatttaaaaatggtgcccacaatttagcacggcgcgcccaccatccctttgccagccgaaaataatttgagcataatccgtcgaatttggaacagtaagtttttgagaaataatttatttcattataaaataaaataaattttgcaaactcaaaaagatgattttcttttgtttaacacatacacatacaatttttgagaaatctaataatttcaatttcctttcatttttttacaactattttggaaaagaacaaaaataacaatggcaaaaattaaaattttaaaaatattaataatttttcaaataaaagaattatcatttttatttttattccacaacttttgacagatgttttgacgtggcttggtggtttggtcagcaacacgcaacacccgcagcagcaggtgttacgcaacagaaaagaaaatgccattttttttgttaattatttattgcttgtttagcgtcctgagtttgatgagcgcgaccgtaccggacaaactgagcacaattcgacgatcaaaacgactgtaaaaacacaaacatataaatttttggccacttcattttgatttctaatattatctttgttcaatttcagcttttgaccattttccacaacgtgtttgatggattcctgatcggctcatcggcgagggcaccgctttcctgcctgagcatttcggtggcgttgctgtgcaagcgatccaaaaaatgtgagtagcgaaaatactaatttatagtgccaataaacataaaataatgctcaaaaatacatttccaaaaacgctaaaaattgtaagcaaaaaaatacccaattaaagttaagaattttgataaattgccaaaaaaatgatgaaaaaaactgttaattgcaacattttattccatgtgatttttgaaaaatgataaaaaataatttgatcaccttcttatgcaaggtttttctgaatgaaaaattcaatgtttttttaaaatattaaataacggggcaaagaaggaatgtgatgagtaattcataaataacgattaatttgtcactcttttccttatagtgcgccctggaaagtcaatgaagatgaacttggtgcttcatttggttagtgccctgacgtgtgccattgggttttcaagcgggctgctcattgacctgctgctttatgacacggtggtcaagtacggctatgcgttgggaagcggaatgtgagttctgaaataataattttgaacaattccaccccaaatgctggcacccataaaaaacgtttttttactatttttactttcccactttctttttcaggttcatttacatctccgcggtatgtttgtttttttaaattatttcttaagactttgggctgctgggtgaaattcttaaaattaattttaaaactaaaagttcaccattccgcaatttaagcgggaattttattgtgctatttcttgaagtttaaatgattttttgcttatatagacaaaaaaaagcgcaaattccaagggatttttgaggccggaattcatgattataaaaatgttttagtctcttgttcattaaacaataaa

SEQ ID NO: 81229 - DNA, 82 bp, Heterodera glycines
  Genomic contig location: Contig_ID=SeqID_16810; Location=43..124; Strand=+
  SCN-specific regions: Sequence locations=1-82
atggccgtgctcaaattctctatccctgtcattttgttggatgaaattctcaaatttgtcgcccgacggatggaagcacatg

SEQ ID NO: 81230 - DNA, 245 bp, Heterodera glycines
  misc_feature (190)..(190): n is a, c, g, or t
  Genomic contig location: Contig_ID=SeqID_16815; Location=1170..1414; Strand=+
  SCN-specific regions: Sequence locations=1-89,111-159,181-245
atgtcatttgagtacaatctcgaaatgtttttggaaaaaagtgaaaacgaattaagtttggaagaacactggttggggatggttttacgaaatgaggaggaaattaattatggaataattaaagaggaagaaaacggggaaaatgcgcagagcaaaggcaaaaagcaaagcacaaaaattttttatggancaacggacactgaaaatgttcttcggatagattttgacggaaaaatagcacaaat

SEQ ID NO: 81231 - DNA, 430 bp, Heterodera glycines
  Genomic contig location: Contig_ID=SeqID_16817; Location=359..788; Strand=-
  SCN-specific regions: Sequence locations=1-121,208-295,318-370,392-430
atgctattgcttgtgaagacgcataaaaaaattatgttgcctaaaagaaaaaatttgaaagcgctggcagagaaagcattttccgattcacattttattaaccgggacaattgcataaaggtaaaataatttattaaaatggtaataatcataattattttttaatgtattttagtgtaaattcctttttatatttaattatttattggtattatttagagactggtattttggaaaaagcctgaacctgaacctggatttccaaattgacctggacctagatttcctggacaaaaaatccaggcctggatccaggccgatctctaatattgttgtttttactcagcgaaatttaaaaggactcattaaaatcacattttattttatattttgtcacaaaaagcaacaataaatcgcaaaatggaataaa

SEQ ID NO: 81232 - DNA, 149 bp, Heterodera glycines
  Genomic contig location: Contig_ID=SeqID_16818; Location=1588..1736; Strand=+
  SCN-specific regions: Sequence locations=1-149
atgacgccggaggagcagcagcaattaatggggtcacgtcggccatttcttgaaccaatcacaaaaagcacaaagcaacaaaacggaaagccacgccttaataaagcggacattccgttgaattttgatgcccgacaacacttttacaa
